(12) United States Patent
Troukhan et al.

(10) Patent No.: US 8,362,325 B2
(45) Date of Patent: Jan. 29, 2013

(54) NUCLEOTIDE SEQUENCES AND CORRESPONDING POLYPEPTIDES CONFERRING MODULATED PLANT CHARACTERISTICS

(75) Inventors: Maxim Troukhan, Agoura Hills, CA (US); Peter Mascia, Thousand Oaks, CA (US)

(73) Assignee: Ceres, Inc., Thousand Oaks, CA (US)

( * ) Notice: Subject to any disclaimer, the term of this patent is extended or adjusted under 35 U.S.C. 154(b) by 861 days.

(21) Appl. No.: 12/286,964

(22) Filed: Oct. 3, 2008

(65) Prior Publication Data
US 2009/0094717 A1   Apr. 9, 2009

Related U.S. Application Data

(60) Provisional application No. 60/997,507, filed on Oct. 3, 2007.

(51) Int. Cl.
*A01H 1/00* (2006.01)
*C07H 21/04* (2006.01)
*C07K 14/415* (2006.01)
*C12N 15/00* (2006.01)

(52) U.S. Cl. ......... 800/295; 435/6.1; 435/468; 435/419; 435/320.1; 435/183; 530/370; 536/23.1; 536/23.6; 800/278

(58) Field of Classification Search ............. 435/6, 69.1, 435/468, 419, 320.1, 6.1; 530/370; 536/23.6; 800/278, 295
See application file for complete search history.

(56) References Cited

U.S. PATENT DOCUMENTS

| | | | |
|---|---|---|---|
| 5,939,533 A | 8/1999 | Lilja et al. | |
| 6,198,021 B1 | 3/2001 | Lange et al. | |
| 6,455,675 B1 | 9/2002 | Lange et al. | |
| 7,985,888 B2 | 7/2011 | Phillips et al. | |
| 2004/0214272 A1* | 10/2004 | La Rosa et al. | 435/69.1 |

OTHER PUBLICATIONS

Oikawa T. et al., "A role of *OsGA20ox1*, encoding an isoform of gibberellin 20-oxidase, for regulation of plant stature in rice", Plant Molecular Biology, vol. 55, pp. 687-700, 2004.

* cited by examiner

*Primary Examiner* — Phuong T Bui
(74) *Attorney, Agent, or Firm* — Birch, Stewart, Kolasch & Birch, LLP

(57) ABSTRACT

The present invention relates to isolated nucleic acid molecules and their corresponding encoded polypeptides able confer the trait of modulated plant size, vegetative growth, organ number, plant architecture, sterility or seedling lethality in plants. The present invention further relates to the use of these nucleic acid molecules and polypeptides in making transgenic plants, plant cells, plant materials or seeds of a plant having such modulated growth or phenotype characteristics that are altered with respect to wild type plants grown under similar conditions.

8 Claims, No Drawings

NUCLEOTIDE SEQUENCES AND CORRESPONDING POLYPEPTIDES CONFERRING MODULATED PLANT CHARACTERISTICS

RELATED APPLICATIONS

This Non-Provisional application claims priority under 35 U.S.C. §119(e) on U.S. Provisional Application No. 60/997,507 filed on Oct. 3, 2007, the entire contents of which are hereby incorporated by reference.

FIELD OF THE INVENTION

The present invention relates to isolated nucleic acid molecules and their corresponding encoded polypeptides able to modulate plant characteristics. The present invention further relates to using the nucleic acid molecules and polypeptides to make transgenic plants, plant cells, plant materials or seeds of a plant having modulated phenotypic and growth characteristics as compared to wild-type plants grown under similar conditions.

BACKGROUND OF THE INVENTION

*Sorghum* is the fifth largest crop worldwide. It is a genus comprised of numerous species of grasses, some of which are raised for the production of biofuels, foods, grains, alcoholic beverages and other useful products. The plants are cultivated in warmer climates worldwide, and several species are native to tropical and subtropical regions of all continents. Several species are drought tolerant and heat tolerant, and are especially important in arid regions.

440,000 square kilometres were devoted worldwide to *Sorghum* production in 2004, but little research has been done to improve *Sorghum* cultivars because the vast majority of *Sorghum* production is done by subsistence farmers. The crop is therefore mostly limited by insects, disease and weeds, rather than by the plant's inherent ability.

*Sorghum*'s growth habit is similar to that of maize, but with more side shoots and a more extensively branched roof system. The root system is fibrous, and can extend to a depth of up to 1.2 m. The plant finds 75% of its water in the top meter of soil, and because of this, in dry areas, the plant's production can be severely affected by the water holding capacity of the soil.

*Sorghum* is well adapted to growth in hot, arid and semi-arid areas. The many subspecies are divided into four groups—grain *sorghums* (such as milo), grass *sorghums* (for pasture and hay), sweet *sorghums* (formerly called "Guinea corn", used to produce *sorghum* syrups), and broom corn (for brooms and brushes). The name "sweet *sorghum*" is used to identify varieties of *S. bicolor* that are sweet and juicy.

*Sorghum bicolor* is the primary *Sorghum* species cultivated for grain for human consumption and for animal feed. The species originated in northern Africa and can grow in arid soils and withstand prolonged droughts. *Sorghum bicolor* is usually an annual, but some cultivars are perennial. It grows in clumps which may reach over 4 meters high. The grain is small, reaching about 3 to 4 mm in diameter. *Sorghum* is source of ethanol biofuel, and in some environments may be better than maize or sugarcane because it can grow under more harsh conditions.

*Sorghum* is one of the most efficient grains for producing ethanol with a typical starch content and ethanol yield as compared to other grains of:

|  | Starch (% dry basis) | Ethanol (liters per ton) |
|---|---|---|
| *Sorghum* | 74 | 400 |
| Corn | 70 | 385 |
| Wheat | 65 | 350 |
| Barley | 60 | 321 |

(See P. Wylie, P. Searching For the Facts on Ethanol. 2005).

Recently, the US Congress passed a Renewable Fuels Standard as part of the Energy Policy Act of 2005, with the goal of producing 30 billion liters (8 billion gallons) of renewable fuel (ethanol) annually by 2012. This bill should noticeably increase the demand for ethanol producing crops for at least the next decade. *Sorghum* growers are predicting that this will stimulate demand for *Sorghum* production.

Despite the many advantages that *Sorghum* has as an energy crop, in order for this grass to fulfill its promise, new varieties of *Sorghum* are needed that will have increased hardiness and yield, reduce the need for nitrogen and other chemical fertilizers, and allow propagation under widely variant growing conditions. For instance, *Sorghum* is a very high nitrogen feeding crop. An average hectare producing grain requires 110 kg of nitrogen. Compacted soil or shallow topsoil can also limit the plants ability to deal with drought by limiting its root system. Moreover, some species of *Sorghum* can contain toxic levels of cyanide and nitrates lethal to grazing animals in the early stages of the plant's growth as well as under stress conditions.

Plants specifically improved for energy usage can be obtained using molecular technologies. Manipulation of crop performance has been accomplished conventionally for centuries through plant breeding. The breeding process is, however, both time-consuming and labor-intensive. Furthermore, appropriate breeding programs must be specially designed for each relevant plant species.

On the other hand, molecular genetics approaches that introduce and express recombinant nucleic acid molecules allow production of plant species tailored to grow more efficiently and produce more product in unique geographic and/or climatic environments. To this end, in some aspects the present invention is directed to advantageously manipulating plant characteristics in traits such as architecture, biomass, development, composition, conversion efficiency, energy output, confinement, nitrogen use, nutrient uptake, phosphate use, photosynthetic capacity, shade avoidance, cold tolerance, drought tolerance, water use efficiency, stress tolerance, vigor, flowering time and yield to maximize the benefits of energy crops and other economically important crops depending on the benefit sought and the particular environment in which the crop must grow. These molecules may be from the plant itself, and simply expressed at a higher or lower level, or the molecules may be from different plant species.

SUMMARY OF THE INVENTION

The present invention, therefore, relates to isolated nucleic acid molecules and polypeptides and their use in making transgenic plants, plant cells, plant materials or seeds of plants having modulated plant characteristics, with respect to wild-type plants grown under similar or identical conditions, in traits such as architecture, biomass, development, composition, conversion efficiency, energy output, confinement, nitrogen use, nutrient uptake, phosphate use, photosynthetic capacity, shade avoidance, cold tolerance, drought tolerance, water use efficiency, stress tolerance, vigor, flowering time and yield. (sometimes hereinafter collectively referred to as "modulated growth and phenotype characteristics").

Unless otherwise defined, all technical and scientific terms used herein have the same meaning as commonly understood by one of ordinary skill in the art to which this invention belongs.

DETAILED DESCRIPTION OF THE INVENTION

1. The Invention

The invention of the present application may be described by, but not necessarily limited to, the following exemplary embodiments.

The present invention discloses novel isolated nucleic acid molecules, nucleic acid molecules that interfere with these nucleic acid molecules, nucleic acid molecules that hybridize to these nucleic acid molecules, and isolated nucleic acid molecules that encode the same protein due to the degeneracy of the DNA code. Additional embodiments of the present application further include the polypeptides encoded by the isolated nucleic acid molecules of the present invention.

More particularly, the nucleic acid molecules of the present invention comprise: (a) a nucleotide sequence encoding an amino acid sequence that is at least 85% identical to any one of the polypeptides in the sequence listing, (b) a nucleotide sequence encoding an amino acid sequence that is at least 85% identical to any one of the polypeptides from *Sorghum* in the sequence listing, (c) a nucleotide sequence that is complementary to any one of the nucleotide sequences according to (a) and (b), (d) a nucleotide sequence according to any one of the nucleotides in the sequence listing (e) a nucleotide sequence able to interfere with any one of the nucleotide sequences according to (a) and (b), (f) a nucleotide sequence able to form a hybridized nucleic acid duplex with the nucleic acid according to any one of paragraphs (a)-(d) at a temperature from about 40° C. to about 48° C. below a melting temperature of the hybridized nucleic acid duplex, (g) a nucleotide sequence encoding any one of the polypeptide sequences from *Sorghum* in the sequence listing, (h) a nucleotide sequence encoding any one of the polypeptide sequences given in the sequence listing.

The present invention further embodies a vector comprising a first nucleic acid having a nucleotide sequence encoding a plant transcription and/or translation signal, and a second nucleic acid having a nucleotide sequence according to the isolated nucleic acid molecules of the present invention. More particularly, the first and second nucleic acids may be operably linked. Even more particularly, the second nucleic acid may be endogenous to a first organism, and any other nucleic acid in the vector may be endogenous to a second organism. Most particularly, the first and second organisms may be different species.

In a further embodiment of the present invention, a host cell may comprise an isolated nucleic acid molecule according to the present invention. More particularly, the isolated nucleic acid molecule of the present invention found in the host cell of the present invention may be endogenous to a first organism and may be flanked by nucleotide sequences endogenous to a second organism. Further, the first and second organisms may be different species. Even more particularly, the host cell of the present invention may comprise a vector according to the present invention, which itself comprises nucleic acid molecules according to those of the present invention.

In another embodiment of the present invention, the isolated polypeptides of the present invention may additionally comprise amino acid sequences that are at least 85% identical to any one of the polypeptides in the sequence listing.

Other embodiments of the present invention include methods of introducing an isolated nucleic acid of the present invention into a host cell. More particularly, an isolated nucleic acid molecule of the present invention may be contacted to a host cell under conditions allowing transport of the isolated nucleic acid into the host cell. Even more particularly, a vector as described in a previous embodiment of the present invention, may be introduced into a host cell by the same method.

Methods of detection are also available as embodiments of the present invention. Particularly, methods for detecting a nucleic acid molecule according to the present invention in a sample. More particularly, the isolated nucleic acid molecule according to the present invention may be contacted with a sample under conditions that permit a comparison of the nucleotide sequence of the isolated nucleic acid molecule with a nucleotide sequence of nucleic acid in the sample. The results of such an analysis may then be considered to determine whether the isolated nucleic acid molecule of the present invention is detectable and therefore present within the sample.

A further embodiment of the present invention comprises a plant, plant cell, plant material or seeds of plants comprising an isolated nucleic acid molecule and/or vector of the present invention. More particularly, the isolated nucleic acid molecule of the present invention may be exogenous to the plant, plant cell, plant material or seed of a plant.

A further embodiment of the present invention includes a plant regenerated from a plant cell or seed according to the present invention. More particularly, the plant, or plants derived from the plant, plant cell, plant material or seeds of a plant of the present invention preferably has increased size (in whole or in part), increased vegetative growth, increased organ number and/or increased biomass (sometimes hereinafter collectively referred to as increased biomass), lethality, sterility, improved stress tolerance, or compositional characteristics as compared to a wild-type plant cultivated under identical conditions. Furthermore, the transgenic plant may comprise a first isolated nucleic acid molecule of the present invention, which encodes a protein involved in modulating growth and phenotype characteristics, and a second isolated nucleic acid molecule which encodes a promoter capable of driving expression in plants, wherein the growth and phenotype modulating component and the promoter are operably linked. More preferably, the first isolated nucleic acid may be mis-expressed in the transgenic plant of the present invention, and the transgenic plant exhibits modulated characteristics as compared to a progenitor plant devoid of the gene, when the transgenic plant and the progenitor plant are cultivated under identical environmental conditions. In another embodiment of the present invention the modulated growth and phenotype characteristics may be due to the inactivation of a particular sequence, using for example an interfering RNA.

A further embodiment consists of a plant, plant cell, plant material or seed of a plant according to the present invention which comprises an isolated nucleic acid molecule of the present invention, wherein the plant, or plants derived from the plant, plant cell, plant material or seed of a plant, has the modulated growth and phenotype characteristics as compared to a wild-type plant cultivated under identical conditions.

Another embodiment of the present invention includes methods of modulating growth and phenotype characteristics in plants. More particularly, these methods comprise transforming a plant with an isolated nucleic acid molecule according to the present invention.

In yet another embodiment, lethality genes of the invention can be used to control transmission and expression of transgenic traits, thereby facilitating the cultivation of transgenic plants without the undesired transmission of transgenic traits to other plants. Such lethality genes can also be utilized for selective lethality, by combining the lethal gene with appropriate promoter elements for selective expression, to thereby cause lethality of only certain cells or only under certain conditions.

In another aspect, methods of identifying a trait associated polymorphism are provided. The methods include providing a population of *Sorghum* plants, and determining whether one or more polymorphisms in the population are present within a nucleic acid corresponding to a *Sorghum* polynucleotide provided in the Sequence Listing. The correlation between variation in the trait in a tissue in plants of the population and the presence of the one or more polymorphisms in plants of the population is measured, thereby permitting identification of the trait associated polymorphism. The trait may be selected from a feature noted in the Sequence Listing for a polypeptide encoded by the corresponding *Sorghum* polynucleotide.

2. Definitions

The following terms are utilized throughout this application:

Biomass: As used herein, "biomass" refers to useful biological material including a product of interest, which material is to be collected and is intended for further processing to isolate or concentrate the product of interest. "Biomass" may comprise the fruit, or parts of it, or seeds, leaves, or stems or roots where these are the parts of the plant that are of particular interest for the industrial purpose. "Biomass", as it refers to plant material, includes any structure or structures of a plant that contain or represent the product of interest.

Transformation: Examples of means by which this can be accomplished are described below and include *Agrobacterium*-mediated transformation (of dicots (9-10), of monocots (11-13), and biolistic methods (14)), electroporation, in planta techniques, and the like. Such a plant containing the exogenous nucleic acid is referred to here as a $T_0$ for the primary transgenic plant and $T_1$ for the first generation.

Functionally Comparable Proteins or Functional Homologs: This phrase describes a set of proteins that perform similar functions within an organism. By definition, perturbation of an individual protein within that set (through misexpression or mutation, for example) is expected to confer a similar phenotype as compared to perturbation of any other individual protein. Such proteins typically share sequence similarity resulting in similar biochemical activity. Within this definition, homologs, orthologs and paralogs are considered to be functionally comparable.

Functionally comparable proteins will give rise to the same characteristic to a similar, but not necessarily the same, degree. Typically, comparable proteins give the same characteristics where the quantitative measurement due to one of the comparables is at least 20% of the other; more typically, between 30 to 40%; even more typically, between 50-60%; even more typically between 70 to 80%; even more typically between 90 to 100% of the other.

Heterologous sequences: "Heterologous sequences" are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence, are considered heterologous to said coding sequence. Elements operatively linked in nature and contiguous to each other are not heterologous to each other. On the other hand, these same elements remain operatively linked but become heterologous if another filler sequence is placed between them. Thus, the promoter and coding sequences of a corn gene expressing an amino acid transporter are not heterologous to each other, but the promoter and coding sequence of a corn gene operatively linked in a novel manner are heterologous.

Misexpression: The term "misexpression" refers to an increase or a decrease in the transcription of a coding region into a complementary RNA sequence as compared to the wild-type. This term also encompasses expression and/or translation of a gene or coding region or inhibition of such transcription and/or translation for a different time period as compared to the wild-type and/or from a non-natural location within the plant genome, including a gene coding region from a different plant species or from a non-plant organism.

Percentage of sequence identity: As used herein, the term "percent sequence identity" refers to the degree of identity between any given query sequence and a subject sequence. A subject sequence typically has a length that is from about 80 percent to 250 percent of the length of the query sequence, e.g., 82, 85, 87, 89, 90, 93, 95, 97, 99, 100, 105, 110, 115, or 120, 130, 140, 150, 160, 170, 180, 190, 200, 210, 220, 230, 240, or 250 percent of the length of the query sequence. A query nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment). Chenna et al. (2003) *Nucleic Acids Res.* 31(13): 3497-500.

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For an alignment of multiple nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher website and at the European Bioinformatics Institute website on the World Wide Web.

To determine a percent identity for polypeptide or nucleic acid sequences between a query and a subject sequence, the sequences are aligned using Clustal W and the number of identical matches in the alignment is divided by the query length, and the result is multiplied by 100. The output is the percent identity of the subject sequence with respect to the query sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

Regulatory Regions: The term "regulatory region" refers to nucleotide sequences that, when operably linked to a sequence, influence transcription initiation or translation initiation or transcription termination of said sequence and the rate of said processes, and/or stability and/or mobility of a transcription or translation product. As used herein, the term "operably linked" refers to positioning of a regulatory region and said sequence to enable said influence. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, and introns. Regulatory regions can be classified in two categories, promoters and other regulatory regions.

Stringency: "Stringency," as used herein is a function of nucleic acid molecule probe length, nucleic acid molecule probe composition (G+C content), salt concentration, organic solvent concentration and temperature of hybridization and/or wash conditions. Stringency is typically measured by the parameter $T_m$, which is the temperature at which 50% of the complementary nucleic acid molecules in the hybridization assay are hybridized, in terms of a temperature differential from $T_m$. High stringency conditions are those providing a condition of $T_m-5°$ C. to $T_m-10°$ C. Medium or moderate stringency conditions are those providing $T_m-20°$ C. to $T_m-29°$ C. Low stringency conditions are those providing a condition of $T_m-40°$ C. to $T_m-48°$ C. The relationship between hybridization conditions and $T_m$ (in ° C.) is expressed in the mathematical equation:

$$T_m=81.5-16.6(\log_{10}[Na^+])+0.41(\% \, G+C)-(600/N) \quad (I)$$

where N is the number of nucleotides of the nucleic acid molecule probe. This equation works well for probes 14 to 70 nucleotides in length that are identical to the target sequence. The equation below, for $T_m$ of DNA-DNA hybrids, is useful for probes having lengths in the range of 50 to greater than 500 nucleotides, and for conditions that include an organic solvent (formamide):

$$T_m=81.5+16.6 \log \{[Na^+]/(1+0.7[Na^+])\}+0.41(\% \, G+C)-500/L \, 0.63(\% \, \text{formamide}) \quad (II)$$

where L represents the number of nucleotides in the probe in the hybrid (Bonner et al. (1973) *J. Mol. Biol.* 81:123). The $T_m$ of Equation II is affected by the nature of the hybrid: for DNA-RNA hybrids, $T_m$ is 10-15° C. higher than calculated; for RNA-RNA hybrids, $T_m$ is 20-25° C. higher. Because the $T_m$ decreases about 1° C. for each 1% decrease in homology when a long probe is used (Frischauf et al. (1983) *J. Mol Biol*, 170: 827-842), stringency conditions can be adjusted to favor detection of identical genes or related family members.

Equation II is derived assuming the reaction is at equilibrium. Therefore, hybridizations according to the present invention are most preferably performed under conditions of probe excess and allowing sufficient time to achieve equilibrium. The time required to reach equilibrium can be shortened by using a hybridization buffer that includes a hybridization accelerator such as dextran sulfate or another high volume polymer.

Stringency can be controlled during the hybridization reaction, or after hybridization has occurred, by altering the salt and temperature conditions of the wash solutions. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

$T_0$: The term "$T_0$" refers to the whole plant, explant or callous tissue, inoculated with the transformation medium.

$T_1$: The term $T_1$ refers to either the progeny of the $T_0$ plant, in the case of whole-plant transformation, or the regenerated seedling in the case of explant or callous tissue transformation.

$T_2$: The term $T_2$ refers to the progeny of the $T_1$ plant. $T_2$ progeny are the result of self-fertilization or cross-pollination of a $T_1$ plant.

$T_3$: The term $T_3$ refers to second generation progeny of the plant that is the direct result of a transformation experiment. $T_3$ progeny are the result of self-fertilization or cross-pollination of a $T_2$ plant.

3. Important Characteristics of the Polynuceotides and Polypeptides of the Invention Many of the nucleic acid molecules and polypeptides of the present invention are of interest because when the nucleic acid molecules are mis-expressed (i.e., when expressed at a non-natural location or in an increased or decreased amount relative to wild-type) they produce plants that exhibit modulated growth and phenotype characteristics as compared to wild-type plants. This trait can be used to exploit or maximize plant products. For example, the nucleic acid molecules and polypeptides of the present invention are used to increase the expression of genes that cause the plant to have modulated growth and phenotype characteristics.

Because some of the disclosed sequences and methods increase vegetative growth, the disclosed methods can be used to enhance biomass production. For example, plants that grow vegetatively have an increase biomass production, compared to a plant of the same species that is not genetically modified for substantial vegetative growth. Examples of increases in biomass production include increases of at least 5%, at least 10%, at least 20%, or even at least 50%, when compared to an amount of biomass production by a plant of the same species not genetically modified.

The life cycle of flowering plants in general can be divided into three growth phases: vegetative, inflorescence, and floral (late inflorescence phase). In the vegetative phase, the shoot apical meristem (SAM) generates leaves that later will ensure the resources necessary to produce fertile offspring. Upon receiving the appropriate environmental and developmental signals the plant switches to floral, or reproductive, growth and the SAM enters the inflorescence phase (I) and gives rise to an inflorescence with flower primordia. During this phase the fate of the SAM and the secondary shoots that arise in the axils of the leaves is determined by a set of meristem identity genes, some of which prevent and some of which promote the development of floral meristems. Once established, the plant enters the late inflorescence phase (12) where the floral organs are produced. If the appropriate environmental and developmental signals for floral, or reproductive, growth are disrupted, the plant will not be able to enter reproductive growth, therefore maintaining vegetative growth and increasing overall biomass.

As more and more transgenic plants are developed and introduced into the environment, it can be important to control the undesired spread of the transgenic trait(s) from transgenic plants to other traditional and transgenic cultivars, plant species and breeding lines, thereby preventing cross-contamination. Such genetic confinement systems (also called biocontainment applications) can be designed using a number of different technical strategies. The use of a conditionally lethal gene, i.e. one which results in plant cell death under certain conditions, has been suggested as a means to selectively kill plant cells containing a recombinant DNA (see e.g., WO 94/03619 and US patent publication 20050044596A1). The use of genes to control transmission and expression of transgenic traits is also described in (see US patent publication 20050257293A1), which is hereby incorporated by reference. Some of the nucleotides of the invention are lethal genes, and can therefore be used as conditionally lethal genes, namely genes to be expressed in response to specific conditions, or in specific plant cells. For example, a gene that encodes a lethal trait can be placed under that control of a tissue specific promoter, or under the control of a promoter that is induced in response to specific conditions, for example, a specific chemical trigger, or specific environmental conditions.

Male or female sterile genes can also be used to control the spread of certain germplasm, such as by selective destruction of tissue, such as of the tapetum by fusing such a gene to a tapetum-specific promoter such as, TA29. Further examples of such promoters are described below.

The sequences of the invention can be used to advantageously manipulate plant characteristics in traits such as architecture, biomass, development, composition, conversion efficiency of biofuel processing steps, energy output, confinement, nitrogen use, nutrient uptake, phosphate use, photosynthetic capacity, shade avoidance, cold tolerance, drought tolerance, water use efficiency, stress tolerance, vigor, flowering time and yield to maximize the benefits of energy crops and other economically important crops depending on the benefit sought and the particular environment in which the crop must grow. These molecules may be from the plant itself, and simply expressed at a higher or lower level, or the molecules may be from different plant species The sequences of the invention can be applied to substrates for use in array applications such as, but not limited to, assays of global gene expression, under varying conditions of development, and growth conditions. The arrays are also used in diagnostic or forensic methods.

The polynucleotides of the invention are also used to create various types of genetic and physical maps of the genome of *Sorghum* plants. Some are absolutely associated with particular phenotypic traits, allowing construction of gross genetic maps. Creation of such maps is based on differences or variants, generally referred to as polymorphisms, between different parents used in crosses. Common methods of detecting polymorphisms that can be used are restriction fragment length polymorphisms (RFLPs, single nucleotide polymorphisms (SNPs) or simple sequence repeats [(SSRs), also called microsatellites].

The sequence information disclosed herein can be useful in breeding of *Sorghum* plants. Based on the information in the Sequence Listing, one can search for and identify polymorphisms linked to genetic loci for such polypeptides. As those of skill in the art appreciate, polymorphisms can be identified based on characterization of libraries, such as genomic or expression libraries, and/or characterization of nucleic acids extracted from individual plants, and possibly amplified and/or otherwise processed. For example, the nucleotide sequences provided in the sequence listing can serve for design of primers for amplification of nucleic acids and polymorphism characterization. As such, polymorphisms may be found in coding regions or untranslated regions of polynucleotides presented in the Sequence Listing, or they may be found within the locus for a disclosed sequence. Polymorphisms that can be identified include simple sequence repeats (SSRs), rapid amplification of polymorphic DNA (RAPDs), amplified fragment length polymorphisms (AFLPs) and restriction fragment length polymorphisms (RFLPs), as described below. If a polymorphism is identified, its presence and frequency in populations is analyzed to determine if it is statistically significantly correlated to a trait, such as the trait noted in the Sequence Listing. Those polymorphisms that are correlated with a trait can be incorporated into a marker assisted breeding program to facilitate the development of lines that have a desired alteration the respective trait. Typically, a polymorphism identified in such a manner is used with polymorphisms at other loci that are correlated with the same trait.

The use of RFLPs and of recombinant inbred lines for such genetic mapping is described for *Arabidopsis* by Alonso-Blanco et al. (*Methods in Molecular Biology*, vol. 82, "*Arabidopsis Protocols*", pp. 137-146, J. M. Martinez-Zapater and J. Salinas, eds., c. 1998 by Humana Press, Totowa, N.J.) and for corn by Burr ("Mapping Genes with Recombinant Inbreds", pp. 249-254. In Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; Gardiner, J. et al., (1993) *Genetics* 134: 917). This procedure, however, is not limited to plants and is used for other organisms (such as yeast) or for individual cells.

The polynucleotides of the present invention are also used for simple sequence repeat (SSR) mapping. Rice SSR mapping is described by Morgante et al. (*The Plant Journal* (1993) 3: 165), Panaud et al. (*Genome* (1995) 38: 1170); Senior et al. (*Crop Science* (1996) 36: 1676), Taramino et al. (*Genome* (1996) 39: 277) and Ahn et al. (*Molecular and General Genetics* (1993) 241: 483-90). SSR mapping is achieved using various methods. In one instance, polymorphisms are identified when sequence specific probes contained within a polynucleotide flanking an SSR are made and used in polymerase chain reaction (PCR) assays with template DNA from two or more individuals of interest. Here, a change in the number of tandem repeats between the SSR-flanking sequences produces differently sized fragments (U.S. Pat. No. 5,766,847). Alternatively, polymorphisms are identified by using the PCR fragment produced from the SSR-flanking sequence specific primer reaction as a probe against Southern blots representing different individuals (U. H. Refseth et al., (1997) *Electrophoresis* 18: 1519).

The polynucleotides of the invention can further be used to identify certain genes or genetic traits using, for example, known AFLP technologies, such as in EP0534858 and U.S. Pat. No. 5,878,215.

The polynucleotides of the present invention are also used for single nucleotide polymorphism (SNP) mapping.

The polynucleotides of the invention can be used with the various types of maps discussed above to identify Quantitative Trait Loci (QTLs). Many important crop traits, such as the solids content of tomatoes, are quantitative traits and result from the combined interactions of several genes. These genes reside at different loci in the genome, often times on different chromosomes, and generally exhibit multiple alleles at each locus. The polynucleotides of the invention are used to identify QTLs and isolate specific alleles as described by de Vicente and Tanksley (*Genetics* (1993) 134:585). Once a desired allele combination is identified, crop improvement is accomplished either through biotechnological means or by directed conventional breeding programs (for review see Tanksley and McCouch (1997) *Science* 277:1063). In addition to isolating QTL alleles in present crop species, the polynucleotides of the invention are also used to isolate alleles from the corresponding QTL of wild relatives.

In addition, the polynucleotides of the present invention can be used for marker assisted breeding. Marker assisted breeding uses genetic fingerprinting techniques to assist plant breeders in matching a molecular profile to the physical properties of a variety. This allows plant breeders to significantly accelerate the speed of natural plant breeding programs. Marker assisted breeding also allows better retention of sequences that participate in QTLs.

Following the procedures described above and using a plurality of the polynucleotides of the present invention, any individual can be genotyped. These individual genotypes are used for the identification of particular cultivars, varieties, lines, ecotypes and genetically modified plants or can serve as tools for subsequent genetic studies directed towards the improvement of multiple phenotypic traits.

4. The Genes of the Invention

Polynucleotides of the present invention and proteins expressed via translation of these polynucleotides are set forth in the Sequence Listing. The Sequence Listing also comprises functionally comparable proteins that can be utilized for the purposes of the invention, namely to make transgenic plants with modulated growth and phenotype characteristics, including ornamental, biomass and seed yield, confinement, stress tolerance, ornamental and/or compositional characteristics.

5. Use of the Genes to Make Transgenic Plants

To use the sequences of the present invention or a combination of them or parts and/or mutants and/or fusions and/or variants of them, recombinant DNA constructs are prepared that comprise the polynucleotide sequences of the invention inserted into a vector and that are suitable for transformation of plant cells. The construct can be made using standard recombinant DNA techniques (see, Sambrook et al., Molecular Cloning: A Laboratory Manual, Second Edition, Cold Spring Harbor Laboratory Press (1989) New York) and can be introduced into the plant species of interest by, for example, *Agrobacterium*-mediated transformation, or by other means of transformation, for example, as disclosed below.

The vector backbone may be any of those typically used in the field such as plasmids, viruses, artificial chromosomes, BACs, YACs, PACs and vectors such as, for instance, bacteria-yeast shuttle vectors, lamda phage vectors, T-DNA fusion vectors and plasmid vectors (see, 17-24).

Typically, the construct comprises a vector containing a nucleic acid molecule of the present invention with any desired transcriptional and/or translational regulatory sequences such as, for example, promoters, UTRs, and 3' end termination sequences. Vectors may also include, for example, origins of replication, scaffold attachment regions (SARs), markers, homologous sequences, and introns. The vector may also comprise a marker gene that confers a selectable phenotype on plant cells. The marker may preferably encode a biocide resistance trait, particularly antibiotic resistance, such as resistance to, for example, kanamycin, bleomycin, or hygromycin, or herbicide resistance, such as resistance to, for example, glyphosate, chlorsulfuron or phosphinothricin.

It will be understood that more than one regulatory region may be present in a recombinant polynucleotide, e.g., introns, enhancers, upstream activation regions, transcription terminators, and inducible elements. Thus, more than one regulatory region can be operably linked to said sequence.

To "operably link" a promoter sequence to a sequence, the translation initiation site of the translational reading frame of said sequence is typically positioned between one and about fifty nucleotides downstream of the promoter. A promoter can, however, be positioned as much as about 5,000 nucleotides upstream of the translation initiation site, or about 2,000 nucleotides upstream of the transcription start site. A promoter typically comprises at least a core (basal) promoter. A promoter also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al. (1989) *Plant Cell* 1:977-984.

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

The choice of promoters to be included depends upon several factors, including, but not limited to, efficiency, selectability, inducibility, desired expression level, and cell- or tissue-preferential expression. It is a routine matter for one of skill in the art to modulate the expression of a sequence by appropriately selecting and positioning promoters and other regulatory regions relative to said sequence.

Some suitable promoters initiate transcription only, or predominantly, in certain cell types. For example, a promoter that is active predominantly in a reproductive tissue (e.g., fruit, ovule, pollen, pistils, female gametophyte, egg cell, central cell, nucellus, suspensor, synergid cell, flowers, embryonic tissue, embryo sac, embryo, zygote, endosperm, integument, or seed coat) can be used. Thus, as used herein a cell type- or tissue-preferential promoter is one that drives expression preferentially in the target tissue, but may also lead to some expression in other cell types or tissues as well. Methods for identifying and characterizing promoter regions in plant genomic DNA include, for example, those described in the following references: Jordano, et al. (1989) *Plant Cell* 1:855-866; Bustos et al. (1989) *Plant Cell* 1:839-854; Green et al. (1988) *EMBO J.* 7: 4035-4044; Meier et al. (1991) *Plant Cell* 3: 309-316; and Zhang et al. (1996) *Plant Physiology* 110: 1069-1079.

Examples of various classes of regulatory regions are described below. Some properties of the regulatory regions indicated below, as well as additional regulatory regions, are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/034308; and PCT/US05/23639. Specifically, the sequences of regulatory regions p326, YP0144, YP0190, p13879, YP0050, p32449, 21876, YP0158, YP0214, YP0380, PT0848, PT0633 YP0128, YP0275, PT0660, PT0683, PT0758, PT0613, PT0672, PT0837, YP0092, PT0676, PT0708, YP0396, YP0007, YP0111, YP0103, YP0028, YP0121, YP0008, YP0039, YP0115, YP0119, YP0120, YP0374, YP0039, YP0101, YP0102, YP0110, YP0117, YP0119, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, YP0374, PT0710, YP0356, YP0385, YP0396, YP0384, PT0688, YP0286, YP0377, PD1367, PT0863, PT0829, PT0665, PT0678, YP0086, YP0188, YP0263, PT0758, PT0743, PT0829, YP 0119, and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022, and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236. It will be appreciated that a regulatory region may meet criteria for one classification based on its activity in one plant species, and yet meet criteria for a different classification based on its activity in another plant species.

Broadly Expressing Promoters: A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root Promoters: Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

Maturing Endosperm Promoters: In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell. Biol.*, 13:5829-5842 (1993)), the beta-amylase promoter, and the barley hordein promoter. Other maturing endosperm promoters include the YP0092, PT0676, and PT0708 promoters.

Ovary Tissue Promoters: Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

Embryo Sac/Early Endosperm Promoters: To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters. Promoters that may be suitable include those derived from the following genes: *Arabidopsis* viviparous-1 (see, GenBank No. U93215); *Arabidopsis* atmycl (see, Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.*, 22:10131-1038). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

Embryo Promoters Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltpl) promoter (*Plant Cell Rep* (2001) 20:647-654), YP0097, YP0107, YP0088, YP0143, YP0156, PT0650, PT0695, PT0723, PT0838, PT0879, and PT0740.

Photosynthetic Tissue Promoters: Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

Vascular Tissue Promoters: Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2): 185-192 (1992)), and the rice tungro bacilliform virus (RTBV) promoter (Dai et al., *Proc. Natl. Acad. Sci. USA*, 101(2):687-692 (2004)).

Inducible Promoters: Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, and PD1367. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) *Nature Biotech* 17: 287-291).

Basal Promoters: A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

Other Promoters: Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

Other Regulatory Regions: A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence. It will be understood that more than one regulatory region may be present in a recombinant polynucleotide, e.g., introns, enhancers, upstream activation regions, transcription terminators, and inducible elements.

Alternatively, misexpression can be accomplished using a two component system, whereby the first component consists of a transgenic plant comprising a transcriptional activator operatively linked to a promoter and the second component consists of a transgenic plant that comprise a nucleic acid molecule of the invention operatively linked to the target-binding sequence/region of the transcriptional activator. The two transgenic plants are crossed and the nucleic acid molecule of the invention is expressed in the progeny of the plant (US patent publication 20050257293A1). In another alternative embodiment of the present invention, the misexpression can be accomplished by having the sequences of the two component system transformed in one transgenic plant line.

Another alternative consists in inhibiting expression of a growth or phenotype-modulating polypeptide in a plant species of interest. The term "expression" refers to the process of converting genetic information encoded in a polynucleotide into RNA through transcription of the polynucleotide (i.e., via the enzymatic action of an RNA polymerase), and into protein, through translation of mRNA. "Up-regulation" or "activation" refers to regulation that increases the production of expression products relative to basal or native states, while "down-regulation" or "repression" refers to regulation that decreases production relative to basal or native states.

A number of nucleic-acid based methods, including antisense RNA, ribozyme directed RNA cleavage, and interfering RNA (RNAi) can be used to inhibit protein expression in plants. Antisense technology is one well-known method. In this method, a nucleic acid segment from the endogenous gene is cloned and operably linked to a promoter so that the antisense strand of RNA is transcribed. The recombinant vector is then transformed into plants, as described above, and the antisense strand of RNA is produced. The nucleic acid segment need not complement the entire sequence of the endogenous gene to be repressed, but typically will be substantially identical to at least a portion of the endogenous gene to be repressed. Generally, higher homology can be used to compensate for the use of a shorter sequence. Typically, a sequence of at least 30 nucleotides is used (e.g., at least 40, 50, 80, 100, 200, 500 nucleotides or more).

Thus, for example, an isolated nucleic acid provided herein can be an antisense nucleic acid to one of the aforementioned nucleic acids encoding a growth or phenotype-modulating polypeptide. A nucleic acid that decreases the level of a transcription or translation product of a gene encoding a growth or phenotype-modulating polypeptide is transcribed into an antisense nucleic acid, or complementary to the coding sequence of the growth or phenotype-modulating polypeptide in the Sequence Listing. Alternatively, the transcription product of an isolated nucleic acid can be similar or complementary to the coding sequence of a growth or phenotype-modulating polypeptide in the Sequence Listing, but is an RNA that is unpolyadenylated, lacks a 5' cap structure, or contains an unsplicable intron.

In another method, a nucleic acid can be transcribed into a ribozyme, or catalytic RNA, that affects expression of an mRNA. (See, U.S. Pat. No. 6,423,885). Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman, et al. (1995) *Proc. Natl. Acad. Sci. USA*, 92(13):6175-6179; de Feyter and Gaudron, Methods in Molecular Biology, Vol. 74, Chapter 43, "Expressing Ribozymes in Plants", Edited by Turner, P. C, Humana Press Inc., Totowa, N.J. RNA endoribonucleases such as the one that occurs naturally in *Tetrahymena thermophila*, and which have been described extensively by Cech and collaborators can be useful. See, for example, U.S. Pat. No. 4,987,071.

Methods based on RNA interference (RNAi) can be used. RNA interference is a cellular mechanism to regulate the expression of genes and the replication of viruses. This mechanism is thought to be mediated by double-stranded small interfering RNA molecules. A cell responds to such a double-stranded RNA by destroying endogenous mRNA having the same sequence as the double-stranded RNA. Methods for designing and preparing interfering RNAs are known to those of skill in the art; see, e.g., WO 99/32619 and WO 01/75164. For example, a construct can be prepared that includes a sequence that is transcribed into an interfering RNA. Such an RNA can be one that can anneal to itself, e.g., a double stranded RNA having a stem-loop structure. One strand of the stem portion of a double stranded RNA comprises a sequence that is similar or identical to the sense coding sequence of the polypeptide of interest, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises an antisense sequence of the growth or phenotype-modulating polypeptide of interest, and can have a length that is shorter, the same as, or longer than the corresponding length of the sense sequence. The loop portion of a double stranded RNA can be from 10 nucleotides to 5,000 nucleotides, e.g., from 15 nucleotides to 1,000 nucleotides, from 20 nucleotides to 500 nucleotides, or from 25 nucleotides to 200 nucleotides. The loop portion of the RNA can include an intron. See, e.g., WO 99/53050.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller (1997) *Antisense Nucleic Acid Drug Dev.*, 7:187-195; Hyrup et al. (1996) *Bioorgan. Med. Chem.*, 4: 5-23. In addition, the deoxyphosphate backbone can be replaced with, for example, a phosphorothioate or phosphorodithioate backbone, a phosphoroamidite, or an alkyl phosphotriester backbone.

In some cases, expression of a polypeptide of the invention inhibits one or more functions of an endogenous polypeptide. For example, a nucleic acid that encodes a dominant negative polypeptide can be used to inhibit gene function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation Transformation Nucleic acid molecules of the present invention may be introduced into the genome or the cell of the appropriate host plant by a variety of techniques. These techniques, able to transform a wide variety of higher plant species, are well known and described in the technical and scientific literature (see, e.g., 28-29).

A variety of techniques known in the art are available for the introduction of DNA into a plant host cell. These techniques include transformation of plant cells by injection (30), microinjection (31), electroporation of DNA (32), PEG (33), use of biolistics (34), fusion of cells or protoplasts (35), and via T-DNA using *Agrobacterium tumefaciens* (36-37) or *Agrobacterium rhizogenes* (38) or other bacterial hosts (39), for example.

In addition, a number of non-stable transformation methods that are well known to those skilled in the art may be desirable for the present invention. Such methods include, but are not limited to, transient expression (40) and viral transfection (41).

Seeds are obtained from the transformed plants and used for testing stability and inheritance. Generally, two or more generations are cultivated to ensure that the phenotypic feature is stably maintained and transmitted.

A person of ordinary skill in the art recognizes that after the expression cassette is stably incorporated in transgenic plants and confirmed to be operable, it can be introduced into other plants by sexual crossing. Any of a number of standard breeding techniques can be used, depending upon the species to be crossed.

The methods according to the present invention can be applied to any plant, preferably higher plants, pertaining to the classes of *Angiospermae* and *Gymnospermae*. Plants of the subclasses of the *Dicotylodenae* and the *Monocotyledonae* are particularly suitable. Suitable species may come from the family *Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae,* and *Vitaceae.*

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea.*

The methods of the present invention are preferably used in plants that are important or interesting for agriculture, horticulture, biomass for the production of liquid fuel molecules and other chemicals, and/or forestry. Non-limiting examples include, for instance, *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Arundo donax* (giant reed), *Secale cereale* (rye), *Salix* spp. (willow), *Eucalyptus* spp. (eucalyptus), *Triticosecale* spp. (triticum—wheat X rye), Bamboo, *Carthamus tinctorius* (safflower), *Jatropha curcas* (jatropha), *Ricinus communis* (castor), *Elaeis guineensis* (palm), *Linum usitatissimum* (flax), *Brassica juncea, Manihot esculenta* (cassaya), *Lycopersicon esculentum* (tomato), *Lactuca saliva* (lettuce), *Musa paradisiaca* (banana), *Solanum tuberosum* (potato), *Brassica oleracea* (broccoli, cauliflower, brusselsprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Papaver somniferum* (opium poppy), *Papaver orientale, Taxus baccata, Taxus brevifolia, Artemisia annua, Cannabis saliva, Camptotheca acuminate, Catharanthus roseus, Vinca rosea, Cinchona officinalis, Coichicum autumnale, Veratrum californica., Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana, Alstroemeria* spp., *Rosa* spp. (rose), *Dianthus caryophyllus* (carnation), *Petunia* spp. (petunia), *Poinsettia pulcherrima* (poinsettia), *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass), *Phleum pratense* (timothy), and conifers. Of interest are plants grown for energy production, so called energy crops, such as cellulose-based energy crops like *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed), *Secale cereale* (rye), *Salix* spp. (willow), *Eucalyptus* spp. (eucalyptus), *Triticosecale* spp. (triticum—wheat X rye), and Bamboo; and starch-based energy crops like *Zea mays* (corn) and *Manihot esculenta* (cassaya); and sucrose-based energy crops like *Saccharum* sp. (sugarcane) and *Beta vulgaris* (sugarbeet); and biodiesel-producing energy crops like *Glycine max* (soybean), *Brassica napus* (canola), *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*. Thus, the described materials and methods are useful for modifying biomass characteristics, such as characteristics of biomass renewable energy source plants. A biomass renewable energy source plant is a plant having or producing material (either raw or processed) that comprises stored solar energy that can be converted to electrical energy, liquid fuels, and other useful chemicals. In general terms, such plants comprise dedicated energy crops as well as agricultural and woody plants. Examples of biomass renewable energy source plants include: *Panicum virgatum* (switchgrass), *Sorghum bicolor* (sorghum, sudangrass),

*Miscanthus giganteus* (miscanthus), *Saccharum* sp. (energycane), *Populus balsamifera* (poplar), *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed), *Secale cereale* (rye), *Salix* spp. (willow), *Eucalyptus* spp. (eucalyptus), *Triticosecale* spp. (triticum—wheat X rye), Bamboo, *Zea mays* (corn), *Manihot esculenta* (cassaya), *Saccharum* sp. (sugarcane), *Beta vulgaris* (sugarbeet), *Glycine max* (soybean), *Brassica napus* (canola), *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*.

Homologues Encompassed by the Invention

It is known in the art that one or more amino acids in a sequence can be substituted with other amino acid(s), the charge and polarity of which are similar to that of the substituted amino acid, i.e. a conservative amino acid substitution, resulting in a biologically/functionally silent change. Conservative substitutes for an amino acid within the polypeptide sequence can be selected from other members of the class to which the amino acid belongs. Amino acids can be divided into the following four groups: (1) acidic (negatively charged) amino acids, such as aspartic acid and glutamic acid; (2) basic (positively charged) amino acids, such as arginine, histidine, and lysine; (3) neutral polar amino acids, such as serine, threonine, tyrosine, asparagine, and glutamine; and (4) neutral nonpolar (hydrophobic) amino acids such as glycine, alanine, leucine, isoleucine, valine, proline, phenylalanine, tryptophan, cysteine, and methionine.

Nucleic acid molecules of the present invention can comprise sequences that differ from those encoding a protein or fragment thereof selected from the group consisting of the nucleotide sequences in the sequence listing due to the fact that the different nucleic acid sequence encodes a protein having one or more conservative amino acid changes.

Biologically functional equivalents of the polypeptides, or fragments thereof, of the present invention can have about 10 or fewer conservative amino acid changes, more preferably about 7 or fewer conservative amino acid changes, and most preferably about 5 or fewer conservative amino acid changes. In a preferred embodiment of the present invention, the polypeptide has between about 5 and about 500 conservative changes, more preferably between about 10 and about 300 conservative changes, even more preferably between about 25 and about 150 conservative changes, and most preferably between about 5 and about 25 conservative changes or between 1 and about 5 conservative changes.

Identification of Useful Nucleic Acid Molecules and their Corresponding Nucleotide Sequences The nucleic acid molecules and nucleotide sequences thereof of the present invention were identified as functional homologs of other sequences of established function and utility. The other sequences and their established function come from public and proprietary sources. For example, in some cases the properties of these sequences were established by use of a variety of screens that are predictive of nucleotide sequences that provide plants with altered size, vegetative growth, organ number, plant architecture, biomass, and/or enhanced resistance to various abiotic or biotic stresses. In other cases, characteristics of similar sequences are known from scientific and technical literature readily accessible to those of skill in the art.

Functional homologs/orthologs from *Sorghum* for each gene of interest, which in many cases may be capable of modulating growth and phenotype characteristic when transformed in plants, are identified through sequence homology, as may be ascertained using the "Determination of Functional Homolog/Ortholog Sequences" process described below and/or other known orthology detection methods. Functional homologs/orthologs of a gene of interest are understood to affect similar phenotype(s) as observed for the respective gene of interest when their expression is modulated in plants. The modulated growth and phenotype characteristic(s) determined for the functional homologs/orthologs are noted in the Sequence Listing.

Determination of Functional Homolog/Ortholog Sequences

A subject sequence is considered a functional homolog or ortholog of a query sequence if the subject and query sequences encode proteins having a similar function and/or activity. A process known as Reciprocal BLAST (Rivera et al., *Proc. Natl. Acad. Sci. USA*, 95:6239-6244 (1998)) is used to identify potential functional homolog and/or ortholog sequences from a database consisting of Ceres-Inc. proprietary peptide sequences from *Panicum virgatum*.

Before starting a Reciprocal BLAST process, a specific query polypeptide is searched against all peptides from its source species using BLAST in order to identify polypeptides having BLAST sequence identity of 80% or greater to the query polypeptide and an alignment length of 85% or greater along the shorter sequence in the alignment. The query polypeptide and any of the aforementioned identified polypeptides are designated as a cluster.

The BLASTP version 2.0 program from Washington University at Saint Louis, Mo., USA is used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity is calculated based on the alignment of the first BLAST HSP (High-scoring Segment Pairs) of the identified potential functional homolog and/or ortholog sequence with a specific query polypeptide. The number of identically matched residues in the BLAST HSP alignment is divided by the HSP length, and then multiplied by 100 to get the BLAST sequence identity. The HSP length typically includes gaps in the alignment, but in some cases gaps can be excluded.

The main Reciprocal BLAST process consists of two rounds of BLAST searches; forward search and reverse search. In the forward search step, a query polypeptide sequence, "polypeptide A," from source species SA (such as *Arabidopsis*) is BLASTed against all Ceres-Inc. proprietary peptide sequences from *Sorghum bicolor*. Top hits are determined using an E-value cutoff of $10^{-5}$ and a sequence identity cutoff of 35%. Among the top hits, the sequence having the lowest E-value is designated as the best hit, and considered a potential functional homolog or ortholog. Any other top hit that has a high BLAST sequence identity to the best hit or to the original query polypeptide is considered a potential functional homolog or ortholog as well.

In the reverse search round, the top hits identified in the forward search from *Sorghum* are BLASTed against all protein sequences from the source species SA. A top hit from the forward search that returns a polypeptide from the aforementioned cluster as its best hit is also considered as a potential functional homolog or ortholog.

Functional homologs and/or orthologs are identified by manual inspection of potential functional homolog and/or ortholog sequences. In some cases identification is based on known correlations between sequence domains and functions for specific classes of biomolecules.

Information in the Sequence Listing

The *sorghum* sequences provided in the Sequence Listing are annotated to indicate one or several potential applications of the respective sequences. Some sequences are enzymes, i.e. catalysts of specific chemical or biochemical reactions, and their activity is indicated by enzyme classification (EC) numbers. The EC numbers used in the sequence listing correspond to the swissprot enzyme classification system, as found for example at the expassy website on the world wide web. Some sequences contain "pfam" domains which are indicative of particular applications. The specific pfam domains are described in more detail by various sources, such as on the world wide web at the sanger or janelia websites. Thus, various practical applications of the *sorghum* sequences in the sequence listing are immediately apparent to those of skill in the art based on their similarity to known sequences.

Some *sorghum* sequences in the Sequence Listing are annotated in the "miscellaneous features" section as functional homologs of known sequences, and associated traits that could be modulated by the respective sequences in transgenic plants. Known sequence-function associations are sometimes based at least in part on literature documentation. In some cases, the known query sequences are not reproduced in the sequence listing, but it is identified by literature reference, such as by reference to specific sequences in patent publications or *Arabidopsis* locus numbers. If desired, sequence information for these designations may be obtained from various sources, such as the EMBL sequence database or http://www.arabidopsis.org. In some cases, query sequences such as SEQ ID NOs: 12875-14769 are provided in the sequence listing, along with information pertinent to observed phenotypes of transgenic plant misexpressing the respective sequences. When a listed query sequence is a truncation of a known coding region, those of skill in the art could design if necessary an equivalent truncation of the corresponding *sorghum* functional homologs to obtain the indicated phenotype.

Modulated growth and phenotype characteristics for some of the sequences of the invention are noted by entries in the "miscellaneous feature" section for the respective nucleic acid and/or polypeptide sequence in the Sequence Listing. Valuable applications of the respective sequences are also sometimes noted in the Sequence Listing. In many cases, traits were originally associated with known sequences by misexpression or other transgenic or genetic interference with specific gene functions. For some sequences, plants were transformed with the genes of interest and screened for modulated morphological characteristics, as described, for example in PCT/US2005/023326 or PCT/US2005/047099. When applicable, phenotypic observations for transformants are noted in the Sequence Listing. For some sequences, transgenic trait associations were suggested by results of screening transgenic plants for tolerance to specific stress conditions. Screening procedures and some results are exemplified in PCT/US2005/018950, PCT/US2005/018912, PCT/US2005/014197, or PCT/US2006/040572. Other methods are exemplified by references cited in the Sequence Listing or below.

Differential expression characteristics of some *sorghum* sequences in response to specific signaling compounds or environmental stresses are indicated in the "miscellaneous features" fields for the respective sequences in the Sequence Listing. The plant organs in which the expression of the respective sequences in the Sequence Listing is regulated in response to specific compounds or growth conditions are indicated. In most cases, expression characteristics are associated with the *sorghum* sequences in the Sequence Listing by monitoring genome-wide changes in gene expression in response to specific abiotic stresses or in response to a variety of chemical treatments, as described, for example in Salzman et al. (Plant Physiol. 2005 May; 138:352-368) or Buchanan et al. (Plant Mol Biol. 2005 July; 58:699-720). As those skilled in the art would readily appreciate, such expression data can be used as an indication of the potential for certain genes to play key roles in expression of different plant phenotypes. Moreover, it is a common practice of those skilled in the art to use such first-level genomic data to uncover sequences of interest and to derive a path toward identifying genes important in a particular pathway or response of interest. Differentially expressed sequences may be used in vectors for making transgenic plants with modulated characteristics, or to characterize exposure of a plant or plant part to the specific abiotic stress or treatment or conditions indicated.

Additional information of sequence applications comes from similarity to sequences in public databases. Entries in the "miscellaneous features" sections of the Sequence Listing labeled "NCBI GI:" and "NCBI Dese:" provide additional information regarding the respective sequences. The corresponding public records, which may be retrieved from the ncbi website associated with the government's nih website on the world wide web and are herein incorporated by reference, in certain cases cite publications with data indicative of uses of the annotated sequences.

From the disclosure of the Sequence Listing, it can be seen that the nucleotides and polypeptides of the inventions are sometimes useful, depending upon the respective individual sequence, to make plants with one or more altered characteristics. For example, the sequences can be used, as noted in the sequence listing for the respective sequences, to modify the appearance, physiology, and/or content of plants, e.g. by altering leaf size, color, or number, petiole angle, plant size, biomass, branching, time to flowering, senescence, or abscission, seed number and size, endosperm size, endosperm cell number and/or size, reproductive capacity, nutrient or nitrogen or phosphate use efficiency, content or composition of alkaloid, carbon, carotene, cell wall, glycerol, lignin, lutein, lycopene, nitrogen, oil, protein, sterol, sugar, terpenoid, tocopherol, carbohydrate, silicon of at least some plant parts, biotic or abiotic (e.g. aluminum, biotic, stress, cold, drought, heat, herbicide, high, pH, light, quality, response low, iron, oxidative, stress, salt, ultraviolet radiation, low light, or shade) stress resistance, or facilitating asexual embryo production.

Nucleotides and polypeptides that are useful for modulating plant characteristics in traits such as sterility, lethality and/or viability have been noted as "useful for biocontainment applications" in the Sequence Listing. Nucleotides and polypeptides with this designation include those that are able to confer one or more of the following phenotypes, relative to wild-type control, when mis-expressed in plants: increased or decreased number of floral organs; alter floral organ type; reduced fertility; sterility, including female-sterility and/or male-sterility; alter how leaves emerge from the meristem; low/no seed germination; and reduced plant viability (e.g. albino plants and plants with vitrified leaves). The ability to modulate sterility, lethality, and/or viability is important in developing a genetic confinement system designed to reduce or prevent gene flow from transgenic pants to commercial crops and wild-type counterparts, making ornamental plants; and for other agricultural and/or horticultural purposes. Nucleotides and polynucleotides useful for developing a genetic confinement system can be utilized by procedures known to those skilled in the art, such as in US2005/0257293 A1, hereby incorporated by reference.

Some nucleotides and polypeptides are noted as being "useful for making plants with modulated biomass", "useful for making plants with modulated flowering time", "useful for making plants with modulated seed size", "useful for making plants with modulated time to senescence", "useful for making plants with modulated endosperm cell number", "useful for making plants with modulated endosperm cell size", "useful for making plants with modulated plant growth and development", "useful for making plants with modulated root development", "useful for making plants with modulated seed number", "useful for making plants with modulated endosperm size", "useful for making plants with modulated growth rate", "useful for making plants with modulated abscission" or "useful for making plants with modulated seedling growth" in the Sequence Listing. Nucleotides and polypeptides that have been given these designation include those that are able to confer one or more of the following phenotypes, relative to wild-type control, when mis-expressed in plants: increased or decreased plant size; increased or decreased plant height; increased or decreased leaf size; altered leaf shape; altered leaf structure; increased or decreased number of leaves; increased or decreased organ size; altered organ shape; increased or decreased organ number; increased or decreased branching length; increased or decreased branch number; increased or decreased apical dominance; and increased or decreased hypocotyls length. Altering plant biomass is valuable for increasing plant biomass produced per acre of arable land, increasing crop yield per acre of arable land, utilizing plants as chemical factories to produce valuable pharmaceutical compounds, developing a genetic confinement system designed to reduce or prevent gene flow from transgenic plants to commercial crops and wild-type counterparts, making ornamental plants, and for other agricultural and/or horticultural purposes.

Some nucleotides and polypeptides that are useful for modulating plant characteristics in traits such as the composition of a plant, plant material, plant tissue, plant cell and seed from a plant include those that have been given the designations "useful for making plants with altered alkaloid content", "useful for making plants with altered carbon content", "useful for making plants with altered carotene content", "useful for making plants with modulated or altered carbohydrate content", "useful for making plants with altered lycopene content", "useful for making plants with altered amino acid content", "useful for making plants with altered sugar content", "useful for making plants with modulated seed quality", "useful for making plants with modulated carbon-nitrogen partitioning", "useful for making plants with enhanced nutritional value", "useful for making plants with altered cell wall content and/or composition "useful for making plants with altered glycerol content", "useful for making plants with altered lignin content", "useful for making plants with altered lutein content", "useful for making plants with altered nitrogen content", "useful for making plants with altered oil content", "useful for making plants with altered protein content", "useful for making plants with altered sterol content", "useful for making plants with altered terpenoid content", or "useful for making plants with altered tocopherol content" in the Sequence Listing. Nucleotides and polypeptides that have been given these designations include those that are able to confer one or more of the following phenotypes, relative to wild-type control, when mis-expressed in plants: increased or decreased carbon content; increased or decreased plant nitrogen content; altered color (indicative of change(s) to the chemical composition); altered metabolic profile, increased or decreased starch content, increased or decreased fiber content; increased or decreased amount of a valuable compound (e.g. increased alkaloids and/or terpenoids); increased or decreased number of trichomes; increased or decreased cotyledon size; increased or decreased cotyledon number; altered cotyledon shape; increased or decreased fruit size; increased or decreased fruit length; altered fruit shape; increased or decreased seed size; and altered seed shape; altered seed color (indicative of altered chemical composition); and having activated expression of a gene operably linked to an alkaloid or terpenoid related regulatory region or promoter. Altering characteristics such as the composition of a plant, plant organ, plant tissue and plant cell is valuable for improving the nutritional value of crops, improving the composition of plants to be used as bio-fuels, utilizing plants as chemical factories by increasing the content of valuable pharmaceutical compounds, producing plants with increased tolerance to abiotic or biotic stress, developing a genetic confinement system designed to reduce or prevent gene flow from transgenic plants to commercial crops and wild-type counterparts, making ornamental plants, and for other agricultural and/or horticultural purposes. Nucleotides and polynucleotides useful for developing plants with modified compositions can be utilized by procedures known to those skilled in the art, such as in PCT/US2006/014161, PCT/US2005/032680, PCT/US2006/0022851, PCT/US2005/44112, PCT/US2005/043562, PCT/US2006/41516, U.S. Ser. No. 60/838,646, U.S. Ser. No. 60/855,108, U.S. Ser. No. 60/854,825 PCT/US2006/360,459, PCT/US2007/061052, and PCT/US2007/002214, hereby incorporated by reference.

Some nucleotides and polypeptides that are useful for modulating plant characteristics in traits such as phosphate use include those that have been given the designation "Useful for making plants with modulated phosphate use efficiency", "useful for making plants with modulated high pH sensitivity", or "useful for making plants with high aluminum sensitivity", in the Sequence Listing. Nucleotides and polypeptides that have been given these designations include those that are able to confer one or more of the following phenotypes, relative to wild-type control, when mis-expressed in plants: increased or decreased tolerance to low phosphate conditions; increased or decreased tolerance to no phosphate conditions, and increased or decreased tolerance to high pH conditions. Altering characteristics such as phosphate use through genetic technologies is valuable for producing crop plants with increased tolerance to phosphate limiting conditions, using traditionally un-arable land to grow crop plants with increased tolerance to phosphate limiting conditions, developing a genetic confinement system designed to reduce or prevent gene flow from transgenic plants to commercial crops and wild-type counterparts, and for other agricultural and/or horticultural purposes. Nucleotides and polynucleotides useful for developing plants with modulated phosphate use efficiency can be utilized by procedures known to those skilled in the art, such as in PCT/US2005/018912, hereby incorporated by reference.

Nucleotides and polypeptides that are useful for modulating plant characteristics in traits such as light responses include those that have been given the designations "useful for making plants with modulated light quality response", "useful for making plants with modulated UV sensitivity", "useful for making plants with modulated low light sensitivity", "useful for making plants with modulated light quality sensitivity", "useful for making plants with modulated light quality response", "useful for making plants with modulated light response", or "useful for making plants with altered low light response" in the Sequence Listing. Nucleotides and polypeptides that have been given these designations include those that are able to confer one or more of the following phenotypes, relative to wild-type control, when mis-expressed in plants: increased or decreased vigor in the dark; increased or decreased seedling vigor under low light conditions; increased or decreased plant vigor under low light conditions; increased or decreased leaf length; altered leaf shape; altered leaf structure, and increased or decreased cotyledon length. Altering characteristics such as shade avoidance and shade tolerance through genetic technologies is valuable for producing plants with tolerance to light limiting conditions, increasing plant biomass produced per acre of arable land, increasing crop production per acre of arable land, developing a genetic confinement system designed to reduce or prevent gene flow from transgenic plants to commercial crops and wild-type counterparts, making ornamental plants, and for other agricultural and/or horticultural purposes. Nucleotides and polynucleotides useful for developing plants with light responses can be utilized by procedures known to those skilled in the art, such as in U.S. Ser. No. 60/799,404, U.S. Ser. No. 60/813,533, and U.S. Ser. No. 60/818,569, hereby incorporated by reference.

Nucleotides and polypeptides that are useful for modulating plant characteristics in traits such as nitrogen use include those that have been given the designation "Useful for making plants with modulated nitrogen use efficiency" in the Sequence Listing. Nucleotides and polypeptides that have been given the "Nitrogen use" designation include those that are able to confer one or more of the following phenotypes, relative to wild-type control, when mis-expressed in plants: increased or decreased tolerance to low nitrogen conditions and surrogate low nitrogen conditions (e.g. exposure to an effective amount of MSX); increased or decreased tolerance to no nitrogen conditions; increased tolerance to high nitrogen conditions. Altering nitrogen use through genetic technologies is valuable for producing plants with increased tolerance to high or low nitrogen conditions, decreasing the amount of fertilizers used in crop production, using traditionally un-arable land to grow crop plants with increased tolerance to high or low nitrogen conditions, developing a genetic confinement system designed to reduce or prevent gene flow from transgenic plants to commercial crops and wild-type counterparts, and for other agricultural and/or horticultural purposes. Nucleotides and polynucleotides useful for developing plants with improved nitrogen use efficiency can be utilized by procedures known to those skilled in the art, such as in PCT/US2005/014197, hereby incorporated by reference.

Nucleotides and polypeptides that are useful for modulating plant characteristics in traits such as abiotic stress tolerance include those that have been given the designations "useful for making plants with modulated cold sensitivity", "useful for making plants with modulated drought sensitivity", "useful for making plants with modulated water use efficiency", "useful for making plants with modulated heat sensitivity", "useful for making plants with modulated low iron sensitivity", "useful for making plants with modulated oxidative stress sensitivity", or "useful for making plants with modulated salt sensitivity" in the Sequence Listing. Nucleotides and polypeptides that have been given these designation include those that are able to confer one or more of the following phenotypes, relative to wild-type control, when mis-expressed in plants: increased or decreased tolerance to drought and/or surrogate drought conditions (e.g. exposure to effective amounts of ABA, PEG, mannitol or sucrose); increased or decreased tolerance to low temperature conditions; increased or decreased tolerance to high temperature conditions; increased or decreased salt tolerance; increased or decreased tolerance to oxidative stressors and/or surrogate oxidative stressors (e.g. exposure to an effective amount of arginine, ozone, or salicylic acid); and having leaves with shiny or dull appearance (indicative of altered wax composition and/or content). Altering abiotic stress tolerance through genetic technologies is valuable for farmers seeking to minimize economic losses due to drought, cold, heat, flooding and oxidative stressors; producing crop plants with increased tolerance to abiotic stressors; using traditionally un-arable land to grow crop plants with increased tolerance to abiotic stressors; developing a genetic confinement system designed to reduce or prevent gene flow from transgenic plants to commercial crops and wild-type counterparts; making ornamental plants; and for other agricultural and/or horticultural purposes. Nucleotides and polynucleotides useful for developing plants with improved abiotic stress tolerance can be utilized by procedures known to those skilled in the art, such as in PCT/US2005/018950, U.S. Ser. No. 11/248,547, U.S. Ser. No. 60/837,434, U.S. Ser. No. 60/860,296, or U.S. Ser. No. 60/851,585, hereby incorporated by reference.

The phenotypes mentioned in the sequence listing can be modulated by controlling the expression of nucleic acid sequences and polypeptide sequences that confer phenotype(s) when mis-expressed in plants. Modulation of a phenotype can also be achieved by inhibiting the expression of nucleic acid sequences and polypeptide sequences that confer phenotype(s) when mis-expressed in plants. A phenotype resulting from the expression of a nucleic acid sequence and/or polypeptide sequence can be modulated (e.g. increase or decrease of an observable/measurable phenotypic change in relation to wild-type control) using recombinant-DNA methods, as discussed in previous paragraphs.

According to another aspect, the nucleotide sequences of the invention encode polypeptides that can be utilized as herbicide targets, those useful in the screening of new herbicide compounds. Thus, the proteins encoded by the nucleotide sequences provide the bases for assays designed to easily and rapidly identify novel herbicides.

According to yet another aspect, the present invention provides a method of identifying a herbicidal compound, comprising: (a) combining a polypeptide comprising an amino acid sequence at least 85% identical to an amino acid sequence selected from the group consisting of the polypeptides described in the sequence listing with a compound to be tested for the ability to inhibit the activity of said polypeptide, under conditions conducive to inhibition; (b) selecting a compound identified in (a) that inhibits the activity of said polypeptide; (c) applying a compound selected in (b) to a plant to test for herbicidal activity; (d) selecting a compound identified in (c) that has herbicidal activity. The polypeptide can alternatively comprise an amino acid sequence at least 90%, or at least 95%, or at least 99% identical to an amino acid sequence selected from the group consisting of the polypeptides in the sequence listing. The present invention also provides a method for killing or inhibiting the growth or viability of a plant, comprising applying to the plant a herbicidal compound identified according to this method.

The Sequence Listing sets forth the polypeptide and polynucleotide sequences of the invention, including functional homologs of specific query sequences. The Sequence Listing indicates which of the functional homologs are associated with each query sequence.

The present invention further encompasses nucleotides that encode the above described polypeptides, such as those included in the sequence listing, as well as the complements and/or fragments thereof, and including alternatives thereof based upon the degeneracy of the genetic code.

The invention being thus described, it will be apparent to one of ordinary skill in the art that various modifications of the materials and methods for practicing the invention can be made. Such modifications are to be considered within the scope of the invention as defined by the following claims.

Each of the references from the patent and periodical literature cited herein and below is hereby expressly incorporated in its entirety by such citation.

REFERENCES (1) Zhang et al. (2004) *Plant Physiol.* 135:615.
(2) Salomon et al. (1984) *EMBO J.* 3:141.
(3) Herrera-Estrella et al. (1983) *EMBO J.* 2:987.
(4) Escudero et al. (1996) *Plant J.* 10:355.
(5) Ishida et al. (1996) *Nature Biotechnology* 14:745.
(6) May et al. (1995) *Bio/Technology* 13:486)
(7) Armaleo et al. (1990) *Current Genetics* 17:97.
(8) Smith. T. F. and Waterman, M. S. (1981) *Adv. App. Math.* 2:482.
(9) Needleman and Wunsch (1970) *J. Mol. Biol.* 48:443.
(10) Pearson and Lipman (1988) *Proc. Natl. Acad. Sci. (USA)* 85: 2444.
(11) Yamauchi et al. (1996) *Plant Mol. Biol.* 30:321-9.
(12) Xu et al. (1995) *Plant Mol. Biol.* 27:237.
(13) Yamamoto et al. (1991) *Plant Cell* 3:371.
(14) P. Tijessen, "Hybridization with Nucleic Acid Probes" In Laboratory Techniques in Biochemistry and Molecular Biology, P. C. vand der Vliet, ed., c. 1993 by Elsevier, Amsterdam.
(15) Bonner et al., (1973) *J. Mol. Biol.* 81:123.
(16) Sambrook et al., Molecular Cloning: A Laboratory Manual, Second Edition, Cold Spring Harbor Laboratory Press, 1989, New York.
(17) Shizuya et al. (1992) *Proc. Natl. Acad. Sci. USA,* 89: 8794-8797.
(18) Hamilton et al. (1996) *Proc. Natl. Acad. Sci. USA,* 93: 9975-9979.
(19) Burke et al. (1987) *Science,* 236:806-812.
(20) Sternberg N. et al. (1990) *Proc Natl Acad Sci USA.,* 87:103-7.
(21) Bradshaw et al. (1995) *Nucl Acids Res,* 23: 4850-4856.
(22) Frischaufetal. (1983) *J. Mol Biol,* 170: 827-842.
(23) Huynh et al., Glover N M (ed) DNA Cloning: A practical Approach, Vol. 1 Oxford: IRL Press (1985).
(24) Walden et al. (1990) *Mol Cell Biol* 1: 175-194.
(25) Vissenberg et al. (2005) *Plant Cell Physiol* 46:192.
(26) Husebye et al. (2002) *Plant Physiol* 128:1180.
(27) Plesch et al. (2001) *Plant J* 28:455.
(28) Weising et al. (1988) *Ann. Rev. Genet.,* 22:421.
(29) Christou (1995) *Euphytica,* v. 85, n.1-3:13-27.
(30) Newell (2000)
(31) Griesbach (1987) *Plant Sci.* 50:69-77.
(32) Fromm et al. (1985) *Proc. Natl. Acad. Sci. USA* 82:5824.
(33) Paszkowski et al. (1984) *EMBO J.* 3:2717.
(34) Klein et al. (1987) *Nature* 327:773.
(35) Willmitzer, L. (1993) Transgenic Plants. In: iotechnology, A Multi-Volume Comprehensive treatise (H. J. Rehm, G. Reed, A. Püler, P. Stadler, eds., Vol. 2, 627-659, VCH Weinheim-New York-Basel-Cambridge).
(36) *Crit. Rev. Plant. Sci.* 4:146.
(37) Fromm et al. (1990) *Biotechnology* 8:833-844.
(38) Cho et al. (2000) *Planta* 210:195-204.
(39) Brootghaerts et al. (2005) *Nature* 433:629-633.
(40) Lincoln et al. (1998) *Plant Mol. Biol. Rep.* 16:1-4.
(41) Lacomme et al. (2001), "Genetically Engineered Viruses" (C. J. A. Ring and E. D. Blair, Eds). Pp. 59-99, BIOS Scientific Publishers, Ltd. Oxford, UK.
(42) Wylie, P., Searching For the Facts on Ethanol. Ethanol Review: Vol. 1, October 2005.

SEQUENCE LISTING (21783 sequences)

SEQ ID NO: 1 - DNA, 363 bp, Sorghum bicolor
  misc_feature: Ceres ANNOT ID no. 6003564
  misc_feature: Encodes the peptide sequence at SEQ ID NO 2
atgaaagtcgaatttcttccattctcatttgagaatgcgaatacaaggaggtattttgtgtttgggaaagtccgaagaaaaaaggatttggaatctaccttttcttttgctttttcccttagaaaaataactcaatcaaaatccaattatctactctacaagaatgaaatgcttgttatgcctaatatacttagtttaacctgtatctgttttaattctgttctttgtccgactagctttttcttcgccaaattacccgaagcttatgccattttcaacccaatcgtggatgttatgcctgtcatacctgtactcttttttctattagcgtttgtttggcaagctgctgtaagttttcgatga

SEQ ID NO: 2 - protein, 120 aa, Sorghum bicolor
  misc_feature: Ceres ANNOT ID no. 6003564
  misc_feature (79)..(120): Pfam Id: PsbK Pfam Desc: Photosystem II 4 kDa reaction centre component
  misc_feature (22)..(120): NCBI GI: 42795540 NCBI Desc: photosystem ii protein k; psbk [oryza sativa (japonica cultivar-group)]
  misc_feature (60)..(120): NCBI GI: 75261501 NCBI Desc: photosystem ii reaction center protein k precursor (psii-k)
  misc_feature (60)..(120): NCBI GI: 902204 NCBI Desc: psii k protein [zea mays]
  misc_feature (60)..(120): NCBI GI: 48478757 NCBI Desc: photosystem ii protein k [saccharum hybrid cultivar sp-80-3280]
  misc_feature (60)..(120): NCBI GI: 50812508 NCBI Desc: psii k-protein [saccharum officinarum]
MKVEFLPFSFENANTRRYFVFGKVRRKKDLESTFSFAFSLRKITQSKSNYLLYKNEMLVMPNILSLTCICFNSVLCPTSFFFAKLPEAYAIFNPIVDVMPVIPVLFFLLAFVWQAAVSFR

SEQ ID NO: 3 - DNA, 249 bp, Sorghum bicolor
  misc_feature: Ceres ANNOT ID no. 6003577
  misc_feature: Encodes the peptide sequence at SEQ ID NO 4
atgttggctcaatccgaaggaaattatgcggaagctttgcagaattattatgaagctacgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattacgtgcgactatctccactatag

SEQ ID NO: 4 - protein, 82 aa, Sorghum bicolor
  misc_feature: Ceres ANNOT ID no. 6003577
  misc_feature (30)..(63): Pfam Id: TPR_1 Pfam Desc: Tetratricopeptide repeat
  misc_feature (1)..(82): NCBI GI: 81176251 NCBI Desc: photosystem i assembly protein ycf3 [lactuca sativa]
  misc_feature (1)..(82): NCBI GI: 225200 NCBI Desc: orf 82
  misc_feature (1)..(76): NCBI GI: 14017573 NCBI Desc: photosystem i assembly protein ycf3 [triticum aestivum]
  misc_feature (1)..(76): NCBI GI: 50812529 NCBI Desc: intron containing rf(irf168) [saccharum officinarum]
  misc_feature (1)..(76): NCBI GI: 50233972 NCBI Desc: photosystem i assembly protein ycf3 [oryza nivara]
MLAQSEGNYAEALQNYYEATRLEIDPYDRSYILYNIGLIHTSNGEHTKALEYYFRALERNPFLPQAFNNMAVICHYVRLSPL

SEQ ID NO: 5 - DNA, 1866 bp, Sorghum bicolor
  misc_feature: Ceres ANNOT ID no. 6003581
  misc_feature: Encodes the peptide sequence at SEQ ID NO 6
  misc_feature: Down-regulated in shoot tissues in response to salicylic acid treatment
atgagaaccaatcctactacttcgcgtcccggggtttccacaattgaagaaaaaagcgtagggcgtattgatcaaattattggacccgtgctggatatcacttttcccccgggcaagttgccttatatttataatgctttgatagtcaagagtcgagacactgccgataagcaaattaatgtgacttgtgaggtacaacaattattaggaaataatcgagttagagctgtggctatgagtgctacagacgggttgatgagaggaatggaagtgattgacacgggaactcctctcagtgttccagtcggtggagctactctcggacgaatttttaacgttcttggggagcctattgacaatttgggtcctgtggatactagtgcaacattccctattcatagatctgcgcctgcctttatcgagttagatacgaaattatctatctttgaaacaggtattaaggtggtcgatcttttagctccctatcgacgtggaggaaaaatcggactgtttgggggggcaggagtaggtaaaacagtactcatcatggaattaatcaataacattgctaaagctcatggaggcgtatccgtatttggcggagtaggggaacggactcgtgaaggaaatgatctttatatggaaatgaaggaatccggagtaattaatgaaaaaaatattgaggaatcaaaggtagctctagtctatggccaaatgaatgaaccgccgggagctcgtatgagagttggtttaactgccctaactatggcagaatatttccgagatgttaataagcaagacgtgcttttattcatcgataatatctttcgttttgttcaagcaggatcggaagtatccgccttattaggcagaatgccctccgcagtgggttatcaacctacccttagtacagaaatgggttctttgcaagaaagaattacttctaccaaaaagggatctataacttcgatccaagcagtttatgtacctgcagacgatttgaccgaccctgctcctgccacaacatttgcacatttggacgctactaccgtactttccagaggattagcttccaagggtatttatcccgcagtagatcctttagattcaacctcaactatgttacagcctcggatcgttggcaacgaacattatgaaactgcgcaaagagttaaggaaactttacaacgttacaaagaacttcaggacattatcgcaattcttggattggatgaattatcggaggaggatcgtttaactgtagcaagagcacgaaaaatcgagcggttcttatcacaaccgttctttgtggcagaagtttttaccggttctccaggaaagtatgttggtcttgcagaaacaattaggggatttcaactaatcctttccggagaattagacggcctacccgaacaggctttttatttagtggggaacatcgatgaagctaaaatgaaattaaatctttatgtactgactcctaaacgaattatttgggattgtgaagtgaaagaaatcattttatctactaatagtggccaaattggtgtattaccaaaccacgcccccattaacacagctgtagatatgggtcctttgagaatacgcctcctcaacgaccaatggttaacggcggttctgtggagtggttttgcgagaatagttaataatgagatcatcattttaggaaatgatgcagaactgggtagtgacattgatccagaagaagctcaacaggcacttgaaatagccgaagctaacttgagtaaagctgagggtacgaaagaattggttgaagcgaagctagctctcagacgagctaggatacgagtcgaggctgtcaattggattcccccatccaattga

SEQ ID NO: 6 - protein, 621 aa, Sorghum bicolor
  misc_feature: Ceres ANNOT ID no. 6003581
  misc_feature (151)..(372): Pfam Id: ATP-synt_ab Pfam Desc: ATP synthase alpha/beta family, nucleotide-binding domain
  misc_feature (385)..(492): Pfam Id: ATP-synt_ab_C Pfam Desc: ATP synthase alpha/beta chain, C terminal domain
  misc_feature (23)..(95): Pfam Id: ATP-synt_ab_N Pfam Desc: ATP synthase alpha/beta family, beta-barrel domain
  misc_feature (486)..(568): Pfam Id: ATP-synt_DE_N Pfam Desc: ATP synthase, Delta/Epsilon chain, beta-sandwich domain
  misc_feature (570)..(617): Pfam Id: ATP-synt_DE Pfam Desc: ATP synthase, Delta/Epsilon chain, long alpha-helix domain
  misc_feature (1)..(617): NCBI GI: 124360831 NCBI Desc: h+-transporting two-sector atpase, alpha/beta subunit, central region; h+-transporting two-sector atpase, delta/epsilon subunit [medicago truncatula]
  misc_feature (1)..(446): NCBI GI: 115481654 NCBI Desc: os10g0355800 [oryza sativa (japonica cultivar-group)]
  misc_feature (1)..(489): NCBI GI: 118614499 NCBI Desc: atp synthase cf1 beta subunit [sorghum bicolor]
  misc_feature (1)..(489): NCBI GI: 227786 NCBI Desc: cf1 atpase:subunit=beta
  misc_feature (1)..(489): NCBI GI: 552732 NCBI Desc: coupling factor beta-subunit [zea mays]
  misc_feature (1)..(489): SWISSPROT Homolog: EC 3.6.3.14 ATP synthase subunit beta
  misc_feature (15)..(486): SWISSPROT Homolog: EC 3.6.3.15 ATP synthase subunit beta, sodium ion specific
  misc_feature: Down-regulated in shoot tissues in response to salicylic acid treatment
MRTNPTTSRPGVSTIEEKSVGRIDQIIGPVLDITFPPGKLPYIYNALIVKSRDTADKQINVTCEVQQLLGNNRVRAVAMSATDGLMRGMEVIDTGTPLSVPVGGATLGRIFNVLGEPIDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAETIRGFQLILSGELDGLPEQAFYLVGNIDEAKMKLNLYVLTPKRIIWDCEVKEIILSTNSGQIGVLPNHAPINTAVDMGPLRIRLLNDQWLTAVLWSGFARIVNNEIIILGNDAELGSDIDPEEAQQALEIAEANLSKAEGTKELVEAKLALRRARIRVEAVNWIPPSN

SEQ ID NO: 7 - DNA, 159 bp, Sorghum bicolor
  misc_feature: Ceres ANNOT ID no. 6003588
  misc_feature: Encodes the peptide sequence at SEQ ID NO 8
atgtattccaatacggaaggaggattttcaatgcgggatataaaaacatatctctctgtagcacccgtgctaagtactctatggtttggggctttagcaggtttattgatagaaatcaatcgtttattcccagatgctttgtcattcccttttttttaa

SEQ ID NO: 8 - protein, 52 aa, Sorghum bicolor
  misc_feature: Ceres ANNOT ID no. 6003588
  misc_feature (11)..(47): Pfam Id: PSI_PsaJ Pfam Desc: Photosystem I reaction centre subunit IX / PsaJ
  misc_feature (11)..(52): NCBI GI: 75261486 NCBI Desc: photosystem i reaction center subunit ix (psi-j)
  misc_feature (11)..(52): NCBI GI: 60390388 NCBI Desc: photosystem i reaction center subunit ix (psi-j)
  misc_feature (11)..(52): NCBI GI: 902241 NCBI Desc: psaj [zea mays]
  misc_feature (11)..(52): NCBI GI: 14017591 NCBI Desc: photosystem i subunit ix [triticum aestivum]
  misc_feature (11)..(52): NCBI GI: 48478789 NCBI Desc: photosystem i subunit ix [saccharum hybrid cultivar sp-80-3280]
MYSNTEGGFSMRDIKTYLSVAPVLSTLWFGALAGLLIEINRLFPDALSFPFF

SEQ ID NO: 9 - DNA, 303 bp, Sorghum bicolor
  misc_feature: Ceres ANNOT ID no. 6003600
  misc_feature: Encodes the peptide sequence at SEQ ID NO 10
atggctgaatggttaaagcgtcgtaatgccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttga

SEQ ID NO: 10 - protein, 100 aa, Sorghum bicolor
  misc_feature: Ceres ANNOT ID no. 6003600
  misc_feature (8)..(83): Pfam Id: Ribosomal_L2 Pfam Desc: Ribosomal Proteins L2, RNA binding domain
  misc_feature (6)..(100): NCBI GI: 42795534 NCBI Desc: ribosomal protein l2 [oryza sativa (indica cultivar-group)]
  misc_feature (6)..(100): NCBI GI: 42795583 NCBI Desc: ribosomal protein l2; rpl2 [oryza sativa (japonica cultivar-group)]
  misc_feature (6)..(98): NCBI GI: 75324215 NCBI Desc: chloroplast 50s ribosomal protein l2
  misc_feature (6)..(98): NCBI GI: 48478751 NCBI Desc: ribosomal protein l2 [saccharum hybrid cultivar sp-80-3280]
  misc_feature (6)..(98): NCBI GI: 50812619 NCBI Desc: ribosomal protein l2 [saccharum officinarum]
MAEWLKRRNARGIITARHRGGGHKRLYRKIDFRRNQKDISGRIVTIEYDPNRNAYICLIHYGDGEKRYILHPRGAIIGDTIVSGTKVPISMGNALPLSAV

SEQ ID NO: 11 - DNA, 528 bp, Sorghum bicolor
  misc_feature: Ceres ANNOT ID no. 6003620
  misc_feature: Encodes the peptide sequence at SEQ ID NO 12
atggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggtcgtaatgccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttga

SEQ ID NO: 12 - protein, 175 aa, Sorghum bicolor
  misc_feature: Ceres ANNOT ID no. 6003620
  misc_feature (82)..(158): Pfam Id: Ribosomal_L2 Pfam Desc: Ribosomal Proteins L2, RNA binding domain
  misc_feature (1)..(88): Pfam Id: Ribosomal_L23 Pfam Desc: Ribosomal protein L23
  misc_feature (1)..(175): NCBI GI: 140040663 NCBI Desc: ribosomal l23 protein; ribosomal protein l2 [medicago truncatula]
  misc_feature (82)..(175): NCBI GI: 42795534 NCBI Desc: ribosomal protein l2 [oryza sativa (indica cultivar-group)]
  misc_feature (82)..(175): NCBI GI: 42795583 NCBI Desc: ribosomal protein l2; rpl2 [oryza sativa (japonica cultivar-group)]
  misc_feature (82)..(173): NCBI GI: 75324215 NCBI Desc: chloroplast 50s ribosomal protein l2
  misc_feature (82)..(173): NCBI GI: 48478751 NCBI Desc: ribosomal protein l2 [saccharum hybrid cultivar sp-80-3280]
MDGIKYAVFTEKSLRLLGKNQYTFNVESGFTKTEIKHWVELFFGVKVVAVNSHRLPGKGRRMGPILGHTMHYRRMIITLQPGRNARGIITARHRGGGHKRLYRKIDFRRNQKDISGRIVTIEYDPNRNAYICLIHYGDGEKRYILHPRGAIIGDTIVSGTKVPISMGNALPLSAV

SEQ ID NO: 13 - DNA, 594 bp, Sorghum bicolor
  misc_feature: Ceres ANNOT ID no. 6003667
  misc_feature: Encodes the peptide sequence at SEQ ID NO 14
atgctgctgcgctgccgtgccgtcctgctcctcccactcccgctccctccgccgcctcgcttgcttcgccgcctgccgcacccgcgcgccctctcgtcctcgtccgggtcctccccactcccgccgccggggatggaggcttcctacaagttcgggccctacaagatcgacgccagggaggtcttccacgccacgcccctctcctacgccatggtcaatctccgcccgctgctccccgtttttactattcagcgtgaagcgaaaagatttgctgatctaagctctgatgagatcagtgacttatgggttactgcaaaggaagttggtgcgcgtcttgagcagtaccacaaagcatcttcacttacctttgctatccaggatggtcctcaagctggccaaacagttgcacatgtccacattcacctcatcccaaggaagaaaggggattttgagaaaaatgatgaaatatatgacgcgattgatgtgaaagaaaaagaattgaaggagaagcttgacctggacattgagaggaaagatagaaccatggaagaaatggctcatgaggccaatgagtaccgtgctctattctcctag

SEQ ID NO: 14 - protein, 197 aa, Sorghum bicolor
  misc_feature: Ceres ANNOT ID no. 6003667
  misc_feature (58)..(148): Pfam Id: HIT Pfam Desc: HIT domain
  misc_feature (10)..(197): NCBI GI: 115483895 NCBI Desc: os11g0120600 [oryza sativa (japonica cultivar-group)]
  misc_feature (45)..(197): NCBI GI: 27542770 NCBI Desc: atpase-like protein [sorghum bicolor]
  misc_feature (2)..(197): NCBI GI: 42565467 NCBI Desc: diadenosine tetraphosphate hydrolase [hyacinthus orientalis]
  misc_feature (47)..(196): NCBI GI: 27808510 NCBI Desc: at5g58240 [arabidopsis thaliana]
  misc_feature (45)..(172): NCBI GI: 77548404 NCBI Desc: atpase-like protein [oryza sativa (japonica cultivar-group)]
  misc_feature: Useful for making plants with modulated heat sensitivity
  misc_feature: Functional homolog of the protein sequence given in SEQ ID NO 13204
MLLRCRAVLLLPLPLPPPPRLLRRLPHPRALSSSSGSSPLPPPGMEASYKFGPYKIDAREVFHATPLSYAMVNLRPLLPVFTIQREAKRFADLSSDEISDLWVTAKEVGARLEQYHKASSLTFAIQDGPQAGQTVAHVHIHLIPRKKGDFEKNDEIYDAIDVKEKELKEKLDLDIERKDRTMEEMAHEANEYRALFS

SEQ ID NO: 15 - DNA, 819 bp, Sorghum bicolor
  misc_feature: Ceres ANNOT ID no. 6003670
  misc_feature: Encodes the peptide sequence at SEQ ID NO 16
atggcctacgccgcacgcctcgtagccaagatccaccccgccgcctaccccgccgggacgccgcgggccgagccgcgccgcccctccagcctccgcgtaggtaagcgagttggcggagcattcagtggatccacaaccgttaaacagcaaaagtttgttgctaaatctgctatctcgggagtggaaggtggtgatgcatttgttggagtaaagcaaaatactagaccaatcatagtcatagacaactacgatagcttcacatataatttatgccagtatatgggagaggttggagctaattttgaggtttatcgcaatgatgagatcacggtggaagaaattaagaagatctctcctagaggaatacttatttccccaggccctggcactcctcaagattctggaatatccttgcaaacagttacagagcttggaccctctatacctttgtttggggtttgcatgggtttacaatgcattggggaggcatttggagggaaggttgtccgatctccttatggagttgtgcatggaaagggctcccttgttcattatgatgagaagcttgatggaactctgttttccgatcttccaaacccattccaggccggaaggtatcacagccttgtaattgagaaggatagtttcccgcatgataccctggaaattgttgcatggacagatgatgggttgatcatggctgctcgccacaggatatacaaacatattcagggtgtgcagttccatccagagagcatcataactactgaagggaggctcatggtcaagaattttatcaagattattgaagactactaa

SEQ ID NO: 16 - protein, 272 aa, Sorghum bicolor
  misc_feature: Ceres ANNOT ID no. 6003670
  misc_feature (78)..(268): Pfam Id: GATase Pfam Desc: Glutamine amidotransferase class-I
  misc_feature (97)..(251): Pfam Id: Peptidase_C26 Pfam Desc: Peptidase C26
  misc_feature (53)..(270): NCBI GI: 21594026 NCBI Desc: anthranilate synthase beta chain [arabidopsis thaliana]
  misc_feature (71)..(270): NCBI GI: 25403004 NCBI Desc: probable anthranilate synthase beta subunit [imported] - arabidopsis thaliana
  misc_feature (2)..(271): NCBI GI: 90265199 NCBI Desc: b0812a04.8 [oryza sativa (indica cultivar-group)]
  misc_feature (2)..(271): NCBI GI: 38567722 NCBI Desc: b1358b12.20 [oryza sativa (japonica cultivar-group)]
  misc_feature (2)..(271): NCBI GI: 115458822 NCBI Desc: os04g0463500 [oryza sativa (japonica cultivar-group)]
  misc_feature (77)..(269): SWISSPROT Homolog: EC 4.1.3.27 Anthranilate synthase component II
  misc_feature: Useful for making plants with altered carbon content
  misc_feature: GREAT-hit functional homolog of the protein sequence given in SEQ ID NO 13357
  misc_feature: Useful for making plants with altered carbon content
  misc_feature: Functional homolog of the protein sequence given in SEQ ID NO 13357
  misc_feature: The sequence is a functional homolog of SEQ ID NO. 469 in the 11/188,298 US application
MAYAARLVAKIHPAAYPAGTPRAEPRRPSSLRVGKRVGGAFSGSTTVKQQKFVAKSAISGVEGGDAFVGVKQNTRPIIVIDNYDSFTYNLCQYMGEVGANFEVYRNDEITVEEIKKISPRGILISPGPGTPQDSGISLQTVTELGPSIPLFGVCMGLQCIGEAFGGKVVRSPYGVVHGKGSLVHYDEKLDGTLFSDLPNPFQAGRYHSLVIEKDSFPHDTLEIVAWTDDGLIMAARHRIYKHIQGVQFHPESIITTEGRLMVKNFIKIIEDY

SEQ ID NO: 17 - DNA, 705 bp, Sorghum bicolor
  misc_feature: Ceres ANNOT ID no. 6003676
  misc_feature: Encodes the peptide sequence at SEQ ID NO 18
atggatcagcaacagcaccaggagcggccgcgggaggtgtaccgcgaatgcatgcgcaaccacgcggcgaaactcgggacatacgcttccgacgggtgctgcgagtacacccccgacgacggccagcccgcagcgatgctctgcgccgcctgcggctgccaccgcaacttccaccggaaggcgttcgtggacgccgcggcgggggcgcacgttggcggcggcggtggcgcgcacggcgcaatgctgccctcccccggcgtgtccccgggctacggcatgcaccacatggcgattaccgcggccggcatgggcggcggtgacgccggtggctccgggggcagcaggcgccggacgcggaccaagttcacggaggagcagaaggagcgcatggcgcggttcgcggagcggctcggctggcggatgccaaagcgggagcccggccgcgcgccgggggacgacgaggtgggccgcttctgccgggagatcggggtcaccaggcaggtcttcaaggtatggatgcacaaccacaaggctggtgtcggcggcagcgggggcgcgggcgtcggtggagccgctcagacgtcgtcgtccacgacgcgtggcggcggcgtcggcgtcgttggagcaggcgggagcttgtccccggcgatgggcgccgacgtcgaggacgacgaggaggtgaagggcagcgagatgtgcatgtag

SEQ ID NO: 18 - protein, 234 aa, Sorghum bicolor
  misc_feature: Ceres ANNOT ID no. 6003676
  misc_feature (9)..(66): Pfam Id: ZF-HD_dimer Pfam Desc: ZF-HD protein dimerisation region
  misc_feature (102)..(226): NCBI GI: 32480091 NCBI Desc: osjnbb0086g13.8 [oryza sativa (japonica cultivar-group)]
  misc_feature (102)..(226): NCBI GI: 116309869 NCBI Desc: h0823a09.8 [oryza sativa (indica cultivar-group)]
  misc_feature (102)..(187): NCBI GI: 5091602 NCBI Desc: 10a19i.6 [oryza sativa (japonica cultivar-group)]
  misc_feature (111)..(177): NCBI GI: 124359224 NCBI Desc: homeobox domain, zf-hd class; zf-hd homeobox protein cys/his-rich dimerisation region; homeodomain-like [medicago truncatula]
  misc_feature (103)..(204): NCBI GI: 13277220 NCBI Desc: zf-hd homeobox protein [flaveria bidentis]
  misc_feature: The sequence is a functional homolog of SEQ ID NO 102 in the 10/714,887US patent application
  misc_feature: The sequence is a functional homolog of SEQ ID NO 102 in the 11/435,388US patent application
  misc_feature: The sequence is a functional homolog of SEQ ID NO 106 in the 10/714,887US patent application
  misc_feature: The sequence is a functional homolog of SEQ ID NO 106 in the 11/435,388US patent application
  misc_feature: The sequence is a functional homolog of SEQ ID NO 112 in the 10/714,887US patent application
  misc_feature: The sequence is a functional homolog of SEQ ID NO 112 in the 11/435,388US patent application
  misc_feature: The sequence is a functional homolog of SEQ ID NO 124 in the 10/714,887US patent application
  misc_feature: The sequence is a functional homolog of SEQ ID NO 124 in the 11/435,388US patent application
  misc_feature: The sequence is a functional homolog of SEQ ID NO 60 in the 10/714,887US patent application
  misc_feature: The sequence is a functional homolog of SEQ ID NO 60 in the 11/435,388US patent application
  misc_feature: The sequence is a functional homolog of SEQ ID NO 66 in the 10/714,887US patent application
  misc_feature: The sequence is a functional homolog of SEQ ID NO 66 in the 11/435,388US patent application
  misc_feature: Useful for making plants with modulated growth and phenotype characteristics
  misc_feature: The sequence is a functional homolog of SEQ ID NO 102 in the 20060015972 US patent application
  misc_feature: The sequence is a functional homolog of SEQ ID NO 106 in the 20060015972 US patent application
  misc_feature: The sequence is a functional homolog of SEQ ID NO 112 in the 20060015972 US patent application
  misc_feature: The sequence is a functional homolog of SEQ ID NO 124 in the 20060015972 US patent application
  misc_feature: The sequence is a functional homolog of SEQ ID NO 60 in the 20060015972 US patent application
  misc_feature: The sequence is a functional homolog of SEQ ID NO 66 in the 20060015972 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: Useful for making plants with modulated low light sensitivity
  misc_feature: Functional homolog of the protein sequence given in SEQ ID NO 13756
MDQQQHQERPREVYRECMRNHAAKLGTYASDGCCEYTPDDGQPAAMLCAACGCHRNFHRKAFVDAAAGAHVGGGGGAHGAMLPSPGVSPGYGMHHMAITAAGMGGGDAGGSGGSRRRTRTKFTEEQKERMARFAERLGWRMPKREPGRAPGDDEVGRFCREIGVTRQVFKVWMHNHKAGVGGSGGAGVGGAAQTSSSTTRGGGVGVVGAGGSLSPAMGADVEDDEEVKGSEMCM

SEQ ID NO: 19 - DNA, 714 bp, Sorghum bicolor
  misc_feature: Ceres ANNOT ID no. 6003677
  misc_feature: Encodes the peptide sequence at SEQ ID NO 20
atggcgatgcgtccgctcgccaggctccgccaccaactttccccctccctcctccgcttccatggccctcggaatgggtggccccccgcctccgacgccgccttcctctggcgcgggctcgcctcgtcatcaccttccgcggccgctgctgcggcgggtcgggagaagaggtcgagacggactctggggtacctgctcggcgttgcggtcgccatggtcggcgcctcgtacgctgccgtcccgctgtaccgtcgcttctgccaggctaccggctacggcggcaccgtccaaatacgcgagagtgtggagcagaagatctcacggcatgctcgagacggaactacaacatcgcgagaaataattgttcaatttaatgctgatgttgctgatggaatgccgtggaggttcatccctacacagagagaggtcagagttaaaccgggtgaaagtgctctggctttttatactgctgagaatcgcagttcagccccaattactggtgtatccacatataatgttgctcctatgaaggctgcgatttacttcaataagatacaatgtttctgctttgaggagcaaacacttcttcctggagaacagattgacatgccagtattcttctatatcgatcctgagtttgagacagaccccaaaatggacggggtgaacaatattgttctttcgtacacattcttcaaggtgaacgatagttag

SEQ ID NO: 20 - protein, 237 aa, Sorghum bicolor
  misc_feature: Ceres ANNOT ID no. 6003677
  misc_feature (79)..(234): Pfam Id: CtaG_Cox11 Pfam Desc: Cytochrome c oxidase assembly protein CtaG / Cox11
  misc_feature (55)..(236): NCBI GI: 9857538 NCBI Desc: similar to cytochrome-c oxidase assembly protein [arabidopsis thaliana]
  misc_feature (30)..(236): NCBI GI: 145348616 NCBI Desc: cox 11/ctag family of cytochrome oxidase assembly protein-like protein [ostreococcus lucimarinus cce9901]
  misc_feature (57)..(236): NCBI GI: 11466506 NCBI Desc: component involved in haem biosynthesis [reclinomonas americana]
  misc_feature (3)..(236): NCBI GI: 24581944 NCBI Desc: cg31648-pa [drosophila melanogaster]
  misc_feature (42)..(236): NCBI GI: 60814946 NCBI Desc: cox11-like cytochrome c oxidase assembly protein [synthetic construct]
MAMRPLARLRHQLSPSLLRFHGPRNGWPPASDAAFLWRGLASSSPSAAAAAAGREKRSRRTLGYLLGVAVAMVGASYAAVPLYRRFCQATGYGGTVQIRESVEQKISRHARDGTTTSREIIVQFNADVADGMPWRFIPTQREVRVKPGESALAFYTAENRSSAPITGVSTYNVAPMKAAIYFNKIQCFCFEEQTLLPGEQIDMPVFFYIDPEFETDPKMDGVNNIVLSYTFFKVNDS

SEQ ID NO: 21 - DNA, 837 bp, Sorghum bicolor
  misc_feature: Ceres ANNOT ID no. 6003807
  misc_feature: Encodes the peptide sequence at SEQ ID NO 22
atggaagcggcaccatccgtccgcaccttctcctcgtcctcgtcctcctccgcgggggctagaccctgccttctcctcgcgggcccggcgtcgcggcgcgcccgggcgctcgcggcgccgcccccgccccgcgccgtcgcctcctcccgcgcgccgctggtggtcaccagcccgccaccgccggaggcctcgggcacgcccgcccccgcgcacgccaaggtcgaccgctccggccgcttctgcagcccccgcgctgcccgtgagctcgcgctgatgatttcctacgccgcgtgtctggagggaaccgacgtcgtgcggctcttcgaccgcaggatcagcgcaaggcgagagcccgggtttgttttcgataaggcatgcttattgagttacaaccatatgagctttggtggggttccgctcgaggttggaacggaggaggaggctgagaagctgaccagtcagaacgagaaggattcagccaacgctcctccaaaactggtgtacaacaactttgtcttacggttgtccagggaacttttagtggctgttgctagtggatgggataagcatgtagatatcattgacaaaataattccccaggcttggaaggatgagcctgtggcaaggatacttgagctctgcattctacatattgctatggcagagatgacatcaaaaggaacacctcacaaagttgtcatcaatgaggcagtagatctggcaaagcgattttgtgatggtggtgcccctcgggtaattaatggatgccttcgaacatttgtaaaggatcatgttgacattgcaggcacgagccagggagctgaatcaaaatcgtga

SEQ ID NO: 22 - protein, 278 aa, Sorghum bicolor
  misc_feature: Ceres ANNOT ID no. 6003807
  misc_feature (84)..(264): Pfam Id: NusB Pfam Desc: NusB family
  misc_feature (46)..(159): NCBI GI: 42573051 NCBI Desc: antitermination nusb domain-containing protein [arabidopsis thaliana]
  misc_feature (176)..(257): NCBI GI: 118744906 NCBI Desc: nusb antitermination factor [geobacter lovleyi sz]
  misc_feature (158)..(263): NCBI GI: 22095940 NCBI Desc: n utilization substance protein b homolog (nusb protein)
  misc_feature (158)..(263): NCBI GI: 20807741 NCBI Desc: transcription termination factor [thermoanaerobacter tengcongensis]
  misc_feature (178)..(268): NCBI GI: 57233932 NCBI Desc: n utilization substance protein b [dehalococcoides ethenogenes 195]
MEAAPSVRTFSSSSSSSAGARPCLLLAGPASRRARALAAPPPPRAVASSRAPLVVTSPPPPEASGTPAPAHAKVDRSGRFCSPRAARELALMISYAACLEGTDVVRLFDRRISARREPGFVFDKACLLSYNHMSFGGVPLEVGTEEEAEKLTSQNEKDSANAPPKLVYNNFVLRLSRELLVAVASGWDKHVDIIDKIIPQAWKDEPVARILELCILHIAMAEMTSKGTPHKVVINEAVDLAKRFCDGGAPRVINGCLRTFVKDHVDIAGTSQGAESKS

SEQ ID NO: 23 - DNA, 1110 bp, Sorghum bicolor
  misc_feature: Ceres ANNOT ID no. 6003828
  misc_feature: Encodes the peptide sequence at SEQ ID NO 24
atgaagcgcttcttccagccagtggccaaggacggctccccatccaagaagcggcaggcggccgctgccgaaccggagggcggccccgcctcagccggcgccgccaccggcggggatggagaggggagacccgccgaggagccgcgcaagttcctgacgtggaacgccaacagcctgctcctccggatgaagagcgactggcccgctttctcgcagctcgtcgcccgtctcgaccccgacgtcatctgcgtccaggaagtgcggatgccggcggctggttccaaaggggctcctaaaaaccctagtgaactgaaagacgacacaagctcgtcacgggatgaaaagcaggtagttctgcgtgctttgtcaacttcacctttcaaagactaccgtgtctggtggtctctttcagattcaaaatatgcggggacagctatgtttataaagaaaaagtttgagcctaagaaggtgtctttcaacttggatagaacatcttctaagcatgaaactgatgggcgcgttataattgcggaatttgaatcattcctcttactaaacacttatgctccaaacaatggatggaaggaggaggaaaattcgtttcaaagaagacgtaagtgggacaagaggatgctggaatttgttcaacatgtggacaaacccttaatctggtgtggggacttgaatgtcagtcatgaagaaatcgatgtcagccatcctgatttctttagcagtgctaagctgaatggatacaccccacccaatcaagaggactgtgggcagccaggattcaccccagcagagaggcggcgctttggcaacattttattccaaggaaagctggtagatgcttacaggcacctgcacaaagaaaaggacatggatggtggcttctcttggtccggtcatccaattggcaagtaccgaggaaagagaatgaggatcgactacttccttgtttcggagcagttaaaggacagaattgtttcatgtgaaatgcatggccgtggcattgaattagatggattttatggaagtgaccattgccctgttacacttgagctttccaaagctgtagcagaagcagcaccagaacagcccaagccatag

SEQ ID NO: 24 - protein, 369 aa, Sorghum bicolor
  misc_feature: Ceres ANNOT ID no. 6003828
  misc_feature (49)..(355): Pfam Id: Exo_endo_phos Pfam Desc: Endonuclease/Exonuclease/phosphatase family
  misc_feature (1)..(366): NCBI GI: 55733769 NCBI Desc: at3g48425 [arabidopsis thaliana]
  misc_feature (11)..(288): NCBI GI: 14578320 NCBI Desc: pv1h14200_p [plasmodium vivax]
  misc_feature (107)..(357): NCBI GI: 83314890 NCBI Desc: ap endonuclease-related [plasmodium yoelii yoelii str. 17xnl]
  misc_feature (128)..(334): NCBI GI: 42733748 NCBI Desc: similar to dictyostelium discoideum (slime mold). dna-(apurinic or apyrimidinic site) lyase (ec 4.2.99.18) (class ii apurinic/apyrimidinic(ap)-endonuclease)
  misc_feature (107)..(341): NCBI GI: 178743 NCBI Desc: apurinic endonuclease
MKRFFQPVAKDGSPSKKRQAAAAEPEGGPASAGAATGGDGEGRPAEEPRKFLTWNANSLLLRMKSDWPAFSQLVARLDPDVICVQEVRMPAAGSKGAPKNPSELKDDTSSSRDEKQVVLRALSTSPFKDYRVWWSLSDSKYAGTAMFIKKKFEPKKVSFNLDRTSSKHETDGRVIIAEFESFLLLNTYAPNNGWKEEENSFQRRRKWDKRMLEFVQHVDKPLIWCGDLNVSHEEIDVSHPDFFSSAKLNGYTPPNQEDCGQPGFTPAERRRFGNILFQGKLVDAYRHLHKEKDMDGGFSWSGHPIGKYRGKRMRIDYFLVSEQLKDRIVSCEMHGRGIELDGFYGSDHCPVTLELSKAVAEAAPEQPKP

SEQ ID NO: 25 - DNA, 1062 bp, Sorghum bicolor
  misc_feature: Ceres ANNOT ID no. 6003834
  misc_feature: Encodes the peptide sequence at SEQ ID NO 26
atggagagaggcaataatggcgggagcgggaggccgccttctccgccgccgactccggtcgagaggaaggcggcgtgggcgtggagggacggcgccgtcacctacttccacctcctcttctacatcgccatctccggcggccagatcttcttcaacaagtgggtcttatcctcaaaagagatcaacttcccctatcctgtggcactaactctgctgcacatggtcttctcctctgtagtatgctttgcgattacaaaggttttcaaggagagatatatcagttcagtcattccaattggggcaatgtttgcaatgacactttggctagggaacagtgcgtacctctacatatctgtcgcgtttgcacaaatgttgaaggcaataatgcctgtagctgtgtttcttctcggagcagcatttggcctggaagaaatgagctataaaatgctttctatcatgtctgttatcagtgtcggagttattgtggcttctgttggtgaaattacaatcagttgggttggagtggtttaccagatgggtggagttgttgcggaagccctaagacttatcttcattgagatatttctgaagaaaaagggcgtcaagctgaacttgatatccatgatgtactatgttagcccttgcagtgctgtatgcctctttattccctggttgttcttagagaagccaaagatggatgatagtatttcatggaacttcccgccattcacattgttcttaaattgcctgtgcactttcatactcaacatgtcggttttccttgtcatatctcggactagtgcgctgacagctcgtgttactggagttgtgagggattggtctgtagttttgctgtcagctgccatcttcgctgatacacaacttaccttcataaacataattggttatgccatagccatagctggtgttgttgcatataacaaccacaagctcaaggtaaaaccccaagcgaacccacagcaaggtgacgagaacaaggtcatctcaggaagcactcgagatgtggtattatcaatgaattcatcaaaagaagcttcgtaa

SEQ ID NO: 26 - protein, 353 aa, Sorghum bicolor
  misc_feature: Ceres ANNOT ID no. 6003834
  misc_feature (174)..(315): Pfam Id: TPT Pfam Desc: Triose-phosphate Transporter family
  misc_feature (40)..(321): Pfam Id: UAA Pfam Desc: UAA transporter family
  misc_feature (27)..(353): NCBI GI: 46390796 NCBI Desc: phosphate/phosphoenolpyruvate translocator protein-like [oryza sativa (japonica cultivar-group)]
  misc_feature (33)..(319): NCBI GI: 20147279 NCBI Desc: at3g14410/mln21_19 [arabidopsis thaliana]
  misc_feature (33)..(319): NCBI GI: 9279588 NCBI Desc: phosphate/phosphoenolpyruvate translocator protein-like [arabidopsis thaliana]
  misc_feature (33)..(319): NCBI GI: 15221115 NCBI Desc: phosphate translocator-related [arabidopsis thaliana]
  misc_feature (38)..(319): NCBI GI: 8778534 NCBI Desc: f21d18.5 [arabidopsis thaliana]
  misc_feature: The sequence is a functional homolog of SEQ ID NO. 360 in the 11/188,298 US application
  misc_feature: The sequence is a functional homolog of SEQ ID NO. 484 in the 11/188,298 US application
MERGNNGGSGRPPSPPPTPVERKAAWAWRDGAVTYFHLLFYIAISGGQIFFNKWVLSSKEINFPYPVALTLLHMVFSSVVCFAITKVFKERYISSVIPIGAMFAMTLWLGNSAYLYISVAFAQMLKAIMPVAVFLLGAAFGLEEMSYKMLSIMSVISVGVIVASVGEITISWVGVVYQMGGVVAEALRLIFIEIFLKKKGVKLNLISMMYYVSPCSAVCLFIPWLFLEKPKMDDSISWNFPPFTLFLNCLCTFILNMSVFLVISRTSALTARVTGVVRDWSVVLLSAAIFADTQLTFINIIGYAIAIAGVVAYNNHKLKVKPQANPQQGDENKVISGSTRDVVLSMNSSKEAS

SEQ ID NO: 27 - DNA, 1260 bp, Sorghum bicolor
  misc_feature: Ceres ANNOT ID no. 6003835
  misc_feature: Encodes the peptide sequence at SEQ ID NO 28
atggaagagccggattgtccagaaggttccgtttccgaccgcggaggagagcggcagacggcttccctgccgctgccggacgccttcctcgagttcctcagcgagaatggcctggacccagcggtgtactcaatggcagccaccatcccgcgctacataagggagcttgatttagtttttttcctaatcccaagactaaaaccaggcatggagtcccagatcacagagatcgaatccgagttgaagtgtgtcctcgagaaggtttcatggctgccagggttctatgcgattccgccagaaattcagattgctggctccaaggcttatcagcaagggaagatctatggaattgatgctgcttctggagctgctatattagcacttgatgttcgaccaggcgaccatgttcttgacctctgtgctgctccaggtgcaaagctttgcatgcttgcagatacgcttggaaccactggttctctgactggtgttgatgttgcaaagcaccgtcttgcagcctgtcgtacaatgttgcagaagtattgtcttggtgaccgtactcggctctttgttgctgatggaactttgttttccattttacctgtgaactccaggatgcaaagaatggaaggttcaattggcgttgaagaaaatggaagcacattcccagaatggacttcaagaagatcatggaaggatcggcagaagactaagaaagcaaatgcaaatggtccacagcacctactggccactttggaacctgaactgatatactatggtaaacattcaggattagttggactgtgtaaatctgatgtcttttgtccatcagttgataatgaagcttgtacatctggctatgataaggtcctagtggatgcggagtgtactcatgatggatccataaaacacattcagaaatttgaattctggggatggaaaactctggatcgccgcatacttgatgctggaagaaccgagaaccttcttcagcttcagttacatcttctcacaaatggttttaaactgttgaaaaccggtggatcacttgtatatagtacttgcagcttgacagtctcacaaaatgagagtgtggttcagcaattcctttcaactcacccttctgcagatttgcagaagatcgatttggctgataattggccgtgcagaagtggcggcatccccaaaacactgcgatttgatcctgcagtttcacaaaccagtggtctttttgttgccaagttcagtaaactaccaacttaa

SEQ ID NO: 28 - protein, 419 aa, Sorghum bicolor
  misc_feature: Ceres ANNOT ID no. 6003835
  misc_feature (149)..(415): Pfam Id: Nol1_Nop2_Fmu Pfam Desc: NOL1/NOP2/sun family
  misc_feature (17)..(354): NCBI GI: 50252730 NCBI Desc: phosphate/phosphoenolpyruvate translocator-like [oryza sativa (japonica cultivar-group)]
  misc_feature (17)..(349): NCBI GI: 140063595 NCBI Desc: bacterial fmu (sun)/eukaryotic nucleolar nol1/nop2p [medicago truncatula]
  misc_feature (287)..(416): NCBI GI: 126014110 NCBI Desc: fmu (sun) domain protein [staphylothermus marinus f1]
  misc_feature (286)..(416): NCBI GI: 42519411 NCBI Desc: sun protein [lactobacillus johnsonii ncc 533]
  misc_feature (280)..(416): NCBI GI: 116629419 NCBI Desc: trna and rrna cytosine-c5-methylase [lactobacillus gasseri atcc 33323]
MEEPDCPEGSVSDRGGERQTASLPLPDAFLEFLSENGLDPAVYSMAATIPRYIRELDLVFFLIPRLKPGMESQITEIESELKCVLEKVSWLPGFYAIPPEIQIAGSKAYQQGKIYGIDAASGAAILALDVRPGDHVLDLCAAPGAKLCMLADTLGTTGSLTGVDVAKHRLAACRTMLQKYCLGDRTRLFVADGTLFSILPVNSRMQRMEGSIGVEENGSTFPEWTSRRSWKDRQKTKKANANGPQHLLATLEPELIYYGKHSGLVGLCKSDVFCPSVDNEACTSGYDKVLVDAECTHDGSIKHIQKFEFWGWKTLDRRILDAGRTENLLQLQLHLLTNGFKLLKTGGSLVYSTCSLTVSQNESVVQQFLSTHPSADLQKIDLADNWPCRSGGIPKTLRFDPAVSQTSGLFVAKFSKLPT

SEQ ID NO: 29 - DNA, 987 bp, Sorghum bicolor
  misc_feature: Ceres ANNOT ID no. 6003881
  misc_feature: Encodes the peptide sequence at SEQ ID NO 30
atggctgatttccggacctccacccaacgggagaggtggatcttccagccgcacgatctgatggagaggtgggcggcggcaaaccagcgggctgttcagacccttgcgcagtatgggacgacgcggcttagtgtggacctgcttgatggctcggtctcctacccagagcccgcaccggatcatgttgagggtagttcgggtataaaacctctgtcttacgaagaggagcaattgacacgggtattttacgagcagaaaattcaggaagtatgtgctgcattcaagttccctcacaaaatccaggctacagcaataatatatttcaagagattctatttacaatggtctgtaatggagcatcacccaaagcatatcatgttaacatgtgtatatgcttcttgcaaagtggaagaaaaccatgtttctgctgaggaacttggtaaaggaattcagcaggaccaccagatcattctaaataatgagatgattcttcttaaaactttagattttgacctcattgtttatgctccatatcgatcgattgaaggatttattgatgacctagaggatttttgcagggtaggtaatggtccattccagcgtttgaaggagttgcgccaagctgctgtatcccatgttgacaaaatgatgttgactgatgcacctcttctctatactcctgggcagttggcactggctgcccttcacaagtccaatgatcttctcagggtcgtcaattttgaaagatacttggaaactattttctcaaggcaacattctgattgtccagtcgaacagtttgttcagtcaatcaacacaatcaattacttggttgaccagcttaatatacctaccgttaaggacctgaggcacgttgaccgcaagctgaaacattgttgggatccaagctcacatgatgagcataagaagaaagaaaagaagtcaaagcacaaatcaaaaagaacatctactgatgcccaactgtaa

SEQ ID NO: 30 - protein, 328 aa, Sorghum bicolor
  misc_feature: Ceres ANNOT ID no. 6003881
  misc_feature (67)..(173): Pfam Id: Cyclin_N Pfam Desc: Cyclin, N-terminal domain
  misc_feature (1)..(328): NCBI GI: 37999989 NCBI Desc: cyclin h-1 [oryza sativa (japonica cultivar-group)]
  misc_feature (1)..(328): NCBI GI: 9796396 NCBI Desc: cyclin h-1 [oryza sativa]
  misc_feature (1)..(328): NCBI GI: 29788869 NCBI Desc: cyclin h-1 [oryza sativa (japonica cultivar-group)]
  misc_feature (1)..(215): NCBI GI: 53771899 NCBI Desc: cyclin h-1 [zea mays]
  misc_feature (1)..(327): NCBI GI: 4106515 NCBI Desc: cak associated cyclinh homolog [populus tremula x populus tremuloides]
MADFRTSTQRERWIFQPHDLMERWAAANQRAVQTLAQYGTTRLSVDLLDGSVSYPEPAPDHVEGSSGIKPLSYEEEQLTRVFYEQKIQEVCAAFKFPHKIQATAIIYFKRFYLQWSVMEHHPKHIMLTCVYASCKVEENHVSAEELGKGIQQDHQIILNNEMILLKTLDFDLIVYAPYRSIEGFIDDLEDFCRVGNGPFQRLKELRQAAVSHVDKMMLTDAPLLYTPGQLALAALHKSNDLLRVVNFERYLETIFSRQHSDCPVEQFVQSINTINYLVDQLNIPTVKDLRHVDRKLKHCWDPSSHDEHKKKEKKSKHKSKRTSTDAQL

SEQ ID NO: 31 - DNA, 654 bp, Sorghum bicolor
  misc_feature: Ceres ANNOT ID no. 6003916
  misc_feature: Encodes the peptide sequence at SEQ ID NO 32
atgggagctttctgttcatgtctgcaacctgattattctgaccaccatggaaattcttcggcgtttaggaactgcatgtgcctcagatgctttacccagcagctgatcaatgcgtacactgttttgttccgagctggagcagtgcattctgtttctccagctattgaagccactcctgttgacacaagtgaaagttccttcgatacatatcgttcaccgccaagacctctgccctatgatgatccacgattttcccctcctgctcgtgattggctaaggcgtgagagcccaagccattccccagaggaatcagaaccacttagatcaaatgatgttgatgaggaaatggaaacacctagtagaatagacaaggcaagtaaaacaaactacaacacaaaaatgaaaatttgcagctctgcttatggagataaggttccgccaaaggaacatggaaattacttcagctatttttccccatctgctgaagatgaagatgtctgcccaacatgtcttgaagattatgattctgagaatcctaagatagtaatgcagtgctcacaccatttccaccttggctgtatttatgagtggatggaaagaagtgaggcatgccctgtctgtggaaagaagatggagtttgacgagacaacataa

SEQ ID NO: 32 - protein, 217 aa, Sorghum bicolor
  misc_feature: Ceres ANNOT ID no. 6003916
  misc_feature (167)..(207): Pfam Id: zf-C3HC4 Pfam Desc: Zinc finger, C3HC4 type (RING finger)
  misc_feature (1)..(216): NCBI GI: 92885424 NCBI Desc: zinc finger, ring-type; ringv [medicago truncatula]
  misc_feature (1)..(216): NCBI GI: 57900128 NCBI Desc: zinc finger (c3hc4-type ring finger) protein-like [oryza sativa (japonica cultivar-group)]
  misc_feature (50)..(216): NCBI GI: 23505815 NCBI Desc: at5g41350/myc6_6 [arabidopsis thaliana]
  misc_feature (162)..(215): NCBI GI: 42572783 NCBI Desc: zinc finger (c3hc4-type ring finger) family protein [arabidopsis thaliana]
  misc_feature (162)..(215): NCBI GI: 21593116 NCBI Desc: ring-h2 finger protein rhb1a [arabidopsis thaliana]
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 329 in the 11/188,298 US application
  misc_feature: The sequence is a functional homolog of SEQ ID NO. 350 in the 11/188,298 US application
  misc_feature: The sequence is a functional homolog of SEQ ID NO. 468 in the 11/188,298 US application
MGAFCSCLQPDYSDHHGNSSAFRNCMCLRCFTQQLINAYTVLFRAGAVHSVSPAIEATPVDTSESSFDTYRSPPRPLPYDDPRFSPPARDWLRRESPSHSPEESEPLRSNDVDEEMETPSRIDKASKTNYNTKMKICSSAYGDKVPPKEHGNYFSYFSPSAEDEDVCPTCLEDYDSENPKIVMQCSHHFHLGCIYEWMERSEACPVCGKKMEFDETT

SEQ ID NO: 33 - DNA, 1206 bp, Sorghum bicolor
  misc_feature: Ceres ANNOT ID no. 6003934
  misc_feature: Encodes the peptide sequence at SEQ ID NO 34
atggccagcagcggcacgaacgccaccggcgacgggacggtgccgcagccaccgccgtcgcaggggaggctcatcaccgttctgagcatcgatggcggcggcatccgggggctcatccctgccaccatcatcacctgcctcgagaccaagctccaggagctggacgggccggacgcacgcatcgccgactacttcgacgtgatcgccgggacgagcaccggcgcgctgctgacgtcgatgctggcggcgcccgacgagaacaggcggccgctgttcgccgccaaggacctcaccaccttctacctcgagaacggccccaacatcttcccacagagaaaggtggggtggctgacgccggtggcgaacctgatcggcacgatgaggggtcccaagtacgacggcgtgttcctgcacgacaagatcaagagcctgacgcacgacgtgcggatcgcggacacggtcaccaacatcgtggtgccggcgttcgacgtcaagtacctgcagccgatcatcttctccacgtacgaggccaagaccgacgcgctgaagaacgcgcacctctccgacatctgcatcagcacgtcggcggcgccgacctacttcccggcgcactacttcacgacggagcccgccgggcccggcgacgcgcgcccgccgcgggagtaccacctcgtcgacggcggcgtggcggccaacaaccccaccatgatcgccatgtccatgctcacaaaggaggtgctccgcgggaacccggacttcaaccccggtaagcccaccgagtaccggaactacctcgtcatctccgtcgggacagggtccgccaagtctcgccgagaagtacaccgcgccgcaggcgggttcacccccatcatcgacatcttctcgcacgccagcgccgacatggtcgacatccatgccgccgtgctcttcgaggccctccattgcgagaagaattacctccgcattcaggacgattctctgacgggccatgcgtcgtcggtggacatcgcgacgaaggagaacatggaggcactgattgggatcgggaagaagcttctgaagaagccggtggcgagagtgaacatcgacacggggatgtacgagcccgtcgccggcgagggcacaaacgaggacgcgcttgcgcgcttcgccaagatgctctccgacgagcggaggctacgccaggccaacctcaactcctactag

SEQ ID NO: 34 - protein, 401 aa, Sorghum bicolor
  misc_feature: Ceres ANNOT ID no. 6003934
  misc_feature (28)..(239): Pfam Id: Patatin Pfam Desc: Patatin-like phospholipase
  misc_feature (110)..(401): NCBI GI: 4539656 NCBI Desc: patatin-like protein [sorghum bicolor]
  misc_feature (1)..(401): NCBI GI: 4539677 NCBI Desc: patatin-like protein [sorghum bicolor]
  misc_feature (18)..(396): NCBI GI: 9794868 NCBI Desc: patatin-like protein 1 [nicotiana tabacum]
  misc_feature (113)..(398): NCBI GI: 4539676 NCBI Desc: patatin-like protein [sorghum bicolor]
  misc_feature (15)..(394): NCBI GI: 62766606 NCBI Desc: patatin-like protein [gossypium hirsutum]
  misc_feature: Useful for making plants with modulated heat sensitivity
  misc_feature: Functional homolog of the protein sequence given in SEQ ID NO 13256
MASSGTNATGDGTVPQPPPSQGRLITVLSIDGGGIRGLIPATIITCLETKLQELDGPDARIADYFDVIAGTSTGALLTSMLAAPDENRRPLFAAKDLTTFYLENGPNIFPQRKVGWLTPVANLIGTMRGPKYDGVFLHDKIKSLTHDVRIADTVTNIVVPAFDVKYLQPIIFSTYEAKTDALKNAHLSDICISTSAAPTYFPAHYFTTEPAGPGDARPPREYHLVDGGVAANNPTMIAMSMLTKEVLRGNPDFNPGKPTEYRNYLVISVGTGSAKSRREVHRAAGGFTPIIDIFSHASADMVDIHAAVLFEALHCEKNYLRIQDDSLTGHASSVDIATKENMEALIGIGKKLLKKPVARVNIDTGMYEPVAGEGTNEDALARFAKMLSDERRLRQANLNSY

SEQ ID NO: 35 - DNA, 492 bp, Sorghum bicolor
  misc_feature: Ceres ANNOT ID no. 6003957
  misc_feature: Encodes the peptide sequence at SEQ ID NO 36
atggaaagagtagatgaccgccaaatcaagctgcagcagcagcaacaaccgccatgcagtgacaacaacttcagcttggccgccgccgcctcctccttctcatggccgccgccacaggtaaggtcttcgccgttgtcgtcgtcctacacctgcgggtactgcaagaaggagttcaggtcagcacaagggctgggaggccacatgaacgtccacaggttggacagggccaagctgatccaccagcagacatttcttgatcttgggctcagcttgtcgtcgctgctagcgcgcggcggcgctgccggcggcgatatcgatggaggcggcttgcctgttccattagaaaagcagctgggcgaccgtttctccttggcatcgtccgccgcgactaatgactactactccgaggggaagaacttggagttgaggatgggagcgtgcagtcatggcggcgatggatgtctggatcttcagcttagactgtgctactag

SEQ ID NO: 36 - protein, 163 aa, Sorghum bicolor
  misc_feature: Ceres ANNOT ID no. 6003957
  misc_feature (49)..(71): Pfam Id: zf-C2H2 Pfam Desc: Zinc finger, C2H2 type
  misc_feature (8)..(153): NCBI GI: 62865694 NCBI Desc: ramosa1 c2h2 zinc-finger transcription factor [sorghum bicolor]
  misc_feature (1)..(163): NCBI GI: 62865696 NCBI Desc: ramosa1 c2h2 zinc-finger transcription factor [miscanthus sinensis]
  misc_feature (1)..(163): NCBI GI: 62865692 NCBI Desc: ramosa1 c2h2 zinc-finger transcription factor [tripsacum dactyloides]
  misc_feature (1)..(163): NCBI GI: 64175646 NCBI Desc: ramosa 1 [zea mays]
  misc_feature (1)..(163): NCBI GI: 64175632 NCBI Desc: ramosa 1 [zea mays]
  misc_feature: The plant is abnormally small.
  misc_feature: The plant produces a reduced number of seeds.
  misc_feature: The sequence is a functional homolog of SEQ ID NO 836 in the 11/435,388US patent application
  misc_feature: Useful for biocontainment applications
  misc_feature: Useful for making plants with modulated biomass
  misc_feature: Useful for making plants with modulated growth and phenotype characteristics
  misc_feature: Functional homolog of the protein sequence given in SEQ ID NO 12998
  misc_feature: Functional homolog of the protein sequence given in SEQ ID NO 13411
  misc_feature: The sequence is a functional homolog of SEQ ID NO 836 in the 20060272060 US patent application
  misc_feature: Functional homolog of the protein sequence given in SEQ ID NO 13581
  misc_feature: The sequence is a functional homolog of SEQ ID NO. 457 in the 11/188,298 US application
MERVDDRQIKLQQQQQPPCSDNNFSLAAAASSFSWPPPQVRSSPLSSSYTCGYCKKEFRSAQGLGGHMNVHRLDRAKLIHQQTFLDLGLSLSSLLARGGAAGGDIDGGGLPVPLEKQLGDRFSLASSAATNDYYSEGKNLELRMGACSHGGDGCLDLQLRLCY

SEQ ID NO: 37 - DNA, 1380 bp, Sorghum bicolor
  misc_feature: Ceres ANNOT ID no. 6003962
  misc_feature: Encodes the peptide sequence at SEQ ID NO 38
atggcgtctctgatttccccctacctctccgtccccaccgcccccgggcacgcgcgccttgctgctccggcggcgccgcggcggcggaggatggcggtggtgagggcgaagattcgggagatattcatgccggctctgagctcgacgatgacggagggcaagatcgtctcctggacggcagccgagggggaccgcgtggccaagggcgaccccgtggtggtcgtcgagtccgacaaggccgacatggacgtggagacgttccacgacggcatagtcgcagtcgtcctcgtcccggccggtgagaccgcccccgtaggcgcccctatcgccctcctcgccgagtcagaggaggaggtcgcgctggcgcgggcgcgcgctcaggccctctcgcagggacaaagccaggaaccctctcctccccatgccgccgccgcccccgtctcggggacacctcctccagcgcctgtggcggctccagtgacaaagggcatcgcgacaccttacgccaagaaggtcgcgaagcagcacagggtggacatcgccggggttgtcggcaccgggccacacggccgcgtcacggcggctgacgtcgaggcagctgctggcatcaagcacaagcgaaaggtcgcgccccctccacctccaccccctgctgctgttggccctgcgccaccaatgcccgcaagtgcggtgctgccaccagtgcccggtggcacggtggtgccgttcacgacaatgcaggcggcggtgagcaggaacatggtggacagcttgagtgtgccaacgttccgggttggctactccatgatcactgacaagcttgacgcactctatgaaaaggtcaagtcgaagggggttaccaagacagtgctgctggtgaaggcggcagctgtggcgctcacccagcaccctgtagtaaatgctagctgcagagatggaaagagcttctcctacaataacagtgtcaacattggagtggctgttgcactcgagggtggccttcttactccagtattggaggatgctgataagctggatatatatctgcttgcgcaaaagtggagagtgctgctcaagaaggcacgcatgaagcagctgcaaccaaatgaatacaactctgggacatttacactatccaatttgggtatgtttggggtggataaattcgatgcaatccttccagctggtcagggggctatcatggctgttggagcatcaagaccaactgtagtggctgacaaggatggtttctttagtatcaagagtgaaatgctggtgaatgttactgctgatcacaggattatctatggtgctgatttggcagcattcctgcaaacatttgcaaagattgttgaggatcctgaaagcctcacattgtaa

SEQ ID NO: 38 - protein, 459 aa, Sorghum bicolor
  misc_feature: Ceres ANNOT ID no. 6003962
  misc_feature (235)..(459): Pfam Id: 2-oxoacid_dh Pfam Desc: 2-oxoacid dehydrogenases acyltransferase (catalytic domain)
  misc_feature (39)..(112): Pfam Id: Biotin_lipoyl Pfam Desc: Biotin-requiring enzyme
  misc_feature (161)..(199): Pfam Id: E3_binding Pfam Desc: e3 binding domain
  misc_feature (34)..(459): NCBI GI: 9279589 NCBI Desc: dihydrolipoamide s-acetyltransferase [arabidopsis thaliana]
  misc_feature (20)..(458): NCBI GI: 115487664 NCBI Desc: os12g0182200 [oryza sativa (japonica cultivar-group)]
  misc_feature (1)..(458): NCBI GI: 8778253 NCBI Desc: f12k21.24 [arabidopsis thaliana]
  misc_feature (38)..(459): NCBI GI: 22298842 NCBI Desc: dihydrolipoamide s-acetyltransferase [thermosynechococcus elongatus bp-1]
  misc_feature (38)..(459): NCBI GI: 75909383 NCBI Desc: biotin/lipoyl attachment [anabaena variabilis atcc 29413]
MASLISPYLSVPTAPGHARLAAPAAPRRRRMAVVRAKIREIFMPALSSTMTEGKIVSWTAAEGDRVAKGDPVVVVESDKADMDVETFHDGIVAVVLVPAGETAPVGAPIALLAESEEEVALARARAQALSQGQSQEPSPPHAAAAPVSGTPPPAPVAAPVTKGIATPYAKKVAKQHRVDIAGVVGTGPHGRVTAADVEAAAGIKHKRKVAPPPPPPPAAVGPAPPMPASAVLPPVPGGTVVPFTTMQAAVSRNMVDSLSVPTFRVGYSMITDKLDALYEKVKSKGVTKTVLLVKAAAVALTQHPVVNASCRDGKSFSYNNSVNIGVAVALEGGLLTPVLEDADKLDIYLLAQKWRVLLKKARMKQLQPNEYNSGTFTLSNLGMFGVDKFDAILPAGQGAIMAVGASRPTVVADKDGFFSIKSEMLVNVTADHRIIYGADLAAFLQTFAKIVEDPESLTL

SEQ ID NO: 39 - DNA, 1350 bp, Sorghum bicolor
  misc_feature: Ceres ANNOT ID no. 6003974
  misc_feature: Encodes the peptide sequence at SEQ ID NO 40
atggagctgatgacgttgctgacgctgccgctgctggcgtgcttggcggcgatgctagcgcggctgctggtggcgcgcgcgcagcggcgtcggtgctacctgctggactacgtctgctacaaggcgacggacgaccgcaagctgccgacggacctgtgcggcgagatcatccagcggaaccagctgctggggctggaggagtacaagttcctgctcaaggtgatcgccaactccggcatcggcgaggagacgtacggcccgcgcaacatgatcgagggcggggaggcccggcccgaccgcctccgggagggcatggaggagatggacgagaccttccacgccgtcctcgacgagctcttcgcccggtccgcggcgccggggggcgtcggcatccgacccgccgacgtcgacgtcctcgtcgtcaacgtgtccatgttctcgccggcgccgtcgctgtcggcgcgcgtcgtgcgccgctacggcctccgcgaggacgtcaaggtgtacaacctcacgggcatggggtgcagcgccacgctcatcgcgcttgacctcgtcaacagattcttcagtacgcgcgcgggtcaggtggctctggtgatgacgtcggagtcgatcgcgcccaactggtacgccggcaacaagaagtccttcatgctgggcaactgcctcttccgctccggcggctgcgcctacttcctcagcaacgacccgcgcctccggtcacacgccaagctccggctccgccacgtgatggaggacgacgccggccgccccgggttccacctgggcaaggagctgccgcgcgccgccgtgcacgccttcatccacaacctccgcgtgctggctcccaaggtgctcccactcccggagctgctccgcctcacctgcgccaccttctccgcgcgcctcgcgcgcaagcgcggctacaagtcgtccaaccacctcaccatccgcatgaaggccggcgtcgaccacttctgcgtccacaccggcggcgccgccgtcatcgacggcgtgggcaaggggctcacgctcacggagcacgacctggagccctcgcgcatgacgctgcaccgcttcggcaacacctccgccagcagcgtctggtacgtgctcagctacatggaggctcagggacgcctgcgcaagggcgaccgcgtgctcatggtcaccttcggcgccggcttcaagtgcaacagctgcatctggaccgtcgagaaccccgccaccgacgccggcgtctggaaggaccgcatccacctctacccgctcaaggacgtctccaacccattcatggagaagtatggcttcctcaaggacctgaccatcgatggaccgatgatgtga

SEQ ID NO: 40 - protein, 449 aa, Sorghum bicolor
  misc_feature: Ceres ANNOT ID no. 6003974
  misc_feature (25)..(308): Pfam Id: FAE1_CUT1_RppA Pfam Desc: FAE1/Type III polyketide synthase-like protein
  misc_feature (320)..(406): Pfam Id: ACP_syn_III_C Pfam Desc: 3-Oxoacyl-[acyl-carrier-protein (ACP)] synthase III C terminal
  misc_feature (1)..(257): NCBI GI: 92877047 NCBI Desc: chalcone and stilbene synthases, n-terminal [medicago truncatula]
  misc_feature (1)..(257): NCBI GI: 92877056 NCBI Desc: chalcone and stilbene synthases, n-terminal [medicago truncatula]
  misc_feature (1)..(276): NCBI GI: 92877054 NCBI Desc: probable fatty acid elongase [imported] - arabidopsis thaliana [medicago truncatula]
  misc_feature (3)..(273): NCBI GI: 114149943 NCBI Desc: 3-ketoacyl-coa synthase 3 (kcs-3) (very-long-chain fatty acid condensing enzyme 3) (vlcfa condensing enzyme 3)
  misc_feature (1)..(256): NCBI GI: 140054927 NCBI Desc: chalcone and stilbene synthases, c-terminal; very-long-chain 3-ketoacyl-coa synthase [medicago truncatula]
MELMTLLTLPLLACLAAMLARLLVARAQRRRCYLLDYVCYKATDDRKLPTDLCGEIIQRNQLLGLEEYKFLLKVIANSGIGEETYGPRNMIEGGEARPDRLREGMEEMDETFHAVLDELFARSAAPGGVGIRPADVDVLVVNVSMFSPAPSLSARVVRRYGLREDVKVYNLTGMGCSATLIALDLVNRFFSTRAGQVALVMTSESIAPNWYAGNKKSFMLGNCLFRSGGCAYFLSNDPRLRSHAKLRLRHVMEDDAGRPGFHLGKELPRAAVHAFIHNLRVLAPKVLPLPELLRLTCATFSARLARKRGYKSSNHLTIRMKAGVDHFCVHTGGAAVIDGVGKGLTLTEHDLEPSRMTLHRFGNTSASSVWYVLSYMEAQGRLRKGDRVLMVTFGAGFKCNSCIWTVENPATDAGVWKDRIHLYPLKDVSNPFMEKYGFLKDLTIDGPMM

SEQ ID NO: 41 - DNA, 1362 bp, Sorghum bicolor
  misc_feature: Ceres ANNOT ID no. 6004016
  misc_feature: Encodes the peptide sequence at SEQ ID NO 42
  misc_feature: Down-regulated in shoot tissues in response to salicylic acid treatment
atggagtcggaccagggcaagctcttcatcggcggcatctcctgggaaacgacggaggagaagctgagcgagcacttctccgcctacggcgaggttacgcaggcggccgtcatgcgcgacaagatcaccggccgcccccgcggcttcgggttcgtcgtcttcgccgaccccgccgtcgtcgaccgagcgctgcaggacccccacaccctcgacggccgcacggtcgatgtgaagcgggcactctcgcgggaggagcagcaggcctccaaggccgcgaaccctagcggtgggaggaacactggcggtgctggaggaggaggaggaggcggtgccggcgatgcaagtggtgctcggaccaagaagatctttgtgggcgggctgccctctactctgactgaggatgggtttcggcagtacttccagaccttcggcagcgtcactgacgttgttgtcatgtatgaccagaacacgcagcgcccgcgtggcttcggattcatcacctttgactcggaggacgcagttgaccgtgtgctgcacaagaccttccatgatcttggtgggaagctggttgaggtgaagcgtgcattgccccgtgaggcgaaccctggtggctctagtggtgggcgttctgggggaagtgggggttatcagagcaacaatggccataacaccagctctggtagctatgatggtagaagtgatggtggcaggtatgggcaggcccagcagggcagtggtggctatcctggctacggtgcaggaggctatggtgctggggcagctggatatggatatggtgctaaccctgcagttggatatggaaattatggagctggaggatatggaggtgttcctgctgcttatggtggacattatggaaacccaggtgctgctggttctggttaccaaggtggacctccaggctcaaatagaggaccttggggcagtcaagctccatctgcatatggaactggagggtacggtagcagtgctggctatagtgcttggaacaactcttctggtggtggcaatgctcccagtagtcaagctcctggtggacctgcaggctatggaagccagggctatgggtatggtggatatggaggggatccatcgtacgctagtcatggaggatatggggcttatggaggacgtagtgatggtgctggcaatcctgctactggtggagcatctggatacagtgcaggctatggaagtgggggcgccaactctggctattcaagtgcttggagtgatccttcacaaggtggtggatttggcggttcagttaatggaggtgctgaagggcaatcaaattatggcactggctatggcagtgtgcagcccagggttgctcagtaa

SEQ ID NO: 42 - protein, 453 aa, Sorghum bicolor
  misc_feature: Ceres ANNOT ID no. 6004016
  misc_feature (8)..(77): Pfam Id: RRM_1 Pfam Desc: RNA recognition motif. (a.k.a. RRM, RBD, or RNP domain)
  misc_feature (122)..(192): Pfam Id: RRM_1 Pfam Desc: RNA recognition motif. (a.k.a. RRM, RBD, or RNP domain)
  misc_feature (1)..(437): NCBI GI: 7268135 NCBI Desc: ribonucleoprotein like protein [arabidopsis thaliana]
  misc_feature (3)..(442): NCBI GI: 7269517 NCBI Desc: hnrnp-like protein [arabidopsis thaliana]
  misc_feature (3)..(444): NCBI GI: 20453245 NCBI Desc: at4g26650/t15n24_100 [arabidopsis thaliana]
  misc_feature (3)..(444): NCBI GI: 79325275 NCBI Desc: rna binding / nucleic acid binding [arabidopsis thaliana]
  misc_feature (1)..(441): NCBI GI: 30696616 NCBI Desc: rna recognition motif (rrm)-containing protein [arabidopsis thaliana]
  misc_feature: Down-regulated in shoot tissues in response to salicylic acid treatment
  misc_feature: The sequence is a functional homolog of SEQ ID NO. 339 in the 11/188,298 US application
  misc_feature: The sequence is a functional homolog of SEQ ID NO. 458 in the 11/188,298 US application
MESDQGKLFIGGISWETTEEKLSEHFSAYGEVTQAAVMRDKITGRPRGFGFVVFADPAVVDRALQDPHTLDGRTVDVKRALSREEQQASKAANPSGGRNTGGAGGGGGGGAGDASGARTKKIFVGGLPSTLTEDGFRQYFQTFGSVTDVVVMYDQNTQRPRGFGFITFDSEDAVDRVLHKTFHDLGGKLVEVKRALPREANPGGSSGGRSGGSGGYQSNNGHNTSSGSYDGRSDGGRYGQAQQGSGGYPGYGAGGYGAGAAGYGYGANPAVGYGNYGAGGYGGVPAAYGGHYGNPGAAGSGYQGGPPGSNRGPWGSQAPSAYGTGGYGSSAGYSAWNNSSGGGNAPSSQAPGGPAGYGSQGYGYGGYGGDPSYASHGGYGAYGGRSDGAGNPATGGASGYSAGYGSGGANSGYSSAWSDPSQGGGFGGSVNGGAEGQSNYGTGYGSVQPRVAQ

SEQ ID NO: 43 - DNA, 228 bp, Sorghum bicolor
  misc_feature: Ceres ANNOT ID no. 6004020
  misc_feature: Encodes the peptide sequence at SEQ ID NO 44
atggcggagaggctagaggcggcggcgccggccgctgccgacgagtacacgcaggacggcacggtggacctccatggcaacccggtgctccgctccaagcgaggagggtggaaagcctgcggcttcgtcgtaggtacgcaagcagctagcgacccctacatatcacgaattcatccttatactcctgccatggtttgtgttttctcgagctcctcaaagctaagctag

SEQ ID NO: 44 - protein, 75 aa, Sorghum bicolor
  misc_feature: Ceres ANNOT ID no. 6004020
  misc_feature (14)..(44): NCBI GI: 23297791 NCBI Desc: peptide transporter [arabidopsis thaliana]
  misc_feature (12)..(48): NCBI GI: 92881089 NCBI Desc: tgf-beta receptor, type i/ii extracellular region [medicago truncatula]
  misc_feature (14)..(44): NCBI GI: 9757724 NCBI Desc: peptide transporter [arabidopsis thaliana]
  misc_feature (10)..(47): NCBI GI: 115469842 NCBI Desc: os06g0705900 [oryza sativa (japonica cultivar-group)]
  misc_feature (16)..(47): NCBI GI: 4102839 NCBI Desc: leopt1 [lycopersicon esculentum]
MAERLEAAAPAAADEYTQDGTVDLHGNPVLRSKRGGWKACGFVVGTQAASDPYISRIHPYTPAMVCVFSSSSKLS

SEQ ID NO: 45 - DNA, 1185 bp, Sorghum bicolor
  misc_feature: Ceres ANNOT ID no. 6004045
  misc_feature: Encodes the peptide sequence at SEQ ID NO 46
atgctgttccaggtgggagggcagggcgcgcggcccaccttcttcgagatgtccgccgcgcagcagctgcccgccagcctccgcgccgccctcacctactcgctcggggtttttgcgctaagaagaccattactacacaaagttttagattacgaagacgaattctttgctttgttaatgggcgtccttgagtcccatagtctacggacaacagatggttccttttcagagtcattatatggcctcaggaggagacctgttaaggtttcagtgaagagaaaaggtcctggtacagaatccagtgacaaagtctatgattctgcactaaggaagcgccagaaaatcctttcggttgtttttttggttgttttgccatattttaagtcaaagttgcagtctatatataacaaagaaagggaagccaggttgcaggcaaccctttggggtcaggatgatgttagatttgatgaagctggctttgtattagatcaggagcagacttctcaatcacagactgaacctacaactggagaagtgtcaaatttgacacgttttaaaaagaattttgtctcacttataggtgtttgctatccatggattcatgcaactaatgaaggtctctcatttgcataccagctcttgtatctgttggatgctactggattttatagtccagcactgcatgtgcttgggcttcatgtttgtcgtgctactggacaagagctgatggaatcatcttctaggatatcaaggattagaaatcgtgaacttgagagacttcgtggtcctccatggttcaaggctgtgcaacgagtgttccttagttgtgtgtacacaactctagattatgcacaaaccggtttaattgctgcagtcttctttttcaagatgatggagtggtggtatcaatctgctgaagaaagaatgtcagctccaactgtatatccgccaccgccccctcctccaactccgaaggttgccaaagacgggattcccttgccacctgacaggacgctctgccccctttgctgccagaagcgtgctaatccctctgttctttctgtttctggttttgttttttgctacagctgcatattcaaatctgtctctcagcataaaaggtgccctgtcacactaatgcctgccagtgttgagcaaatcaggcgtctcttccacgatttctag

SEQ ID NO: 46 - protein, 394 aa, Sorghum bicolor
  misc_feature: Ceres ANNOT ID no. 6004045
  misc_feature (16)..(305): Pfam Id: Pex2_Pex12 Pfam Desc: Pex2 / Pex12 amino terminal region
  misc_feature (1)..(393): NCBI GI: 42563493 NCBI Desc: pex2/pex12 n-terminal domain-containing protein [arabidopsis thaliana]
  misc_feature (169)..(393): NCBI GI: 92873050 NCBI Desc: zinc finger, ring-type; pex2 / pex12, n-terminal [medicago truncatula]
  misc_feature (183)..(391): NCBI GI: 119600549 NCBI Desc: peroxisomal biogenesis factor 12 [homo sapiens]
  misc_feature (183)..(391): NCBI GI: 123994893 NCBI Desc: peroxisomal biogenesis factor 12 [synthetic construct]
  misc_feature (187)..(391): NCBI GI: 16758802 NCBI Desc: peroxisomal biogenesis factor 12 [rattus norvegicus]
MLFQVGGQGARPTFFEMSAAQQLPASLRAALTYSLGVFALRRPLLHKVLDYEDEFFALLMGVLESHSLRTTDGSFSESLYGLRRRPVKVSVKRKGPGTESSDKVYDSALRKRQKILSVVFLVVLPYFKSKLQSIYNKEREARLQATLWGQDDVRFDEAGFVLDQEQTSQSQTEPTTGEVSNLTRFKKNFVSLIGVCYPWIHATNEGLSFAYQLLYLLDATGFYSPALHVLGLHVCRATGQELMESSSRISRIRNRELERLRGPPWFKAVQRVFLSCVYTTLDYAQTGLIAAVFFFKMMEWWYQSAEERMSAPTVYPPPPPPPTPKVAKDGIPLPPDRTLCPLCCQKRANPSVLSVSGFVFCYSCIFKSVSQHKRCPVTLMPASVEQIRRLFHDF

SEQ ID NO: 47 - DNA, 1587 bp, Sorghum bicolor
  misc_feature: Ceres ANNOT ID no. 6004069
  misc_feature: Encodes the peptide sequence at SEQ ID NO 48
atgatctgcgcgatctccggcgaggtgccggacgagccggtggtgtcgaagaagtcggggctcctcttcgagcggcggctcatcgagcgctatgttgaggaccatggcaagtgtcccgtcaccaaggaggacctcaccatggatgatatcgtgccggtcaagaccaacaaggtcgtgaagcccaggcctttgcaggctgcaagcattccgggactccttgggatttttcagaatgagtgggatgctctcatgctttctaattttgctttggagcagcagcttcacacagcaagacaagaacttagtcatgcgctctaccagcatgacgctgcctgccgtgttatagccagattaaagaaggaaagggatgaggctagagcacttttggctctagctgagagacagattcctgcatcagttccaggagctgctcctgtagctgttgtttccaatggaaaaagagcaatggaagatgaaattggccctgacgggaagaagattcgtcctggtatcaaccctgtcatgattgatgaacttacagagtgtaataccatgctttcagcacagcgtaagaaaagacagattacatgttctccaactctggcaccgatcgatgcactcgagagatacactcaaatctccagccatccccttcataagacaaacaaaccaggcattttgtccatggatattcatccttcaaaggacattgttgcaactgggggtatcgatacaaatgcagtactctttgatcgggcatctggtcaaatcttgtgcacgcttactggtcactcgaagaagataaccactttgaagtttgttccacgggatcaactctttgtaactggatcagcagataagactgttcgcatttggcaggagaatgagaatgggagctataactgcgttcatacattgaaagaccatactgctgaggttgaggctgttacagtacatgcaactcagaagtattttgtgagtgcttccaaggataactcgtggtgcttctatgatatgtcaacaggatcttgcctgacacaggttggcgaggcttcaggacaagagggatatacatccgcggctttccatccagatggtcttatccttggaacaggaactactgatgctgttgcgaaaatttgggatgtgaagactcagtcaaatgttgcaaagtttgaggggcatgttggaccagtcactgctatgtctttctctgaaaatggttacttcctagcgactgctgctcatgatggtgtcaagctttgggatcttcggaaattgagaaattttaggaccttctctccctatgattcggacacgccaaccaatacggtggaatttgattttagcggaaactatcttgccattggtggttcagatataagggtctaccaagtagctaatgttaagagcgaatggaatcttatcaagacattacctgatttatcaggaacagggaaagtaacttccgtaaagttcggagcagatgctaagtacattgctgtaggttctatggaccgcaatctgcggatatttggcctccctggagatgaccaaatggaggaatcaaacacagcggccgagtga

SEQ ID NO: 48 - protein, 528 aa, Sorghum bicolor
  misc_feature: Ceres ANNOT ID no. 6004069
  misc_feature (255)..(293): Pfam Id: WD40 Pfam Desc: WD domain, G-beta repeat
  misc_feature (300)..(338): Pfam Id: WD40 Pfam Desc: WD domain, G-beta repeat
  misc_feature (386)..(423): Pfam Id: WD40 Pfam Desc: WD domain, G-beta repeat
  misc_feature (64)..(133): Pfam Id: Prp19 Pfam Desc: Prp19/Pso4-like
  misc_feature (1)..(523): NCBI GI: 79316596 NCBI Desc: nucleotide binding / ubiquitin-protein ligase [arabidopsis thaliana]
  misc_feature (1)..(508): NCBI GI: 30685651 NCBI Desc: transducin family protein / wd-40 repeat family protein [arabidopsis thaliana]
  misc_feature (1)..(508): NCBI GI: 30685653 NCBI Desc: transducin family protein / wd-40 repeat family protein [arabidopsis thaliana]
  misc_feature (1)..(488): NCBI GI: 79324134 NCBI Desc: nucleotide binding / ubiquitin-protein ligase [arabidopsis thaliana]
  misc_feature (1)..(514): NCBI GI: 41393099 NCBI Desc: prp19/pso4 homolog [danio rerio]
  misc_feature: The sequence is a functional homolog of SEQ ID NO. 502 in the 11/188,298 US application
  misc_feature: The sequence is a functional homolog of SEQ ID NO. 485 in the 11/188,298 US application
  misc_feature: The sequence is a functional homolog of SEQ ID NO. 308 in the 11/188,298 US application
  misc_feature: The sequence is a functional homolog of SEQ ID NO. 309 in the 11/188,298 US application
MICAISGEVPDEPVVSKKSGLLFERRLIERYVEDHGKCPVTKEDLTMDDIVPVKTNKVVKPRPLQAASIPGLLGIFQNEWDALMLSNFALEQQLHTARQELSHALYQHDAACRVIARLKKERDEARALLALAERQIPASVPGAAPVAVVSNGKRAMEDEIGPDGKKIRPGINPVMIDELTECNTMLSAQRKKRQITCSPTLAPIDALERYTQISSHPLHKTNKPGILSMDIHPSKDIVATGGIDTNAVLFDRASGQILCTLTGHSKKITTLKFVPRDQLFVTGSADKTVRIWQENENGSYNCVHTLKDHTAEVEAVTVHATQKYFVSASKDNSWCFYDMSTGSCLTQVGEASGQEGYTSAAFHPDGLILGTGTTDAVAKIWDVKTQSNVAKFEGHVGPVTAMSFSENGYFLATAAHDGVKLWDLRKLRNFRTFSPYDSDTPTNTVEFDFSGNYLAIGGSDIRVYQVANVKSEWNLIKTLPDLSGTGKVTSVKFGADAKYIAVGSMDRNLRIFGLPGDDQMEESNTAAE

SEQ ID NO: 49 - DNA, 465 bp, Sorghum bicolor
  misc_feature: Ceres ANNOT ID no. 6004070
  misc_feature: Encodes the peptide sequence at SEQ ID NO 50
atggcaactctgaaagatgcagcagcaaggaagcctgtactggcaacaatccgtcttattgtcccagctggtgcagcccgtcctgcacctccagttggcccagcacttggtttctatcggctcaatttgatggctttctgcaaggatttcaatgccaggacccagaaatacaaggcagacactccaatgcaagtcaccttgactgcctacaaggatagcaccttcgagtttgtggtcaagtcgccctcagtatcatggttcctcaagaaggctgcaggaatagaaactgccagcagtcgcccagggcacagcaatgtgtcatccctcactctgcgccacgtgtatgagattgcaaagttgaagcaggctgaccccttctgcaagcacatgtcgcttgaggcactgtgcaagtccatcattggcacagccaactccatgggtattgcaattgttaaagatctatga

SEQ ID NO: 50 - protein, 154 aa, Sorghum bicolor
  misc_feature: Ceres ANNOT ID no. 6004070
  misc_feature (80)..(150): Pfam Id: Ribosomal_L11 Pfam Desc: Ribosomal protein L11, RNA binding domain
  misc_feature (16)..(75): Pfam Id: Ribosomal_L11_N Pfam Desc: Ribosomal protein L11, N-terminal domain
  misc_feature (1)..(154): NCBI GI: 15823668 NCBI Desc: mitochondrial ribosomal protein l11 [triticum aestivum]
  misc_feature (1)..(154): NCBI GI: 21618064 NCBI Desc: ribosomal protein l11-like protein [arabidopsis thaliana]
  misc_feature (17)..(151): NCBI GI: 19115007 NCBI Desc: probable 50s ribosomal protein l11 [schizosaccharomyces pombe]
  misc_feature (17)..(151): NCBI GI: 6523777 NCBI Desc: spac1486.07c [schizosaccharomyces pombe]
  misc_feature (11)..(152): NCBI GI: 144900869 NCBI Desc: 50s ribosomal protein l11 [magnetospirillum gryphiswaldense msr-1]
MATLKDAAARKPVLATIRLIVPAGAARPAPPVGPALGFYRLNLMAFCKDFNARTQKYKADTPMQVTLTAYKDSTFEFVVKSPSVSWFLKKAAGIETASSRPGHSNVSSLTLRHVYEIAKLKQADPFCKHMSLEALCKSIIGTANSMGIAIVKDL

SEQ ID NO: 51 - DNA, 495 bp, Sorghum bicolor
  misc_feature: Ceres ANNOT ID no. 6004079
  misc_feature: Encodes the peptide sequence at SEQ ID NO 52
atgccggctggccacgggctgcgctcgcggacgcgcgacctcttcgcgcgccccttccgcaagaagggctacatcccgctcaccacctacctccgcacctacaagattggcgactacgtcgacgtcaaggtgaacggcgccgtccacaaggggatgccgcacaagttctaccacggccgcaccggtcgcgtctggaacgtcaccaagcgcgccatcggcgtcgagatcaacaagcaggttaatggtcgcatcatcaggaagcgtatccatgtccgtgtggagcacgtgcagccgtcccgctgcacagaagagttccgcctgaggaaggcaaagaatgatcagctgaaggcggatgccaaggcacgtggtgaggtcatcagcaccaagaggcagccattgggtccgaagcctggattcatggttgagggcgccaccatcgagaccgtcactcccatcccgtacgatgtggtcaatgatctcaagggaggatactag

SEQ ID NO: 52 - protein, 164 aa, Sorghum bicolor
  misc_feature: Ceres ANNOT ID no. 6004079
  misc_feature (2)..(100): Pfam Id: Ribosomal_L21e Pfam Desc: Ribosomal protein L21e
  misc_feature (1)..(164): NCBI GI: 31432571 NCBI Desc: 60s ribosomal protein l21 [oryza sativa (japonica cultivar-group)]
  misc_feature (1)..(164): NCBI GI: 3885884 NCBI Desc: 60s ribosomal protein l21 [oryza sativa]
  misc_feature (1)..(164): NCBI GI: 32400808 NCBI Desc: 60s ribosomal protein l21 [triticum aestivum]
  misc_feature (1)..(164): NCBI GI: 76161012 NCBI Desc: 60s ribosomal protein l21-like protein [solanum tuberosum]
  misc_feature (1)..(157): NCBI GI: 54292803 NCBI Desc: ribosomal protein l21 [helicoverpa zea]
  misc_feature: Useful for making plants with modulated biomass
  misc_feature: Useful for making plants with modulated flowering time
  misc_feature: Useful for making plants with modulated heat sensitivity
  misc_feature: Useful for making plants with modulated phosphate use efficiency
  misc_feature: GREAT-hit functional homolog of the protein sequence given in SEQ ID NO 13434
  misc_feature: GREAT-hit functional homolog of the protein sequence given in SEQ ID NO 13465
  misc_feature: GREAT-hit functional homolog of the protein sequence given in SEQ ID NO 13467
  misc_feature: Useful for making plants with modulated flowering time
  misc_feature: Functional homolog of the protein sequence given in SEQ ID NO 13467
MPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKAKNDQLKADAKARGEVISTKRQPLGPKPGFMVEGATIETVTPIPYDVVNDLKGGY

SEQ ID NO: 53 - DNA, 1644 bp, Sorghum bicolor
  misc_feature: Ceres ANNOT ID no. 6004082
  misc_feature: Encodes the peptide sequence at SEQ ID NO 54
atggccttcaacctggctcagtgcgccaccgctgcggcgtccgtcgcgccccgcacccctcgccctgctaggtccgcggtcgcggcgtccgtgtctgtctccacaaggaaggcggcggacggcaggctgcggctgcagcggcaggcgagctgcgagccgtcggtggcgccgtcgcgttcggtgttctgccgggccgcggtgtcggggaagagcgcggccgaccgggccgcctccaccaggaggaggtccggcgtgccggtgttcgtcatgatgccgctggacaccgtgaagaagtgcggcagcgcgctgaaccgccgcaaggcggtgcaggcgagcctgtccgcgctcaagagcgcgggcgtggagggcatcatggtggacgtgtggtggggcatcgccgagagcgacggccccgggaggtacaacttcgcggggtacatggagctcatggagatggcgcgcaaggccgggctcaaggtgcaggccgtcatgtccttccaccagtgcggcggcaacgtcggcgactccgtcaacatcccgctgccgcggtgggccgtggaggagatggagaaggaccaggacctctgctacaccgaccagtggggccgacgcaactacgagtacgtctccctcggctgcgacgccatgcccgtcctcaagggccgcacccccgtcgagtgctacaccgacttcatgcgcgcgttccgggaccacttcgccgactacctcggcaacaccatcgtggaaatccaggtcggcatgggccccgccggcgagctgcgctacccgtcgtacccggagagcaacggcacctggaagttccccggcatcggcgccttccaatgcaacgacaggcacatgcgtagcagcctgaaggcggcggcggaggcggccggcaagccggagtggggccacggtggccccacggacgctggcggctacaacaactggcccgaggacaccctcttcttccgcgccgacaacggcgggtggagcacccagtacggcgacttcttcctgtcgtggtactcgcagatgctgctggagcacggcgaccgcatcctgtcgggcgccacgtccgtgttcggcgcgtcgtcgcccgtggaggtgtccgtgaaggtggccggcatccactggcactacggcacccggtcgcacgcgccggagctgaccgcggggtactacaacacgcggcaccacgacgggtaccgccccatcgcggacctcctggcccgccacggcgccgtgctcaacttcacctgcgtggagatgcgggaccacgagcagccgcaggaggcgcagtgcatgccggagcacctggtccggcaggtgggcgccgcggcgcgcgcagcgggcgtgggcctcgcgggcgagaacgcgctgcccaggtacgacggcacggcgcacgaccaggtggtagccaccgccgcgcagcgcgccgccgaggaccggatggtggcgttcacgtacctgcgcatggggcccgacctcttccacccggacaactggcagcggttcgccgccttcgtgcgccgcatgaacggcgccgggtcgtgccgggaggccgcggagcgggaggcgcacggcgtcgcgcaggcaaccgggtcgctggtgcacgaggccgccgtcgcgctgcggagctga

SEQ ID NO: 54 - protein, 547 aa, Sorghum bicolor
  misc_feature: Ceres ANNOT ID no. 6004082
  misc_feature (88)..(509): Pfam Id: Glyco_hydro_14 Pfam Desc: Glycosyl hydrolase family 14
  misc_feature (57)..(545): NCBI GI: 68300884 NCBI Desc: beta-amylase 1 [nicotiana langsdorffii x nicotiana sanderae]
  misc_feature (76)..(517): NCBI GI: 15082058 NCBI Desc: beta-amylase pct-bmyi [solanum tuberosum]
  misc_feature (85)..(545): NCBI GI: 140058358 NCBI Desc: glycoside hydrolase, family 14 [medicago truncatula]
  misc_feature (29)..(529): NCBI GI: 59668408 NCBI Desc: beta-amylase [glycine max]
  misc_feature (85)..(530): NCBI GI: 2559006 NCBI Desc: beta-amylase [medicago sativa]
MAFNLAQCATAAASVAPRTPRPARSAVAASVSVSTRKAADGRLRLQRQASCEPSVAPSRSVFCRAAVSGKSAADRAASTRRRSGVPVFVMMPLDTVKKCGSALNRRKAVQASLSALKSAGVEGIMVDVWWGIAESDGPGRYNFAGYMELMEMARKAGLKVQAVMSFHQCGGNVGDSVNIPLPRWAVEEMEKDQDLCYTDQWGRRNYEYVSLGCDAMPVLKGRTPVECYTDFMRAFRDHFADYLGNTIVEIQVGMGPAGELRYPSYPESNGTWKFPGIGAFQCNDRHMRSSLKAAAEAAGKPEWGHGGPTDAGGYNNWPEDTLFFRADNGGWSTQYGDFFLSWYSQMLLEHGDRILSGATSVFGASSPVEVSVKVAGIHWHYGTRSHAPELTAGYYNTRHHDGYRPIADLLARHGAVLNFTCVEMRDHEQPQEAQCMPEHLVRQVGAAARAAGVGLAGENALPRYDGTAHDQVVATAAQRAAEDRMVAFTYLRMGPDLFHPDNWQRFAAFVRRMNGAGSCREAAEREAHGVAQATGSLVHEAAVALRS

SEQ ID NO: 55 - DNA, 1194 bp, Sorghum bicolor
  misc_feature: Ceres ANNOT ID no. 6004097
  misc_feature: Encodes the peptide sequence at SEQ ID NO 56
atgtcagcaccgatgcccatttcccggcttgtttcccatgtcatccttgatttggatggcaccctcttaaacacagattccgttgtaagtaaggtggtaaaaccatttcttgtcaaaaatgggaaaacgtgggacagcaagaaagcttacaaggtagttgggaagacaccttatgaagctgcagctattgttttagaagactatggactcccttactctacagaagagttcctctcaatgattactccagtgttcagtgaacagtggtgcaacataaaagctcttccaggagctactcggctgctaaaacatttaaggagtaatggggtgcctactgctttggcttcaaactcaccaagatctaacatagaagccaaaatttcatgccatcaaggatggaaagagtctttctctgcaattgttggtggagacgaagtagagaaagggaagccatccccagatatatttttggaagctgctaaaagaatgaacgccactccttcaaattgcctagtaattgaggattccttgccaggtattacagctggtaaagctgcagggatgcatgtcatagctgtaccttcaatacccaaaaagactgctgagttcagttctgctgatgtggtgatcaattccctccttgatgtgaggcctgagaaatggggtttaccaccatttaatgattggattgaagataccttaccaatagaaccgtggtttatcagtggaccagtgatcaaaggatttggccgtggttctaaagtactaggaataccaacagctaatttacctgcagagaacttttctgatgtagtgtccgagtatacatctggggtatactttggctgggctggactttcaacacgtggtacatataagatggttatgagtgttggctggaacccatattttgacaatactgagaagacagtagaaccttggttgcttcataattttggtgaggacttctatggtgaggagctgcgccttgccattgttggctacataagacctgaggccaactttccttcgcttgagagcttgatagagaggattcaagaggatgggagaatagcagagaaggcactagacttaccgatgtatgccaagtacaaagactcaccatatctgagaaatactttgcagctgggaagtactaatgatgatagccaggctgagctgaattccaagtga

SEQ ID NO: 56 - protein, 397 aa, Sorghum bicolor
  misc_feature: Ceres ANNOT ID no. 6004097
  misc_feature (234)..(364): Pfam Id: Flavokinase Pfam Desc: Riboflavin kinase
  misc_feature (11)..(196): Pfam Id: Hydrolase Pfam Desc: haloacid dehalogenase-like hydrolase
  misc_feature (1)..(397): NCBI GI: 33242903 NCBI Desc: gs1-like protein [oryza sativa (japonica cultivar-group)]
  misc_feature (156)..(380): NCBI GI: 87240728 NCBI Desc: riboflavin kinase / fad synthetase [medicago truncatula]
  misc_feature (9)..(177): NCBI GI: 87240727 NCBI Desc: haloacid dehalogenase/epoxide hydrolase; haloacid dehalogenase-like hydrolase [medicago truncatula]
  misc_feature (238)..(378): NCBI GI: 31615984 NCBI Desc: chain a, crystal structure of riboflavin kinase
  misc_feature (238)..(378): NCBI GI: 40889446 NCBI Desc: chain a, crystal structure of riboflavin kinase with ternary product complex
  misc_feature (238)..(378): SWISSPROT Homolog: EC 2.7.1.26 Riboflavin kinase
MSAPMPISRLVSHVILDLDGTLLNTDSVVSKVVKPFLVKNGKTWDSKKAYKVVGKTPYEAAAIVLEDYGLPYSTEEFLSMITPVFSEQWCNIKALPGATRLLKHLRSNGVPTALASNSPRSNIEAKISCHQGWKESFSAIVGGDEVEKGKPSPDIFLEAAKRMNATPSNCLVIEDSLPGITAGKAAGMHVIAVPSIPKKTAEFSSADVVINSLLDVRPEKWGLPPFNDWIEDTLPIEPWFISGPVIKGFGRGSKVLGIPTANLPAENFSDVVSEYTSGVYFGWAGLSTRGTYKMVMSVGWNPYFDNTEKTVEPWLLHNFGEDFYGEELRLAIVGYIRPEANFPSLESLIERIQEDGRIAEKALDLPMYAKYKDSPYLRNTLQLGSTNDDSQAELNSK

SEQ ID NO: 57 - DNA, 1887 bp, Sorghum bicolor
  misc_feature: Ceres ANNOT ID no. 6004098
  misc_feature: Encodes the peptide sequence at SEQ ID NO 58
atggctgacggggccgagatggacgaggaggctatgcgagccttctttccgctctctttcggcaaggcgccggctcggcccggctctgcggcctcctccgcccactcctccacccttcgcaagcctcaaaaccctagtaaccccaagccccccgcctctaccgccacggacgacgatggagccgctatgattggtccccctcggccgccgccggcgcccgcggaggaggacgacgacgacaaggaccgcggcggcgtcatgatcgggccgcctcggccaccgccgccctcagctcgcggcgaggggaacgacgacgatggcgacggcatgattgggccgcctaggccgccgccagcggatgatgaagacgtcgatgatgatgatgatgacgaggaggacgacggcgaggagatggaggatgacggcgagggtggattcaatcggatccctctcagcaacgaaattgttctgcgggggcacactaaggttgtctcagcccttgctgttgaccatacaggatccagagtgctctctggtagctatgattatacagtgcgtatgtacgacttccagggtatgaattcaaagcttcagtcattcagacaattggaaccctttgagggccatcaagttcgtagcctaagttggagtccaacatctgatcgattcttatgtgttactggttcagctcaggccaagatttatgacagggatgggcttacactaggagagtttgttaagggtgatatgtatattcgtgatctgaagaatacaaaaggccatatctccgggcttacaggtggtgagtggaatccgaagtcaaaagagaccattctgacatcatctgaggatggctccatacgcctctgggatgtgtctgactttaaaagtcagaagcaggtcatcaaacctaagctggtaagaccaatgcggattcctgttacatcatgtgcatgggaccatgaaggaaaacgaattgtgggtggcataggagatggttctatacaggtctggaccataaaagctggatggggtagcagaccagatatccatgttgagaaaacacacacagaggatattactggggttaaattttcaacagatggacagattcttctgtcaagaagtatggatagtactcttaagatatgggatttgagaaaaatgaaaactcctttgaaagtatttgaagatctgccaaatcactatgctgagacaaatgcagcctttagcccagatgagcagcttatttttactggaacatctattgaaaaagatggtgacaatgggggattactttgtttctttgatagaaagaaacttgagcttgtatcgagggtgggaatttcaccacagtacagtgtgataaggtgcctctggcatccaagaatcaaccaggtgtttgcaacagttggagacaagaaagaaggcgggactcatatcctgtatgatccttctattagtcaaaggggagctcttgtatgtgttggacgagcaccaaggaaaaagtctgttgatgattttgaggtgcaacctgtcatacacaatccacatgcattgccacttttccgagatcaaccaagtcgcaaacgccaaagagagaagatactgaaagacccgctcaaatcacacaagccagaagcacctgttaatggtccaggatatggtggaagagtgggtactacaaaaggcagtttgctgacacagtacctcttgaaggaaggtggtttaattaaggagacctggatggatgaagatccaagagaagcgattttgaagtatgctgatgctgcagagaaagacccaaagtttattgcgccagcttattctcaaacccagccgaaacctgtttttgcagagtctgattcagacaatgaagagaaataa

SEQ ID NO: 58 - protein, 628 aa, Sorghum bicolor
  misc_feature: Ceres ANNOT ID no. 6004098
  misc_feature (151)..(189): Pfam Id: WD40 Pfam Desc: WD domain, G-beta repeat
  misc_feature (252)..(291): Pfam Id: WD40 Pfam Desc: WD domain, G-beta repeat
  misc_feature (347)..(385): Pfam Id: WD40 Pfam Desc: WD domain, G-beta repeat
  misc_feature (10)..(628): NCBI GI: 92887123 NCBI Desc: wd40-like [medicago truncatula]
  misc_feature (87)..(627): NCBI GI: 49119437 NCBI Desc: mgc82743 protein [xenopus laevis]
  misc_feature (104)..(620): NCBI GI: 19922838 NCBI Desc: cg5543-pa [drosophila melanogaster]
  misc_feature (124)..(626): NCBI GI: 125806591 NCBI Desc: ga18958-pa [drosophila pseudoobscura]
  misc_feature (97)..(507): NCBI GI: 119479893 NCBI Desc: wd repeat protein [neosartorya fischeri nrrl 181]
  misc_feature: The sequence is a functional homolog of SEQ ID NO. 502 in the 11/188,298 US application
MADGAEMDEEAMRAFFPLSFGKAPARPGSAASSAHSSTLRKPQNPSNPKPPASTATDDDGAAMIGPPRPPPAPAEEDDDDKDRGGVMIGPPRPPPPSARGEGNDDDGDGMIGPPRPPPADDEDVDDDDDDEEDDGEEMEDDGEGGFNRIPLSNEIVLRGHTKVVSALAVDHTGSRVLSGSYDYTVRMYDFQGMNSKLQSFRQLEPFEGHQVRSLSWSPTSDRFLCVTGSAQAKIYDRDGLTLGEFVKGDMYIRDLKNTKGHISGLTGGEWNPKSKETILTSSEDGSIRLWDVSDFKSQKQVIKPKLVRPMRIPVTSCAWDHEGKRIVGGIGDGSIQVWTIKAGWGSRPDIHVEKTHTEDITGVKFSTDGQILLSRSMDSTLKIWDLRKMKTPLKVFEDLPNHYAETNAAFSPDEQLIFTGTSIEKDGDNGGLLCFFDRKKLELVSRVGISPQYSVIRCLWHPRINQVFATVGDKKEGGTHILYDPSISQRGALVCVGRAPRKKSVDDFEVQPVIHNPHALPLFRDQPSRKRQREKILKDPLKSHKPEAPVNGPGYGGRVGTTKGSLLTQYLLKEGGLIKETWMDEDPREAILKYADAAEKDPKFIAPAYSQTQPKPVFAESDSDNEEK

SEQ ID NO: 59 - DNA, 1044 bp, Sorghum bicolor
  misc_feature: Ceres ANNOT ID no. 6004111
  misc_feature: Encodes the peptide sequence at SEQ ID NO 60
atggaccgggagctgtggccttctgggctaagggtcctggttattgataacaattcttcatatttgtcagttatggaagaactacttatcaagtgcagctacaaagttacgtcatataaggacgtcagggaagcaatgtccttcatctatggaaacatacagattgttgatctcataattagcgatgtgtgctttccaactgaagacagtttacttattctgcaagaagttaccacaaagtttgacatccccaccgtgataatgtcttccaacggtgatgcgagcatagttatgaagtacatcaccagtggggcttccgatttcctgataaagcctgtgagaattgaagtgctgaagaacatatggcagcatgtgttccggaagcagctgatcggggagaacagaagctgcagcaacagtgctcaacacctcgatcaggtttcatatccaccaaccatagctcctgcttctacatgtgccacaagaaccacaggaataatcactgaagcagccacggcgacactggagagcgcgacaagagagacgactaacgggacggtcacagatatacaggatctgaggaagtcaaggctcagctggaccacacagctgcaccgccaattcattgctgctgtgaattccctgggggaaaaggcagttccaaagaagatactggagacaatgaaggttaaacatttgacaagagaacaagttgcaagccacttgcagaaatacaggcttcacctaaggaaattgaatcaaacattgcacaaggatgacacaccttcaccatcaagccatcccaatgaatcaaacattctccgaaccgaattcaatagttctttgaattcaacgtattttgatcaagatggatgcttggagatcacagagtactctttgcccaaggatgacatctcaagtggttcagactgtatgctgggagaacgaaacaactactcacctcaaggcttccaggatttcagatgggattcagagaaacagggatctgaaacgacatatttatggaatttcgaggcagagtga

SEQ ID NO: 60 - protein, 347 aa, Sorghum bicolor
  misc_feature: Ceres ANNOT ID no. 6004111
  misc_feature (10)..(123): Pfam Id: Response_reg Pfam Desc: Response regulator receiver domain
  misc_feature (197)..(246): Pfam Id: Myb_DNA-binding Pfam Desc: Myb-like DNA-binding domain
  misc_feature (1)..(344): NCBI GI: 31338862 NCBI Desc: b-type response regulator [oryza glaberrima]
  misc_feature (1)..(344): NCBI GI: 31338860 NCBI Desc: b-type response regulator [oryza sativa (indica cultivar-group)]
  misc_feature (1)..(344): NCBI GI: 31338856 NCBI Desc: b-type response regulator [oryza sativa (japonica cultivar-group)]
  misc_feature (1)..(344): NCBI GI: 31338858 NCBI Desc: b-type response regulator [oryza sativa (japonica cultivar-group)]
  misc_feature (4)..(129): NCBI GI: 4210449 NCBI Desc: arr1 protein [arabidopsis thaliana]
  misc_feature: The sequence is a functional homolog of SEQ ID NO 1104 in the 11/479,226US patent application
  misc_feature: The sequence is a functional homolog of SEQ ID NO 1233 in the 10/666,642US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 2404 in the 10/374,780US patent application
  misc_feature: The sequence is a functional homolog of SEQ ID NO 550 in the 10/225,066US patent application
  misc_feature: The sequence is a functional homolog of SEQ ID NO 932 in the 10/666,642US patent application
  misc_feature: The sequence is a functional homolog of SEQ ID NO 933 in the 10/666,642US patent application
  misc_feature: The sequence is a functional homolog of SEQ ID NO 934 in the 10/666,642US patent application
  misc_feature: The sequence is a functional homolog of SEQ ID NO 935 in the 10/666,642US patent application
  misc_feature: The sequence is a functional homolog of SEQ ID NO 936 in the 10/666,642US patent application
  misc_feature: The sequence is a functional homolog of SEQ ID NO 937 in the 10/666,642US patent application
  misc_feature: Useful for making plants with modulated growth and phenotype characteristics
  misc_feature: The sequence is a functional homolog of SEQ ID NO 550 in the 20050160493 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1233 in the 20070033671 US patent application
  misc_feature: The sequence is a functional homolog of SEQ ID NO 932 in the 20070033671 US patent application
  misc_feature: The sequence is a functional homolog of SEQ ID NO 933 in the 20070033671 US patent application
  misc_feature: The sequence is a functional homolog of SEQ ID NO 934 in the 20070033671 US patent application
  misc_feature: The sequence is a functional homolog of SEQ ID NO 935 in the 20070033671 US patent application
  misc_feature: The sequence is a functional homolog of SEQ ID NO 936 in the 20070033671 US patent application
  misc_feature: The sequence is a functional homolog of SEQ ID NO 937 in the 20070033671 US patent application
  misc_feature: The sequence is a functional homolog of SEQ ID NO 933 in the 10/666,642 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: The sequence is a functional homolog of SEQ ID NO. 378 in the 11/188,298 US application
  misc_feature: The sequence is a functional homolog of SEQ ID NO. 514 in the 11/188,298 US application
MDRELWPSGLRVLVIDNNSSYLSVMEELLIKCSYKVTSYKDVREAMSFIYGNIQIVDLIISDVCFPTEDSLLILQEVTTKFDIPTVIMSSNGDASIVMKYITSGASDFLIKPVRIEVLKNIWQHVFRKQLIGENRSCSNSAQHLDQVSYPPTIAPASTCATRTTGIITEAATATLESATRETTNGTVTDIQDLRKSRLSWTTQLHRQFIAAVNSLGEKAVPKKILETMKVKHLTREQVASHLQKYRLHLRKLNQTLHKDDTPSPSSHPNESNILRTEFNSSLNSTYFDQDGCLEITEYSLPKDDISSGSDCMLGERNNYSPQGFQDFRWDSEKQGSETTYLWNFEAE

SEQ ID NO: 61 - DNA, 783 bp, Sorghum bicolor
  misc_feature: Ceres ANNOT ID no. 6004177
  misc_feature: Encodes the peptide sequence at SEQ ID NO 62
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
atggattcaggcgccgtgcagcacggctgcgcgcattacagccgtgggtgcagcgtcgtggcgccctgctgcggccaggtcttcgcctgccgccattgccacaacgacgccaagaactcgctcgaggtcgacccgcgcgaccggcacgagatcccccgccacgaaatcgaaaaggtgatctgttctctctgctccaaagaacaggatgtgcaacagaactgctccaactgtggggcctgcatggggaaatacttctgtgaaatatgcaaattctttgacgatgatgtctcaaagggccaataccactgtgatgggtgtggcatatgcagaactggtggcgtcgataacttttttcactgtgatacatgtgggtgttgctacagcaatgtcttgaaggattcccaccactgtatcgaaagagcaatgcatcacaactgccctgtctgcttcgagtatctgttcgactccacaaaggacatcagtgtgctgcaatgcgggcacacaattcatctggagtgcatgaacgagatgagagcgcaccatcacttctcgtgcccggtgtgctcgaggtccgcctgcgacatgtccgccacatggcggaagctcgatgaggaggttgcggcgacgccaatgcctgacatctatctgaagaaaatggtatggatcctgtgcaacgactgcagcgcgacctcgagcgtgcggttccacgtgctggggcagaagtgccccgggtgcagctcctacaacacccgggagacgagggccgcgtgccccaggacctga

SEQ ID NO: 62 - protein, 260 aa, Sorghum bicolor
  misc_feature: Ceres ANNOT ID no. 6004177
  misc_feature (10)..(93): Pfam Id: zf-CHY Pfam Desc: CHY zinc finger
  misc_feature (146)..(188): Pfam Id: zf-C3HC4 Pfam Desc: Zinc finger, C3HC4 type (RING finger)
  misc_feature (2)..(254): NCBI GI: 4105798 NCBI Desc: pgpd14 [petunia x hybrida]
  misc_feature (1)..(254): NCBI GI: 21593716 NCBI Desc: pgpd14 protein [arabidopsis thaliana]
  misc_feature (1)..(254): NCBI GI: 10177239 NCBI Desc: pgpd14 protein [arabidopsis thaliana]
  misc_feature (2)..(254): NCBI GI: 140043244 NCBI Desc: zinc finger, ring-type; zinc finger, chy-type [medicago truncatula]
  misc_feature (1)..(252): NCBI GI: 57899891 NCBI Desc: zinc finger protein zfp-like [oryza sativa (japonica cultivar-group)]
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: The sequence is a functional homolog of SEQ ID NO. 350 in the 11/188,298 US application
  misc_feature: The sequence is a functional homolog of SEQ ID NO. 468 in the 11/188,298 US application
  misc_feature: The sequence is a functional homolog of SEQ ID NO. 271 in the 11/188,298 US application
MDSGAVQHGCAHYSRGCSVVAPCCGQVFACRHCHNDAKNSLEVDPRDRHEIPRHEIEKVICSLCSKEQDVQQNCSNCGACMGKYFCEICKFFDDDVSKGQYHCDGCGICRTGGVDNFFHCDTCGCCYSNVLKDSHHCIERAMHHNCPVCFEYLFDSTKDISVLQCGHTIHLECMNEMRAHHHFSCPVCSRSACDMSATWRKLDEEVAATPMPDIYLKKMVWILCNDCSATSSVRFHVLGQKCPGCSSYNTRETRAACPRT

SEQ ID NO: 63 - DNA, 786 bp, Sorghum bicolor
  misc_feature: Ceres ANNOT ID no. 6004193
  misc_feature: Encodes the peptide sequence at SEQ ID NO 64
atggcagccgcaaacgccgagaacacgtcgtcgctgctccggctcgacggccgcgtcgcgctcatcaccggcggctcccgcggcatcggccgcgaggtgtcctcccacctcgccgccctcggcgcgcgcgtcgtggtgaactacgcgtccaattccgccagggcagacgagctcgtcgcggagctcgcctcccgcggccaccaggccgtggccgtccgcgcggacgtgtcagacccggacgccgtgcgcgcgctcttcgaccgcgccgaggaggcgttcgggtccccgccgcacatcgtcgtctgctgtgcaggcgtcctcagcgacaagtacccggcgctcgcggacaccgccgtcgaggacttcgacgccatgttcgcggtgaacgtgcgcgggacgttcctcgtgtgccgtgaggcggcgaaccgagtcccagccaacagcggcggccgcatcgtgacgttctcgtcgtccatcgtcggcacgctcctgccgggatacgcggcgtacacggcgaccaacgccgccgtggaggcgatgacgaagatcctagccaaggaggtggcggcgaagggagtgactgcgaacgtggtcgcgccggggcccgtgcgcaccgagcttttcttggccgggaaggacgaagcgttcctgcggaaggtggagcagcagtccatggggcgcatcgccgagacgacggacgtggcgccggtggtggcgttcctggccagcgacgccgcggtatgggtgaacgggcaggtcatcagggtcaatggtggtttcgtctaa

SEQ ID NO: 64 - protein, 261 aa, Sorghum bicolor
  misc_feature: Ceres ANNOT ID no. 6004193
  misc_feature (18)..(189): Pfam Id: adh_short Pfam Desc: short chain dehydrogenase
  misc_feature (19)..(206): Pfam Id: KR Pfam Desc: KR domain
  misc_feature (20)..(257): Pfam Id: Epimerase Pfam Desc: NAD dependent epimerase/dehydratase family
  misc_feature (4)..(260): NCBI GI: 115482316 NCBI Desc: os10g0456100 [oryza sativa (japonica cultivar-group)]
  misc_feature (5)..(261): NCBI GI: 21594913 NCBI Desc: short-chain alcohol dehydrogenase like protein [arabidopsis thaliana]
  misc_feature (2)..(259): NCBI GI: 115472775 NCBI Desc: os07g0561500 [oryza sativa (japonica cultivar-group)]
  misc_feature (8)..(261): NCBI GI: 77403673 NCBI Desc: short chain dehydrogenase [solanum tuberosum]
  misc_feature (15)..(261): NCBI GI: 115466800 NCBI Desc: os06g0185100 [oryza sativa (japonica cultivar-group)]
  misc_feature: The sequence is a functional homolog of SEQ ID NO. 389 in the 11/188,298 US application
  misc_feature: The sequence is a functional homolog of SEQ ID NO. 453 in the 11/188,298 US application
MAAANAENTSSLLRLDGRVALITGGSRGIGREVSSHLAALGARVVVNYASNSARADELVAELASRGHQAVAVRADVSDPDAVRALFDRAEEAFGSPPHIVVCCAGVLSDKYPALADTAVEDFDAMFAVNVRGTFLVCREAANRVPANSGGRIVTFSSSIVGTLLPGYAAYTATNAAVEAMTKILAKEVAAKGVTANVVAPGPVRTELFLAGKDEAFLRKVEQQSMGRIAETTDVAPVVAFLASDAAVWVNGQVIRVNGGFV

SEQ ID NO: 65 - DNA, 450 bp, Sorghum bicolor
  misc_feature: Ceres ANNOT ID no. 6004923
  misc_feature: Encodes the peptide sequence at SEQ ID NO 66
atggtttccagggagcagaagcgaggagttttgcatgagaagctgcagattctccgcagcgttactcattctcatgcgggggataaaatgtcaataatagcggacgcatcattgtacatcaaagatctacagcagaaaattgcgaagctaaaccaagagattgcatctgcacaacacgccaatgtttgccaaccattggtgagtgttggagtcctggacaagggtttcctcattaatgtgttcatggacaagagctgcccaccaggactacttgcttgtatccttgaggcatttgacgagattgggctcacagtgcttgaggctagggctacatgtgctggttcatttcgtctagaagctgtaggagaggaagaaggtgagggcctaatcgacgcacatgcagtggagaaagcagtagttcaagcaatcaagaattgtcctacaaactaa

SEQ ID NO: 66 - protein, 149 aa, Sorghum bicolor
  misc_feature: Ceres ANNOT ID no. 6004923
  misc_feature (82)..(146): NCBI GI: 115483803 NCBI Desc: os11g0111800 [oryza sativa (japonica cultivar-group)]
  misc_feature (1)..(68): NCBI GI: 124359524 NCBI Desc: helix-loop-helix dna-binding [medicago truncatula]
  misc_feature (1)..(57): NCBI GI: 75706692 NCBI Desc: inducer of cbf expression 2 [hordeum vulgare subsp. vulgare]
  misc_feature (1)..(57): NCBI GI: 74136905 NCBI Desc: inducer of cbf expression 2 [hordeum vulgare subsp. vulgare]
  misc_feature (1)..(57): NCBI GI: 75706690 NCBI Desc: inducer of cbf expression 2 [hordeum vulgare subsp. vulgare]
  misc_feature: The plant is abnormally small.
  misc_feature: Useful for making plants with modulated biomass
  misc_feature: Functional homolog of the protein sequence given in SEQ ID NO 13549
  misc_feature: Useful for making plants with modulated biomass
  misc_feature: Functional homolog of the protein sequence given in SEQ ID NO 13549
MVSREQKRGVLHEKLQILRSVTHSHAGDKMSIIADASLYIKDLQQKIAKLNQEIASAQHANVCQPLVSVGVLDKGFLINVFMDKSCPPGLLACILEAFDEIGLTVLEARATCAGSFRLEAVGEEEGEGLIDAHAVEKAVVQAIKNCPTN

SEQ ID NO: 67 - DNA, 1653 bp, Sorghum bicolor
  misc_feature: Ceres ANNOT ID no. 6005517
  misc_feature: Encodes the peptide sequence at SEQ ID NO 68
atgatgtcctcggcgccgccgtcggagccggccaccgccggcgacgacgacgatatggagtctctcccccttgccgccgcctccgactacgcctccgttgcctccaccttcgacccccttctctcctccacctccgccaccgccgcctcgccccgctcccctccgacgcgcgccgccgccttcaccctctcctcgaccttctcctcctccttcgttgacccgccctcctacgccgacgccaccggcgccggcgccggctcctcctccccgcgctccgcctcctctccctcctccgcgtcgccgagatccgcgcgcttggcggcctccgagtactccctcctcgccgtctccgacccagagaccgaggccgagccagccgccacctcgctcgtccccggatccggacccacctttgtctcctacctcgtcaccagcgtccaccgccgggaccccgaccagcgccgccattcggtgcgccgccgcttccgcgacttcgtcacgctcgccgaccgccttgccgaggccttccggggccatttcgtgccgccgcgcccggacaagaacaccgtcgagagccaggtcatgcagcgggacgagttcgtggcgcagcgccgtgccgctctcgagaggtacctctggcgactcgccgagcacccggccatcggccccagcgacgagctgcgcgtctttctgcatgccgagggaaagatgccactgcccggcagcactgatatggcatcacggatgctcgatggtgcggcaaggctgccgcggcagctcattgctggggaggatgccgtcgccccgccgcaggaagttgtgcagcctgccaagggtggcagggacctgctgaggatattcaaggagctcaagcagtcggtggtaactgactgggccggtgtcaagccacccctggtagaggaggatagggagttcctggagaagaaaaataagctgcaggagtgggagcagcagctcaccagtgcgtcacaacaggcagaagcacttgtcaaggctcaacaagatatggctgaaacaatgggagcgcttggattggcatttgttagactaacaaagtttgagaccgaggaggcaatgtatgactctcagaggataagagcagctgacagcaggcgtgtggccactgctgctgttaaatctagcagggcatgtcgagatttgaatgcgcaaactgtcaaatatctggatacgctacatgaacatttaagcataatgttgtctgtccacactgcattttctgatcgggcaagtgcattattgactgtgcaaacactcatgtcagatgtggcatcattacagtccaggattgagaaactcgaggttgcatcctcgaagatatttggtggtgacagagctaggactcgcaaagttgaagagctaaaggaaacaattagggctactgaagatgctaagttctgtgctttaagagagtacgagagaattaaggaaaataacaggagtgaactccagcgactagacagcgaaagaaaacaagatttcctggtgatgctaaaaggatttgtagcaagccaggcggcctatgcggagaaaatcgtggatggatgggagacggtggcagaggagacgagcggatatgtgcgagcgcgaggatctgatagcatcgcttcgtag

SEQ ID NO: 68 - protein, 550 aa, Sorghum bicolor
  misc_feature: Ceres ANNOT ID no. 6005517
  misc_feature (124)..(234): Pfam Id: PX Pfam Desc: PX domain
  misc_feature (283)..(535): Pfam Id: Vps5 Pfam Desc: Vps5 C terminal like
  misc_feature (38)..(541): NCBI GI: 30681754 NCBI Desc: phox (px) domain-containing protein [arabidopsis thaliana]
  misc_feature (101)..(545): NCBI GI: 115440797 NCBI Desc: os01g0827200 [oryza sativa (japonica cultivar-group)]
  misc_feature (158)..(541): NCBI GI: 115464451 NCBI Desc: os05g0474500 [oryza sativa (japonica cultivar-group)]
  misc_feature (133)..(267): NCBI GI: 33304626 NCBI Desc: transformation-related 9 [homo sapiens]
  misc_feature (133)..(267): NCBI GI: 32880025 NCBI Desc: sorting nexin 2 [homo sapiens]
MMSSAPPSEPATAGDDDDMESLPLAAASDYASVASTFDPLLSSTSATAASPRSPPTRAAAFTLSSTFSSSFVDPPSYADATGAGAGSSSPRSASSPSSASPRSARLAASEYSLLAVSDPETEAEPAATSLVPGSGPTFVSYLVTSVHRRDPDQRRHSVRRRFRDFVTLADRLAEAFRGHFVPPRPDKNTVESQVMQRDEFVAQRRAALERYLWRLAEHPAIGPSDELRVFLHAEGKMPLPGSTDMASRMLDGAARLPRQLIAGEDAVAPPQEVVQPAKGGRDLLRIFKELKQSVVTDWAGVKPPLVEEDREFLEKKNKLQEWEQQLTSASQQAEALVKAQQDMAETMGALGLAFVRLTKFETEEAMYDSQRIRAADSRRVATAAVKSSRACRDLNAQTVKYLDTLHEHLSIMLSVHTAFSDRASALLTVQTLMSDVASLQSRIEKLEVASSKIFGGDRARTRKVEELKETIRATEDAKFCALREYERIKENNRSELQRLDSERKQDFLVMLKGFVASQAAYAEKIVDGWETVAEETSGYVRARGSDSIAS

SEQ ID NO: 69 - DNA, 579 bp, Sorghum bicolor
  misc_feature: Ceres ANNOT ID no. 6005526
  misc_feature: Encodes the peptide sequence at SEQ ID NO 70
atgtttacagcaaggaggaagatccagaaggacaatggcatggagccaactgagtttgaagacacagttgcccaggcgttctttgacctcgaaaatgggaatcaggagcttaagagtgacttgaaggaactttacatcaatggagcaatgcagatggatatggctggcaacaggaaggctgttatcatccatgttccgtacagactgcaaaagtcttacaagaagattcatgtgaggcttgttcgggagcttgagaagaagttcagtgggaaggatgttgttctggttgctactcgaagaatagtgaggcctccgaagacaggctcagctattgtgcgcccacgtaaccgcactcttactgctgttcatgatggcattttggaggacgttgtgtatccagctgagattgttgggaagcgtattaggtaccacatggatggtgccaaagttttgaaggtcttcctggatccaaaggagcgaacaaacactgagaataagcttgacactttcagctcggtctaccggaggctctgtgggaaggaggtggtgtttgactaccctgtggccgagagcgcttaa

SEQ ID NO: 70 - protein, 192 aa, Sorghum bicolor
  misc_feature: Ceres ANNOT ID no. 6005526
  misc_feature (6)..(191): Pfam Id: Ribosomal_S7e Pfam Desc: Ribosomal protein S7e
  misc_feature (1)..(192): NCBI GI: 22671664 NCBI Desc: ribosomal protein s7 [oryza sativa (japonica cultivar-group)]
  misc_feature (1)..(192): NCBI GI: 109940179 NCBI Desc: 40s ribosomal protein s7
  misc_feature (1)..(192): NCBI GI: 4588906 NCBI Desc: ribosomal protein s7 [secale cereale]
  misc_feature (1)..(192): NCBI GI: 57471724 NCBI Desc: ribosomal protein s7 [triticum aestivum]
  misc_feature (1)..(192): NCBI GI: 49036474 NCBI Desc: 40s ribosomal protein s7
  misc_feature: The plant is abnormally large.
  misc_feature: The plant is abnormally small.
  misc_feature: Useful for making plants with modulated biomass
  misc_feature: Functional homolog of the protein sequence given in SEQ ID NO 13013
  misc_feature: Useful for making plants with modulated biomass
  misc_feature: Functional homolog of the protein sequence given in SEQ ID NO 13013
MFTARRKIQKDNGMEPTEFEDTVAQAFFDLENGNQELKSDLKELYINGAMQMDMAGNRKAVIIHVPYRLQKSYKKIHVRLVRELEKKFSGKDVVLVATRRIVRPPKTGSAIVRPRNRTLTAVHDGILEDVVYPAEIVGKRIRYHMDGAKVLKVFLDPKERTNTENKLDTFSSVYRRLCGKEVVFDYPVAESA

SEQ ID NO: 71 - DNA, 978 bp, Sorghum bicolor
  misc_feature: Ceres ANNOT ID no. 6005633
  misc_feature: Encodes the peptide sequence at SEQ ID NO 72
atggagcctggtcccgacgcgcctgctggtggcggaggaaccagtagtagtgcgccagcggagaccgggccgtcgtcgtcctcggccgccgccgcagcagcagcctcgtcgtcgtcgaaccggcagcaggcagcagagcaggaagcagcgccgcagcaacaagccggagctcagcagcctcagaggcaacagccggcagcagcgccgccggcccagccacaggctcagcagccgcagccactggcacagcagcctccgccgccgccgccgcctccggcggggctcagccggtacgagtcgcagaagcggcgcgactggaacacgttcctgcagtacctgcggaaccacaagccgccgctgacgctggcgcgctgcagcggcgcgcacgtcatcgagttcctccgctacctggaccagttcggcaagaccaaggtgcacgccgagggctgcgcctacttcggccagcccaacccgccggcgccctgcgcctgcccgctgcgccaggcctggggaagcctcgacgcgctcatcggccgcctccgcgccgcctacgaggagtcggggggacgcccggagtccaacccgttcgcggccaaagccgtgcgcatctacctccgcgacgtgagggaggcgcaggccaaggcgcgcggcatcccctacgagaagaagaagcgcaagcgagggagcgccgccgcgcctccagtcgcgccgcctcctgttgtaaccgcagggacgacgtcaggggccgccggcggtgaggaggaggaggacgacgacgacgaaccatcgccgtctgccgcaggtgaacgaccacaacagcagaccaccacgccggcgtccgcctcggctagcgctcctcctcctgctgcaagtacttccagcgctagtgcaagtagtagcactgccgccacggccacggcgacggtgacgacgacgacgacaaggaaggaggaagaaggatccgcgccaagctcgtga

SEQ ID NO: 72 - protein, 325 aa, Sorghum bicolor
  misc_feature: Ceres ANNOT ID no. 6005633
  misc_feature (92)..(244): NCBI GI: 115447383 NCBI Desc: os02g0623400 [oryza sativa (japonica cultivar-group)]
  misc_feature (96)..(231): NCBI GI: 115444445 NCBI Desc: os02g0166800 [oryza sativa (japonica cultivar-group)]
  misc_feature (92)..(227): NCBI GI: 38344650 NCBI Desc: osjnbb0072m01.12 [oryza sativa (japonica cultivar-group)]
  misc_feature (71)..(227): NCBI GI: 107738137 NCBI Desc: at1g78815 [arabidopsis thaliana]
  misc_feature (95)..(227): NCBI GI: 92871139 NCBI Desc: ribulose bisphosphate carboxylase, large chain [medicago truncatula]
  misc_feature: The plant flowers significantly late compared to wild-type.
  misc_feature: The plant is abnormally small.
  misc_feature: The plant produces a reduced number of seeds.
  misc_feature: Useful for biocontainment applications
  misc_feature: Useful for making plants with altered sterol content
  misc_feature: Useful for making plants with modulated biomass
  misc_feature: Useful for making plants with modulated flowering time
  misc_feature: Useful for making plants with modulated heat sensitivity
  misc_feature: Useful for making plants with modulated low light sensitivity
  misc_feature: Functional homolog of the protein sequence given in SEQ ID NO 13338
  misc_feature: Functional homolog of the protein sequence given in SEQ ID NO 13339
  misc_feature: Functional homolog of the protein sequence given in SEQ ID NO 13352
  misc_feature: GREAT-hit functional homolog of the protein sequence given in SEQ ID NO 13434
  misc_feature: GREAT-hit functional homolog of the protein sequence given in SEQ ID NO 13435
  misc_feature: GREAT-hit functional homolog of the protein sequence given in SEQ ID NO 13437
  misc_feature: Useful for making plants with modulated low light sensitivity
  misc_feature: Useful for making plants with modulated nitrogen use efficiency
  misc_feature: Functional homolog of the protein sequence given in SEQ ID NO 13437
  misc_feature: Useful for making plants with modulated flowering time
  misc_feature: Functional homolog of the protein sequence given in SEQ ID NO 13982
  misc_feature: Useful for biocontainment applications
  misc_feature: Functional homolog of the protein sequence given in SEQ ID NO 13983
  misc_feature: Useful for making plants with modulated biomass
  misc_feature: Functional homolog of the protein sequence given in SEQ ID NO 13338
MEPGPDAPAGGGGTSSSAPAETGPSSSSAAAAAAASSSSNRQQAAEQEAAPQQQAGAQQPQRQQPAAAPPAQPQAQQPQPLAQQPPPPPPPPAGLSRYESQKRRDWNTFLQYLRNHKPPLTLARCSGAHVIEFLRYLDQFGKTKVHAEGCAYFGQPNPPAPCACPLRQAWGSLDALIGRLRAAYEESGGRPESNPFAAKAVRIYLRDVREAQAKARGIPYEKKKRKRGSAAAPPVAPPPVVTAGTTSGAAGGEEEEDDDDEPSPSAAGERPQQQTTTPASASASAPPPAASTSSASASSSTAATATATVTTTTTRKEEEGSAPSS

SEQ ID NO: 73 - DNA, 2613 bp, Sorghum bicolor
  misc_feature: Ceres ANNOT ID no. 6005661
  misc_feature: Encodes the peptide sequence at SEQ ID NO 74
  misc_feature: Up-regulated in shoot tissues in response to salicylic acid treatment
atggatatcactcaggttctgctagctgctcaatctccagatgctaaccttcgaacagtagcagaaagcaacctcacacagttccaggagcagaatcttcctaacttcctcctctccctatcaatagagctctcaaatgatgaaaaacctccagagtctagaaggcttgctggtattatccttaagaattctttggatgcaaaggattctgcgaaaaaggagctattgactcagcaatgggtaagcgtggatccatctgtcaaattgaagatcaaggagttgttgctggtgacactaggatcttcggtgcatgatgcaagacatacctcttcgcaagtcattgccaaggttgcatcaattgagataccacgtcgagaatggcaagaccttgttgccaacttactgggcaacatgacttctccaggtgcatccgctcctttgaaacaagcaacactagaggcattggggtatgtgtgtgaggagatttctccacaggacttggagcaggaccaagtgaatgctgttctgactgctgttgtccagggaatgaatcagacagagctcagccctgaggttcgtctagctgcagttaaggccctatataatgctcttgactttgccgagagtaactttgcaaatgaaatggagaggaattatataatgaaggtggtttgtgagactgctgtgtccaaagaagtggagatcagacaggctgcatttgaatgccttgttgcaatagcatccacatattattcacacttagatccttatatgcaaaccatattcaacctgacagcaaatgcagtgaaaggtgatgaggaaccggttgcacttcaagctgttgagttctggagcgctatttgtgatgaagagattgcactccaagatgaatacgagggatctgaggatggcaactctactgtacactttcgctttattgaaaaggccctcccttcacttgtaccgatgctgctagaaactttattgaagcaagaggaagatcaagatcaagatgataatgtttggaacatttctatgagtggtgggacgtgccttggactcatttctagaactgttggtgatgcagttgttcctcttgtgatgccatttgttgaggccaacatcacaaagcctgattggcattgtcgcgaggcagctacttttgcatttggttctatccttgaaggcccctctgttgaaaaacttgctccacttgtccagggtggtcttgatttcttgcttaacacaatgaatgatgcaaatagccaggtaaaagatactactgcttggactcttgggagggtatttgagctcttgcattctccagctggtgcaaacccaatcataaataattcaaaccttcctcgtatcatgtctgtgctgcttgagagtagtaaagattctccaaatgtggctgagaaagtctgtggagctatttattttcttgcccaaggatatgaagatgcagagtcaatgtcttctgtgctcacaccttatctacctaatatcattgctgctcttctttctgccgcggaccgtgctgataccacccatttcaggcttcgtgcttctgcttatgaagcactgaatgagattgtgagagtcagcaacatacctgaaacttcaggcatcataggccaattgttgcaggagatcatgagaagattaaaccttacatttgatctccatatactttcttctggtgataaggagaagcaaagcgatctgcaggctttgctatgtggtgttctgcaggtcatcatccagaagctgaatagcacagatgcaaagtccataatttctcagactgctgatcagctgatgatgctgtttttgcgtgtctttgcctgccacaattctactgttcatgaagaagcaatgcttgcaattggtgctcttgcatatgctactggtccagattttgttaaatacatgcctaacttcttcacatacctggaggctggcttgcagaattatgaagagtaccaagtgtgttccatctctgttggggtggtcggtgatatttgtcgtgccttggaagataaaatcttgcccttctgtgatcgcattatgactgttcttctaaaggatctatcaagctctatgctcaatcggtctgtgaagcctccaattttctcatgctttggagatattgctcttgctattggtgagaattttgagaaatacctaccatatgccatgccaatgcttcaaggagctgcaggactccttggtactcttgatcggagtgatgatgatatggttgattatggcaaccaactcagacgtggcatttttgaggcgtactctggtatactccagggcatcaagggcccgaaagctcagctgatgatcccatacgcaacccatctactacagttcactgaagctgtcttcaaagataggagcagggatgacagtgtgacaaaggctgcagttgctgtaattggggatctcgcagacacgcttggccagagctcgaaggatctgttcaagacccacctattccatgttgaattcttgagggagtgccaagcccaagagtttgatgatgaagttcgggagactgcacaatgggcccaggggatgataaaccaggcggtggtctcttga

SEQ ID NO: 74 - protein, 870 aa, Sorghum bicolor
  misc_feature: Ceres ANNOT ID no. 6005661
  misc_feature (21)..(101): Pfam Id: IBN_N Pfam Desc: Importin-beta N-terminal domain
  misc_feature (7)..(870): NCBI GI: 23954312 NCBI Desc: importin beta-like protein [oryza sativa (indica cultivar-group)]
  misc_feature (1)..(860): NCBI GI: 30851368 NCBI Desc: karyopherin (importin) beta 1 [mus musculus]
  misc_feature (1)..(860): NCBI GI: 1669535 NCBI Desc: scg [mus musculus]
  misc_feature (1)..(860): NCBI GI: 30931411 NCBI Desc: karyopherin (importin) beta 1 [mus musculus]
  misc_feature (1)..(860): NCBI GI: 1100994 NCBI Desc: nuclear factor p97
  misc_feature: Up-regulated in shoot tissues in response to salicylic acid treatment
MDITQVLLAAQSPDANLRTVAESNLTQFQEQNLPNFLLSLSIELSNDEKPPESRRLAGIILKNSLDAKDSAKKELLTQQWVSVDPSVKLKIKELLLVTLGSSVHDARHTSSQVIAKVASIEIPRREWQDLVANLLGNMTSPGASAPLKQATLEALGYVCEEISPQDLEQDQVNAVLTAVVQGMNQTELSPEVRLAAVKALYNALDFAESNFANEMERNYIMKVVCETAVSKEVEIRQAAFECLVAIASTYYSHLDPYMQTIFNLTANAVKGDEEPVALQAVEFWSAICDEEIALQDEYEGSEDGNSTVHFRFIEKALPSLVPMLLETLLKQEEDQDQDDNVWNISMSGGTCLGLISRTVGDAVVPLVMPFVEANITKPDWHCREAATFAFGSILEGPSVEKLAPLVQGGLDFLLNTMNDANSQVKDTTAWTLGRVFELLHSPAGANPIINNSNLPRIMSVLLESSKDSPNVAEKVCGAIYFLAQGYEDAESMSSVLTPYLPNIIAALLSAADRADTTHFRLRASAYEALNEIVRVSNIPETSGIIGQLLQEIMRRLNLTFDLHILSSGDKEKQSDLQALLCGVLQVIIQKLNSTDAKSIISQTADQLMMLFLRVFACHNSTVHEEAMLAIGALAYATGPDFVKYMPNFFTYLEAGLQNYEEYQVCSISVGVVGDICRALEDKILPFCDRIMTVLLKDLSSSMLNRSVKPPIFSCFGDIALAIGENFEKYLPYAMPMLQGAAGLLGTLDRSDDDMVDYGNQLRRGIFEAYSGILQGIKGPKAQLMIPYATHLLQFTEAVFKDRSRDDSVTKAAVAVIGDLADTLGQSSKDLFKTHLFHVEFLRECQAQEFDDEVRETAQWAQGMINQAVVS

SEQ ID NO: 75 - DNA, 774 bp, Sorghum bicolor
  misc_feature: Ceres ANNOT ID no. 6005736
  misc_feature: Encodes the peptide sequence at SEQ ID NO 76
atggaacccaacaacaatcagcccgcggccacggccgaggaagctgcggcaggcagcggccccggcggagaaggcgggcggaagggcaaggcgcccaagggcgggcccgagaacggcaagttccggtaccgcggcgtgcggcagcggagctggggcaagtgggtggcggagatccgggagccgcggaagcgctcccgcaagtggctcggcaccttcgccaccgccgaggacgccgcgcgcgcctacgaccgcgccgcgctcctcctctacggcccccgcgcgcacctcaacctcacctccccgccgccgcctacgctcgccgcgccgcgctcgcacccgcactcctccgcgacgtcgtcgtcgtctgccccgccagcgctccggccgctcctgccgcgcccgccgctgcaccatcagctctccagcggcgcctgtgctcctgcaccggatttccaccaccaccaccagcagttccagtgccaccacctcttgccgcaggcgcagccgacaccgccgctatactacgccaacacggccacggcgtccacggtcaccaccactgtgccgacacgggtggcggttccgcaggagccggccgtcgcgcccgcagtaggttcctcgacatctctacaggagccgcaggcgagtacgccggaggaggcgcccagggagacagggtgggactaccacggcggcgaggaggaggactacgcggcggcgctgctctgggacgagccggagcccttcttctggtttgatgtcttcctcaagtga

SEQ ID NO: 76 - protein, 257 aa, Sorghum bicolor
  misc_feature: Ceres ANNOT ID no. 6005736
  misc_feature (41)..(92): Pfam Id: AP2 Pfam Desc: AP2 domain
  misc_feature (1)..(257): NCBI GI: 22415744 NCBI Desc: ap2 domain transcription factor [zea mays]
  misc_feature (4)..(156): NCBI GI: 92892802 NCBI Desc: pathogenesis-related transcriptional factor and erf [medicago truncatula]
  misc_feature (4)..(134): NCBI GI: 6598941 NCBI Desc: ap2 domain transcription factor (abi4:abscisic acid-insensitive 4 ) [arabidopsis thaliana]
  misc_feature (27)..(222): NCBI GI: 108706456 NCBI Desc: ap2 domain containing protein [oryza sativa (japonica cultivar-group)]
  misc_feature (10)..(123): NCBI GI: 115476860 NCBI Desc: os08g0474000 [oryza sativa (japonica cultivar-group)]
  misc_feature: The sequence is a functional homolog of SEQ ID NO 2386 in the 10/374,780US patent application
  misc_feature: The sequence is a functional homolog of SEQ ID NO 542 in the 10/225,066US patent application
  misc_feature: Useful for making plants with altered Lignin content
  misc_feature: Useful for making plants with modulated growth and phenotype characteristics
  misc_feature: Functional homolog of the protein sequence given in SEQ ID NO 13215
  misc_feature: The sequence is a functional homolog of SEQ ID NO 542 in the 20050160493 US patent application
MEPNNNQPAATAEEAAAGSGPGGEGGRKGKAPKGGPENGKFRYRGVRQRSWGKWVAEIREPRKRSRKWLGTFATAEDAARAYDRAALLLYGPRAHLNLTSPPPPTLAAPRSHPHSSATSSSSAPPALRPLLPRPPLHHQLSSGACAPAPDFHHHHQQFQCHHLLPQAQPTPPLYYANTATASTVTTTVPTRVAVPQEPAVAPAVGSSTSLQEPQASTPEEAPRETGWDYHGGEEEDYAAALLWDEPEPFFWFDVFLK

SEQ ID NO: 77 - DNA, 1149 bp, Sorghum bicolor
  misc_feature: Ceres ANNOT ID no. 6005842
  misc_feature: Encodes the peptide sequence at SEQ ID NO 78
atggccgccgcccacctcctcgccgcctccgccgccgcctcgtcctcctccaccgccttccgccctcctctccgccttcgctctccactgcatccaccacatctccgcttcaatcgtactgggaggaggccgttcccggtggtacgcgcggctgagaccgacgccaaagacgcgaaggcgaacgccaaggtccccgagaaggcgcccgcggcggatggctccagcttcaaccagctgctcggcatcaagggtgccaagcaggagagcgacatatggaagatccgtcttcaacttactaagccagtgacatggcctccacttgtatggggagttctctgtggcgcagctgcctctggaaatttccactggacagttgaagatgtcgcaaaatctattgtatgcatgataatgtctggtccatgccttacaggatacacacagacacttaatgactggtatgatcgagacattgatgcaattaatgagccttatcgccctattccatcgggtgctatatcagaaaatgaggtaataacccagatctgggtgctattgctaggagggcttggattgggcgctttgttagatgtgtgggcagggcacgattttcctattgtgttttatcttgctgtgggtggctccttactttcttacatatactcagcaccacctctcaagctcaagcagaatggatggattgggaacttcgctctgggtgcaagttacatcagcttgccctggtgggctggccaggcgttatttggaactcttacaccggatattgttgtcttgactactttgtacagcatagctgggctagggattgctattgtaaatgattttaagagcattgaaggggatagaactctggggcttcagtcacttcctgttgcttttgggatggaaactgcaaaatggatatgtgttggagcaattgatatcactcaattatctgttgcaggttatctattgagcactggtaagctgtattatgccttggcgttgcttgggctaacaattcctcaggtgttctttcagttccagtacttcctgaaggaccctgtgaagtatgatgtcaaataccaggcaagcgcacagccgttcttcgtgttcggcctactggtgacagccctggcaaccagccattga

SEQ ID NO: 78 - protein, 382 aa, Sorghum bicolor
  misc_feature: Ceres ANNOT ID no. 6005842
  misc_feature (105)..(378): Pfam Id: UbiA Pfam Desc: UbiA prenyltransferase family
  misc_feature (1)..(382): NCBI GI: 7378659 NCBI Desc: chlorophyll synthase [avena sativa]
  misc_feature (1)..(382): NCBI GI: 75110660 NCBI Desc: chlorophyll synthase, chloroplast precursor (polyprenyl transferase)
  misc_feature (68)..(382): NCBI GI: 32307562 NCBI Desc: chlorophyll synthetase [bigelowiella natans]
  misc_feature (64)..(382): NCBI GI: 81300893 NCBI Desc: bacteriochlorophyll/chlorophyll synthetase chlorophyll synthase, chlg [synechococcus elongatus pcc 7942]
  misc_feature (78)..(382): NCBI GI: 16331483 NCBI Desc: chlorophyll a synthase [synechocystis sp. pcc 6803]
MAAAHLLAASAAASSSSTAFRPPLRLRSPLHPPHLRFNRTGRRPFPVVRAAETDAKDAKANAKVPEKAPAADGSSFNQLLGIKGAKQESDIWKIRLQLTKPVTWPPLVWGVLCGAAASGNFHWTVEDVAKSIVCMIMSGPCLTGYTQTLNDWYDRDIDAINEPYRPIPSGAISENEVITQIWVLLLGGLGLGALLDVWAGHDFPIVFYLAVGGSLLSYIYSAPPLKLKQNGWIGNFALGASYISLPWWAGQALFGTLTPDIVVLTTLYSIAGLGIAIVNDFKSIEGDRTLGLQSLPVAFGMETAKWICVGAIDITQLSVAGYLLSTGKLYYALALLGLTIPQVFFQFQYFLKDPVKYDVKYQASAQPFFVFGLLVTALATSH

SEQ ID NO: 79 - DNA, 150 bp, Sorghum bicolor
  misc_feature: Ceres ANNOT ID no. 6005952
  misc_feature: Encodes the peptide sequence at SEQ ID NO 80
atggccaagtcgaagaaccacacggcgcataaccagtcgtacaaggcgcacaagaacggcatcaagaagcccaagcgccaccgccagacctccaccaaggggcagaaaatctcgatcttagcagttgttagaaaaaaaaaaacacactaa

SEQ ID NO: 80 - protein, 49 aa, Sorghum bicolor
  misc_feature: Ceres ANNOT ID no. 6005952
  misc_feature (3)..(42): Pfam Id: Ribosomal_L29e Pfam Desc: Ribosomal L29e protein family
  misc_feature (1)..(49): NCBI GI: 92875021 NCBI Desc: ribosomal l29e protein [medicago truncatula]
  misc_feature (1)..(49): NCBI GI: 92875023 NCBI Desc: ribosomal l29e protein [medicago truncatula]
  misc_feature (1)..(49): NCBI GI: 12231298 NCBI Desc: ripening regulated protein ddtfr19 [lycopersicon esculentum]
  misc_feature (1)..(49): NCBI GI: 7959366 NCBI Desc: ribosomal protein l29 [panax ginseng]
  misc_feature (1)..(49): NCBI GI: 30679956 NCBI Desc: 60s ribosomal protein l29 (rpl29b) [arabidopsis thaliana]
MAKSKNHTAHNQSYKAHKNGIKKPKRHRQTSTKGQKISILAVVRKKKTH

SEQ ID NO: 81 - DNA, 942 bp, Sorghum bicolor
  misc_feature: Ceres ANNOT ID no. 6006085
  misc_feature: Encodes the peptide sequence at SEQ ID NO 82
atggcgacgccggcgagcctccaccccgccacgccgccggcgatatcaggtgccctggcggtggtggcgtgcgccgtcatggcggtatcctacgtcgctgtcctctatgccccgacggtcatccttcgcttcccgcccccgacctcgctccgcaccttcctgcaccgccgcttcgcctgcgccgccgtcgcatccgccgcctccgcccttgccaccgcgtccctcctccgagtctggagcctcagcgacttcgctgatatgcttgctgtgttcggcgttaggaaggatcacttgtttcaggccgtggtgattccacttttacttacatccctggtgtatgctgggtctttcgttactagattgtggttcctagcgagctcatggggcagtggcgatgaggtggagataggctgcgcccagaggcttgcacaatggatccaagctgctgttgcggatgttatggtttggcggaactatgtagtggcgccatttactgaggagctggttttcagggcatgcatgatacctcttcttctgtgcgggggattcaaaatgtctacaattatatttctgagtccagtcttcttcagtctagcacacttaaaccatttatttgaactacaccagcagggatgcaattttatgagatcgctactgattgtaggtgtccagctgggctacaccgtaatctttgggtggtatgcagcatttttgttcattcgaacaggtaatctgttatgcccaattgttgctcacgtcttctgtaatatgatgggtttgcctgttttctcgtcaccacgaacaaaaggagcagcatcggtagcatttatggctggattgatatccttcttttggctgctttttcctgcaacaagtcctgaactgtacaacagtagttttgatcgctgcaattgctggcatggcttttgcaattggaaataa

SEQ ID NO: 82 - protein, 313 aa, Sorghum bicolor
  misc_feature: Ceres ANNOT ID no. 6006085
  misc_feature (153)..(263): Pfam Id: Abi Pfam Desc: CAAX amino terminal protease family
  misc_feature (14)..(312): NCBI GI: 79594437 NCBI Desc: prenyl-dependent caax protease [arabidopsis thaliana]
  misc_feature (1)..(175): NCBI GI: 115463397 NCBI Desc: os05g0357700 [oryza sativa (japonica cultivar-group)]
  misc_feature (8)..(296): NCBI GI: 62858955 NCBI Desc: rce1 [xenopus tropicalis]
  misc_feature (13)..(296): NCBI GI: 49257606 NCBI Desc: mgc83398 protein [xenopus laevis]
  misc_feature (13)..(298): NCBI GI: 4826976 NCBI Desc: prenyl protein protease rce1 [homo sapiens]
MATPASLHPATPPAISGALAVVACAVMAVSYVAVLYAPTVILRFPPPTSLRTFLHRRFACAAVASAASALATASLLRVWSLSDFADMLAVFGVRKDHLFQAVVIPLLLTSLVYAGSFVTRLWFLASSWGSGDEVEIGCAQRLAQWIQAAVADVMVWRNYVVAPFTEELVFRACMIPLLLCGGFKMSTIIFLSPVFFSLAHLNHLFELHQQGCNFMRSLLIVGVQLGYTVIFGWYAAFLFIRTGNLLCPIVAHVFCNMMGLPVFSSPRTKGAASVAFMAGLISFFWLLFPATSPELYNSSFDRCNCWHGFCNWK

SEQ ID NO: 83 - DNA, 1203 bp, Sorghum bicolor
  misc_feature: Ceres ANNOT ID no. 6006086
  misc_feature: Encodes the peptide sequence at SEQ ID NO 84
atggctcctaacgaagccgctaacatcaccaccccgtccgagccggagagcgtgggcggcagtgagatgagcagcgaagacacggctgccgccaggccgctgctctcgtcgtcctccccctccccctccctctccccctccgcggcctctgcagccccggtgctggagagcatagaggagctggaccggaggtacgcgccgtacgcgcggcgggacgcgtacgggccgatggggctcggccccctgagcgccgcggaggcggcgcggctggcgtttgccgcggtcgtgctggtcccgctccgcgtcatggcaggcgtgctcgtactcgtggtctactaccttgtgtgccgcgtgtgcacgctgcgggtggaggaggagcgggaaggcggcgaaggggatgggtacgcgcggctggacggatggagacgggcgggggttgtgcgatgcggccgcgcactcgctcgcgccatgttgttcgtcttcggattctactggatccgagagtacgactgccgcttccccaatgccgaggatgacgatgtggaccagtctaaagaaaccgaaaggcctggggcaattgtgtctaatcatgtatcttatgtggatattctttatcacatgtcagcctcttttcctagttttgttgcaaagagatcagtggccagattgcctctagttggtctcataagcaaatgtcttggatgcatttttgttcagcgggagtctaaaacatcagatttcaaaggtgtttcaggtgctgtaactgaaagaatccagcgtgctcatcaacagaaaaatgcaccagtgatgctactcttccctgagggcacaactacaaatggggattatctccttccattcaaaacaggtgcttttcttgcaaaagcaccactcagaccagtcattttgagatatccttacaaaagatttaatccagcatgggagtccatgtcaggggcacgtcatgtatttctgctcctctgtcaatttgtaaattatctagaggtggtccatttacctgtttactatccttctgagcaagaaaaggatgattctaagctttatgcaaataatgtacggaaattgatggcagtggagggaaacttgattctttcagaccttgggctggcggagaagcgagtgtaccatgccgcactgaatggtaatagtctacctcgtgctttacatcagaaagatgattga

SEQ ID NO: 84 - protein, 400 aa, Sorghum bicolor
  misc_feature: Ceres ANNOT ID no. 6006086
  misc_feature (175)..(304): Pfam Id: Acyltransferase Pfam Desc: Acyltransferase
  misc_feature (13)..(400): NCBI GI: 140062229 NCBI Desc: phospholipid/glycerol acyltransferase [medicago truncatula]
  misc_feature (124)..(300): NCBI GI: 6503307 NCBI Desc: is a member of the pf01553 acyltransferase family. [arabidopsis thaliana]
  misc_feature (92)..(386): NCBI GI: 89290368 NCBI Desc: acyltransferase family protein [tetrahymena thermophila sb210]
  misc_feature (94)..(362): NCBI GI: 146162918 NCBI Desc: acyltransferase family protein [tetrahymena thermophila sb210]
  misc_feature (138)..(364): NCBI GI: 24640840 NCBI Desc: cg32699-pa [drosophila melanogaster]
  misc_feature: The sequence is a functional homolog of SEQ ID NO. 487 in the 11/188,298 US application
MAPNEAANITTPSEPESVGGSEMSSEDTAAARPLLSSSSPSPSLSPSAASAAPVLESIEELDRRYAPYARRDAYGPMGLGPLSAAEAARLAFAAVVLVPLRVMAGVLVLVVYYLVCRVCTLRVEEEREGGEGDGYARLDGWRRAGVVRCGRALARAMLFVFGFYWIREYDCRFPNAEDDDVDQSKETERPGAIVSNHVSYVDILYHMSASFPSFVAKRSVARLPLVGLISKCLGCIFVQRESKTSDFKGVSGAVTERIQRAHQQKNAPVMLLFPEGTTTNGDYLLPFKTGAFLAKAPLRPVILRYPYKRFNPAWESMSGARHVFLLLCQFVNYLEVVHLPVYYPSEQEKDDSKLYANNVRKLMAVEGNLILSDLGLAEKRVYHAALNGNSLPRALHQKDD

SEQ ID NO: 85 - DNA, 708 bp, Sorghum bicolor
  misc_feature: Ceres ANNOT ID no. 6006088
  misc_feature: Encodes the peptide sequence at SEQ ID NO 86
  misc_feature: Up-regulated in root tissues in response to methyl jasmonate treatment
  misc_feature: Up-regulated in shoot tissues in response to methyl jasmonate treatment
atggacgccgccgacgtgtggggccgctcgtcgtcctcgtcttcttcttccgccgccgccgccgcgaggcgcctgcaggcgcgctacgatctgtatatggggttcgacgacgcggacgccggcggggatgacgtgacggacccgcgcggcggcggggcggagccctacaactgccccttctgcggcgaggacttcgacttcgtcagcctctgctgtcacatcgacgacgagcatgccgttgaggctaagagcggggtatgccccatctgtgctacaagggttggaatggacttgataggacatttgacaatgcagcatggaagttatttcaagatgcaacgcaggcgcagagtccgaaaagtgtctactgggtcccattctttgttatccttgttgagaaaggacttgagaaatggcagtttgcagtcatttctcggtggatcatcctatgtatccaatcctcctgctgcagcaccagatccatttttgtcatctttaatttgtagtttgcctgtggctgaaccatccaaagatttacattccgactcatctgacaataactttttgctaaataaattcccagatgaaaagactgtagagagagctgaaccatcattgtcagagaaggatcagaaggaaaggattcaaaggagcaaattcgtccgtgggcttgtgctctcgacaatatttgatgatgataacttgtaa

SEQ ID NO: 86 - protein, 235 aa, Sorghum bicolor
  misc_feature: Ceres ANNOT ID no. 6006088
  misc_feature (14)..(229): Pfam Id: Di19 Pfam Desc: Drought induced 19 protein (Di19)
  misc_feature (1)..(235): NCBI GI: 115463401 NCBI Desc: os05g0358000 [oryza sativa (japonica cultivar-group)]
  misc_feature (1)..(232): NCBI GI: 25992529 NCBI Desc: fiber protein fb2 [gossypium barbadense]
  misc_feature (1)..(232): NCBI GI: 66271049 NCBI Desc: fb2 [gossypium hirsutum]
  misc_feature (11)..(232): NCBI GI: 45752696 NCBI Desc: at5g26990 [arabidopsis thaliana]
  misc_feature (17)..(232): NCBI GI: 22137138 NCBI Desc: at5g49230/k21p3_11 [arabidopsis thaliana]
  misc_feature: Up-regulated in root tissues in response to methyl jasmonate treatment
  misc_feature: Up-regulated in shoot tissues in response to methyl jasmonate treatment
MDAADVWGRSSSSSSSSAAAAARRLQARYDLYMGFDDADAGGDDVTDPRGGGAEPYNCPFCGEDFDFVSLCCHIDDEHAVEAKSGVCPICATRVGMDLIGHLTMQHGSYFKMQRRRRVRKVSTGSHSLLSLLRKDLRNGSLQSFLGGSSYVSNPPAAAPDPFLSSLICSLPVAEPSKDLHSDSSDNNFLLNKFPDEKTVERAEPSLSEKDQKERIQRSKFVRGLVLSTIFDDDNL

SEQ ID NO: 87 - DNA, 1959 bp, Sorghum bicolor
  misc_feature: Ceres ANNOT ID no. 6006089
  misc_feature: Encodes the peptide sequence at SEQ ID NO 88
  misc_feature: Down-regulated in shoot tissues in response to methyl jasmonate treatment
  misc_feature: Down-regulated in shoot tissues in response to aminocyclopropane carboxylic treatment
atgatctccgcgcgcaccgccgcgtccccggcctcccccgcctccgcgtggaagcggggaggaggacgaagcgaggtcggcggcggcagcagctgcgacggatgccggacctacaggaacaccttgcggaggagcgccgcggcggcgaaggtgcgcgccgtgccgccgaggcgggtggaggcggtcgcgatgggctccgccgcggagacggagaaggagaaggaggagcagcaggaggtggtggccggggccggcggcctcgtcgaggaccactacgacgaggacagtgccgccgaggaggtgccaatcatgccctgggccttctccgtcgcgagcggttacactctcttgagggatccccatcacaacaagggtcttgctttcacggagaaggagagggatgcacaccacttgcgtgggctgcttcctcctgcagttgtgcctcagcaactccaagttaagaagatcatgcacaacctgcggcagtatcaggtccctttgcagcgctatatggccatgatggaccttcaggagaggaacgagaggcttttctacaagcttttaattgataatgtggaggagctgcttcctgtggtttacacaccaactgtaggtgaggcctgccagaagtatgggtccatctttcgacaaccacagggtctgtatgtcagcctgagggacaaggggaaggtcctagaagttctaaggaactggccacataggaacattgaagttatctgtgttactgatggggagcgaatcttgggacttggagatttgggttctcagggaatgggaattcctgtaggcaaacttgctctatacactgctcttggaggagttcgtccatcagcttgtttgcctatcacaattgatgttggcacaaacaatgagaaactgcttaatgatgagttctacattggactccggcaaaaacgtgcaactggcgaggagtatcatgagcttatggaagagttcatggctgctgttaagcaaatctacggtgagaaagtcctcgttcagttcgaggacttcgccaaccataatgcctttgatttgcttgcaaaatatagcaagagccatcttgttttcaatgatgatatccagggcacagcatcagtggtccttgcaggtgtgttagcagcactcaaggtggttggtgggaccctggcagagcacacttatttattccttggtgctggggaggctggaactggtattgcagaactcattgctcttgagatttcaaaacagacgaagactccaattgaagagtgccgcaagaaggtttggctggtggactcaaagggtttgattgttgactctcggaaaaactcccttcagtcattcaaaaaaccttgggcacatgagcatgagcccttgacaaccttgtatgatgctgttcagtccatcaaacctacagttctgattgggacatctggagttggaagaacattcacaaaagaagttgttgaggccatggcttccttcaatgagaggcctatcatcttttcactgtcaaatccaacctcacattcagaatgtactgctgaagaagcatataactggactcagggtcgtgcgatatttgccagtggcagtccatttgaccctgtggagtacgatgggaagatttttgtgccgggccaggcgaacaatgcctacattttccctggattcggccttggtcttgttatttctggagccatccgtgtccacgaggacatgcttcttgccgcctcggaagcactagctggtcaggccacacaggagaactttgacaagggatcgatcttcccacccttcaccaacattagaaagatctctgcgcgcattgctgcagccgtggctgcaaaagcttatgaacttggtttggcgacacgtctgcctcccccaagagacctggtgaaatatgcagagagctgcatgtacactcctgtctaccgtaattaccgatag

SEQ ID NO: 88 - protein, 652 aa, Sorghum bicolor
  misc_feature: Ceres ANNOT ID no. 6006089
  misc_feature (368)..(621): Pfam Id: Malic_M Pfam Desc: Malic enzyme, NAD binding domain
  misc_feature (177)..(366): Pfam Id: malic Pfam Desc: Malic enzyme, N-terminal domain
  misc_feature (1)..(652): NCBI GI: 37147841 NCBI Desc: non-photosynthetic nadp-malic enzyme [zea mays]
  misc_feature (1)..(652): NCBI GI: 18460985 NCBI Desc: nadp-dependent malic enzyme [zea mays]
  misc_feature (1)..(652): NCBI GI: 109896185 NCBI Desc: nadp-dependent malic enzyme, chloroplast precursor (nadp-me)
  misc_feature (1)..(652): NCBI GI: 115434998 NCBI Desc: os01g0188400 [oryza sativa (japonica cultivar-group)]
  misc_feature (1)..(652): NCBI GI: 415315 NCBI Desc: nadp-dependent malic enzyme [oryza sativa]
  misc_feature (1)..(652): SWISSPROT Homolog: EC 1.1.1.40 NADP-dependent malic enzyme, chloroplast precursor
  misc_feature: Down-regulated in shoot tissues in response to methyl jasmonate treatment
  misc_feature: Down-regulated in shoot tissues in response to aminocyclopropane carboxylic treatment
  misc_feature: The sequence is a functional homolog of SEQ ID NO. 292 in the 11/188,298 US application
MISARTAASPASPASAWKRGGGRSEVGGGSSCDGCRTYRNTLRRSAAAAKVRAVPPRRVEAVAMGSAAETEKEKEEQQEVVAGAGGLVEDHYDEDSAAEEVPIMPWAFSVASGYTLLRDPHHNKGLAFTEKERDAHHLRGLLPPAVVPQQLQVKKIMHNLRQYQVPLQRYMAMMDLQERNERLFYKLLIDNVEELLPVVYTPTVGEACQKYGSIFRQPQGLYVSLRDKGKVLEVLRNWPHRNIEVICVTDGERILGLGDLGSQGMGIPVGKLALYTALGGVRPSACLPITIDVGTNNEKLLNDEFYIGLRQKRATGEEYHELMEEFMAAVKQIYGEKVLVQFEDFANHNAFDLLAKYSKSHLVFNDDIQGTASVVLAGVLAALKVVGGTLAEHTYLFLGAGEAGTGIAELIALEISKQTKTPIEECRKKVWLVDSKGLIVDSRKNSLQSFKKPWAHEHEPLTTLYDAVQSIKPTVLIGTSGVGRTFTKEVVEAMASFNERPIIFSLSNPTSHSECTAEEAYNWTQGRAIFASGSPFDPVEYDGKIFVPGQANNAYIFPGFGLGLVISGAIRVHEDMLLAASEALAGQATQENFDKGSIFPPFTNIRKISARIAAAVAAKAYELGLATRLPPPRDLVKYAESCMYTPVYRNYR

SEQ ID NO: 89 - DNA, 1464 bp, Sorghum bicolor
  misc_feature: Ceres ANNOT ID no. 6006187
  misc_feature: Encodes the peptide sequence at SEQ ID NO 90
atgggtagggatgatgagcaggttgactctatggagattgacgaccagaagcagcaacagctagaagcccccgctgctgtgccagaagggttcaacactgactatctccgagtctactacggaaagctcttcccatatggtgatttcttcaaatggctttgctatggaaatgatggaaagcaccccggatgtgatcagtcatacgttggacgtcgagagttttcatttacactggagaatgacatctacttgcgcttccaatcctttgatagtgctactgaattggagagttctatcaaggagaagtgccctttcaagattgatattggacctgtctacagcgtagatccttcaaagcgtcatgcttacgcccaatctggcaataatgtctttgtaccagtggagagagaactaatttttgacattgatatctctgattatgatgatgttcgctactgctgctctggagctgatgtctgcttagactgctggcccttaatgacaattgctatcaaaattttggatacttctcttagagatgattttggtttcaatcacatactatgggtatacagtggccgtcgtggtgtccattgctgggtgtgtgatagcagagcaagaaagctaagcaatgaacaaagggctgcaattgctgactactttcgagtctacaagggtggtgaaaatgcactgaagaaagtatccttggctggacctgtcctccatcccttccttgcccggtcatacatggatgttctcaaaaccttctttgaagataggttgctccttagccaacaactcttttcatcagaggagagatgtcagaagatacttgatctcatccctgatgaaaatgttgctagtgaggtccatgacaagtggcagggaaatagacgatcatctatttcaaaggaagatgtcaatgtgaccagatgggagcaattgaagacgactttacagtcaggaaaacacaaggctcaggggcttcgtagatgtgtggaagagattgtcttctcatacacatatcctagacttgacatggaggtatcaaagcacatgaatcatttactaaaagctcccttttgtatacatccaaagacaggtcgtgtttgtgttccaattgatcccagtaactgtgatgatttcgatcctgcagctgttccgactctatcacagcttttaggagagctcaatgctactggttttaagacagattctgaaaataatttggaaagaacgtcccttgggaaatccatcagttttttcagaacttcctttctgcacccattgctgaaagcatgcaaggaggaactggaaagtgcatataatgcaaagcttcaacagtccaagaattccttgaactggggtaaacctgtattggtgctggaatttctaccattaggtttctgttattcatggggcaatgaatgtgaccgacggtggcaagataatcatgcatcttag

SEQ ID NO: 90 - protein, 487 aa, Sorghum bicolor
  misc_feature: Ceres ANNOT ID no. 6006187
  misc_feature (140)..(376): Pfam Id: DNA_primase_S Pfam Desc: Eukaryotic and archaeal DNA primase small subunit
  misc_feature (58)..(409): NCBI GI: 10177372 NCBI Desc: dna polymerase alpha subunit iv (primase)-like protein [arabidopsis thaliana]
  misc_feature (24)..(464): NCBI GI: 89267400 NCBI Desc: primase, polypeptide 1, 49kda [xenopus tropicalis]
  misc_feature (24)..(464): NCBI GI: 29612475 NCBI Desc: dnapol-alpha50-prov protein [xenopus laevis]
  misc_feature (34)..(452): NCBI GI: 41393065 NCBI Desc: primase polypeptide 1 [danio rerio]
  misc_feature (4)..(408): NCBI GI: 66852353 NCBI Desc: p48 dna primase [aspergillus fumigatus af293]
MGRDDEQVDSMEIDDQKQQQLEAPAAVPEGFNTDYLRVYYGKLFPYGDFFKWLCYGNDGKHPGCDQSYVGRREFSFTLENDIYLRFQSFDSATELESSIKEKCPFKIDIGPVYSVDPSKRHAYAQSGNNVFVPVERELIFDIDISDYDDVRYCCSGADVCLDCWPLMTIAIKILDTSLRDDFGFNHILWVYSGRRGVHCWVCDSRARKLSNEQRAAIADYFRVYKGGENALKKVSLAGPVLHPFLARSYMDVLKTFFEDRLLLSQQLFSSEERCQKILDLIPDENVASEVHDKWQGNRRSSISKEDVNVTRWEQLKTTLQSGKHKAQGLRRCVEEIVFSYTYPRLDMEVSKHMNHLLKAPFCIHPKTGRVCVPIDPSNCDDFDPAAVPTLSQLLGELNATGFKTDSENNLERTSLGKSISFFRTSFLHPLLKACKEELESAYNAKLQQSKNSLNWGKPVLVLEFLPLGFCYSWGNECDRRWQDNHAS

SEQ ID NO: 91 - DNA, 2127 bp, Sorghum bicolor
  misc_feature: Ceres ANNOT ID no. 6006283
  misc_feature: Encodes the peptide sequence at SEQ ID NO 92
atggcgaggggcaccaccaccatggaggtgcgcgcagacggcgtcgccgtcatcaccatctccaacccgcccgtcaacgccctctccctcgacgtcattgctagtttgcagaggaactatacagaggctctaagcaggaatgatatcaaggcaatcgtcctcactggtgccaaaggaaggttctgcggcggattcgatatatctgcgtttggaaagaagccaaaaaatgagaagcctggatccatgtctattgatttcttgactgacatagtggaagatgcacataaaccgtcagtggctgctatagatggcattgctctaggaggtgggttggagcttgctatggtttgccatgctcgcatttcaacaccatcagctcaattaggactacctgaacttcaacttggaatcattcctggactgggagggacgcagcgccttccccgtcttgttggcctgccaaaagccattgagatgatgttgatgtcaaagactataaaaggcatgggggcacaagaactcggcttagttgatgctgttacttcagctaatgaattggtcaacgctgcctgttcctgggctctagaaattgttgaaaagaagaaaccatggttcagaagtctccacagaactgataaacttccagatcttgcggaagtgaaggatgttctgaaatttgcaagagttcaagctaaaatgaagggtgctaatgttcagcatcccatagtttgcattgatgttattgaagaaggaatagtctctggccctcgtgcaggtctcatgaagtctcaaacaagcaaaagcttaagacacttttttttcgctcagcgtgctacttcaaagattccaaatattaccaacatgggtttgacagcacggaaaattaaaaaggcagctatcattgggggtggtctaatgggatcaggcattgcaacaatattgatattgaacaacttcagtgttgtcttgaaagaagtaaatgaagagttcttatctactggcattaacagaattaaagccaatttgcagagtttcgtcaaaaagggtcaacttgccatagaagattataaaaagaaactttctctgttatgtggtgttcttgactatgaacagttcagagatacagatgtagtcattgaggcagttattgaggatatgtttcttaagcagcaaatattttctgatcttgagaagtattgccatcataattgcatatttgccacaaacacttcaactatagacctgaacataattggtgagaagacagcttctcaggaccggattgtcggcgcacacttctttagcccagctcatgtcatgccactgttggaaatagtttgtactcatcatacttcttctcaagttattgtggacctgcttgatttggcaaagaagatacagaaaacaccaatagttgttggcaactgcacaggtttcgctgtcaatcggatgttctttccttacgctcaggcagcttgttttcttgttgatcatggtctggatgtgtatcacacagatcatgtgatcacacaatttggaatgccaatggggcccttccgattagctgatcttgttggttttggtgttgctattgccacaaggaagcaatattaccagagttatcctggacgatgctacaaatcaatgattcttcagattcttgttgaggataataggacaggtgaatcttctcgtaagggcttctatgtatatgacaataagcgcaaagcctctcgagatcctgatttgggaaagtacattgaaaaatcaaggaacatggcaggtgttatgcaagatcctaagctgatgaaactaacagacaatgacattgtggagatgatcttctttcctgtggtgaatgaagcctgccgagtgcttgatgagggaattgctctcaaagcatctgaccttgatgtagcttccattatggggatgggtttcccttcttacaggggtggactaatgttttgggccgactcgcttggtgcgaaatatgtgtacgacagactggatgcatggtcgaaggattacggggagttcttcagaccctgtgaatatttagctgtgagagctcgtcagggtgtatccctggctgccaaggttgatggtgtcaagtcgcgactctag

SEQ ID NO: 92 - protein, 708 aa, Sorghum bicolor
  misc_feature: Ceres ANNOT ID no. 6006283
  misc_feature (297)..(476): Pfam Id: 3HCDH_N Pfam Desc: 3-hydroxyacyl-CoA dehydrogenase, NAD binding domain
  misc_feature (16)..(182): Pfam Id: ECH Pfam Desc: Enoyl-CoA hydratase/isomerase family
  misc_feature (478)..(571): Pfam Id: 3HCDH Pfam Desc: 3-hydroxyacyl-CoA dehydrogenase, C-terminal domain
  misc_feature (2)..(708): NCBI GI: 551428 NCBI Desc: tetrafunctional protein [cucumis sativus]
  misc_feature (3)..(708): NCBI GI: 6728993 NCBI Desc: fatty acid multifunctional protein (atmfp2) [arabidopsis thaliana]
  misc_feature (3)..(708): NCBI GI: 2832898 NCBI Desc: tetrafunctional protein of glyoxysomal fatty acid beta-oxidation [brassica napus]
  misc_feature (3)..(708): NCBI GI: 115462175 NCBI Desc: os05g0155000 [oryza sativa (japonica cultivar-group)]
  misc_feature (87)..(708): NCBI GI: 551444 NCBI Desc: protein mfp-b [cucumis sativus]
MARGTTTMEVRADGVAVITISNPPVNALSLDVIASLQRNYTEALSRNDIKAIVLTGAKGRFCGGFDISAFGKKPKNEKPGSMSIDFLTDIVEDAHKPSVAAIDGIALGGGLELAMVCHARISTPSAQLGLPELQLGIIPGLGGTQRLPRLVGLPKAIEMMLMSKTIKGMGAQELGLVDAVTSANELVNAACSWALEIVEKKKPWFRSLHRTDKLPDLAEVKDVLKFARVQAKMKGANVQHPIVCIDVIEEGIVSGPRAGLMKSQTSKSLRHFFFAQRATSKIPNITNMGLTARKIKKAAIIGGGLMGSGIATILILNNFSVVLKEVNEEFLSTGINRIKANLQSFVKKGQLAIEDYKKKLSLLCGVLDYEQFRDTDVVIEAVIEDMFLKQQIFSDLEKYCHHNCIFATNTSTIDLNIIGEKTASQDRIVGAHFFSPAHVMPLLEIVCTHHTSSQVIVDLLDLAKKIQKTPIVVGNCTGFAVNRMFFPYAQAACFLVDHGLDVYHTDHVITQFGMPMGPFRLADLVGFGVAIATRKQYYQSYPGRCYKSMILQILVEDNRTGESSRKGFYVYDNKRKASRDPDLGKYIEKSRNMAGVMQDPKLMKLTDNDIVEMIFFPVVNEACRVLDEGIALKASDLDVASIMGMGFPSYRGGLMFWADSLGAKYVYDRLDAWSKDYGEFFRPCEYLAVRARQGVSLAAKVDGVKSRL

SEQ ID NO: 93 - DNA, 519 bp, Sorghum bicolor
  misc_feature: Ceres ANNOT ID no. 6006288
  misc_feature: Encodes the peptide sequence at SEQ ID NO 94
atgctcgcccaccgccgcctcctcctcctcctcctcgccgccgcggctgcggcgacgggcggcaccgccttcgctaagaaaacggcgtacgaagtcctcgccgactacgacttcccgccggggatcctccccaagggcgtggtctcctatacgctcgacaacgccacgggcgccttcacggccacgctcgatggatcctcctcctgcgagttctccatcgagggctcctacactctccgctacaagaccgagatcaccggcaccatcgccaccgaccacctcaccgacctcgagggcgtctccgtcaaggtcctcctcttctggctcgacatcgtcgaggtcacccgcagcggcgacagcctcgagttctccatcggcatcgtctccgccgacttcgggatcgacaacttcctcgagagccccacctgcggctgcggcttcgactgcgacgaccggctcgtgctccagaagcagccggggggcgccacagccaagctgcgcctgcgaggtgccttctag

SEQ ID NO: 94 - protein, 172 aa, Sorghum bicolor
  misc_feature: Ceres ANNOT ID no. 6006288
  misc_feature (28)..(145): NCBI GI: 115463963 NCBI Desc: os05g0421100 [oryza sativa (japonica cultivar-group)]
  misc_feature (7)..(143): NCBI GI: 115472661 NCBI Desc: os07g0548800 [oryza sativa (japonica cultivar-group)]
  misc_feature (13)..(146): NCBI GI: 32479663 NCBI Desc: p0041a24.4 [oryza sativa (japonica cultivar-group)]
  misc_feature (13)..(146): NCBI GI: 115458574 NCBI Desc: os04g0443200 [oryza sativa (japonica cultivar-group)]
  misc_feature (26)..(127): NCBI GI: 61680608 NCBI Desc: chain a, solution nmr structure of at5g01610, an arabidopsis thaliana protein containing duf538 domain
  misc_feature: Useful for making plants with altered terpenoid content
  misc_feature: Functional homolog of the protein sequence given in SEQ ID NO 13044
  misc_feature: Useful for making plants with altered terpenoid content
  misc_feature: Functional homolog of the protein sequence given in SEQ ID NO 13044
MLAHRRLLLLLLAAAAAATGGTAFAKKTAYEVLADYDFPPGILPKGVVSYTLDNATGAFTATLDGSSSCEFSIEGSYTLRYKTEITGTIATDHLTDLEGVSVKVLLFWLDIVEVTRSGDSLEFSIGIVSADFGIDNFLESPTCGCGFDCDDRLVLQKQPGGATAKLRLRGAF

SEQ ID NO: 95 - DNA, 540 bp, Sorghum bicolor
  misc_feature: Ceres ANNOT ID no. 6006300
  misc_feature: Encodes the peptide sequence at SEQ ID NO 96
atgctcgcccaccgtctcctcctcgtcgccgtcgccgtcgccgccgctgccgcggctactgtgagcagcaccgccttcgctaagccgacggcctacgaagccctcgccgacttcgacttcccgccggggatcctccccaagggcgtggtcgcctacacgctcgacaacgccacgggcgccttcacggccacgctcgatgcctccgcgtccggcaccggatcctccgtctgcgagttctccatccagggctcctactcgctgcgctaccagaccaagatcaccggcaagatcgcccccgaccacctcagcgacctccagggggtctccgtcaaggtcctcttcctctggatcaacatcgtcgaggtcacccgccgcggcgacaacctcgagttctccgtcggcatcgcctccgccgacttcgggattgagaacttcctcgagtgcccaacctgcggctgcgggttcgactgcaacgacctgctcatgctccagaagccgggggccgccaccgccaagctgcgcctgcgaggtgccttttag

SEQ ID NO: 96 - protein, 179 aa, Sorghum bicolor
  misc_feature: Ceres ANNOT ID no. 6006300
  misc_feature (28)..(153): NCBI GI: 115463963 NCBI Desc: os05g0421100 [oryza sativa (japonica cultivar-group)]
  misc_feature (7)..(154): NCBI GI: 32479663 NCBI Desc: p0041a24.4 [oryza sativa (japonica cultivar-group)]
  misc_feature (7)..(154): NCBI GI: 115458574 NCBI Desc: os04g0443200 [oryza sativa (japonica cultivar-group)]
  misc_feature (28)..(135): NCBI GI: 40642817 NCBI Desc: cp protein [celosia cristata]
  misc_feature (28)..(135): NCBI GI: 61680608 NCBI Desc: chain a, solution nmr structure of at5g01610, an arabidopsis thaliana protein containing duf538 domain
  misc_feature: Useful for making plants with altered terpenoid content
  misc_feature: GREAT-hit functional homolog of the protein sequence given in SEQ ID NO 13044
  misc_feature: Useful for making plants with altered terpenoid content
  misc_feature: Functional homolog of the protein sequence given in SEQ ID NO 13044
MLAHRLLLVAVAVAAAAAATVSSTAFAKPTAYEALADFDFPPGILPKGVVAYTLDNATGAFTATLDASASGTGSSVCEFSIQGSYSLRYQTKITGKIAPDHLSDLQGVSVKVLFLWINIVEVTRRGDNLEFSVGIASADFGIENFLECPTCGCGFDCNDLLMLQKPGAATAKLRLRGAF

SEQ ID NO: 97 - DNA, 282 bp, Sorghum bicolor
  misc_feature: Ceres ANNOT ID no. 6006301
  misc_feature: Encodes the peptide sequence at SEQ ID NO 98
atggcgcgtgctgcgtccagctatatatccaggaggggcctctctgcagcgataacggtggcggagtcgtcggcgaagaaggtggaggagaaggcggtgaagctgggcacggtggccaaggacatcgccagcgccatggcgaccacgacggaggagaagacggcgttctgggagccggaccccgagaccggcttctaccgcccggtgaccggcaccaaggaggtggacgccgccgacctgcgcgccgagatgctcaagcagaggatgctgcagcaggactga

SEQ ID NO: 98 - protein, 93 aa, Sorghum bicolor
  misc_feature: Ceres ANNOT ID no. 6006301
  misc_feature (1)..(86): Pfam Id: LEA_3 Pfam Desc: Late embryogenesis abundant protein
  misc_feature (1)..(79): NCBI GI: 13249144 NCBI Desc: zinc-induced protein [oryza sativa]
  misc_feature (1)..(88): NCBI GI: 58395780 NCBI Desc: late embryogenesis abundant-like protein [arabidopsis thaliana]
  misc_feature (1)..(88): NCBI GI: 7268998 NCBI Desc: at4g02380 [arabidopsis thaliana]
  misc_feature (6)..(87): NCBI GI: 94503776 NCBI Desc: late embryogenesis abundant protein 5 [populus suaveolens]
  misc_feature (11)..(88): NCBI GI: 145332961 NCBI Desc: sag21 (senescence-associated gene 21) [arabidopsis thaliana]
  misc_feature: Useful for making plants with modulated drought sensitivity
  misc_feature: Functional homolog of the protein sequence given in SEQ ID NO 13514
MARAASSYISRRGLSAAITVAESSAKKVEEKAVKLGTVAKDIASAMATTTEEKTAFWEPDPETGFYRPVTGTKEVDAADLRAEMLKQRMLQQD

SEQ ID NO: 99 - DNA, 1062 bp, Sorghum bicolor
  misc_feature: Ceres ANNOT ID no. 6006364
  misc_feature: Encodes the peptide sequence at SEQ ID NO 100
atgatggacgtggtctaccatgaggagtacgtgaggaacccgaggggcgtgcagctcttcacctgcggctggctgccgccggcgtcctcctccccacccaaagcgctcgtcttcctctgccatggctacgggatggagtgcagcgacttcatgagagcatgtgggatcaagttggccacagcagggtatggtgtgtttggcatcgattatgagggccacggcaagtccatgggcgccaggtgctacatccagaagtttgaaaacctcgtggctgactgcgacaggttcttcaagtccatctgtgatatggaggaatacagaaataaaagccggtttctgtacggcgagtcgatggggggagccgtggctctactactgcacaggaaggatccgaccttctgggatggtgcagttcttgtggcgccaatgtgcaagatttcagagaaagtgaaaccgcacccggtggtggtcaccctcctgactcaagtggaggagatcatcccaaagtggaagatcgtccccaccaaagacgtcatcgactcggcattcaaggaccccgtcaagcgcgaaaagatcaggaagaacaagctcatctaccaggacaagccccggctgaagacagctctggagctgctcaggaccagcatggatgtggaagatagcctgtcagaggtgacgatgccattcttcatcctgcacggcgaggccgacacggtgaccgacccggaggtcagccgcgccctctacgagcgcgccgccagcaccgacaagaccatcaagctgtaccctgggatgtggcacggcctcaccgccggcgagcctgacgagaacgtggagctggtgttctccgacatcgtctcgtggctcgacaagcgcagtcgccactgggagcaagacgagcgggcaaggactccaccggagcctgagaacaagcaccgccaggcggcgaccaccaaaatcacacgcgttaccagcagcagtggcggcaccgagagtcagcggcgcggcagctgcctctgcggactaggcggtcgaccacaccagcaacagtgtaggatgtag

SEQ ID NO: 100 - protein, 353 aa, Sorghum bicolor
  misc_feature: Ceres ANNOT ID no. 6006364
  misc_feature (63)..(287): Pfam Id: Abhydrolase_1 Pfam Desc: alpha/beta hydrolase fold
  misc_feature (6)..(344): NCBI GI: 30695682 NCBI Desc: esterase/lipase/thioesterase family protein [arabidopsis thaliana]
  misc_feature (6)..(293): NCBI GI: 92878320 NCBI Desc: alpha/beta hydrolase [medicago truncatula]
  misc_feature (4)..(293): NCBI GI: 7019651 NCBI Desc: lipase-like protein [arabidopsis thaliana]
  misc_feature (4)..(292): NCBI GI: 7019652 NCBI Desc: lipase-like protein [arabidopsis thaliana]
  misc_feature (8)..(295): NCBI GI: 140063294 NCBI Desc: alpha/beta hydrolase [medicago truncatula]
MMDVVYHEEYVRNPRGVQLFTCGWLPPASSSPPKALVFLCHGYGMECSDFMRACGIKLATAGYGVFGIDYEGHGKSMGARCYIQKFENLVADCDRFFKSICDMEEYRNKSRFLYGESMGGAVALLLHRKDPTFWDGAVLVAPMCKISEKVKPHPVVVTLLTQVEEIIPKWKIVPTKDVIDSAFKDPVKREKIRKNKLIYQDKPRLKTALELLRTSMDVEDSLSEVTMPFFILHGEADTVTDPEVSRALYERAASTDKTIKLYPGMWHGLTAGEPDENVELVFSDIVSWLDKRSRHWEQDERARTPPEPENKHRQAATTKITRVTSSSGGTESQRRGSCLCGLGGRPHQQQCRM

SEQ ID NO: 101 - DNA, 837 bp, Sorghum bicolor
  misc_feature: Ceres ANNOT ID no. 6006376
  misc_feature: Encodes the peptide sequence at SEQ ID NO 102
atgacccggcggaacggctgtacgatctacgtgggcaatctccccggcgacatccgcgagagggaagtagatgatctcttctacaagtatggacgtatcgtggaaattgacttgaagattccaccaaggcctcctggttttgcttttgttgagtttgaggatccacatgatgctgaagatgcaatatatggccgtgatggatacaactttgatggccataggttgcgggtggaattagctcatggtggacgaggcccatcttcttttgatcgatctagcagctatagcagtgctgggcaacgcggtgcctctaaacgttctgattaccgtgttatggttactggattaccttcttcagcatcatggcaagatctcaaggatcatatgcggcgagctggtgatgtctgtttcactgatgtgtatcgtgaggctggagcaactattggaatagctgattatactaactatgaagatatgaaacatgcgataaggaagctagatgattctgagttccgtaatgctttttcaaggacatatatccgggtgagggagtatgatgctaggcgcagccgttctcgctccagaggcagaagccgtagccgctctaagtcaagaagcagaagtcatagccgctcatactcaagaagtagaagccgcagttatagcaagagtaggagcccaagatctagatctgcttctcagtcaaaatcacctgttaaagcaagatcaccatccagatcccctcctgtttctcccccacgtgacaagtctataagcaggagtcctgccaggagcaaaagtctgccccgatcttgttctccggcaaaacctgaatga

SEQ ID NO: 102 - protein, 278 aa, Sorghum bicolor
  misc_feature: Ceres ANNOT ID no. 6006376
  misc_feature (9)..(77): Pfam Id: RRM_1 Pfam Desc: RNA recognition motif. (a.k.a. RRM, RBD, or RNP domain)
  misc_feature (111)..(178): Pfam Id: RRM_1 Pfam Desc: RNA recognition motif. (a.k.a. RRM, RBD, or RNP domain)
  misc_feature (1)..(278): NCBI GI: 52140012 NCBI Desc: asf/sf2-like pre-mrna splicing factor srp31 [zea mays]
  misc_feature (1)..(278): NCBI GI: 52140014 NCBI Desc: asf/sf2-like pre-mrna splicing factor srp31'' [zea mays]
  misc_feature (1)..(242): NCBI GI: 52140013 NCBI Desc: asf/sf2-like pre-mrna splicing factor srp31' [zea mays]
  misc_feature (1)..(252): NCBI GI: 52140015 NCBI Desc: asf/sf2-like pre-mrna splicing factor srp31''' [zea mays]
  misc_feature (1)..(278): NCBI GI: 115463447 NCBI Desc: os05g0364600 [oryza sativa (japonica cultivar-group)]
  misc_feature: Useful for making plants with altered alkaloid content
  misc_feature: Useful for making plants with altered lignin content
  misc_feature: Functional homolog of the protein sequence given in SEQ ID NO 13245
MTRRNGCTIYVGNLPGDIREREVDDLFYKYGRIVEIDLKIPPRPPGFAFVEFEDPHDAEDAIYGRDGYNFDGHRLRVELAHGGRGPSSFDRSSSYSSAGQRGASKRSDYRVMVTGLPSSASWQDLKDHMRRAGDVCFTDVYREAGATIGIADYTNYEDMKHAIRKLDDSEFRNAFSRTYIRVREYDARRSRSRSRGRSRSRSKSRSRSHSRSYSRSRSRSYSKSRSPRSRSASQSKSPVKARSPSRSPPVSPPRDKSISRSPARSKSLPRSCSPAKPE

SEQ ID NO: 103 - DNA, 1026 bp, Sorghum bicolor
  misc_feature: Ceres ANNOT ID no. 6006393
  misc_feature: Encodes the peptide sequence at SEQ ID NO 104
atgaggagctcaagcagcctagtgctgttctctgctgctctgctcctcttctgctgcttcaccactggcgcggcggcggacgccggcggcgatggtggtcttcggctgggctactactcggggagctgcccgcgagccgaggacatcgtcaaggagcaggtgacgcagctgtaccacaagcacggcaacacggcggtgtcatggctgcgcgccctgttccacgactgcttcgtgaggtcctgcgacgcctcgctgctcctggatcccacggcggccaccggcggcgcctccgagaaggcctccccgcggagcttcggcatgcggaacttcaagtacgtcgacgtgatcaaggcggcggtggagcgggagtgccccggcaccgtctcctgcgccgacgtgctggccctggcggcgcgcgacggcgccgccatcctgggcggcccgcgcgcggtgcgcatgcgcacggggcggcgggacagcctggagagccactacgccgaggtggagcgcgacatccccaaccacaacgacagcgtgtcggcggtgctggcccggttcgcggccgtaggcgtggacgccgagggcgccgtggcgctgctgggcgcgcactccgtcggccgcgtgcactgctccaacctggtggcgcggctgtacccgacggtggacgccggcgtcgacccgggatacggggaatacctccgggggcggtgcccgacggcggacgccggcgaggaggaggacacgcgcgacgtggcgtacgcgcgcaacgaccgcgccacgcccatggtgctggacaacatgtactacaagaacctgctggcgcggcgggggctcctcctggtggaccagcggctcgccgacgacccccgcacggcgcccttcgtcgcaaggatggccgccgacaacgcctacttccacgaccgcttcgccgccgcgctgctcaccatgtcggagtacaacccgctgggcgacggagagggggagatcaggcgccactgcaggttcgtcaattcagcagcagcatga

SEQ ID NO: 104 - protein, 341 aa, Sorghum bicolor
  misc_feature: Ceres ANNOT ID no. 6006393
  misc_feature (50)..(301): Pfam Id: peroxidase Pfam Desc: Peroxidase
  misc_feature (43)..(339): NCBI GI: 115474277 NCBI Desc: os07g0694300 [oryza sativa (japonica cultivar-group)]
  misc_feature (30)..(337): NCBI GI: 1402912 NCBI Desc: peroxidase [arabidopsis thaliana]
  misc_feature (3)..(337): NCBI GI: 10697182 NCBI Desc: secretory peroxidase [avicennia marina]
  misc_feature (6)..(337): NCBI GI: 125620184 NCBI Desc: cationic peroxidase [nelumbo nucifera]
  misc_feature (8)..(337): NCBI GI: 167367 NCBI Desc: peroxidase
  misc_feature (30)..(337): SWISSPROT Homolog: EC 1.11.1.7 Peroxidase 21 precursor
  misc_feature: Useful for making plants with altered cell wall content and/or composition
  misc_feature: GREAT-hit functional homolog of the protein sequence encoded by LOCUS at2g37130
  misc_feature: Functional homolog of the protein sequence encoded by LOCUS at4g21960
  misc_feature: Useful for making plants with altered carbohydrate content
  misc_feature: Functional homolog of the protein sequence given in SEQ ID NO 13613
  misc_feature: Useful for making plants with altered cell wall content and/or composition
  misc_feature: Functional homolog of the protein sequence given in SEQ ID NO 13614
MRSSSSLVLFSAALLLFCCFTTGAAADAGGDGGLRLGYYSGSCPRAEDIVKEQVTQLYHKHGNTAVSWLRALFHDCFVRSCDASLLLDPTAATGGASEKASPRSFGMRNFKYVDVIKAAVERECPGTVSCADVLALAARDGAAILGGPRAVRMRTGRRDSLESHYAEVERDIPNHNDSVSAVLARFAAVGVDAEGAVALLGAHSVGRVHCSNLVARLYPTVDAGVDPGYGEYLRGRCPTADAGEEEDTRDVAYARNDRATPMVLDNMYYKNLLARRGLLLVDQRLADDPRTAPFVARMAADNAYFHDRFAAALLTMSEYNPLGDGEGEIRRHCRFVNSAAA

SEQ ID NO: 105 - DNA, 834 bp, Sorghum bicolor
  misc_feature: Ceres ANNOT ID no. 6006410
  misc_feature: Encodes the peptide sequence at SEQ ID NO 106
atggctcccacggcgccgacgcagcggccgacgatgcgccactcctccgcgttcctcatccctccttcgcccccaccgtcctcctcgtcgcccgcgcctggtcccgatcccgatcccgacgacgacgacgccaccgtcgcgctcgtcgtcctcaaccagccgctgccccgcttcgcgcccctcctctggtcccgcgcggcggcgcgggtgtgcgcggacggcggcgccaaccgcgtcttcgacggcatgccggccctgctccctggccaggaccccgacgaggtccgcacgagttacaagccagatgtaatcaaaggggatatggactcagtaagaccggaagtgaaggaacattattctaacttgggcaccagaattgttgatgaatcacatgatcaggacaccacggatttacacaagtgcatagcttttatagcagagaattatcctgcctctaacaaatctaacctcagcatcctggtccttggagctcttgggggaaggtttgatcacgagatggcaaacatcaatgtgcttcatctcttcccaagcatcaatatcgtcctcctatcagatgattgtctgatctttctgctcccaagaacacacacccacgagattcacatcgaacggttgatcgagggaccccactgcgggttgatccccatcggcatgccctccactagcacaacaaccacggggctccgatggaatttagataataccagtatgagctatggaggattgatcagcacgtcaaacatcgtggaagaggacaaggttaccgtcgcctcggattctgaccttatctggacaatatcgctccggaagtga

SEQ ID NO: 106 - protein, 277 aa, Sorghum bicolor
  misc_feature: Ceres ANNOT ID no. 6006410
  misc_feature (52)..(192): Pfam Id: TPK_catalytic Pfam Desc: Thiamin pyrophosphokinase, catalytic domain
  misc_feature (203)..(271): Pfam Id: TPK_B1_binding Pfam Desc: Thiamin pyrophosphokinase, vitamin B1 binding domain
  misc_feature (12)..(276): NCBI GI: 115436492 NCBI Desc: os01g0356500 [oryza sativa (japonica cultivar-group)]
  misc_feature (48)..(276): NCBI GI: 46250253 NCBI Desc: thiamin pyrophosphokinase 1 [homo sapiens]
  misc_feature (48)..(276): NCBI GI: 119600497 NCBI Desc: thiamin pyrophosphokinase 1, isoform cra_a [homo sapiens]
  misc_feature (48)..(276): NCBI GI: 39644700 NCBI Desc: tpk1 protein [homo sapiens]
  misc_feature (14)..(276): NCBI GI: 14278355 NCBI Desc: chain b, mouse thiamin pyrophosphokinase complexed with thiamin
MAPTAPTQRPTMRHSSAFLIPPSPPPSSSSPAPGPDPDPDDDDATVALVVLNQPLPRFAPLLWSRAAARVCADGGANRVFDGMPALLPGQDPDEVRTSYKPDVIKGDMDSVRPEVKEHYSNLGTRIVDESHDQDTTDLHKCIAFIAENYPASNKSNLSILVLGALGGRFDHEMANINVLHLFPSINIVLLSDDCLIFLLPRTHTHEIHIERLIEGPHCGLIPIGMPSTSTTTTGLRWNLDNTSMSYGGLISTSNIVEEDKVTVASDSDLIWTISLRK

SEQ ID NO: 107 - DNA, 867 bp, Sorghum bicolor
  misc_feature: Ceres ANNOT ID no. 6006454
  misc_feature: Encodes the peptide sequence at SEQ ID NO 108
atggcggtgcgcgccattcacacgccgccgctgctcctctgcaccgtggcgttgctgctgctgaccggcggcctcgtgtcgccgtccaccgccgagctcagcctcgacacggtgagggacttcctgacgcgggaggaggacaccattgtgttcagcctcatcgagaggaccaagtacccgctcaaccggccggcctacgagcccctccacttcggcgacggcgccgcgcaccgcctcaacgcctctttcgccgagctcttcatccgcgagtccgaggccgttcagtccaaggccggaaggtaccaaagcctacaggagattccattcttcgcttacagagttcctttcactctggcacctccatacaacttcacaagagatctgtatcccgctgccgcattacttaacgttaatgacgccatatggagcatgtacttcaatgagctgctccctctgctggccaagaacggtgatgatggcaactatgccgtaactgttgatgcagatcttgcatgtcttcaggtgctttcaagaaggatcaactatggtaggtacgtggcagaagtgaagttcagaggagaccagcagacctataccagcttaattcaggctaaggatagagatgctctgatgaagctactgacatctgaagcccaagaagacgtggtaaagagaagggtagagaagaaggcagttgtatttgggcaaaccataacattagatggaccaatccaaactgatgtcaaccatagcagccaggctaacttcaaagttgatccttcagttgtttataaactgtatgatcagtgggtgattccgttgactaaacaagtggaggtcgagtaccttctccatcgtctcgattga

SEQ ID NO: 108 - protein, 288 aa, Sorghum bicolor
  misc_feature: Ceres ANNOT ID no. 6006454
  misc_feature (32)..(288): NCBI GI: 92899219 NCBI Desc: chorismate mutase [medicago truncatula]
  misc_feature (21)..(288): NCBI GI: 5824343 NCBI Desc: chorismate mutase [arabidopsis thaliana]
  misc_feature (21)..(288): NCBI GI: 18406100 NCBI Desc: chorismate mutase, chloroplast (cm1) [arabidopsis thaliana]
  misc_feature (21)..(288): NCBI GI: 9293913 NCBI Desc: chorismate mutase precursor [arabidopsis thaliana]
  misc_feature (32)..(288): NCBI GI: 5732018 NCBI Desc: chorimate mutase [lycopersicon esculentum]
MAVRAIHTPPLLLCTVALLLLTGGLVSPSTAELSLDTVRDFLTREEDTIVFSLIERTKYPLNRPAYEPLHFGDGAAHRLNASFAELFIRESEAVQSKAGRYQSLQEIPFFAYRVPFTLAPPYNFTRDLYPAAALLNVNDAIWSMYFNELLPLLAKNGDDGNYAVTVDADLACLQVLSRRINYGRYVAEVKFRGDQQTYTSLIQAKDRDALMKLLTSEAQEDVVKRRVEKKAVVFGQTITLDGPIQTDVNHSSQANFKVDPSVVYKLYDQWVIPLTKQVEVEYLLHRLD

SEQ ID NO: 109 - DNA, 1242 bp, Sorghum bicolor
  misc_feature: Ceres ANNOT ID no. 6006476
  misc_feature: Encodes the peptide sequence at SEQ ID NO 110
atggccaggccgcgcaagaacgccggtaccgacgaggataatcctaacgccgccacgggcgtcagcgtcaccgggaagccgccgaagctgaagcgggtgcggaggaagggcgagccgcgggagagcagcaccccgtcccagcgcagctccgcgtaccgcggcgtcacacggcaccggtggacggggcggttcgaggcgcacctgtgggacaaggacgcccgcaatggctcccggaacaagaaaggcaagcaaggtgcgtacgacgacgaggaagcggcggcgcgcgcgcacgacctggcggcgctcaagtactggggccccgccaccgtcctcaacttcccgctgtgcggctacgacgaggagctgagggagatggaggcgcagcccagggaggagtacatcgggtcgctgcgtcggcggagcagcggcttctcgcgaggggtgtccaagtacaggggcgttgccaggcatcatcacaacgggcgatgggaggcgaggatcgggcgcgtgctgggcaacaagtacctctacctcgcaacgcaagaggaggcggcggtggcgtacgacatcgccgctatagagcaccgtggcctcaacgcggtcaccaacttcgacatcagccactacgtcaatcactggcatcgacactgccacggcccctccgacgacagcctcggcgtggtggtggacgacgtcgccgcgttccagctaccagatgacctgcccgagtgcccggcgcaccacaccagcggacccttcggcgcgcagcagcagcttcctgacgagacgggagcgctagcggctcatcaaatggcgccaaattcgtcggcgctcgacatggtgttgcagtctcccaagttcaaggagctgatggagcaggtctccgcggcggcggcggcggtggcctccgagagcagcatcggcggcagcatgagcagcagctcgccgtcgccgtctttgtcctcgttctcgccttcgcctctgcagctgccatcgccgtcgtctttgtcctcgttctcgccttcgtcgcctctgcagcagccatcgccgccgctgcagcagcctgagttcgtcgaaggagcgccggcggctcggtgcagcttcccggacgacgtgcagacgttcttcgatttcgagaacgagagcgacatgagcttcatgtacgcggaggttgacacgttcctcttcggggacctgggcgcgtacgcggcgccgatattccacttcgacctagacgtgtga

SEQ ID NO: 110 - protein, 413 aa, Sorghum bicolor
  misc_feature: Ceres ANNOT ID no. 6006476
  misc_feature (50)..(107): Pfam Id: AP2 Pfam Desc: AP2 domain
  misc_feature (149)..(198): Pfam Id: AP2 Pfam Desc: AP2 domain
  misc_feature (1)..(413): NCBI GI: 42407423 NCBI Desc: ap2/erebp transcription factor-like protein [oryza sativa (japonica cultivar-group)]
  misc_feature (1)..(413): NCBI GI: 115476642 NCBI Desc: os08g0442400 [oryza sativa (japonica cultivar-group)]
  misc_feature (18)..(339): NCBI GI: 115479243 NCBI Desc: os09g0423800 [oryza sativa (japonica cultivar-group)]
  misc_feature (5)..(210): NCBI GI: 6587812 NCBI Desc: similar to gbu44028 transcription factor ckc from arabidopsis thaliana and contains two pf00847 ap2 domains
  misc_feature (3)..(211): NCBI GI: 7715603 NCBI Desc: f20b17.12 [arabidopsis thaliana]
  misc_feature: The sequence is a functional homolog of SEQ ID NO 1070 in the 10/225,066US patent application
  misc_feature: The sequence is a functional homolog of SEQ ID NO 1311 in the 10/374,780US patent application
  misc_feature: The sequence is a functional homolog of SEQ ID NO 1313 in the 10/374,780US patent application
  misc_feature: The sequence is a functional homolog of SEQ ID NO 1314 in the 10/374,780US patent application
  misc_feature: The sequence is a functional homolog of SEQ ID NO 140 in the 11/375,241US patent application
  misc_feature: The sequence is a functional homolog of SEQ ID NO 1456 in the 10/412,699US patent application
  misc_feature: The sequence is a functional homolog of SEQ ID NO 1458 in the 10/412,699US patent application
  misc_feature: The sequence is a functional homolog of SEQ ID NO 1459 in the 10/412,699US patent application
  misc_feature: The sequence is a functional homolog of SEQ ID NO 1900 in the 10/412,699US patent application
  misc_feature: The sequence is a functional homolog of SEQ ID NO 1904 in the 10/412,699US patent application
  misc_feature: The sequence is a functional homolog of SEQ ID NO 2164 in the 10/374,780US patent application
  misc_feature: The sequence is a functional homolog of SEQ ID NO 358 in the 10/666,642US patent application
  misc_feature: The sequence is a functional homolog of SEQ ID NO 458 in the 11/435,388US patent application
  misc_feature: The sequence is a functional homolog of SEQ ID NO 676 in the 11/435,388US patent application
  misc_feature: Useful for making plants with modulated growth and phenotype characteristics
  misc_feature: The sequence is a functional homolog of SEQ ID NO 1456 in the 20040045049 US patent application
  misc_feature: The sequence is a functional homolog of SEQ ID NO 1458 in the 20040045049 US patent application
  misc_feature: The sequence is a functional homolog of SEQ ID NO 1459 in the 20040045049 US patent application
  misc_feature: The sequence is a functional homolog of SEQ ID NO 1900 in the 20040045049 US patent application
  misc_feature: The sequence is a functional homolog of SEQ ID NO 1904 in the 20040045049 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: Useful for biocontainment applications
  misc_feature: Functional homolog of the protein sequence given in SEQ ID NO 13650
  misc_feature: The sequence is a functional homolog of SEQ ID NO. 274 in the 11/188,298 US application
MARPRKNAGTDEDNPNAATGVSVTGKPPKLKRVRRKGEPRESSTPSQRSSAYRGVTRHRWTGRFEAHLWDKDARNGSRNKKGKQGAYDDEEAAARAHDLAALKYWGPATVLNFPLCGYDEELREMEAQPREEYIGSLRRRSSGFSRGVSKYRGVARHHHNGRWEARIGRVLGNKYLYLATQEEAAVAYDIAAIEHRGLNAVTNFDISHYVNHWHRHCHGPSDDSLGVVVDDVAAFQLPDDLPECPAHHTSGPFGAQQQLPDETGALAAHQMAPNSSALDMVLQSPKFKELMEQVSAAAAAVASESSIGGSMSSSSPSPSLSSFSPSPLQLPSPSSLSSFSPSSPLQQPSPPLQQPEFVEGAPAARCSFPDDVQTFFDFENESDMSFMYAEVDTFLFGDLGAYAAPIFHFDLDV

SEQ ID NO: 111 - DNA, 903 bp, Sorghum bicolor
  misc_feature: Ceres ANNOT ID no. 6006492
  misc_feature: Encodes the peptide sequence at SEQ ID NO 112
atggcgatccggatgagcaacaacgtgatccgcgcgctgaccctggtgacgctgctgctctcggtgcccatcatcgtcacgggcgtctggctgcggtcgcgcgccgacggcaccgagtgcgaccacttcctcctgtccacgccggccatcgcgctggggacggtgctcatggccgtctccctcttgggcctcgccggcgcctgctgccgcgccacctggctgctctggctctacctcctcgccatgctggccctcatcgtcgcgctgctctgcttcaccgtcttcgccttcgtcgtcaccagcacgggcggcgctggggaggccgtgtccggcgccgggttcagggagtaccgcctcggcgactactccacctggctgcggcgccacgtcgagggccgcaagaactgggccaggatccggagctgcctcgccgacgcgcacgtctgcaggcgcttcctggaggcggaggaggaggaggaggagagcaaggacgcgaacgcggcgggtggtctggcgcggctcggcggcctctccccggtcgagtccgggtgctgcaagccgcccgcgagctgcaacttcacgtacgccggcggcggcacggagtggacgaccaagacgaaggcggcggcaggggcaggatccgcgcccgccgccggcgccgacccggactgcggcaagtggagcaacgacgaggacgacctctgctacgggtgccagtcgtgcaaggccggcgtggtggacgcgctcaggcgggactggaagcgggccgccattgttaacgtcgtcatcctcgccttcgtcgtcgtcgttttttccgtcggttgttgtgccttcaggaacagtcgccgggacaactacgcctaccacagcggccgcggatggaaacgaagcggtgacgcttaa

SEQ ID NO: 112 - protein, 300 aa, Sorghum bicolor
  misc_feature: Ceres ANNOT ID no. 6006492
  misc_feature (5)..(267): Pfam Id: Tetraspannin Pfam Desc: Tetraspanin family
  misc_feature (3)..(206): NCBI GI: 7269944 NCBI Desc: senescence-associated protein homolog [arabidopsis thaliana]
  misc_feature (1)..(206): NCBI GI: 54208706 NCBI Desc: senescence-associated protein dh [zea mays]
  misc_feature (4)..(198): NCBI GI: 9294106 NCBI Desc: senescence-associated protein-like [arabidopsis thaliana]
  misc_feature (5)..(202): NCBI GI: 92869567 NCBI Desc: cd9/cd37/cd63 antigen [medicago truncatula]
  misc_feature (1)..(193): NCBI GI: 45773872 NCBI Desc: at1g63260 [arabidopsis thaliana]
MAIRMSNNVIRALTLVTLLLSVPIIVTGVWLRSRADGTECDHFLLSTPAIALGTVLMAVSLLGLAGACCRATWLLWLYLLAMLALIVALLCFTVFAFVVTSTGGAGEAVSGAGFREYRLGDYSTWLRRHVEGRKNWARIRSCLADAHVCRRFLEAEEEEEESKDANAAGGLARLGGLSPVESGCCKPPASCNFTYAGGGTEWTTKTKAAAGAGSAPAAGADPDCGKWSNDEDDLCYGCQSCKAGVVDALRRDWKRAAIVNVVILAFVVVVFSVGCCAFRNSRRDNYAYHSGRGWKRSGDA

SEQ ID NO: 113 - DNA, 1959 bp, Sorghum bicolor
  misc_feature: Ceres ANNOT ID no. 6006520
  misc_feature: Encodes the peptide sequence at SEQ ID NO 114
atggcggccaccgcctccaacccgttcccgttcccctcccgccgcccgccggacgacagcctcttctacgccgtctacccgctaccactccccaccggcctccccgcgcccgcgctccacgcctcgctgcagtccctccacctctccctcctctcgcacctcgcccccttcctctcctcccacctcttccaccgggaccccttcacgctctccctccccgcggacccgtccgccccctgcgcactctgcgcctcgccgcccgtgccccacctccacggcgcgctccgcttcggcgactccctccccgacgagtggctcgccgtctccctcctcttcgcgctcacccgcgccttccccgacgtcgcggcccgcgcctgggactccgacggggagttcctcctcatcgaggccgccttcgcgctcccaaggtggctcgacccggaatccgcccccaatcgcgtcttcatcttccgcggagacctccacatcctgccgccctccctcttccccgagacgccgtctctggaagccgctctcgccgccgtctacgacgactccgtcgatacccgcgccgccgacgccatccaggcggccatacagcgccgcatcgctgggctgcccgagaaggcggcggtgaacctacacacggcacgcgttatcgtcccggcgcccgtggcaaaggtgctgaaggaggagccatgcctgatcgcgcgtgccgtcgagggtttctacgaccgggacatagacaccatgaagcatgcggcgaggatggaaaaattcctcaaggggcctggtggggagggggttgagatggtgagaaccacggtacgcatgacgcgggcaatgtacgcacagcttgtgcagcagaactttcaggctcccagggggtacccgatgcctaggagggaggaagggccagagaaatggatggaggcagagctggggatgaagattgcctgcgggttcgagatgatgtaccaggagagaagacgccagggtgaggaaggtaaagggagcacgtgggaggtttacaggaagagcttggaggcagctggatgctttgaggggctgcttcctgggtcaatggagtataagagggtcatggaggatgcaatgcaatattacaagagctctaatttgtattcccgaacaagggagatactgagtgaaccagtgcggcgaattgatgaaatcctatcaacgccatactcggccgatgaatttaaaggcactgatcttcctcctagtgatgatgactcctggttgtatggtggggatgatgagttaaatgcggaactccgtgaaaggcagaaggaactggaagagtatgaagctgcgaagaagcaaagaagtcaaaagcaaagtgtctctagcagttcaaaatcccatacagacgagtttaagcttggagagattacagagtccatgcaagagttcattcgcaaaatgtccagctttgagggagctgagattcctgcagacaggagagatacggaatcagtggacctagatgtcaaccagttcttcaaggccatggaatcggttttaggtggaggttcacaagagcaagctggcagtgatgatggatttgatagaaaatcctcatcgtctgacatggactttgatgattctgatgaagacaatgattttgctgaagaattaggtgacaaggatgtggatgattcttttatggagtcatattcagatgctttaactaaagagctaagcagtaccactcttgagaaaagctttgctcgtgcaccacgaccagaaactaacaatgagggtccatcagatgatgcagctactgatgcagagatgactccagttgatgtagatctgaaccttgttgagagcattcttaactcgtactcttcgcaacaaggtcttcccggtccggcttccaatctgctaggactcatgggcgtaaaggtccctccagatgctaagaagtcgtga

SEQ ID NO: 114 - protein, 652 aa, Sorghum bicolor
  misc_feature: Ceres ANNOT ID no. 6006520
  misc_feature (21)..(648): Pfam Id: SGT1 Pfam Desc: SGT1 protein
  misc_feature (2)..(651): NCBI GI: 42409462 NCBI Desc: suppressor-like protein [oryza sativa (japonica cultivar-group)]
  misc_feature (6)..(651): NCBI GI: 15144507 NCBI Desc: suppressor-like protein [lycopersicon esculentum]
  misc_feature (18)..(646): NCBI GI: 48146931 NCBI Desc: hsgt1 [homo sapiens]
  misc_feature (18)..(646): NCBI GI: 6005784 NCBI Desc: suppressor of s. cerevisiae gcr2 [homo sapiens]
  misc_feature (18)..(646): NCBI GI: 123982714 NCBI Desc: ecdysoneless homolog (drosophila) [synthetic construct]
MAATASNPFPFPSRRPPDDSLFYAVYPLPLPTGLPAPALHASLQSLHLSLLSHLAPFLSSHLFHRDPFTLSLPADPSAPCALCASPPVPHLHGALRFGDSLPDEWLAVSLLFALTRAFPDVAARAWDSDGEFLLIEAAFALPRWLDPESAPNRVFIFRGDLHILPPSLFPETPSLEAALAAVYDDSVDTRAADAIQAAIQRRIAGLPEKAAVNLHTARVIVPAPVAKVLKEEPCLIARAVEGFYDRDIDTMKHAARMEKFLKGPGGEGVEMVRTTVRMTRAMYAQLVQQNFQAPRGYPMPRREEGPEKWMEAELGMKIACGFEMMYQERRRQGEEGKGSTWEVYRKSLEAAGCFEGLLPGSMEYKRVMEDAMQYYKSSNLYSRTREILSEPVRRIDEILSTPYSADEFKGTDLPPSDDDSWLYGGDDELNAELRERQKELEEYEAAKKQRSQKQSVSSSSKSHTDEFKLGEITESMQEFIRKMSSFEGAEIPADRRDTESVDLDVNQFFKAMESVLGGGSQEQAGSDDGFDRKSSSSDMDFDDSDEDNDFAEELGDKDVDDSFMESYSDALTKELSSTTLEKSFARAPRPETNNEGPSDDAATDAEMTPVDVDLNLVESILNSYSSQQGLPGPASNLLGLMGVKVPPDAKKS

SEQ ID NO: 115 - DNA, 1377 bp, Sorghum bicolor
  misc_feature: Ceres ANNOT ID no. 6006527
  misc_feature: Encodes the peptide sequence at SEQ ID NO 116
atgggagaagccctgataggcaggctggaggcagcggtatcccggctggaggcactcagcggcggggcgcgcggcggcctgtccgacactactgcatcagcgcaggacccggcgatcgtggccttcgacgatcttgtcgccagcgcgctcggcagggtgtccgcggccgccggcaagatcgggaccgacgtcgccgaggtgacgagattggtggagaaggcgttcttggttgggaaggaccttcttgtcaggaccaaccagacacagaaaccaacaatggagtcagtgacgatgtttatggggcctctgaatgaaacgatcttggaggccaacgcattggcggaggggacgagatcgatatatgccaaccatctaaaagcagcagccggtagcctggcagctttggcatggattggttacaccggcaaaggttgcggtatgcctcttccgattgctcaggtagaagagagctggcaaatggcagagttctacagcaataaggtgcttgtggaatacaaaaataaggaccccgatcatgtggagtgggttaaagccctgaaagagctttacgtgcccaatttgcgtgattatgtgaagaggtattacccattgggtcctgtatggcaaccaccaggaagtataaccaacaaggcaccttcagccccttccgctccttctacatctctttgcatgtcttcggcctcatcatcccaaccaaaatcgggaatgtcagcagtatttgctgaaatcagctctgggaaaccagtgacacaaggcctcaggaaggtaactgatgacatgaagagcaaaaatagaacagataaaacaggtgttgtagctgctgaaggaaaaggaacccgcaatgcactttcctttagctcaactaaagctcctgctaaattggagctccaaatgggtcgcaaatgggtggttgagcatcatgttgggaacaagagcttaattattgaagattgtgataccaaacagtccgtgtatgtatatggatgcaaggattgtgtgctgcaagtcaaagggaaagtgaacaacataacaattgataagtgcaccaaagtaggagtcttgttcaagggggttgtagcggcttgtgaaattgtgaattgtaacagtgcagaggtccaatgtgagggctcggttccgactatatcaatagataacacatctggctgccaactttacttaagcaaggaatctttagaggcatctataacaaccgctaaatcaagtgaaatcaatgctcttgttccagatgcaaacaatgacggtgattgggccgagcattccttgcctcagcagtatattcacgcgttcaaagacggacaatttacgacatctccagtgtctcattctggcgcttga

SEQ ID NO: 116 - protein, 458 aa, Sorghum bicolor
  misc_feature: Ceres ANNOT ID no. 6006527
  misc_feature (296)..(456): Pfam Id: CAP_C Pfam Desc: DE Adenylate cyclase associated (CAP) C terminal
  misc_feature (3)..(290): Pfam Id: CAP_N Pfam Desc: Adenylate cyclase associated (CAP) N terminal
  misc_feature (1)..(458): NCBI GI: 4126473 NCBI Desc: adenylyl cyclase associated protein [gossypium hirsutum]
  misc_feature (1)..(457): NCBI GI: 92885857 NCBI Desc: cap protein [medicago truncatula]
  misc_feature (206)..(458): NCBI GI: 62733576 NCBI Desc: cap protein [oryza sativa (japonica cultivar-group)]
  misc_feature (5)..(455): NCBI GI: 1705592 NCBI Desc: adenylyl cyclase-associated protein (cap)
  misc_feature (5)..(457): NCBI GI: 37725381 NCBI Desc: cyclase-associated protein-1 [danio rerio]
MGEALIGRLEAAVSRLEALSGGARGGLSDTTASAQDPAIVAFDDLVASALGRVSAAAGKIGTDVAEVTRLVEKAFLVGKDLLVRTNQTQKPTMESVTMFMGPLNETILEANALAEGTRSIYANHLKAAAGSLAALAWIGYTGKGCGMPLPIAQVEESWQMAEFYSNKVLVEYKNKDPDHVEWVKALKELYVPNLRDYVKRYYPLGPVWQPPGSITNKAPSAPSAPSTSLCMSSASSSQPKSGMSAVFAEISSGKPVTQGLRKVTDDMKSKNRTDKTGVVAAEGKGTRNALSFSSTKAPAKLELQMGRKWVVEHHVGNKSLIIEDCDTKQSVYVYGCKDCVLQVKGKVNNITIDKCTKVGVLFKGVVAACEIVNCNSAEVQCEGSVPTISIDNTSGCQLYLSKESLEASITTAKSSEINALVPDANNDGDWAEHSLPQQYIHAFKDGQFTTSPVSHSGA

SEQ ID NO: 117 - DNA, 1659 bp, Sorghum bicolor
  misc_feature: Ceres ANNOT ID no. 6006528
  misc_feature: Encodes the peptide sequence at SEQ ID NO 118
atggtgtcgccgacgacggcggagccgaaggccgagacgacgacggtgttccgctcgacgctcccggacatcgcgatcccggaccacctcccgctccacgactacgtcctggagcgcctggcggagcgccgcgaccgcgcgtgcctcatcgacggcgccacgggggagacgctcacgttcggcgacgtggaccgcgtgtcgcgccgcgtcgcggcggggatgcgcgccgcgctcggcgtccgcagcggcgggacggtgatgctgctgctcccaaactgcgtcgagttcgcgctcgcgttcctcgcgtgctcccgcctcggcgccgccgccaccacggccaacccgctccacaccccgcccgagatcgccaagcaggcggcggcctccggcgccaccgtcgtcatcaccgagccggcgttcgtcggcaaggtgcgggggctcgccggcgtcgccgtcgtcgccacgggcgacggcgccgagggctgcgtctccttctccgagctcaccgacgccgccgacgacgacgacggctcggcgctgccgcccatcgacgtggcgaacgacgtggtcgcgctgccctactcgtccggcacgacggggctgcccaagggcgtgatgctgtcgcaccgcgggctggtgaccagcgtggcgcagctggtggacggcgacaacccgaacctgcacctccgggaggacgacgtcgtgctctgcgtgctgcccatgttccacgtctactcgctgcactccatcctgctgtgcgggatgcgcgccggcgcggcgctcgtcatcatgaagcgcttcgacacgctccgcatgttcgagctggtgaagcggcacggcatcaccgtcgtcccgctcgtgctgcccatcgccgtggagatggccaagagcgacgccatggaccgccacgacctctcctcggtgcgcatggtcatctcgggggccgcgcccatgggcagggagctgcaggacctgctgcgcgccaagctccccggcgccgtgctcgggcaggggtacgggatgacagaggcaggacccgtgctctcaatgtgcatggcgtttgcaaaggagccgttgccggtgaagtccggcgcctgcggcacggtggtgaggaacgccgagctcaagatcgtcgacccggacaccgggctgtccctccgccgcaaccagcccggggagatttgcatcaggggcaagcagttgatgaaagggtacctcaacaacccggaggccacggcgaagaccatcgacgatgaagggtggctgcacaccggagacattgggtacgtcgacgacgacgacgagatcttcatcgtcgacaggctcaaggagctcatcaagtacaaggggttccaagtcgctccggcggagctcgaggccatgctcatcgcccaccccagcatcgccgacgccgccgtcgtgccaatgaaggacgactcctgcggcgagatcccggtggcgttcgtcgtgacgtccggcggctacgagatgaccgaggacgagatcaaacagtacgtggcgaaacaggtggtgttctacaagaggctgcacaaggtcttcttcgtggaggctatccccaaggcgccatctggcaagattctgaggaaggatctgagagcaaagctagcgtctggattttccaatggatcatcgtgttga

SEQ ID NO: 118 - protein, 552 aa, Sorghum bicolor
  misc_feature: Ceres ANNOT ID no. 6006528
  misc_feature (59)..(473): Pfam Id: AMP-binding Pfam Desc: AMP-binding enzyme
  misc_feature (7)..(548): NCBI GI: 73665529 NCBI Desc: 4-coumarate:coenzyme a ligase [eucalyptus camaldulensis]
  misc_feature (9)..(551): NCBI GI: 7188337 NCBI Desc: 4-coumarate--coa ligase 4cl2 [lolium perenne]
  misc_feature (4)..(548): NCBI GI: 398963 NCBI Desc: 4-coumarate--coa ligase 1 (4cl 1) (4-coumaroyl-coa synthase 1)
  misc_feature (16)..(548): NCBI GI: 9651915 NCBI Desc: 4-coumarate:coa ligase 2 [rubus idaeus]
  misc_feature (4)..(548): NCBI GI: 398965 NCBI Desc: 4-coumarate--coa ligase 2 (4cl 2) (4-coumaroyl-coa synthase 2)
  misc_feature (4)..(548): SWISSPROT Homolog: EC 6.2.1.12 4-coumarate--CoA ligase 1
  misc_feature: Useful for making plants with altered cell wall content and/or composition
  misc_feature: Useful for making plants with altered lignin content
  misc_feature: Functional homolog of the protein sequence given in SEQ ID NO 13358
  misc_feature: Functional homolog of the protein sequence encoded by LOCUS at1g51680
  misc_feature: Functional homolog of the protein sequence encoded by LOCUS at3g21230
  misc_feature: Functional homolog of the protein sequence encoded by LOCUS at3g21240
  misc_feature: Useful for making plants with altered carbohydrate content
  misc_feature: Functional homolog of the protein sequence given in SEQ ID NO 13695
  misc_feature: Useful for making plants with altered lignin content
  misc_feature: Functional homolog of the protein sequence given in SEQ ID NO 13358
  misc_feature: Useful for making plants with altered cell wall content and/or composition
  misc_feature: Functional homolog of the protein sequence given in SEQ ID NO 13696
MVSPTTAEPKAETTTVFRSTLPDIAIPDHLPLHDYVLERLAERRDRACLIDGATGETLTFGDVDRVSRRVAAGMRAALGVRSGGTVMLLLPNCVEFALAFLACSRLGAAATTANPLHTPPEIAKQAAASGATVVITEPAFVGKVRGLAGVAVVATGDGAEGCVSFSELTDAADDDDGSALPPIDVANDVVALPYSSGTTGLPKGVMLSHRGLVTSVAQLVDGDNPNLHLREDDVVLCVLPMFHVYSLHSILLCGMRAGAALVIMKRFDTLRMFELVKRHGITVVPLVLPIAVEMAKSDAMDRHDLSSVRMVISGAAPMGRELQDLLRAKLPGAVLGQGYGMTEAGPVLSMCMAFAKEPLPVKSGACGTVVRNAELKIVDPDTGLSLRRNQPGEICIRGKQLMKGYLNNPEATAKTIDDEGWLHTGDIGYVDDDDEIFIVDRLKELIKYKGFQVAPAELEAMLIAHPSIADAAVVPMKDDSCGEIPVAFVVTSGGYEMTEDEIKQYVAKQVVFYKRLHKVFFVEAIPKAPSGKILRKDLRAKLASGFSNGSSC

SEQ ID NO: 119 - DNA, 309 bp, Sorghum bicolor
  misc_feature: Ceres ANNOT ID no. 6006545
  misc_feature: Encodes the peptide sequence at SEQ ID NO 120
atgatgatggcagcgcgcgctcttttgttgtcatcccgtctcgccggcctttacgagcaggaggcggtgaactgcggcggccgccgggcgttcagcgccgcggcgacggcggtggcgcggaaagagcctgtcgaagcggccggcaaagcgaggccggcggcagcggcggataaggcggcggcaaagatggaggaggagtccttctggatgagggaccccaagacgggctactggatgccggagaagcacctgtacgacgtcgacgcagccgacctccgggcgcggctgctcttctccaagaaagattaa

SEQ ID NO: 120 - protein, 102 aa, Sorghum bicolor
  misc_feature: Ceres ANNOT ID no. 6006545
  misc_feature (4)..(98): Pfam Id: LEA_3 Pfam Desc: Late embryogenesis abundant protein
  misc_feature (6)..(101): NCBI GI: 76782016 NCBI Desc: aba-responsive lea-like protein [picea glauca]
  misc_feature (6)..(99): NCBI GI: 76782014 NCBI Desc: aba-responsive lea-like protein [picea glauca]
  misc_feature (5)..(101): NCBI GI: 52788395 NCBI Desc: lea [pinus halepensis]
  misc_feature (5)..(101): NCBI GI: 1350528 NCBI Desc: aba-responsive and embryogenesis-associated gene; lea-like protein
  misc_feature (6)..(101): NCBI GI: 76782050 NCBI Desc: aba-responsive lea-like protein [picea abies]
MMMAARALLLSSRLAGLYEQEAVNCGGRRAFSAAATAVARKEPVEAAGKARPAAAADKAAAKMEEESFWMRDPKTGYWMPEKHLYDVDAADLRARLLFSKKD

SEQ ID NO: 121 - DNA, 2208 bp, Sorghum bicolor
  misc_feature: Ceres ANNOT ID no. 6006546
  misc_feature: Encodes the peptide sequence at SEQ ID NO 122
atgcctcaagtccagaacaccgggcgaaactgcacactcctagctgttctttgtggggagattgccgagaagcggcagacgccagctcccctggcaccagacacaaagcgagtgcggatgtcataccccttcccggagctcgcttcgtctgggagattggaggtgcacacactaatcaatcccactttggagcaatttagagaggcacagcaggcggtgcatcctgtcttcttgtatcttcaagggcagcagcaagagaatgagaaggagattgggacacttgtctggggcgataccgatttatctgacccgcagatgtttgtttcactcatcaccccaccatttccgaccatggtttatttggaggttcccattggcgaaaagcttgcgcagtcacttcattcaaaggggataccatatgtggtatattggaggaattcattttcgtcttatacagcatctcattttcgtcatgcgttaatgtcagtcattgagagccatacatgggatgcatttcaacttgcacatgcctcctttcgactatactgtgtaagaaataattatgtgcaaagtgttaagcttggcccctgcctactaggggatgccccaaaaataaatgtcatccctgctgggaatgaagtgaacaaggaagaaggctgctctgaaggttttccacctataagaatctatgatgaagatgtgaacatgaaatttcttgtctgtggagcaccatgcaccctggatgcatgtttgttgggcgcactagaagatggtttgactgcgctgttgaatattgagagccgatccagtgctcctccacctcttcaagctgaaaatcttccacatggagttgttacaatgcgctgcgatatctcaacttgcagttctgcacacgtgtcatttcttgtttctgccagtgcccaaacttgttttgatgataagcttctagagagccgtatcaagaatgaaattattgagaagaggcagttagttcgtgctctatcgaatactgaggataacaagccatcatatgaacctttgccttccatgtgtgtggcttgtggagcttctacttttgaagtctggataaccctgcctaaatgggcagcacagcttgcgccagaaatctgttacagaagcttggttgcacttggaattgcttgggtaaatggtacaccagtgtcctcatttgataggcaggatgctgatcggctgcttttcttttgctctaaccagtgcaaagataaagctattcaaaatgtctcatatgcccatctatcaagctggtcagcatcccttactaaggatagaactactggaagcatcgagtcaaaacagatgtcatttggtgccaaaggagttggaggggataataagatgtccctatcatcattgaaaccaaggttaaagcctgcaacaatgagacccattccccactctcgcaagcaacaaatgcatccctttatggggtttgctcagtccatccatgatgctagtccagttaagcctagcttaccagcccctcctgtaaaggacaatacagtacctgttatcaaagtgactcaaagaaaatcatcatccgggtcaccatcatcctcatcacgtgttcagccatcaatcccattgaatcctctgccaatgaagaagcatgagtgcaatcggttgcctatcaacatttgctctgaagaagacttcttgaaagatgtcatgcagttcctacttcaaaggggccatgaccgacttgtacctcagggaggaccggcagaatttcctgatgcagtgttaaattcaaagcgtcttgatttatataatttatacaaagaggtggtataccgaggtggctttcatgtaggcaatggcataaattggaaaggtcaagtcttttcaaagatgcgcaaccatacagttacaaacaaaatgacgggtgttgggaacaccctaaaaaggcattatgagacatacttgctggaatatgaacttgcacatgacgatattgaagtggaatgttgcttgatctgccacagtagtgatctgggtgattgggtgaactgtggagtatgtggagaatgggcccaccttggctgtgatagacggcaagggctaggcaatttcaaggactactcaaagacaggcgggctggaatacatttgtccccactgtagccatgcgaagtcaccattgcctgtacaagtaggcaatgactcatag

SEQ ID NO: 122 - protein, 735 aa, Sorghum bicolor
  misc_feature: Ceres ANNOT ID no. 6006546
  misc_feature (669)..(723): Pfam Id: PHD Pfam Desc: PHD-finger
  misc_feature (1)..(733): NCBI GI: 115476700 NCBI Desc: os08g0451400 [oryza sativa (japonica cultivar-group)]
  misc_feature (78)..(733): NCBI GI: 42407626 NCBI Desc: fiber protein-like [oryza sativa (japonica cultivar-group)]
  misc_feature (269)..(721): NCBI GI: 140072127 NCBI Desc: at-rich interaction region; zinc finger, fyve/phd-type [medicago truncatula]
  misc_feature (5)..(721): NCBI GI: 34849889 NCBI Desc: at3g43240 [arabidopsis thaliana]
  misc_feature (186)..(721): NCBI GI: 144923184 NCBI Desc: at-rich interaction region; zinc finger, fyve/phd-type [medicago truncatula]
MPQVQNTGRNCTLLAVLCGEIAEKRQTPAPLAPDTKRVRMSYPFPELASSGRLEVHTLINPTLEQFREAQQAVHPVFLYLQGQQQENEKEIGTLVWGDTDLSDPQMFVSLITPPFPTMVYLEVPIGEKLAQSLHSKGIPYVVYWRNSFSSYTASHFRHALMSVIESHTWDAFQLAHASFRLYCVRNNYVQSVKLGPCLLGDAPKINVIPAGNEVNKEEGCSEGFPPIRIYDEDVNMKFLVCGAPCTLDACLLGALEDGLTALLNIESRSSAPPPLQAENLPHGVVTMRCDISTCSSAHVSFLVSASAQTCFDDKLLESRIKNEIIEKRQLVRALSNTEDNKPSYEPLPSMCVACGASTFEVWITLPKWAAQLAPEICYRSLVALGIAWVNGTPVSSFDRQDADRLLFFCSNQCKDKAIQNVSYAHLSSWSASLTKDRTTGSIESKQMSFGAKGVGGDNKMSLSSLKPRLKPATMRPIPHSRKQQMHPFMGFAQSIHDASPVKPSLPAPPVKDNTVPVIKVTQRKSSSGSPSSSSRVQPSIPLNPLPMKKHECNRLPINICSEEDFLKDVMQFLLQRGHDRLVPQGGPAEFPDAVLNSKRLDLYNLYKEVVYRGGFHVGNGINWKGQVFSKMRNHTVTNKMTGVGNTLKRHYETYLLEYELAHDDIEVECCLICHSSDLGDWVNCGVCGEWAHLGCDRRQGLGNFKDYSKTGGLEYICPHCSHAKSPLPVQVGNDS

SEQ ID NO: 123 - DNA, 981 bp, Sorghum bicolor
  misc_feature: Ceres ANNOT ID no. 6006548
  misc_feature: Encodes the peptide sequence at SEQ ID NO 124
atggcagccggatcttccagttccagcaccgccctcgtcggcatcgttgacgacttctacttctccgtcctcgctcacgggcgaaacgacgctggcgccgccggggacgacgagctcttcccgatatccgacgagaagtacgccacggagctccagctacaggaggtgatgatgtcctccgccatcgcggccacggcgcgctcccgggtcgctccacctcgcagcagcacagctgccactagcgacaacgccgccgccgccgccgcgtcgggtcacggcaaaggtaagtgcgcctacacctcgtcgtcgtcgtcgtcgtcccggccgtccatcgccgtcgccgcgacgctcgtgttctgcaagatctgcatggacgtggtgccgccctccgacgcgcaccgcgccagccggggctgcgcacacgccttctgcggcggctgcctcgcgggctacgtgggcgccaagatccaggacaggatcgccgacgtcaggtgccccgaggagcggtgcggcggcgtgctggacccggagctctgccagggcatcctgccccgcgaggtcttcgagcggtggggcgccgcgctgtgcgagtccatgctgctgggggccaagaggacctactgccccttcaaggattgctcggcgatgatgctggcggacgacgacggcagcgacgacgtcgccgaggcggagtgcccgagctgcaggcggctcttctgtgcgaggtgcaacgtggcgccgtggcacgccggcgctacctgcaccgagtacaggaagctccggaagggggacaggggcatcgaggacaccatgctgcttgagatggccaagggggagaagtggaagcggtgccccaagtgcgagttcttcgtggagaagcgtgatggttgccttcacattacttgcaggtgtggctttcagttttgctatggatgtggcaagaggtgggggattactcattctcgttgcactacagcgtga

SEQ ID NO: 124 - protein, 326 aa, Sorghum bicolor
  misc_feature: Ceres ANNOT ID no. 6006548
  misc_feature (189)..(254): Pfam Id: IBR Pfam Desc: IBR domain
  misc_feature (1)..(326): NCBI GI: 115476708 NCBI Desc: os08g0451800 [oryza sativa (japonica cultivar-group)]
  misc_feature (5)..(323): NCBI GI: 50253098 NCBI Desc: ubiquitin conjugating enzyme 7 interacting protein 4-like [oryza sativa (japonica cultivar-group)]
  misc_feature (120)..(321): NCBI GI: 91806425 NCBI Desc: zinc finger protein-like protein [arabidopsis thaliana]
  misc_feature (120)..(304): NCBI GI: 115476710 NCBI Desc: os08g0451900 [oryza sativa (japonica cultivar-group)]
  misc_feature (119)..(312): NCBI GI: 50725962 NCBI Desc: zinc finger (c3hc4-type ring finger)-like protein [oryza sativa (japonica cultivar-group)]
  misc_feature: The sequence is a functional homolog of SEQ ID NO 1727 in the 10/374,780US patent application
  misc_feature: Useful for making plants with modulated growth and phenotype characteristics
  misc_feature: The sequence is a functional homolog of SEQ ID NO 1727 in the 20060162006 US patent application
  misc_feature: The sequence is a functional homolog of SEQ ID NO. 493 in the 11/188,298 US application
MAAGSSSSSTALVGIVDDFYFSVLAHGRNDAGAAGDDELFPISDEKYATELQLQEVMMSSAIAATARSRVAPPRSSTAATSDNAAAAAASGHGKGKCAYTSSSSSSSRPSIAVAATLVFCKICMDVVPPSDAHRASRGCAHAFCGGCLAGYVGAKIQDRIADVRCPEERCGGVLDPELCQGILPREVFERWGAALCESMLLGAKRTYCPFKDCSAMMLADDDGSDDVAEAECPSCRRLFCARCNVAPWHAGATCTEYRKLRKGDRGIEDTMLLEMAKGEKWKRCPKCEFFVEKRDGCLHITCRCGFQFCYGCGKRWGITHSRCTTA

SEQ ID NO: 125 - DNA, 1260 bp, Sorghum bicolor
  misc_feature: Ceres ANNOT ID no. 6006556
  misc_feature: Encodes the peptide sequence at SEQ ID NO 126
atgactggccaaaatcacatgccccacgaccatcaccgcatattccattgtatcttgccagatcaatcttgtaacggtttggtcatttctgacataaatatcaggccaccaccacccacaaacacaaataagccagttataaggatgggtcaagagacatttgaagataataagatgaagaactatggtgagagaaagttaaagagggcacacaagatagatgagggagaggacgactttgaagctgatttccaagcattctctaagaagtgcgatgaggaggatgagagccactataagtttatggctctgctaccattcaaggaaggtcttactagtgtctcaacaccaacagaagggaaagttcgactcgattttcccatgaaagatgatgtgattagtcgagaaccaaccactaccaatgaaggtaccagtgtaaggccaaagcgcaagcgcaagaccccgtataggggcatccgccaacgcccttggggaaaatgggctgctgagattcgtgatcctgcaaagggtgtccgtgtttggttaggaacatatagaacaccagaagatgcagctagggcatatgatgctgaggcccgcaagattagaggcaataaggcaaaggtgaatttccctaatgaaggaccaccaaacatggtgagcaatacaccaaaactaactgctactgcaatgaccacaatggatattccagcagagaaaatgaataccgatgaattggtgtgccatacaaactactctaatgaggatatgttgtcaatggcgaactttagtggtaacaatgctagcttaatttctgctcaagcttttggcttacactatatgaaaaagcctcgtgttccttatgacatcccaagcatgggtgagtgttcaaatcaaaacaaaatcacatatggttcaagtaatggattgggcattgaggctagtaggaacttgaatggatgctctttcttaccacaagttggcatgccgatgttcattcaacctacttttgatggtccatcaaggatgatagaaagaaatgatgtcgtgatttctcctactctgactaatgccacaccaatcactccattgggtgtggctggtgttgatgttgcaaaaaagatgaataagcatcctattctccaagagatggaaaatgaagctactcctattttacaaggtgatgttagtgaggacgtggcggctgagattagtatgtgggagttttatgaccacctattagataataagcaaaattga

SEQ ID NO: 126 - protein, 419 aa, Sorghum bicolor
  misc_feature: Ceres ANNOT ID no. 6006556
  misc_feature (154)..(205): Pfam Id: AP2 Pfam Desc: AP2 domain
  misc_feature (77)..(414): NCBI GI: 126256490 NCBI Desc: ereb [saccharum arundinaceum]
  misc_feature (93)..(308): NCBI GI: 32401360 NCBI Desc: erebp transcription factor [triticum aestivum]
  misc_feature (69)..(414): NCBI GI: 56567581 NCBI Desc: bth-induced erf transcriptional factor 1 [oryza sativa (indica cultivar-group)]
  misc_feature (24)..(411): NCBI GI: 57117316 NCBI Desc: apetala2/ethylene responsive factor [populus alba x populus tremula]
  misc_feature (77)..(411): NCBI GI: 62526569 NCBI Desc: ethylene response factor [manihot esculenta]
  misc_feature: Useful for making plants with altered Lignin content
  misc_feature: Useful for making plants with altered alkaloid content
  misc_feature: Functional homolog of the protein sequence given in SEQ ID NO 12955
  misc_feature: Functional homolog of the protein sequence given in SEQ ID NO 12996
MTGQNHMPHDHHRIFHCILPDQSCNGLVISDINIRPPPPTNTNKPVIRMGQETFEDNKMKNYGERKLKRAHKIDEGEDDFEADFQAFSKKCDEEDESHYKFMALLPFKEGLTSVSTPTEGKVRLDFPMKDDVISREPTTTNEGTSVRPKRKRKTPYRGIRQRPWGKWAAEIRDPAKGVRVWLGTYRTPEDAARAYDAEARKIRGNKAKVNFPNEGPPNMVSNTPKLTATAMTTMDIPAEKMNTDELVCHTNYSNEDMLSMANFSGNNASLISAQAFGLHYMKKPRVPYDIPSMGECSNQNKITYGSSNGLGIEASRNLNGCSFLPQVGMPMFIQPTFDGPSRMIERNDVVISPTLTNATPITPLGVAGVDVAKKMNKHPILQEMENEATPILQGDVSEDVAAEISMWEFYDHLLDNKQN

SEQ ID NO: 127 - DNA, 3003 bp, Sorghum bicolor
  misc_feature: Ceres ANNOT ID no. 6006581
  misc_feature: Encodes the peptide sequence at SEQ ID NO 128
atgtgggcgccgtcgcgggggtcgtcgtcggggagcgggcggcggacgtggcgccgccgcatcgcggactacctcgccgacgaccagaccgacgtgtcggacaatgagtccttcatcacggcgcacagcgacgagtacgtcgccgcctccacgtccatgtccgccgcgggaggcgggggaatgctgccggcgttcctcgcggaccagagcgacctcgtggaggtgatgctggagctggacgaggagtccatggtggtgcgcagcgtcacgcccaccaccgccgcgctgtacgggacccccaccgcgtcgtcgctgcccgggcccggcgcggcggggccgcaggcgcacacgccggacggcccgcggagcctgagccggtgctcgtcgacgtcgtcgcggatccgcaggaagttcgcgtggctgcggtcgccgtctccatcgccgtcgctgcgtcgtcccccgcccgcggccggggccgcggcggcgacggcggcgttgtccgaccagcaggtggtgcgggaggcggcgctggcggcccgcgagcggcggcgcgtccaggcgcgcctcctgaaccggtcgcggtccggggccaggcgcgcgctcaagggcctccggttcatcagccgcaccaccaccgacgccgacggcggcgccgcgctctggcgcgccgtggaggagcgcttcaacgcgctcgccaccgacggcctcctcgcccgcgacgacttcggcgactgcatcgggatggtggactccaaggagttcgcggtgggcatcttcgacgcgctggcgcggcggcggcggcagaacctggagcggatcagcaaggacgagctctacgagttctggctgcaaatctccgaccagagcttcgacgcgcgcctccaaatcttcttcgacatggtggacaccaacgtggacggcaggatcacgagggaggaagtgcaagagctgatcgttctgagcgcgtcggcgaacaagctgtcgaagctcaaggagcaggctgaggagtacgcgtccttgatcatggaggagctcgatccggagaatctcggctacatagagctgtggcagctggaggcgctgctcctgcagcgggacgcgtacatgacctacagccggccgatgagcagcggcagcgcggcgcagtggagccagggcctgagcgccggcgccggcgcgggtgctggtgggcagcagcagcagcagcagcaggcgcagccgcagccgtcgcggtggcagctgcagcggcggaggtggagcccgcgtcgcgcggcggcgcgggcgcgcgtggcggcggcggagcgctggcggcgggcgtgggtggtggcgctgtggtgcgcggccatggcgtcgctgttcgcgtggcggttcgtgcagtaccggcggtcggcggcgttccgggtgatggggtactgcctcccgacggccaagggcgccgccgagacgctcaagctcaacatggcgctcgtgctcctcccggtctgccgcaacacgctgacgtggctccgatccacctgggcgcgattcttcgtccccttcgacgacagcatcgccttccacaagatgatcgcgttggcgatcgcggtggggatctgcctgcacgcggggaaccacctggcgtgcgacttcccgcggctgatcgcgtcggggcccgacgagtaccggctggtggcgcgcttcttcgggcgggacaagcccagctacaggggcctcctcgccggcgccgagggcgtcaccgggatcgtcatggtcacgctcatggccgtctccttcaccctcgccacgcgccccttccggaagcgggaggcggaggtcaagccggccaggtccgcccgccggtggtgctggccgctcgcccacctcgccggcggcttcaacgccttctggtactcgcaccacctgctcatcgtcgtctacctcctgctgctcgtccacggctggttcgtgttcctcgtcgacaagtggtaccagaggacgacatggatgtacatttctgtgccactggtgctctacgtcggggaacggacgctacgggccttccgatccaaggcttacgcagttaagatcctcaaggtgtgccttctaccggggaacgtcttgaccataaccatgtcgaaaccctatgattccgctacagaatgtccaacaatctccccatttgagtggcatcctttctccatcacttcagctcctggagacgactacatcagcgtccacattcagaccaggggtgactggacacaagagctcaagcgcatcttcgtcgagaactacttcacgccatgcgtgccccgaagagctgccttcggcgagctaggcgcggtggagcacaagagtccgccaaggttgctggttgacggcccctacggcgccccagcgcaggatttcaggaactacgacgtgctgctcctcgtcggccttgggatcggcgcaacccctttcatcagcatcctgagagatcttctgaacaacatcaagctggctgatgagctgatggatctggcaatggagaccagccggtctgaggacagcgccaacagcttgagcgcgtcaacggcgagcagcagcaacaagaggcgggcataccgaacaagctgcgcacacttctactgggtcacaagggagccggggtcattcgagtggttcaagggagtgatgaatgaggtcgctgaaatggacaagaagggtgtcattgagctgcacaactatctgacaagcgtgtatgaggagcgagatgcaaggacgaccctgctgtcgatggtgcaggccctgaaccacgccaagcatggcgtagacatagtgtcaggcacaagggtcaggacacattttgcaagacctaactggaaagaagtatttacaagaatcgcgtccaagcacccaaattctacagtcggggtattttactgtgggagacctacacttgccaaagaactgaagaaactgtcacttgacatgagccacaaaacgggaacccgctttgatttccacaaggagtacttctga

SEQ ID NO: 128 - protein, 1000 aa, Sorghum bicolor
  misc_feature: Ceres ANNOT ID no. 6006581
  misc_feature (799)..(983): Pfam Id: NAD_binding_6 Pfam Desc: Ferric reductase NAD binding domain
  misc_feature (189)..(292): Pfam Id: NADPH_Ox Pfam Desc: Respiratory burst NADPH oxidase
  misc_feature (477)..(643): Pfam Id: Ferric_reduct Pfam Desc: Ferric reductase like transmembrane component
  misc_feature (684)..(793): Pfam Id: FAD_binding_8 Pfam Desc: FAD-binding domain
  misc_feature (522)..(1000): NCBI GI: 115476720 NCBI Desc: os08g0453700 [oryza sativa (japonica cultivar-group)]
  misc_feature (436)..(1000): NCBI GI: 15221979 NCBI Desc: respiratory burst oxidase protein e (rbohe) / nadph oxidase [arabidopsis thaliana]
  misc_feature (411)..(1000): NCBI GI: 3242787 NCBI Desc: respiratory burst oxidase protein e [arabidopsis thaliana]
  misc_feature (417)..(1000): NCBI GI: 28268678 NCBI Desc: respiratory burst oxidase homolog [nicotiana benthamiana]
  misc_feature (417)..(1000): NCBI GI: 17384016 NCBI Desc: nadph oxidase [nicotiana tabacum]
MWAPSRGSSSGSGRRTWRRRIADYLADDQTDVSDNESFITAHSDEYVAASTSMSAAGGGGMLPAFLADQSDLVEVMLELDEESMVVRSVTPTTAALYGTPTASSLPGPGAAGPQAHTPDGPRSLSRCSSTSSRIRRKFAWLRSPSPSPSLRRPPPAAGAAAATAALSDQQVVREAALAARERRRVQARLLNRSRSGARRALKGLRFISRTTTDADGGAALWRAVEERFNALATDGLLARDDFGDCIGMVDSKEFAVGIFDALARRRRQNLERISKDELYEFWLQISDQSFDARLQIFFDMVDTNVDGRITREEVQELIVLSASANKLSKLKEQAEEYASLIMEELDPENLGYIELWQLEALLLQRDAYMTYSRPMSSGSAAQWSQGLSAGAGAGAGGQQQQQQQAQPQPSRWQLQRRRWSPRRAAARARVAAAERWRRAWVVALWCAAMASLFAWRFVQYRRSAAFRVMGYCLPTAKGAAETLKLNMALVLLPVCRNTLTWLRSTWARFFVPFDDSIAFHKMIALAIAVGICLHAGNHLACDFPRLIASGPDEYRLVARFFGRDKPSYRGLLAGAEGVTGIVMVTLMAVSFTLATRPFRKREAEVKPARSARRWCWPLAHLAGGFNAFWYSHHLLIVVYLLLLVHGWFVFLVDKWYQRTTWMYISVPLVLYVGERTLRAFRSKAYAVKILKVCLLPGNVLTITMSKPYDSATECPTISPFEWHPFSITSAPGDDYISVHIQTRGDWTQELKRIFVENYFTPCVPRRAAFGELGAVEHKSPPRLLVDGPYGAPAQDFRNYDVLLLVGLGIGATPFISILRDLLNNIKLADELMDLAMETSRSEDSANSLSASTASSSNKRRAYRTSCAHFYWVTREPGSFEWFKGVMNEVAEMDKKGVIELHNYLTSVYEERDARTTLLSMVQALNHAKHGVDIVSGTRVRTHFARPNWKEVFTRIASKHPNSTVGVFYCGRPTLAKELKKLSLDMSHKTGTRFDFHKEYF

SEQ ID NO: 129 - DNA, 918 bp, Sorghum bicolor
  misc_feature: Ceres ANNOT ID no. 6006586
  misc_feature: Encodes the peptide sequence at SEQ ID NO 130
atggacgggggcacggtggaggatctcatacggcggctgctggacggcaagaagcacaaggtgacggggaagaaggcggtgcagctgacggagcccgagatccggcacctctgcgtcaccgccaaggaggtcttcctctcccagcccaacctcctggagctggaggcccccatcaacgtctgcggtgacatccacgggcagttctcggacctgctgcggctgttcgagtacggcggcctgccgccgacggccaactacctgttcctcggcgactacgtggaccgcgggaagcagagcatcgagaccatctgcctgctgctggcgtacaagatccggtacccggacaacttcttcctgctgcggggcaaccacgagtgcgcctccatcaaccgcatctacggcttctacgacgagtgcaagcgccgcttcagcgtccgcctctggaagctcttcaccgactgcttcaactgcctgcccgtcgccgccgtcatcgacgacaagatcctctgcatgcacggcggcctctccccggacctcgacaacctcaaccggatcagggagatccagcgccccgtcgacgtccccgaccagggcctcctctgcgacctcctctggtccgaccccgaccgcgacagctccggctggggcgacaacgaccgcggcgtctccttcaccttcggcgccgacaaggtcaccgagttcttgaacaagcaggacctcgacctcgtctgccgcgcccaccaggtcgtggaggacgggtacgagttcttcgccgaccggcagctggtgaccatattctcggcgcccaactactgcggcgagttcaacaacgccggcgcgctgatgaacgtcgacgccagcctgctctgctcgttccagatcctcaagccgtacaggggcaaagcacagacggagtga

SEQ ID NO: 130 - protein, 305 aa, Sorghum bicolor
  misc_feature: Ceres ANNOT ID no. 6006586
  misc_feature (56)..(251): Pfam Id: Metallophos Pfam Desc: Calcineurin-like phosphoesterase
  misc_feature (1)..(297): NCBI GI: 9759238 NCBI Desc: serine/threonine protein phosphatase pp1 isozyme 2 [arabidopsis thaliana]
  misc_feature (1)..(303): NCBI GI: 108935873 NCBI Desc: serine/threonine-protein phosphatase pp1
  misc_feature (1)..(300): NCBI GI: 92896043 NCBI Desc: serine/threonine-specific protein phosphatase and bis(5-nucleosyl)-tetraphosphatase [medicago truncatula]
  misc_feature (1)..(297): NCBI GI: 16433 NCBI Desc: protein phosphatase 1a [arabidopsis thaliana]
  misc_feature (1)..(297): NCBI GI: 3176072 NCBI Desc: protein phosphatase 1, catalytic beta subunit [medicago sativa]
  misc_feature (1)..(297): SWISSPROT Homolog: EC 3.1.3.16 Serine/threonine-protein phosphatase PP1 isozyme 2
MDGGTVEDLIRRLLDGKKHKVTGKKAVQLTEPEIRHLCVTAKEVFLSQPNLLELEAPINVCGDIHGQFSDLLRLFEYGGLPPTANYLFLGDYVDRGKQSIETICLLLAYKIRYPDNFFLLRGNHECASINRIYGFYDECKRRFSVRLWKLFTDCFNCLPVAAVIDDKILCMHGGLSPDLDNLNRIREIQRPVDVPDQGLLCDLLWSDPDRDSSGWGDNDRGVSFTFGADKVTEFLNKQDLDLVCRAHQVVEDGYEFFADRQLVTIFSAPNYCGEFNNAGALMNVDASLLCSFQILKPYRGKAQTE

SEQ ID NO: 131 - DNA, 585 bp, Sorghum bicolor
  misc_feature: Ceres ANNOT ID no. 6006587
  misc_feature: Encodes the peptide sequence at SEQ ID NO 132
atggcctcggaggagatgaaggcgacggaggtggcggcgctgctggatctgaagccgcacccggagggcggcttctacgccgagaccttccgcgacggctccgtcacgctcaccacctcccagctcccgccccactacaaggttgaccgtgctgttagcactgcaatctacttcttacttcctgcagggagtgtttcacgtctccaccgcattccctgtgctgaaacctggcacttctacaagggagagcctctcacggtctttgagcttcacgacgatggtcacattgaccttactgtcattggcccacacctcgaggctgggcagcgcccccagtatacggtgccaccgaacgtgtggtttggctccttccccacactagacgtcgagtcgttcgcgtctgacggcagcgttctcgtcaaatctcgaaagagggaccccgagctgcactactcccttgttggctgcacctgtgcccctggcttccaatacgaggactttgaaatggccaaatttgaggacgtgagttccattgctcccaaggctgaacccttcctcaagttcctcattccctctaccgagtaa

SEQ ID NO: 132 - protein, 194 aa, Sorghum bicolor
  misc_feature: Ceres ANNOT ID no. 6006587
  misc_feature (8)..(171): Pfam Id: Cupin_5 Pfam Desc: Cupin superfamily (DUF985)
  misc_feature (1)..(189): NCBI GI: 8778289 NCBI Desc: f14d16.29 [arabidopsis thaliana]
  misc_feature (78)..(192): NCBI GI: 115466922 NCBI Desc: os06g0198600 [oryza sativa (japonica cultivar-group)]
  misc_feature (3)..(120): NCBI GI: 23011397 NCBI Desc: cog3542: uncharacterized conserved protein [magnetospirillum magnetotacticum ms-1]
  misc_feature (6)..(125): NCBI GI: 46201612 NCBI Desc: cog3542: uncharacterized conserved protein [magnetospirillum magnetotacticum ms-1]
  misc_feature (6)..(120): NCBI GI: 114327115 NCBI Desc: cupin superfamily protein [granulobacter bethesdensis cgdnih1]
MASEEMKATEVAALLDLKPHPEGGFYAETFRDGSVTLTTSQLPPHYKVDRAVSTAIYFLLPAGSVSRLHRIPCAETWHFYKGEPLTVFELHDDGHIDLTVIGPHLEAGQRPQYTVPPNVWFGSFPTLDVESFASDGSVLVKSRKRDPELHYSLVGCTCAPGFQYEDFEMAKFEDVSSIAPKAEPFLKFLIPSTE

SEQ ID NO: 133 - DNA, 1635 bp, Sorghum bicolor
  misc_feature: Ceres ANNOT ID no. 6006649
  misc_feature: Encodes the peptide sequence at SEQ ID NO 134
atgctcgcgtacatggaccgtgcgacggcggccgccgagccggaggacgccggggagctctcgcccgccacgatggcggccgccgccgcctcggccggtgacgcggcgggccggcgcgtggcggcgatggacttcggcgggctggtccgcgccgtgcccgcggccgtggtccggcccgcgagcgcggacgacgtggccagcgccatccgcgcggcggcgctgacgccgcacctcaccgtggccgcacgcgggaacgggcactcggtggccggccaggccatggccgagggcgggctggtcctcgacatgcgctcgctcgccgcggcgccgtcgtcgtcccggcgcggcgtggcgcagatgcagctggtccagtgccccgaaggcggcggcggcggctgctgcttcttcgccgacgtccccggcggcgcgctctgggaggaggtgctccactggggcgtcgacaaccacgggctcgccccggcgtcgtggacggactacctccgcctcacggtcggcggcacgctctccaacggcggcgtcagcgggcagtccttccgctacggaccccaggtgtccaacgtggccgagctcgaggtggtcaccggcgacggcgagtaccgcgtctgctcgcgctcctcccacccggacctcttcttcgccgtgctcggcgggctcggacagttcggcgtcatcacgcgcgcacgcatcccgctccacaaggcgcccaaggcggtgcggtggacgcgcgtggtgtacgcgagcttcgcggactacacggcggacgcggagtggctagtgacgcgggaccccgatgcggcgttcgactacgtggagggcttcgcgttcgtcaacagcgacgaccccgtcaacgggtggccgtccgtgcccatccccggcggcgcccgcttcgacgcgtccctcctccccgccggcgccggccccgtcctctactgcctggaggtggccctgtaccagtacgacgcgcaccatcggcccgacgacgacgacgacgaggaccagggggtggcgagcgtgagccgtcggatgatggcgcggctcaagtacgtgcgtggcctggagttcgcggcggacgtcgggtacgtggacttcctgtcccgggtgaaccgcgtggaggaggaggcccggcgaaacggcagctgggacgcgccgcacccgtggctcaacctcttcgtctccgcgcgcgacgtcgccgacttcgaccgcgccgtcatcaagggcatgctcgccgacggcatcgacgggcccatgctcgtctaccccatgctcaagagcaagtgggaccccaacacgtcggtggcgctgccggagggcgagatcttctacctggtggcgctgctgcggttctgccgacccggcggcccggcggtggacgagctggtggcgcagaacggcgcgatcctcagcgcgtgccgcgccaacggctacgactacaaggcctacttcccgagctaccgcggcggggaggcggagtggtcgcgccacttcggcgccgccaggtggaggcgcttcgtggaccgcaaggcccgctacgacccgctggcgatcctcgcgccgggccagaagatcttcccccgggccccggccggccgcccgtcgccgtgtagtctagtctag

SEQ ID NO: 134 - protein, 544 aa, Sorghum bicolor
  misc_feature: Ceres ANNOT ID no. 6006649
  misc_feature (242)..(530): Pfam Id: Cytokin-bind Pfam Desc: Cytokinin dehydrogenase 1, FAD and cytokinin binding
  misc_feature (53)..(210): Pfam Id: FAD_binding_4 Pfam Desc: FAD binding domain
  misc_feature (8)..(533): NCBI GI: 83755013 NCBI Desc: chain a, x-ray structure of cytokinin oxidasedehydrogenase (ckx) from arabidopsis thaliana at5g21482
  misc_feature (19)..(531): NCBI GI: 117169180 NCBI Desc: cytokinin oxidase/dehydrogenase 1 [pisum sativum]
  misc_feature (136)..(530): NCBI GI: 11558279 NCBI Desc: cytokinin oxidase [dendrobium cv. 'sonia']
  misc_feature (136)..(533): NCBI GI: 38520861 NCBI Desc: cytokinin oxidase 2 [zea mays]
  misc_feature (41)..(533): NCBI GI: 145339819 NCBI Desc: atckx6/atckx7/ckx6 (cytokinin oxidase/dehydrogenase 6); cytokinin dehydrogenase [arabidopsis thaliana]
  misc_feature (8)..(533): SWISSPROT Homolog: EC 1.5.99.12 Cytokinin dehydrogenase 7
MLAYMDRATAAAEPEDAGELSPATMAAAAASAGDAAGRRVAAMDFGGLVRAVPAAVVRPASADDVASAIRAAALTPHLTVAARGNGHSVAGQAMAEGGLVLDMRSLAAAPSSSRRGVAQMQLVQCPEGGGGGCCFFADVPGGALWEEVLHWGVDNHGLAPASWTDYLRLTVGGTLSNGGVSGQSFRYGPQVSNVAELEVVTGDGEYRVCSRSSHPDLFFAVLGGLGQFGVITRARIPLHKAPKAVRWTRVVYASFADYTADAEWLVTRDPDAAFDYVEGFAFVNSDDPVNGWPSVPIPGGARFDASLLPAGAGPVLYCLEVALYQYDAHHRPDDDDDEDQGVASVSRRMMARLKYVRGLEFAADVGYVDFLSRVNRVEEEARRNGSWDAPHPWLNLFVSARDVADFDRAVIKGMLADGIDGPMLVYPMLKSKWDPNTSVALPEGEIFYLVALLRFCRPGGPAVDELVAQNGAILSACRANGYDYKAYFPSYRGGEAEWSRHFGAARWRRFVDRKARYDPLAILAPGQKIFPRAPAGRPSPCSLV

SEQ ID NO: 135 - DNA, 1230 bp, Sorghum bicolor
  misc_feature: Ceres ANNOT ID no. 6006653
  misc_feature: Encodes the peptide sequence at SEQ ID NO 136
atgctcacgtgcatcgcgtgctccaagcacctcccgggcggcgcgccgccgctgcgcgagccgccggaagaggaggaggaggaggacgacgacgaccaccacgccatcgccggaggcgccggtgaatcggcgacgacgcccggcacgaggcacgccgtcaagtcgctcaccgcccagatcaaggacatggcgctgaaggcgtcgggcgcgtaccggcactgcaagccgtgcgccgggtcgtcgtccccggcggcgtcgcggcggcagcaaccgtactaccacggcgcgtacgcggagtccaggtccgaccgcttccactacgcgtaccagtgcgccggcagctccgcagcatcgacgccgaggctgcgcacggggggcgcgatgtccagcggtgacgtcacgccgtcggtcagcgcgcgcactgacttcctcgccggcgatgaggatgaagaggaaacggcggctggcagcagcgaggaggatgaggcgaaggagtgggtcgcccaggtggaacccggggtgctcatcaccttcctctcgctgccacggggcggcaatggtctgaagcgcatccgattcagccgtgaaatgttcaacaaatggcaagcacaaagatggtggactgaaaattacgagaaggtcatggagctttacaacgttcagaagtttgacagtcaagctgcttctctgccaagcattccaaggtctgaaaatgagagctccaaagacgataactcagctacagctccacttaacaaggggcaactactagatactttgcacagaccactaaaagttagtggagccataggatattcatcttcagattgtcttcagcaccaacccaatcatcttggcaacatttaccgccaagaccgctaccttgggcaccaatgttgtgattcagttggactggcatcaacgcctaagttatcaagcattagtggagcaaagacagaaacttctattgatgcatcagtgaggacaagctcatctcctgaagaggtggatcgatcaggtgaactttcagcctctgttagcaacgcaagtgaccaagagagggaatgggtagaagaggacgagcctggtgtgtatattactattcgagctttgcctggtggcatcagagaactacgtcgcgtcagattcagccgggagagattcaatgagatgcatgccaggttgtggtgggaagaaaaccgagcgaggatacatgatcaatatctctga

SEQ ID NO: 136 - protein, 409 aa, Sorghum bicolor
  misc_feature: Ceres ANNOT ID no. 6006653
  misc_feature (183)..(218): Pfam Id: DZC Pfam Desc: Disease resistance/zinc finger/chromosome condensation-likeregion
  misc_feature (373)..(408): Pfam Id: DZC Pfam Desc: Disease resistance/zinc finger/chromosome condensation-likeregion
  misc_feature (29)..(275): NCBI GI: 56461772 NCBI Desc: at1g54180 [arabidopsis thaliana]
  misc_feature (31)..(243): NCBI GI: 109020194 NCBI Desc: brevis radix [arabidopsis thaliana]
  misc_feature (302)..(409): NCBI GI: 57222218 NCBI Desc: at1g54180 [arabidopsis thaliana]
  misc_feature (197)..(383): NCBI GI: 51536140 NCBI Desc: major intrinsic protein-like [oryza sativa (japonica cultivar-group)]
  misc_feature (302)..(384): NCBI GI: 15221753 NCBI Desc: zinc finger protein-related [arabidopsis thaliana]
MLTCIACSKHLPGGAPPLREPPEEEEEEDDDDHHAIAGGAGESATTPGTRHAVKSLTAQIKDMALKASGAYRHCKPCAGSSSPAASRRQQPYYHGAYAESRSDRFHYAYQCAGSSAASTPRLRTGGAMSSGDVTPSVSARTDFLAGDEDEEETAAGSSEEDEAKEWVAQVEPGVLITFLSLPRGGNGLKRIRFSREMFNKWQAQRWWTENYEKVMELYNVQKFDSQAASLPSIPRSENESSKDDNSATAPLNKGQLLDTLHRPLKVSGAIGYSSSDCLQHQPNHLGNIYRQDRYLGHQCCDSVGLASTPKLSSISGAKTETSIDASVRTSSSPEEVDRSGELSASVSNASDQEREWVEEDEPGVYITIRALPGGIRELRRVRFSRERFNEMHARLWWEENRARIHDQYL

SEQ ID NO: 137 - DNA, 3777 bp, Sorghum bicolor
  misc_feature: Ceres ANNOT ID no. 6006656
  misc_feature: Encodes the peptide sequence at SEQ ID NO 138
atggcggagacggcggcggcggatgggaaggcggacaaggtggcgaacggaggagggggaggcggcgatgcggcgggggaggggaagaagaggggggaccaggccgtggcgttccacgagctcttctcgttcgccgacaagtgggacctgatgctcatggccgcgggcagtctgggcgcgctggcgcacggcgctgccatgccgttcttcttcctgctcttcggggacctcatcaacggcttcggcaagaaccagaccgacctccgcaccatgaccgacgaggtcgccaagtatgcgctctacttcgtctacctggggctggtggtttgcgtctcctcctacgcagagatcgcgtgctggatgtacaccggggaacggcaggtgatcgcgctccggaaggcgtaccttgacgccgtgctgcggcaggatgtggggttcttcgacacggacgcgcgcacgggcgacatcgtcttcggtgtctccaccgacacgctgctcgtgcaggatgccatcggcgagaaggtcggcaacttcatgcactacatcgccaccttcctggccgggctcgtcgtcggattcgtctcggcgtggcggcttgcgctgcttagtgtggccgtcatcccggccatcgccttcgccggcggcctgtacgcgtacacgctcactgggctcacttccaaaagccgggagtcctatgctaatgctggcgtcgtcgcggagcaggcaattgcacaagtaagaacagtgtactcttttgttggagagagcaaagcgctcaattcctattctgaagcaatccagaacacactgaagcttggttacaaagctgggatggccaaaggtcttggaattggatgtacttatgggatcgcttgcatgtcttgggcacttgtattttggtatgccggggtcttcatcaggaatgggcagactgatggtggaaaggcttttaccgcgatcttttctgcaattgctttctcaaacctcggagccttcagtaaaggaaagattgctggttacaaactgttggaggtcattcgccagaaaccctccatagtgaatgaccataaggatggaaagtggttggcagaggtccatggaaacatagaattcaaggaagttactttcagttatccatcaaggcctgatgttataatctttcgggatttctctcttttcttccctgctggtaaaacggttgcagttgttggaggcagtgggtctggaaagagcactgttgtggctttgatagaaaggttctatgatcctaatgaaggccaggttttgctagacaatgttgacataaagacactccagttgaggtggctcagagatcagattggtctggtaaaccaagaacctgctctttttgcaacaacaatccttgagaatatactgtatggaaagccagatgcaactattgcagaagttgaggctgcagcgactgcatccaatgcccatggttttatatctcttcttccaaatggttacaacacaatggtaggtgagcgaggcatccagctttctggtggtcagaaacaacgtatagcaatagctcgtgctatgctgaagaatccaaagattctgctccttgatgaggctaccagtgcattagatgcagactcagaaagcattgtgcaagaagctttagaccgtttgatggttgggaggacgactgtagttgttgcccaccgtctgtccactataagaaacgtgaacatgatcgctgtgatccagcaaggccaagttgttgagacgggcacacatgatgaactcctagcaaaaggaacctctggagcatatgcctcccttgtccgttttcaggaaacggcgcgtaatagggatcttgcaggtgcatctacccgcaggtcacggtcaattcacttgacaagctcactttccaccaaatctctcagcctcaggtctggaagtctaaggaacctcagttatcagtacagtactggagcagatggtcgcattgaaatgatttctaatgctgataatgaccgcaaatacccagcaccacgtggatacttcttcaagcttctgaaactgaatgcacctgaatggccttatgcagtgttgggggccattggttccgtcctctcaggatttattggcccaacttttgccattgttatgggtgaaatgcttgatgtgttctactacagggaccccaatgaaatggagaagaaaaccaagctatatgtgttcatctatattggcactggcatatatgctgtcgttgcttatcttgtgcagcattacttcttcagcatcatgggagaaaatcttacaaccagggttaggcggatgatgttgtctgcaatacttaggaatgaagttggttggtttgatgaagaagaaaacaattcaagtcttgtggctgcacgtctagctgttgatgcagctgatgtgaagtcggctatagctgagagaatatcagtcatcctgcagaacatgacatcccttatgacttctttcgttgttggatttatcattgaatggagagtggcaatacttattctggccactttccctctacttgtgcttgccaactttgctcagcaactttcaatgaagggctttgctggtgacacagcaaaggcacatgccaagagcagtatggttgcaggtgaaggagtgagcaatatccgcaccgtagcggccttcaacgctcaaagcaagatcttgtcactcttcagccatgaactgcgtgtaccagagcagcaaatcctccgccgcagccagacatcaggtcttttgtttggcctgtcacagctctgcttatactcctcagaagcgctcatcctctggtatggttctcatcttgtgcggtcacacggatccaccttctctaaggtcatcaaggtttttgttgtccttgtggtgactgccaactccgtagctgagacggtgagcctggccccagagatcatccgcggaggtgaatccatccgatccatctttggcatcctcaacagagcaacaagaattgagcctgatgatccggagtcagagcgggtcaccaccatccgaggcgacattgagttgcggcacgtcgacttttcatatccagcacgcccagacattcaaatcttcaaggacttcaacctgaaaatccatgccgggcgcagccaagcactagtcggagccagcggttcagggaagagcactgtcattgctctcattgagcggttctacgacccgtgtggggggaaagtggccattgatggcaaggacatccggacgctgaacttgaagtccttgcggctgaagatcggcctcgtgcagcaggagccagtcctcttcgcttcgagcatcctagaaaacattgcatacggcaaggaaggtgcgactgaggaggaggtgatcgaggcagcgaagacggcgaacgtgcacggcttcgtcagccagctgcccgatggctacaagacggcggtcggcgagcggggcatgcagctgtcaggcgggcagaagcaacggatcgccattgccagggcggtgctcaaggacccagccatcctgctgctggacgaggcaacgagcgcgctggacgcggagtccgagtgcgtgctgcaggaggcgctggagcggctgatgaaggggcggaccaccgtgctggtggcgcaccggctgtcgacgatccgaggggtggaccgcatcgcggtcgtgcaggacgggcggatcgtggagcacggcagccacaacgacctcctggcccggccggagggcgcctactcgcggctgctgcagttgcagcaccaccgtgtctga

SEQ ID NO: 138 - protein, 1258 aa, Sorghum bicolor
  misc_feature: Ceres ANNOT ID no. 6006656
  misc_feature (397)..(581): Pfam Id: ABC_tran Pfam Desc: ABC transporter
  misc_feature (1044)..(1228): Pfam Id: ABC_tran Pfam Desc: ABC transporter
  misc_feature (49)..(330): Pfam Id: ABC_membrane Pfam Desc: ABC transporter transmembrane region
  misc_feature (693)..(969): Pfam Id: ABC_membrane Pfam Desc: ABC transporter transmembrane region
  misc_feature (1)..(1256): NCBI GI: 38347317 NCBI Desc: osjnba0063c18.8 [oryza sativa (japonica cultivar-group)]
  misc_feature (17)..(1256): NCBI GI: 115458764 NCBI Desc: os04g0459000 [oryza sativa (japonica cultivar-group)]
  misc_feature (17)..(1256): NCBI GI: 27368847 NCBI Desc: mdr-like abc transporter [oryza sativa (japonica cultivar-group)]
  misc_feature (27)..(1258): NCBI GI: 24324262 NCBI Desc: mdr-like p-glycoprotein [arabidopsis thaliana]
  misc_feature (21)..(1254): NCBI GI: 4204793 NCBI Desc: p-glycoprotein [solanum tuberosum]
MAETAAADGKADKVANGGGGGGDAAGEGKKRGDQAVAFHELFSFADKWDLMLMAAGSLGALAHGAAMPFFFLLFGDLINGFGKNQTDLRTMTDEVAKYALYFVYLGLVVCVSSYAEIACWMYTGERQVIALRKAYLDAVLRQDVGFFDTDARTGDIVFGVSTDTLLVQDAIGEKVGNFMHYIATFLAGLVVGFVSAWRLALLSVAVIPAIAFAGGLYAYTLTGLTSKSRESYANAGVVAEQAIAQVRTVYSFVGESKALNSYSEAIQNTLKLGYKAGMAKGLGIGCTYGIACMSWALVFWYAGVFIRNGQTDGGKAFTAIFSAIAFSNLGAFSKGKIAGYKLLEVIRQKPSIVNDHKDGKWLAEVHGNIEFKEVTFSYPSRPDVIIFRDFSLFFPAGKTVAVVGGSGSGKSTVVALIERFYDPNEGQVLLDNVDIKTLQLRWLRDQIGLVNQEPALFATTILENILYGKPDATIAEVEAAATASNAHGFISLLPNGYNTMVGERGIQLSGGQKQRIAIARAMLKNPKILLLDEATSALDADSESIVQEALDRLMVGRTTVVVAHRLSTIRNVNMIAVIQQGQVVETGTHDELLAKGTSGAYASLVRFQETARNRDLAGASTRRSRSIHLTSSLSTKSLSLRSGSLRNLSYQYSTGADGRIEMISNADNDRKYPAPRGYFFKLLKLNAPEWPYAVLGAIGSVLSGFIGPTFAIVMGEMLDVFYYRDPNEMEKKTKLYVFIYIGTGIYAVVAYLVQHYFFSIMGENLTTRVRRMMLSAILRNEVGWFDEEENNSSLVAARLAVDAADVKSAIAERISVILQNMTSLMTSFVVGFIIEWRVAILILATFPLLVLANFAQQLSMKGFAGDTAKAHAKSSMVAGEGVSNIRTVAAFNAQSKILSLFSHELRVPEQQILRRSQTSGLLFGLSQLCLYSSEALILWYGSHLVRSHGSTFSKVIKVFVVLVVTANSVAETVSLAPEIIRGGESIRSIFGILNRATRIEPDDPESERVTTIRGDIELRHVDFSYPARPDIQIFKDFNLKIHAGRSQALVGASGSGKSTVIALIERFYDPCGGKVAIDGKDIRTLNLKSLRLKIGLVQQEPVLFASSILENIAYGKEGATEEEVIEAAKTANVHGFVSQLPDGYKTAVGERGMQLSGGQKQRIAIARAVLKDPAILLLDEATSALDAESECVLQEALERLMKGRTTVLVAHRLSTIRGVDRIAVVQDGRIVEHGSHNDLLARPEGAYSRLLQLQHHRV

SEQ ID NO: 139 - DNA, 1344 bp, Sorghum bicolor
  misc_feature: Ceres ANNOT ID no. 6006660
  misc_feature: Encodes the peptide sequence at SEQ ID NO 140
atggggtgcgcaacctccaccgaggcgcggcgcgacatggtgtgggtcggcgccgacgccccctcgcgccggagcttctcgctgccctccgtcgaccgccagcgtctgcggcttagggccggttcgatgctcggcaccctcggcctcgccggcagcgcccgtcactccggctcgtgcaggcacgcgacgctgtcggtggaggagatgatgaaaggcgacaacgaccacggcgcggacgcggtgctcctcggcgacgacgcggcgaagcggcccttgaagccccgcacgccgacgctgacgccgcccaacgagcctgaggtgatcaacgcgtgggagctcatggcggggctcgaggacgacgagccgacgccgcgcgccccgtacaagaatctgctactcgatgagccgccgcatgagttcgtcttggaggcgccgccgctgccgcagtggatgcaggccgacatggacatacccgtcgccttagacttcgacccggaggtactgtccggattccgggaggcgctagagggcacgacgccgtcgccggagcctgctgttgtctcgtccgccgaggacgagacacccagggagcaggagccgcagaataggaagggcgcggatgcatgtgacatgccaatgtcgccgccgtcgccggagcctgcggagcggaaggataggaaagacgcggatgcatgtgtcatgccaatgtcgccggccaccggcgacatgccgccggagctttccgggcttgtccgtgcccgcatcatcgcgttccaagagaggatcgaacggaggcgaaccaagggccgcgacgccaagctgtcgcccctgtggccgccggggggcgagcggaaggcggtggtgtacttcacgagcctccgcggcgtgcgcaagacgttcgtggactgctgcgccgtgcgcagcatcctgcgcagctacggcgtgcgcctggacgagcgcgacgtctccatgcacgccgtcttcaaggccgagctcgcggacctcctcgggcccgggttcgcaggcgccgcgctcccgcgcgtgttcatcgacggccagtacctcggcggcgccgaggacgtgcacttcctgcacgaggcgggcgagctcgggcgcgccctggaggggtgcgaggccgcgccctcgcggaagctcgggtacatggaggcatgcgccgcctgcggcgacgtccggttcgtgccgtgcgagacgtgctacggcagctgcaagatcttcgtcgaggacgacgacgcggacgacaggtatcacgacgtcggcgagttccggcggtgttccgattgtaatgagaatggcctcgtcagatgccccgtctgttgctgttga

SEQ ID NO: 140 - protein, 447 aa, Sorghum bicolor
  misc_feature: Ceres ANNOT ID no. 6006660
  misc_feature (287)..(355): Pfam Id: Glutaredoxin Pfam Desc: Glutaredoxin
  misc_feature (1)..(447): NCBI GI: 32490043 NCBI Desc: osjnba0063c18.3 [oryza sativa (japonica cultivar-group)]
  misc_feature (281)..(446): NCBI GI: 87240364 NCBI Desc: glutaredoxin [medicago truncatula]
  misc_feature (220)..(445): NCBI GI: 115467206 NCBI Desc: os06g0226100 [oryza sativa (japonica cultivar-group)]
  misc_feature (249)..(445): NCBI GI: 115448683 NCBI Desc: os02g0748800 [oryza sativa (japonica cultivar-group)]
  misc_feature (280)..(446): NCBI GI: 124359980 NCBI Desc: thioredoxin fold [medicago truncatula]
MGCATSTEARRDMVWVGADAPSRRSFSLPSVDRQRLRLRAGSMLGTLGLAGSARHSGSCRHATLSVEEMMKGDNDHGADAVLLGDDAAKRPLKPRTPTLTPPNEPEVINAWELMAGLEDDEPTPRAPYKNLLLDEPPHEFVLEAPPLPQWMQADMDIPVALDFDPEVLSGFREALEGTTPSPEPAVVSSAEDETPREQEPQNRKGADACDMPMSPPSPEPAERKDRKDADACVMPMSPATGDMPPELSGLVRARIIAFQERIERRRTKGRDAKLSPLWPPGGERKAVVYFTSLRGVRKTFVDCCAVRSILRSYGVRLDERDVSMHAVFKAELADLLGPGFAGAALPRVFIDGQYLGGAEDVHFLHEAGELGRALEGCEAAPSRKLGYMEACAACGDVRFVPCETCYGSCKIFVEDDDADDRYHDVGEFRRCSDCNENGLVRCPVCCC

SEQ ID NO: 141 - DNA, 1092 bp, Sorghum bicolor
  misc_feature: Ceres ANNOT ID no. 6006664
  misc_feature: Encodes the peptide sequence at SEQ ID NO 142
atggcggaggtgcatctaggtctgccaggtccctgggcggcggattaccgggagaaggccgaccactacaccactaagatcggtggagtccctgattggccaactggtgatatgggcattaagcccgagactcttcagtgcagcttatgtgggaccaagctctgtcttgttgctcaggtacatgcgcccgtggcaaagctaaacattgaggagaggataatctatgtgcttgtttgcctgacaccagagtgtggacctaaacctcaaaggcaagtcctaagagttcaaaaatgccgtaatgttatgcaaacagaaggctgtggcgatgaattaggtcagtcgaatggacctccttctacaagtgttccagaagaacagaatgataaaaataaatttcctgagatcaacgacgacgattttgatctagatgccttagccgaagcacttgagcaagctgcaactttggcatctaactcaaagaagaagaataaatcgaagcatgctaatgctcctgtaaaacgttctgtattgaaggagcaagcatgtgatctgagcataccagttcttccttgtttttacatatattatgataaggaactatatgggggcaaaggcactgtgggttcaagtagcagtgagttggttttggacaaagaaatcatggatactgcaaatgatgaagaagaaaaatgggaaggagaaaagtacgagtacgataaagctattggtgctgacagaacctttttaaaattcaagaaacggttggatgcgtacccccagcaatgctttaggtattcttatggtggcaagccactgttggctacaacaaaattacaagatcctggcacctgtagtctgtgtggttcaccacgccaatatgaactgcaattgatgtctcctttatcatactttctccatgaagctggagacggttcctcaaattatgcacccagcagctggacttggctgactgttatcatatacacttgctccaagagctgctgcccgtctccatgcggtggaaagcctcagagctgttgttggggagtagcggaggaggtgatcctgattcaggaggatgaagtcctttag

SEQ ID NO: 142 - protein, 363 aa, Sorghum bicolor
  misc_feature: Ceres ANNOT ID no. 6006664
  misc_feature (211)..(360): Pfam Id: PDCD2_C Pfam Desc: Programmed cell death protein 2, C-terminal putative domain
  misc_feature (3)..(360): NCBI GI: 116310883 NCBI Desc: osigba0138h21-osigba0138e01.15 [oryza sativa (indica cultivar-group)]
  misc_feature (3)..(360): NCBI GI: 38344901 NCBI Desc: osjnbb0079b02.4 [oryza sativa (japonica cultivar-group)]
  misc_feature (60)..(338): NCBI GI: 90399219 NCBI Desc: b0414f07.2 [oryza sativa (indica cultivar-group)]
  misc_feature (23)..(334): NCBI GI: 116126447 NCBI Desc: ensangp00000007243 [anopheles gambiae str. pest]
  misc_feature (13)..(337): NCBI GI: 55963412 NCBI Desc: novel protein (zgc:56288) [danio rerio]
MAEVHLGLPGPWAADYREKADHYTTKIGGVPDWPTGDMGIKPETLQCSLCGTKLCLVAQVHAPVAKLNIEERIIYVLVCLTPECGPKPQRQVLRVQKCRNVMQTEGCGDELGQSNGPPSTSVPEEQNDKNKFPEINDDDFDLDALAEALEQAATLASNSKKKNKSKHANAPVKRSVLKEQACDLSIPVLPCFYIYYDKELYGGKGTVGSSSSELVLDKEIMDTANDEEEKWEGEKYEYDKAIGADRTFLKFKKRLDAYPQQCFRYSYGGKPLLATTKLQDPGTCSLCGSPRQYELQLMSPLSYFLHEAGDGSSNYAPSSWTWLTVIIYTCSKSCCPSPCGGKPQSCCWGVAEEVILIQEDEVL

SEQ ID NO: 143 - DNA, 903 bp, Sorghum bicolor
  misc_feature: Ceres ANNOT ID no. 6006674
  misc_feature: Encodes the peptide sequence at SEQ ID NO 144
atggaggccagcgtgggcgtccgtgcgccggcgcgcggccgtgcctgggccggcatcgagaagccgcacggcgcttactccgtcagagtcccgccggtaaggctcacggcggacaggctgcggctgcctccgccgcggaggctggtgctgggcgccgatccgtggaggaccgcgggtcctgccctccgtcccgcaaagctgagagtttcgtgctccgcgaaatcggcaggaacaggaaaagtccactattctactgacgaggctctcatactacagcaaaaggcccaggatgttctcccttacttggatggccgatgcgtttatcttgttggaatgatgggttcaggcaaaactacagttgggaagatattagccgaagtattaggttattcgttctttgacagtgataagctggtagagaaggctgttggtatctcatctgttgctgagatctttcagctccatagtgaagcattcttcagagataatgagagtgaggtcctgagggatctgtcatcaatgcatcggttggttgttgcaaccggaggtggtgcagtgatccgaccaatcaattggagttacatgaagaaagggctgactgtgtggttagacgttccactggatgcacttgcaagaagaattgctgctgtaggaaccgcatctcgaccactcttgcatcaggaatctggtgacccttatgcaaaggcttatgcgaaacttacatcactttttgagcaaagaatggactcgtatgctaatgctgatgccagagtttcacttgaacatattgcattaaaacaaggccataatgatgtcactatacttacacctagtgccatcgccattgaggcattgctaaagatggaaagttttcttaccgagaagaccatggtcagaaactga

SEQ ID NO: 144 - protein, 300 aa, Sorghum bicolor
  misc_feature: Ceres ANNOT ID no. 6006674
  misc_feature (113)..(289): Pfam Id: SKI Pfam Desc: Shikimate kinase
  misc_feature (1)..(300): NCBI GI: 38344899 NCBI Desc: osjnbb0079b02.2 [oryza sativa (japonica cultivar-group)]
  misc_feature (1)..(300): NCBI GI: 116310881 NCBI Desc: osigba0138h21-osigba0138e01.13 [oryza sativa (indica cultivar-group)]
  misc_feature (58)..(294): NCBI GI: 56805579 NCBI Desc: shikimate kinase 2 [oryza sativa (japonica cultivar-group)]
  misc_feature (1)..(297): NCBI GI: 56805577 NCBI Desc: shikimate kinase 1 [oryza sativa (japonica cultivar-group)]
  misc_feature (77)..(294): NCBI GI: 115467200 NCBI Desc: os06g0225800 [oryza sativa (japonica cultivar-group)]
  misc_feature (28)..(298): SWISSPROT Homolog: EC 2.7.1.71 Shikimate kinase, chloroplast precursor
  misc_feature: Useful for making plants with altered sterol content
  misc_feature: Useful for making plants with modulated biomass
  misc_feature: Useful for making plants with modulated heat sensitivity
  misc_feature: Useful for making plants with modulated salt sensitivity
  misc_feature: GREAT-hit functional homolog of the protein sequence given in SEQ ID NO 13434
  misc_feature: GREAT-hit functional homolog of the protein sequence given in SEQ ID NO 13435
  misc_feature: GREAT-hit functional homolog of the protein sequence given in SEQ ID NO 13442
  misc_feature: Useful for making plants with modulated salt sensitivity
  misc_feature: Functional homolog of the protein sequence given in SEQ ID NO 13442
MEASVGVRAPARGRAWAGIEKPHGAYSVRVPPVRLTADRLRLPPPRRLVLGADPWRTAGPALRPAKLRVSCSAKSAGTGKVHYSTDEALILQQKAQDVLPYLDGRCVYLVGMMGSGKTTVGKILAEVLGYSFFDSDKLVEKAVGISSVAEIFQLHSEAFFRDNESEVLRDLSSMHRLVVATGGGAVIRPINWSYMKKGLTVWLDVPLDALARRIAAVGTASRPLLHQESGDPYAKAYAKLTSLFEQRMDSYANADARVSLEHIALKQGHNDVTILTPSAIAIEALLKMESFLTEKTMVRN

SEQ ID NO: 145 - DNA, 1725 bp, Sorghum bicolor
  misc_feature: Ceres ANNOT ID no. 6006684
  misc_feature: Encodes the peptide sequence at SEQ ID NO 146
atgccccgcggcagtgccgcctctgtgttccttggtgtcgatgttggtactggcagcgctcgtgcaggtctctttgatgaaaagggcaagttgctggggtcggctagcagccctatacagatatggaaagagaaagactgtattgagcaatcatcaactgatatctggcatgcagtctgtgctgcggtgaaatccgcatgctcactggcaaatgttgctcctgaggatgttgccggccttggctttgctgccacttgctcccttgttgctgtcgatgctgatggttcccctgtttcggtttctttgagtggtgatacaaggaggaatatcattgtgtggatggaccatagagctgtgaatcaggcagagagaatcaatgctaccaattcgccagtactgcaatactgcggtgggggtgtttccccagaaatgcaggctccaaagctcttatggatgaaggaaaatcttcaagagtcgtggtctatggtttgtaggtggatggacctaagtgactggttagcatatagagcaacaggtgacgacactcgcagcttatgcacaactgtctgcaaatggacatatcttggacatgcacacatggagcagtggaaggaatctgattcacgtgatatggaggcttgcggatgggacaatgttttttgggaagaaatagggttgggagacctcgtggaaggaaattgtgcaaaaataggacgcagtgtcgcttttcctggtcatcctcttggttctggtttgacacctactgctgcaaaggagttaggcttacttcctggtactcctgttggaacttcacttattgatgctcatgctggtggagttggagtcatggaaagcgtttcagatgcaggatctaaagctggtttgtccgatgaagatgcaatatgtcaccggatggtattggtatgtgggacatcaacatgccacatggctgtttcaaagaacagattgtttatacctggtgtctgggggccgttctggtctgcaatggtacctgagttttggctcacagaaggtggccaaagtgcaactggcgctctactcgattacattattgaaaaccatgttgcctctcctcttctttctaaccatgctgcttctcaaagtatatccatatttgagctactgaacaagatgttgctttctatgtcacatgagcagaatagtccgtttctttctgcattaactcaagacacccatgtacttccggattttcatggaaatcggtctcctgttgctgatccaaaatccaaaggagtgatttatggcttgacacttgatacaagtgagaagcatttagctcttctgtacctagcaacagttcagggtattgcttatggcactcgtcatattgtggagcattgtaatgctcatggccacaagatagacacacttcttgcttgtgggggacttgcaaagaattctgtgtatatccaagagcatgcagatattaccggatgtcctataatacttcctagagagaatgagtctgtgcttttgggtgctgctgttctgggtgctgttgctggcaagaagtttctgggtgttcgtgatgcaatgaaggcgcttaatgcagcagggaaggtcgtaaatccatcttcagatcctagggtgaagaaataccatgatgcaaaatatcagatattcaggtccctgtatgagcagcaactctctcatcgctcgaccatggcacaagcattgcaatag

SEQ ID NO: 146 - protein, 574 aa, Sorghum bicolor
  misc_feature: Ceres ANNOT ID no. 6006684
  misc_feature (9)..(281): Pfam Id: FGGY_N Pfam Desc: FGGY family of carbohydrate kinases, N-terminal domain
  misc_feature (300)..(548): Pfam Id: FGGY_C Pfam Desc: FGGY family of carbohydrate kinases, C-terminal domain
  misc_feature (226)..(574): NCBI GI: 115444585 NCBI Desc: os02g0177900 [oryza sativa (japonica cultivar-group)]
  misc_feature (5)..(569): NCBI GI: 116126734 NCBI Desc: ensangp00000010773 [anopheles gambiae str. pest]
  misc_feature (262)..(562): NCBI GI: 83584942 NCBI Desc: cog1069: ribulose kinase [escherichia coli 101-1]
  misc_feature (215)..(569): NCBI GI: 56207214 NCBI Desc: novel protein [homo sapiens]
  misc_feature (215)..(569): NCBI GI: 123227592 NCBI Desc: novel protein (2310009e04rik) [mus musculus]
MPRGSAASVFLGVDVGTGSARAGLFDEKGKLLGSASSPIQIWKEKDCIEQSSTDIWHAVCAAVKSACSLANVAPEDVAGLGFAATCSLVAVDADGSPVSVSLSGDTRRNIIVWMDHRAVNQAERINATNSPVLQYCGGGVSPEMQAPKLLWMKENLQESWSMVCRWMDLSDWLAYRATGDDTRSLCTTVCKWTYLGHAHMEQWKESDSRDMEACGWDNVFWEEIGLGDLVEGNCAKIGRSVAFPGHPLGSGLTPTAAKELGLLPGTPVGTSLIDAHAGGVGVMESVSDAGSKAGLSDEDAICHRMVLVCGTSTCHMAVSKNRLFIPGVWGPFWSAMVPEFWLTEGGQSATGALLDYIIENHVASPLLSNHAASQSISIFELLNKMLLSMSHEQNSPFLSALTQDTHVLPDFHGNRSPVADPKSKGVIYGLTLDTSEKHLALLYLATVQGIAYGTRHIVEHCNAHGHKIDTLLACGGLAKNSVYIQEHADITGCPIILPRENESVLLGAAVLGAVAGKKFLGVRDAMKALNAAGKVVNPSSDPRVKKYHDAKYQIFRSLYEQQLSHRSTMAQALQ

SEQ ID NO: 147 - DNA, 3069 bp, Sorghum bicolor
  misc_feature: Ceres ANNOT ID no. 6006701
  misc_feature: Encodes the peptide sequence at SEQ ID NO 148
atggcaggggcggcgcccgcaccggcgcccccgttgctccggcggtgcccgtgctccgcgcctccctgggcgccttcgcccttccgctcacgccgccgcggccgctccatggtgtcgccgttcactggcgccagaaggcaggagtactcccagagctcagtccttggaatccaagacagccgagctcttaagcttccagtatgtgtcaactttaatgtgcaaagtagcggcgcgcaagaatgggccgacgagagcaggaggttatccttaagcaaagccagcaatagtaatggttccagtcatctagggacgggtattttccatcatgaacccttggaagatttcaagagctccaaccaatctctattgcacaatgtacgacaaagaatggcaccaaattctcttgcgaataggcacgccaacacggaattggcaaagcatcatgcgattaatcgtgccgcagttgctgtgacagcactgaccagtgttgttaacgatgacattaaaccggtgaagaggcctaaggaatctgaagtggaggctcattggcctaatggtcccaagtttcattcttctcttccgaaaatctctgaagttgaaacaagcttgccatttgatgaaaatgctacagatggccatgctaaagatgtgaatgaaggctcacctgaggagacggtacaaccttctccggctagagcgcccttatcccaggagtctatagatgcgcggaaggcacttgctaccatctatgacaaagttctggtggttgacaatgtcatgtcagctaggagtgttgttcaactgcttactacgaagtacagaaattatattcatgcatgtgacacagaggtagatattgatgttaaacaagagacaccagttggccatggaaaggtcacatgctttagcatctactctggcactaaaggtgctgaagctgattttggaaatggcaagacatgcatttgggtggatgtgctggatggtggaccagatgtactcatggagtttgccccattttttgaggattcatcaatcaggaaggtttggcacaactatagttttgatagtcatgtcatagagaactatggaattaaagttgctggatttcatgctgatacaatgcatcttgcaagactttgggattcttcaagaaggacggatggaggatattctcttgagggacttacaaatgatcatagggtcatgggtgttgtctcaaaggaattgcgaaagattgggaagagatcaatgaaaaccatctttggtaggaaaaagataaagaaggatggatcagaagggaagattactgcaatcgagcctgttgaaattttacaaagagaagacagagaattgtggatctgctattcttcattagattccatgagtaccttgaagctttatgaaagcttgaaaagcaagcttgaaaggaagccttggacttttgatggttgccccagaggttcattgtacgatttctacgaggagtattggcgtccttttggtgctattcttgtaaaaatggaaacagctggaatgcttgttgaccgtgcttacctttcagagattgaaaaggttgctgttgcacagcgcaaattagctgcagataaatttcggaattgggcatctaagtattgccctgatgcaaaatacatgaatgttaatagtgatactcagattcgacaactcttctttggtggtatagagaacatatgcaaacctggtgattttttgccgaagagtaaagctattaaagtgcctaacgatgaaactgcggtttcagagggcaagaaagttccaaagtatcgcacaattgaacttttcaacattgtggaagacctgaaaactgatatatttactgcaagtggctggccttcagttagtggggatgcattgagaaatttggctgggaaggttccatcagatcttgtttactcaacagatgatgaatgtggtagtcattctgaaatttccaactgtgatctagaagacacctcttcttatggaactgcatatgatgcatttggaggaggaaaggaaggaaaagaagcatgccatgccattgcagctttgtgtgagatctgttctattgactcgttaatatccaacttcattcttcctctacagggaaatcatatatcatgtaaggaagggcggatccactgttccttgaatatcaacacagaaacagggcgtttatcggcaagggcaccaaatttacagaaccaacctgcgcttgaaaaggataggtataaaatccgtcaagcttttgttgcagctccagggaacactcttattgttgctgattatggtcagctggaacttaggatcttggcgcatcttgctgattgtaaaagcatgctagatgctttcagagctggcggtgacttccattccaggacagccatgaacatgtatccgcatattcgtgaggctgttgacgaagagaaagtaattcttgagtggcatcctcaacccggtcaagagaaacctcccgtgccgttgttgaaggatgcttttggtgctgagaggaggaaagctaagatgctaaatttctccattgcatatgggaaaacgccccatgggcttgctcgtgattggaaggtttctgttaaggaagcaaaagatacactgaaactctggtatagcgatagaaaggaggttctggcttggcaaatgaaacagaaacagctagcacatgagaagtctgaagtttatactttgcttgggcgatcacgccgttttccaaatatggctcatgcaacttctggccaaaggggtcacattgagcgtgctgctatcaatgctcctgtacagggcagtgcagctgatgttgctatgtgtgcaatgcttgagatagacaggaatactcgtcttaaggagcttggttggacgctactgttgcaggtgcatgatgaagtgatactggaagggccttcagagtctgcggaactggccaagtccatagtggttgagtgtatgtctaagcccttctatggcaccaatatcctgaaggtcgaccttgctgttgatgccaagtgtgcacagaattggtatgcggccaagtag

SEQ ID NO: 148 - protein, 1022 aa, Sorghum bicolor
  misc_feature: Ceres ANNOT ID no. 6006701
  misc_feature (627)..(1021): Pfam Id: DNA_pol_A Pfam Desc: DNA polymerase family A
  misc_feature (55)..(1022): NCBI GI: 19912795 NCBI Desc: poli-like dna polymerase [oryza sativa]
  misc_feature (466)..(1022): NCBI GI: 115460848 NCBI Desc: os04g0637400 [oryza sativa (japonica cultivar-group)]
  misc_feature (414)..(1022): NCBI GI: 76880152 NCBI Desc: dna polymerase [nicotiana tabacum]
  misc_feature (414)..(1022): NCBI GI: 76880150 NCBI Desc: dna polymerase [nicotiana tabacum]
  misc_feature (1)..(568): NCBI GI: 115475033 NCBI Desc: os08g0175600 [oryza sativa (japonica cultivar-group)]
MAGAAPAPAPPLLRRCPCSAPPWAPSPFRSRRRGRSMVSPFTGARRQEYSQSSVLGIQDSRALKLPVCVNFNVQSSGAQEWADESRRLSLSKASNSNGSSHLGTGIFHHEPLEDFKSSNQSLLHNVRQRMAPNSLANRHANTELAKHHAINRAAVAVTALTSVVNDDIKPVKRPKESEVEAHWPNGPKFHSSLPKISEVETSLPFDENATDGHAKDVNEGSPEETVQPSPARAPLSQESIDARKALATIYDKVLVVDNVMSARSVVQLLTTKYRNYIHACDTEVDIDVKQETPVGHGKVTCFSIYSGTKGAEADFGNGKTCIWVDVLDGGPDVLMEFAPFFEDSSIRKVWHNYSFDSHVIENYGIKVAGFHADTMHLARLWDSSRRTDGGYSLEGLTNDHRVMGVVSKELRKIGKRSMKTIFGRKKIKKDGSEGKITAIEPVEILQREDRELWICYSSLDSMSTLKLYESLKSKLERKPWTFDGCPRGSLYDFYEEYWRPFGAILVKMETAGMLVDRAYLSEIEKVAVAQRKLAADKFRNWASKYCPDAKYMNVNSDTQIRQLFFGGIENICKPGDFLPKSKAIKVPNDETAVSEGKKVPKYRTIELFNIVEDLKTDIFTASGWPSVSGDALRNLAGKVPSDLVYSTDDECGSHSEISNCDLEDTSSYGTAYDAFGGGKEGKEACHAIAALCEICSIDSLISNFILPLQGNHISCKEGRIHCSLNINTETGRLSARAPNLQNQPALEKDRYKIRQAFVAAPGNTLIVADYGQLELRILAHLADCKSMLDAFRAGGDFHSRTAMNMYPHIREAVDEEKVILEWHPQPGQEKPPVPLLKDAFGAERRKAKMLNFSIAYGKTPHGLARDWKVSVKEAKDTLKLWYSDRKEVLAWQMKQKQLAHEKSEVYTLLGRSRRFPNMAHATSGQRGHIERAAINAPVQGSAADVAMCAMLEIDRNTRLKELGWTLLLQVHDEVILEGPSESAELAKSIVVECMSKPFYGTNILKVDLAVDAKCAQNWYAAK

SEQ ID NO: 149 - DNA, 1095 bp, Sorghum bicolor
  misc_feature: Ceres ANNOT ID no. 6006703
  misc_feature: Encodes the peptide sequence at SEQ ID NO 150
atggggtacgggcggccggcgccgtcgactgcgccgccggcgccagtaatggcgggcatgtggagcagcgaggccttcaaggtcgtcgacagcggccacggcaccagcgcgtccaccgtcatggaggccgacaccaagttcgagacaaggctagaagatgttcaggtagcacttgagccaacaagaagtacggatcaggaaacaagcaagccgccagagagggtcatgagaaggctcgcgcagaacagagaggctgctcggaagagtcgcctgcggaaaaaggcctacatccaccagctagagacaagccggatgaagctggcccagttagagctggagcttcaacgggctcgacagcagggtgcatatgcaaatgggaacatgggagactcagctctcggttatgcagggtcgatagatccaggtgtcagcgcgttcgagatcgagtacagccactgggtggacgagcagaagaggcacacggcggagctgatgtcggcgctccaggggcagcagacgtcggagctggagctccgcctgctggtggagacggggctcagcaactacgagcacctcttcaggatcaaggcgatggccgccaacgcggacgtgttccacgtcatgtcgggcatgtggaagacccccgccgagaggttcttcctctggatcggcggcttccggccgtcggaagtcctcaagatcctgagcccgcagctggagccgctgacggagccgcagcgcatgctggtcggcggcctccagcacacgtcgacgcaggcggaggacgccctgtcgcagggcatggagaagctgcagcagaacctcgcggagaccctgacggcggaggccgacccgttcgggccccccgacgcctacatgctgcagatggccaccgcggtggacaggctcaaagagctcgtcggcttcgtcacccaggcggaccatctccggctgacgacgctgcagcagatgcacaagatcctgacgacgcggcaggcggccaggggcctcctggcgctgggcgactacttccagcgcctccgcacgctgagctcgctgtgggcggcgcgcccgcgggaggcggcgattagctag

SEQ ID NO: 150 - protein, 364 aa, Sorghum bicolor
  misc_feature: Ceres ANNOT ID no. 6006703
  misc_feature (70)..(122): Pfam Id: bZIP_1 Pfam Desc: bZIP transcription factor
  misc_feature (20)..(362): NCBI GI: 986969 NCBI Desc: tgacg-motif-binding protein
  misc_feature (19)..(360): NCBI GI: 7960722 NCBI Desc: transcription factor obf4 [arabidopsis thaliana]
  misc_feature (19)..(360): NCBI GI: 414613 NCBI Desc: ocs-element binding factor 4 [arabidopsis thaliana]
  misc_feature (20)..(362): NCBI GI: 15148922 NCBI Desc: tga-type basic leucine zipper protein tga1.1 [phaseolus vulgaris]
  misc_feature (22)..(362): NCBI GI: 124361256 NCBI Desc: tga transcription factor 1 [populus tremula x populus alba]
  misc_feature: The plant flowers significantly late compared to wild-type.
  misc_feature: The plant is abnormally small.
  misc_feature: The sequence is a functional homolog of SEQ ID NO 1493 in the 10/374,780US patent application
  misc_feature: The sequence is a functional homolog of SEQ ID NO 1494 in the 10/374,780US patent application
  misc_feature: The sequence is a functional homolog of SEQ ID NO 156 in the 10/412,699US patent application
  misc_feature: The sequence is a functional homolog of SEQ ID NO 1563 in the 10/412,699US patent application
  misc_feature: The sequence is a functional homolog of SEQ ID NO 1564 in the 10/412,699US patent application
  misc_feature: The sequence is a functional homolog of SEQ ID NO 164 in the 10/412,699US patent application
  misc_feature: The sequence is a functional homolog of SEQ ID NO 1754 in the 10/412,699US patent application
  misc_feature: The sequence is a functional homolog of SEQ ID NO 178 in the 10/412,699US patent application
  misc_feature: The sequence is a functional homolog of SEQ ID NO 1786 in the 10/412,699US patent application
  misc_feature: The sequence is a functional homolog of SEQ ID NO 1798 in the 10/412,699US patent application
  misc_feature: The sequence is a functional homolog of SEQ ID NO 1978 in the 10/374,780US patent application
  misc_feature: The sequence is a functional homolog of SEQ ID NO 2024 in the 10/374,780US patent application
  misc_feature: The sequence is a functional homolog of SEQ ID NO 2044 in the 10/374,780US patent application
  misc_feature: The sequence is a functional homolog of SEQ ID NO 352 in the 10/412,699US patent application
  misc_feature: The sequence is a functional homolog of SEQ ID NO 353 in the 11/479,226US patent application
  misc_feature: The sequence is a functional homolog of SEQ ID NO 369 in the 11/479,226US patent application
  misc_feature: The sequence is a functional homolog of SEQ ID NO 389 in the 11/479,226US patent application
  misc_feature: The sequence is a functional homolog of SEQ ID NO 4 in the 10/286,264US patent application
  misc_feature: The sequence is a functional homolog of SEQ ID NO 40 in the 10/374,780US patent application
  misc_feature: The sequence is a functional homolog of SEQ ID NO 408 in the 10/412,699US patent application
  misc_feature: The sequence is a functional homolog of SEQ ID NO 48 in the 10/286,264US patent application
  misc_feature: The sequence is a functional homolog of SEQ ID NO 776 in the 10/225,066US patent application
  misc_feature: The sequence is a functional homolog of SEQ ID NO 819 in the 11/479,226US patent application
  misc_feature: The sequence is a functional homolog of SEQ ID NO 928 in the 11/435,388US patent application
  misc_feature: The sequence is a functional homolog of SEQ ID NO 938 in the 11/435,388US patent application
  misc_feature: The sequence is a functional homolog of SEQ ID NO 957 in the 11/479,226US patent application
  misc_feature: Useful for making plants with altered Lignin content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 13093
  misc_feature: The sequence is a functional homolog of SEQ ID NO 4 in the 20030093837 US patent application
  misc_feature: The sequence is a functional homolog of SEQ ID NO 48 in the 20030093837 US patent application
  misc_feature: The sequence is a functional homolog of SEQ ID NO 156 in the 20040045049 US patent application
  misc_feature: The sequence is a functional homolog of SEQ ID NO 156 in the 20040045049 US patent application
  misc_feature: The sequence is a functional homolog of SEQ ID NO 1563 in the 20040045049 US patent application
  misc_feature: The sequence is a functional homolog of SEQ ID NO 1564 in the 20040045049 US patent application
  misc_feature: The sequence is a functional homolog of SEQ ID NO 178 in the 20040045049 US patent application
  misc_feature: The sequence is a functional homolog of SEQ ID NO 1786 in the 20040045049 US patent application
  misc_feature: GREAT-hit functional homolog of the protein sequence given in SEQ ID NO 13559
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: Useful for making plants with modulated biomass
  misc_feature: Useful for making plants with modulated flowering time
  misc_feature: Functional homolog of the protein sequence given in SEQ ID NO 13559
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: The sequence is a functional homolog of SEQ ID NO. 337 in the 11/188,298 US application
MGYGRPAPSTAPPAPVMAGMWSSEAFKVVDSGHGTSASTVMEADTKFETRLEDVQVALEPTRSTDQETSKPPERVMRRLAQNREAARKSRLRKKAYIHQLETSRMKLAQLELELQRARQQGAYANGNMGDSALGYAGSIDPGVSAFEIEYSHWVDEQKRHTAELMSALQGQQTSELELRLLVETGLSNYEHLFRIKAMAANADVFHVMSGMWKTPAERFFLWIGGFRPSEVLKILSPQLEPLTEPQRMLVGGLQHTSTQAEDALSQGMEKLQQNLAETLTAEADPFGPPDAYMLQMATAVDRLKELVGFVTQADHLRLTTLQQMHKILTTRQAARGLLALGDYFQRLRTLSSLWAARPREAAIS

SEQ ID NO: 151 - DNA, 1713 bp, Sorghum bicolor
  misc_feature: Ceres ANNOT ID no. 6006710
  misc_feature: Encodes the peptide sequence at SEQ ID NO 152
atggacactggctgcctctcatctatgaacattactggagctagccaagcaagaccttttgcgggacaacttcctcagagatgttttgcgactactcaccattcgagcttttccgtgagaaatcttatcttaaggaataaaggaaggagatcacaccgtagacatgctgccttgcaggttgtctgcaaggattttccaagacctccactagaaagcacaataaactatttggaagctgggcagctctcttcgttttttagaaacagcgaacgccccagtaaaccgttgcaggtcgtgattgctggtgcaggattggctggtctatcaacggcgaagtatctggcagatgctggccataaacccatattgcttgaggcaagagatgttttgggcggaaaggtagctgcttggaaggatgaagatggggattggtacgagactgggcttcatatcttttttggagcttatcccaacatacagaatctgtttggtgagcttggaattgaggatcgtttgcagtggaaagaacactccatgatatttgccatgccaaacaagccaggagaattcagccggtttgatttcccagaaactttgccagcacctgtaaacggaatatgggccatactgagaaacaatgaaatgcttacctggccagagaaggtgaagtttgcaattggacttctgccagcaatggtgggtggtcaaccttatgttgaagctcaagatggcttaaccgtttcagaatggatgaaaaagcagggtgttcctgatcgggtgaacgatgaggtttttattgcaatgtccaaggcactcaatttcataaatcctgatgagttatccatgcagtgcattttgattgctttgaacagatttcttcaggagaagcatggttccaaaatggcattcttggatggtaatccacctgaaaggctatgcatgcctattgttgatcacattcggtctaggggtggagaggtccgcttgaattctcgtattaagaagatagagctgaatcctgatggaactgtaaaacacttcgcacttagcgatggaactcaaataactggagatgcttatgtttgtgcagcaccagttgatatcttcaagcttcttgtacctcaagagtggagtgaaattacttacttcaagaagctggagaagttggtgggagttcctgttatcaatgttcatatatggtttgacagaaagctgaaaaacacatatgaccatcttcttttcagcaggagttcacttttaagtgtctatgcagacatgtcagtaacctgcaaggaatactatgatccaaaccgttcaatgctggagttggtctttgctcctgcagatgaatggattggtcgaagtgacactgaaatcattgatgcaactatggaagagctagccaagttatttcctgatgaaattgctgccgaccagagtaaagcaaagattcttaagtatcatattgtgaagacaccgagatcggtttacaaaactgttccaaactgtgaaccttgccgacctctccaaaggtcaccgattgagggtttctatctggctggtgattacacaaagcagaaatacttggcttccatggaaggtgcagttttatccgggaagctttgcgcccagtctatagtgcaggattatagcaggcttgctctcaggagccagaaaagcctacaatccgaagaagttcccgtcccatcttag

SEQ ID NO: 152 - protein, 570 aa, Sorghum bicolor
  misc_feature: Ceres ANNOT ID no. 6006710
  misc_feature (105)..(547): Pfam Id: Amino_oxidase Pfam Desc: Flavin containing amine oxidoreductase
  misc_feature (97)..(479): Pfam Id: DAO Pfam Desc: FAD dependent oxidoreductase
  misc_feature (1)..(570): NCBI GI: 1345838 NCBI Desc: phytoene dehydrogenase, chloroplast precursor (phytoene desaturase)
  misc_feature (1)..(570): NCBI GI: 642624 NCBI Desc: phytoene desaturase
  misc_feature (1)..(570): NCBI GI: 115510975 NCBI Desc: phytoene dehydrogenase, chloroplast precursor (phytoene desaturase)
  misc_feature (15)..(570): NCBI GI: 4105639 NCBI Desc: phytoene desaturase precursor [oryza sativa]
  misc_feature (22)..(570): NCBI GI: 115451171 NCBI Desc: os03g0184000 [oryza sativa (japonica cultivar-group)]
MDTGCLSSMNITGASQARPFAGQLPQRCFATTHHSSFSVRNLILRNKGRRSHRRHAALQVVCKDFPRPPLESTINYLEAGQLSSFFRNSERPSKPLQVVIAGAGLAGLSTAKYLADAGHKPILLEARDVLGGKVAAWKDEDGDWYETGLHIFFGAYPNIQNLFGELGIEDRLQWKEHSMIFAMPNKPGEFSRFDFPETLPAPVNGIWAILRNNEMLTWPEKVKFAIGLLPAMVGGQPYVEAQDGLTVSEWMKKQGVPDRVNDEVFIAMSKALNFINPDELSMQCILIALNRFLQEKHGSKMAFLDGNPPERLCMPIVDHIRSRGGEVRLNSRIKKIELNPDGTVKHFALSDGTQITGDAYVCAAPVDIFKLLVPQEWSEITYFKKLEKLVGVPVINVHIWFDRKLKNTYDHLLFSRSSLLSVYADMSVTCKEYYDPNRSMLELVFAPADEWIGRSDTEIIDATMEELAKLFPDEIAADQSKAKILKYHIVKTPRSVYKTVPNCEPCRPLQRSPIEGFYLAGDYTKQKYLASMEGAVLSGKLCAQSIVQDYSRLALRSQKSLQSEEVPVPS

SEQ ID NO: 153 - DNA, 921 bp, Sorghum bicolor
  misc_feature: Ceres ANNOT ID no. 6006712
  misc_feature: Encodes the peptide sequence at SEQ ID NO 154
  misc_feature: Down-regulated in shoot tissues in response to methyl jasmonate treatment
atggccaccgtctcgctcctgcgagccgcggcgctcggtctggtggttctggcgtcggcgctgccggcggcgcggtcatggagcaaagagggtcacatgctcacatgccaaatcgcacaggatctgctggagcctgacgccgcgcacgccgtgaggaacctgctcccggacgacgtgggcggcgacctgtcggcgctgtgcgtgtggccggaccaggtcaggcactggtacaagtacaagtggacaggcccgctgcacttcatcgacacccctgacaaggcctgcagcttcgactactcgagggactgccacggccccgacggcgccaaggacatgtgcgtcgccggcgccatcgccaacttcacgtcccagctgctgcactacaagcacggcagcgccgaccggagatacaacctgactgaagcccttctgttcctgtcgcacttcatgggagatgttcatcagccaatgcacgtgggattcaccagcgaccaaggcggcaattccatagagctgcggtggttccggcacaaatccaacctccatcacgtgtgggacagggagatcatacagacagctctcgccgatttctacggcaaggacatggacgccttccgcaagcaactcgagcacaacctcaccaagggtacctggtctgacgatgtgtcggcttggacagactgcgaagacctctcgtcttgcccaaccaagtacgcgaccgagagcatagagctggcgtgcaagtgggcgtacagcggcgtccgtgaaggggaaacactgtccgacgactacttcgactcgaggctcccgatcgtgtcgcggcggatcgcgcagggcggggtgcggctggccatgttcctcaacaggatcttcggcgcgcacaaccgcgacgtgccgccggccgccgccgccgcgtcttga

SEQ ID NO: 154 - protein, 306 aa, Sorghum bicolor
  misc_feature: Ceres ANNOT ID no. 6006712
  misc_feature (27)..(292): Pfam Id: S1-P1_nuclease Pfam Desc: S1/P1 Nuclease
  misc_feature (6)..(301): NCBI GI: 90265190 NCBI Desc: h0410g08.16 [oryza sativa (indica cultivar-group)]
  misc_feature (12)..(300): NCBI GI: 3551956 NCBI Desc: senescence-associated protein 6 [hemerocallis hybrid cultivar]
  misc_feature (1)..(293): NCBI GI: 3242447 NCBI Desc: endonuclease [zinnia elegans]
  misc_feature (6)..(293): NCBI GI: 7229711 NCBI Desc: cel i mismatch endonuclease [apium graveolens]
  misc_feature (21)..(291): NCBI GI: 145442272 NCBI Desc: endonuclease [glycine max]
  misc_feature: Down-regulated in shoot tissues in response to methyl jasmonate treatment
MATVSLLRAAALGLVVLASALPAARSWSKEGHMLTCQIAQDLLEPDAAHAVRNLLPDDVGGDLSALCVWPDQVRHWYKYKWTGPLHFIDTPDKACSFDYSRDCHGPDGAKDMCVAGAIANFTSQLLHYKHGSADRRYNLTEALLFLSHFMGDVHQPMHVGFTSDQGGNSIELRWFRHKSNLHHVWDREIIQTALADFYGKDMDAFRKQLEHNLTKGTWSDDVSAWTDCEDLSSCPTKYATESIELACKWAYSGVREGETLSDDYFDSRLPIVSRRIAQGGVRLAMFLNRIFGAHNRDVPPAAAAAS

SEQ ID NO: 155 - DNA, 696 bp, Sorghum bicolor
  misc_feature: Ceres ANNOT ID no. 6006716
  misc_feature: Encodes the peptide sequence at SEQ ID NO 156
atggcatcatcttcggacccatggatgaaggagtacaatgaagcatccagacttgctgatgacatcagttccatgattgccgatagagggtctcttccacaatcaggcccagaaattatgcggcatacttcagccatccggagaaaaataactattcttgggactagactggatagcttggagtcattgcttggtagaattcctccaaagtcaatcactgacaaggagatgcataagcgccaagacatgctttctagtttgaagtctaaagcaaagcagatggcaacaagtttcaacatgtcaaactttgctaacagggaggatctgcttggtcagagtaaaaaggcagatgacatgagcagagttgccgggttagataaccaaggaattgttggccttcagaggcaaattatgaaagagcaagatgagggtcttgagaagctggaagagacagtgctgagcacaaagcatattgcgttagcagtcaatgaagaacttaccctgcacacaagattgatagatgaccttgaagatcatgttgatattacaaattcacgtcttcagcgtgtgcaaaagaggcttgcaattctgaacaagcgcaccaaaggtggctgctcatgcatgtgcctgcttctatctgtcgttgccatcgtgattcttgcggtcattgtttggcttctcgtcaagtatctgtaa

SEQ ID NO: 156 - protein, 231 aa, Sorghum bicolor
  misc_feature: Ceres ANNOT ID no. 6006716
  misc_feature (140)..(202): Pfam Id: SNARE Pfam Desc: SNARE domain
  misc_feature (1)..(173): NCBI GI: 7715588 NCBI Desc: f20b17.2 [arabidopsis thaliana]
  misc_feature (1)..(192): NCBI GI: 145323914 NCBI Desc: syp51 (syntaxin of plants 51) [arabidopsis thaliana]
  misc_feature (1)..(193): NCBI GI: 42562084 NCBI Desc: syntaxin-related family protein [arabidopsis thaliana]
  misc_feature (1)..(133): NCBI GI: 71534985 NCBI Desc: syntaxin of plants [medicago sativa]
  misc_feature (1)..(142): NCBI GI: 115187337 NCBI Desc: syntaxin [arachis hypogaea]
MASSSDPWMKEYNEASRLADDISSMIADRGSLPQSGPEIMRHTSAIRRKITILGTRLDSLESLLGRIPPKSITDKEMHKRQDMLSSLKSKAKQMATSFNMSNFANREDLLGQSKKADDMSRVAGLDNQGIVGLQRQIMKEQDEGLEKLEETVLSTKHIALAVNEELTLHTRLIDDLEDHVDITNSRLQRVQKRLAILNKRTKGGCSCMCLLLSVVAIVILAVIVWLLVKYL

SEQ ID NO: 157 - DNA, 2013 bp, Sorghum bicolor
  misc_feature: Ceres ANNOT ID no. 6006720
  misc_feature: Encodes the peptide sequence at SEQ ID NO 158
atgggaggggaagttgatagcaatacactgcgaatacttgtagcaactgactgccatctaggctacatggagagagatgagatacgcaggtttgattcctttcaagcatttgaggagatttgtgcattggcggatcaaaacaaggtagatcttattcttcttggcggtgatctattccatgagaacaagccgtcgcgctcaaccctggtaaaaacaattgagattctacggcgctactgcctaaatgatcaaccaataaagttccaggttgtcagtgatcagacagtcaacttcccaaacagatttggtaaggtaaattatgaggaccctaacttcaacgttggtctgcctgtgttcaccatccatggaaatcacgatgaccctgctggagtggataatctctctgccattgatattctttcggcttgcaatcttgtaaattattttggaaagatggaccttggtggctctggtgttggtcagatagcagtttatcctgtactcgtaaaaaagggcatgacttcggttgcactatatggtcttggcaacattagagatgaacgactaaatagaatgtttcagacgcctcattcagtacagtggatgcgacctggaactcaagatggggaatcagtgtctgactggttcaatatattggtacttcatcagaacaggataaagacaaaccctaaaagtgccatcaatgagcattttttaccacgttttctggattttgttgtttggggccatgagcatgaatgcctcattgatcctcaggaggtccctggaatgggcttccacatcactcaaccaggctcctcagttgcgacatccctgattgatggtgaagcaaaaccaaagcatgttcttttgttagaaatcaagggaaatcagtacaggccaaccaaaatacctctgagatctgtcagaccttttgagtatgctgaggttgtgttgaaagatgaagcagatgtggacccaaatgatcaggcctctgtgcttgaacatttggataaaattgtaagaaatctgattgagaagagtagccaaccaactgccagcagatcggagcccaaacttccgttagttagaatcaaggtagattactctgggttttcaacaataaacccacaacgttttggtcagaagtatgtaggaaaggtcgcaaaccctcaagatattctcattttctcaaaatcagcaaagaaacgccagactacaggagatcacattgatgattctgagaaacttcgtcctgaggaactaaaccaacaaacaatcgaagctctggttgcagagagtaacttgaaaatggagattcttccggttgatgatttggacattgcattgcatgattttgtgaacaaggatgacaagatggcattttattcatgtttgcagcgaaaccttgaagaaaccaggaataagttgagttctgaagcagataaatccaaaattgaggaagaagacataatagtcaaagttaacgagtgcatgcaggacattggaggtaaatcttttgcagctcaaagcagcctgaactcattcagtgatgacgaagacaccagggatgcacttcttggtgcaaaatcaactgatgttggacgaaaatcatctggatttactagaccctccaaagataatgctgatgttgctaaacgtggtgcttccaaaagaggcaggggaagaggcaccagctcaatgaagcagaccactcttactttcagccagtcgaggtcaactacggttatccgtagtgaggatgtctcctcagaggaagaagcagatgcaaatgaagttgttgaaaattcagaagaagagagtgcgcaacaagttgggcgtaaaagagcagctcctagaggtagaggaagaggtagaggttccactgcaaagagggggcggaaaacagatattgcttctatccaaagtatgatgagcaaagatgatgatgattcagaagatgagccgccaaagaaagtcacaaggaactatggcgctgtcaggaggagatga

SEQ ID NO: 158 - protein, 670 aa, Sorghum bicolor
  misc_feature: Ceres ANNOT ID no. 6006720
  misc_feature (255)..(453): Pfam Id: Mre11_DNA_bind Pfam Desc: Mre11 DNA-binding  domain
  misc_feature (10)..(254): Pfam Id: Metallophos Pfam Desc: Calcineurin-like phosphoesterase
  misc_feature (1)..(608): NCBI GI: 90265185 NCBI Desc: h0410g08.11 [oryza sativa (indica cultivar-group)]
  misc_feature (1)..(608): NCBI GI: 38344808 NCBI Desc: osjnba0043l09.28 [oryza sativa (japonica cultivar-group)]
  misc_feature (1)..(608): NCBI GI: 115460824 NCBI Desc: os04g0635900 [oryza sativa (japonica cultivar-group)]
  misc_feature (4)..(634): NCBI GI: 70907744 NCBI Desc: meiotic recombination 11 [triticum turgidum]
  misc_feature (4)..(634): NCBI GI: 70907754 NCBI Desc: meiotic recombination 11 [aegilops tauschii]
MGGEVDSNTLRILVATDCHLGYMERDEIRRFDSFQAFEEICALADQNKVDLILLGGDLFHENKPSRSTLVKTIEILRRYCLNDQPIKFQVVSDQTVNFPNRFGKVNYEDPNFNVGLPVFTIHGNHDDPAGVDNLSAIDILSACNLVNYFGKMDLGGSGVGQIAVYPVLVKKGMTSVALYGLGNIRDERLNRMFQTPHSVQWMRPGTQDGESVSDWFNILVLHQNRIKTNPKSAINEHFLPRFLDFVVWGHEHECLIDPQEVPGMGFHITQPGSSVATSLIDGEAKPKHVLLLEIKGNQYRPTKIPLRSVRPFEYAEVVLKDEADVDPNDQASVLEHLDKIVRNLIEKSSQPTASRSEPKLPLVRIKVDYSGFSTINPQRFGQKYVGKVANPQDILIFSKSAKKRQTTGDHIDDSEKLRPEELNQQTIEALVAESNLKMEILPVDDLDIALHDFVNKDDKMAFYSCLQRNLEETRNKLSSEADKSKIEEEDIIVKVNECMQDIGGKSFAAQSSLNSFSDDEDTRDALLGAKSTDVGRKSSGFTRPSKDNADVAKRGASKRGRGRGTSSMKQTTLTFSQSRSTTVIRSEDVSSEEEADANEVVENSEEESAQQVGRKRAAPRGRGRGRGSTAKRGRKTDIASIQSMMSKDDDDSEDEPPKKVTRNYGAVRRR

SEQ ID NO: 159 - DNA, 1557 bp, Sorghum bicolor
  misc_feature: Ceres ANNOT ID no. 6006735
  misc_feature: Encodes the peptide sequence at SEQ ID NO 160
  misc_feature: Up-regulated in root tissues in response to methyl jasmonate treatment
  misc_feature: Up-regulated in shoot tissues in response to methyl jasmonate treatment
atggcagtggatgcagcgccggaggcggacaatcgccagcaacatcggacgaacgcaattcgaacggaggtccagatggaactacacagaatttgcactaatggttcctgccacatctcatgcgggccactgacagactactacatccctgattacatactgaaaccggactctgaacaagtcactgttgatagtgtaccatgttgccctgtggtagtcttcatcaattctaaaagtggtggccagctcggaagcagtctgatcaaaacataccgtgaacttctcaatgaagcgcaggtttttgatctcttagaagaggctcctgataaggttctacacagattatactgcaactttgaaaagctcaagtctaacggtgaccttgttgctactcaaattcagaagagcttaaggctaattgttgctggtggtgacggcacggcaagttggttgcttggagtagttagtgacctgaaactatcacatccccctcctgttgctactgtgcctcttggaactggaaacaacctcccttttgcatttggatggggaaagaagaatccagctactgaccaagcagcagtgaaatcatttctgggtcaagtaaaaggagcaagagaaatgaatattgatagttggcatatcatcatgaggatgcgaattccacaggaaggcccatgcgatcctattgctcccttagatcttccacattcattgcatgctttccaccgtgtatcagcttgcgattctctcaatttggagggctaccacacattccgtggaggattctggaattattttagcttgggaatggatgcacaagtatcctatgaatttcactctgaaagaaagagaaatccagagaagttcagacaccaactaagaaatcagggtacatatgctaagcttggatttaaacattccctaaaccatctttcttcgaggaacatttctcaacttgcaaaggtgaagatcatgaaaagacctggtagccaatgggaagagctcacgattcctcgcagcattcaatcagttatctgcctcaacctgccaagcttctcgggaggattgaatccctggggaacacctggcactaggaaagtacaagacagagacctgactgcaccttacgttgatgatggccttatcgaggttgtcggcttccgtgacgcctggcatgggctcatcttgctggctcctaatggccatggaactcgtctagcacaggcccatcgaatccgtttcgagttccacaagggagcagcggagcacacgttcatgaggatcgacggggagccatggaagcaacctctccccaaggaggacgacacggtggtcgtggagatctccaacctccgtcaggtggccatgctggccatcgacccgtgcaggtcgaagagcgtgaacgagccgtcctccccgttgtgccacagccacgaggacgacgacagcaacagcctggaggacgaggacgagtgggaggacgggaggaagaagttcggcgcggcggccaccttcaagatccctgacgaggtcgacatcgctcatcttagttag

SEQ ID NO: 160 - protein, 518 aa, Sorghum bicolor
  misc_feature: Ceres ANNOT ID no. 6006735
  misc_feature (70)..(213): Pfam Id: DAGK_cat Pfam Desc: Diacylglycerol kinase catalytic domain
  misc_feature (265)..(433): Pfam Id: DAGK_acc Pfam Desc: Diacylglycerol kinase accessory domain
  misc_feature (26)..(518): NCBI GI: 38344795 NCBI Desc: osjnba0043l09.15 [oryza sativa (japonica cultivar-group)]
  misc_feature (26)..(518): NCBI GI: 78498844 NCBI Desc: diacylglycerol kinase 1 [oryza sativa (indica cultivar-group)]
  misc_feature (26)..(518): NCBI GI: 90265221 NCBI Desc: h0315f07.7 [oryza sativa (indica cultivar-group)]
  misc_feature (35)..(518): NCBI GI: 115475067 NCBI Desc: os08g0178700 [oryza sativa (japonica cultivar-group)]
  misc_feature (46)..(518): NCBI GI: 10798892 NCBI Desc: diacylglycerol kinase [lycopersicon esculentum]
  misc_feature: Up-regulated in root tissues in response to methyl jasmonate treatment
  misc_feature: Up-regulated in shoot tissues in response to methyl jasmonate treatment
MAVDAAPEADNRQQHRTNAIRTEVQMELHRICTNGSCHISCGPLTDYYIPDYILKPDSEQVTVDSVPCCPVVVFINSKSGGQLGSSLIKTYRELLNEAQVFDLLEEAPDKVLHRLYCNFEKLKSNGDLVATQIQKSLRLIVAGGDGTASWLLGVVSDLKLSHPPPVATVPLGTGNNLPFAFGWGKKNPATDQAAVKSFLGQVKGAREMNIDSWHIIMRMRIPQEGPCDPIAPLDLPHSLHAFHRVSACDSLNLEGYHTFRGGFWNYFSLGMDAQVSYEFHSERKRNPEKFRHQLRNQGTYAKLGFKHSLNHLSSRNISQLAKVKIMKRPGSQWEELTIPRSIQSVICLNLPSFSGGLNPWGTPGTRKVQDRDLTAPYVDDGLIEVVGFRDAWHGLILLAPNGHGTRLAQAHRIRFEFHKGAAEHTFMRIDGEPWKQPLPKEDDTVVVEISNLRQVAMLAIDPCRSKSVNEPSSPLCHSHEDDDSNSLEDEDEWEDGRKKFGAAATFKIPDEVDIAHLS

SEQ ID NO: 161 - DNA, 1053 bp, Sorghum bicolor
  misc_feature: Ceres ANNOT ID no. 6006766
  misc_feature: Encodes the peptide sequence at SEQ ID NO 162
atgccggcgggcgcgggtgctgctagtgctagcaaggggaggaagaagacggcgtgcgtcaccggaggcaacggctacatcgcttcggcactggtgaagatgctgctggacaagggctacgccgtcaagaccactgtcagaaatccagatgacatggacaagaactcccacctgattatggagctgcagtcgctcggccacctggaggtcttccgcgccgacctggacgaggaaggcagcttcgacgacgccgtcgccggctgcgactacgccttcctcgtcgccgctccggtgaacctcacgtcagagaatccggagacggagcagatcgagccgaccgtgcgagcaactctgaacgtgatgaggtcgtgcttgaaggccggcacggtgaggcgcgtggtcctcacctcggcggcctccaccatctgcatccgtccactggagggcgacggccacgtgctggacgagcactcctggtccgacctggactacgtcaccgccgagaggccgccagcctggggatatgtcatctccaaggtgctgtcggagaaggaagcgttcaggttcgcgcaggagcacggcatcagcctggccatcgtgtgcccggtcctcaccgtgggcgcgtcgccggcgcgcgaggcgtacgcgagcgtccgggctagcctctccatgctatcaggcgacgaggcagcgctggccatgctgaaaggcatcgagaagtccttcggcgcggtgcctgtcgtccacctgcacgacctctgccgcgccgaggtgttcctcgccgagacggcgacggcggcgcccgggaggtacatctgcagcagtgtcagcaccaccgtcgtcgagatcgcccgcttcctggcagacaagtacacgcagtaccacgtggacataaagcagtccagtgacgatgagctcctggagaagccgagagtgagcctgtcgtcggcgaagctggtgaaggaggggttccagttcaagtacagcaccctggatgcgatatacggagacgtaatccagtacggcaagacattgggcaatcttctccactaa

SEQ ID NO: 162 - protein, 350 aa, Sorghum bicolor
  misc_feature: Ceres ANNOT ID no. 6006766
  misc_feature (18)..(274): Pfam Id: Epimerase Pfam Desc: NAD dependent epimerase/dehydratase family
  misc_feature (20)..(234): Pfam Id: NAD_binding_4 Pfam Desc: Male sterility protein
  misc_feature (20)..(244): Pfam Id: NmrA Pfam Desc: NmrA-like family
  misc_feature (5)..(350): NCBI GI: 90399263 NCBI Desc: h0105c05.3 [oryza sativa (indica cultivar-group)]
  misc_feature (16)..(348): NCBI GI: 90399264 NCBI Desc: h0105c05.4 [oryza sativa (indica cultivar-group)]
  misc_feature (16)..(348): NCBI GI: 21741066 NCBI Desc: osjnbb0015d13.10 [oryza sativa (japonica cultivar-group)]
  misc_feature (15)..(350): NCBI GI: 115460754 NCBI Desc: os04g0630800 [oryza sativa (japonica cultivar-group)]
  misc_feature (15)..(350): NCBI GI: 90399306 NCBI Desc: h0323c08.18 [oryza sativa (indica cultivar-group)]
MPAGAGAASASKGRKKTACVTGGNGYIASALVKMLLDKGYAVKTTVRNPDDMDKNSHLIMELQSLGHLEVFRADLDEEGSFDDAVAGCDYAFLVAAPVNLTSENPETEQIEPTVRATLNVMRSCLKAGTVRRVVLTSAASTICIRPLEGDGHVLDEHSWSDLDYVTAERPPAWGYVISKVLSEKEAFRFAQEHGISLAIVCPVLTVGASPAREAYASVRASLSMLSGDEAALAMLKGIEKSFGAVPVVHLHDLCRAEVFLAETATAAPGRYICSSVSTTVVEIARFLADKYTQYHVDIKQSSDDELLEKPRVSLSSAKLVKEGFQFKYSTLDAIYGDVIQYGKTLGNLLH

SEQ ID NO: 163 - DNA, 1026 bp, Sorghum bicolor
  misc_feature: Ceres ANNOT ID no. 6006772
  misc_feature: Encodes the peptide sequence at SEQ ID NO 164
atgtctaccggcaacaggaagaagacggcgtgcgtgaccggagggaacgggtacatcgcctccgcgctcatcaagatgctgctagagagagggtacgccgtgaagacgacggtcaggaaacccgatgacatggagaagaactcccaccttaaggacctgcagactcttggatccttggagatcttccgcgccgacttggatgaagatggcagctttgacgacgccgtcgccggctgcgactacgccttcctagtcgccgctccagtgaacctccacacgaagaatcctgagaaagagctgatcgagcccgctgtcaggggaactctgaacgtcatgcggtcgtgcgtgaaggccgggacggtgaggcgcgtggtcctgacctcgtcggcggcctcggtctccagcaggccgcagctgcagggcgacgggcacgtgctggacgaagactcctggtccgacgtcgagtaccttagagcccacaagcctgcagggccctgggcgtacccggtgtccaaggtgctcctggagaaggaggcgtgcaggttctcggaggagcatggcatcagcctcgtcaccgtctgccccgtcctcaccgtcggcgccgcgccggccccgaccgtgcgcaccagcgtcccaaactgcctctcccttctatccggcgacgaggcagagttcgcggtgctggacgccatcgagagggccacggggtgcgtgccgctggtgcacgtcgacgacctctgccgcgccgagctgttcgtcgccgaggaggtatctgccgcggggaggtacatctgctgcagcctcaacacgaccatcaccgacctcgcacggttcctcacggacaattacccgcagtacgacgtgaaaacgagcctgctctccggcgagcggcttgagaagccgagagtgcgtctgtcgtccgagaagctggtgaaggaagggttcgggttcaggtacacgacgctggatgacatgtacgacgacatggtcgagtatggcaaggtcctgggaatcctgccctgctga

SEQ ID NO: 164 - protein, 341 aa, Sorghum bicolor
  misc_feature: Ceres ANNOT ID no. 6006772
  misc_feature (10)..(266): Pfam Id: Epimerase Pfam Desc: NAD dependent epimerase/dehydratase family
  misc_feature (12)..(261): Pfam Id: NAD_binding_4 Pfam Desc: Male sterility protein
  misc_feature (11)..(270): Pfam Id: 3Beta_HSD Pfam Desc: 3-beta hydroxysteroid dehydrogenase/isomerase family
  misc_feature (7)..(340): NCBI GI: 115460754 NCBI Desc: os04g0630800 [oryza sativa (japonica cultivar-group)]
  misc_feature (8)..(340): NCBI GI: 90399264 NCBI Desc: h0105c05.4 [oryza sativa (indica cultivar-group)]
  misc_feature (8)..(340): NCBI GI: 21741066 NCBI Desc: osjnbb0015d13.10 [oryza sativa (japonica cultivar-group)]
  misc_feature (8)..(340): NCBI GI: 90399263 NCBI Desc: h0105c05.3 [oryza sativa (indica cultivar-group)]
  misc_feature (7)..(340): NCBI GI: 90399306 NCBI Desc: h0323c08.18 [oryza sativa (indica cultivar-group)]
MSTGNRKKTACVTGGNGYIASALIKMLLERGYAVKTTVRKPDDMEKNSHLKDLQTLGSLEIFRADLDEDGSFDDAVAGCDYAFLVAAPVNLHTKNPEKELIEPAVRGTLNVMRSCVKAGTVRRVVLTSSAASVSSRPQLQGDGHVLDEDSWSDVEYLRAHKPAGPWAYPVSKVLLEKEACRFSEEHGISLVTVCPVLTVGAAPAPTVRTSVPNCLSLLSGDEAEFAVLDAIERATGCVPLVHVDDLCRAELFVAEEVSAAGRYICCSLNTTITDLARFLTDNYPQYDVKTSLLSGERLEKPRVRLSSEKLVKEGFGFRYTTLDDMYDDMVEYGKVLGILPC

SEQ ID NO: 165 - DNA, 1026 bp, Sorghum bicolor
  misc_feature: Ceres ANNOT ID no. 6006774
  misc_feature: Encodes the peptide sequence at SEQ ID NO 166
atgtcggccggcgacatgaagaagactgcgtgcgtgaccggagggaacggctacatcgcctcggcgctcatcaagatgctgctggaaaagggctacgccgtcaagacgacggtcaggaaccccgatgacatggagaagaactcccacctcaaggacctgcaggcgctcggccacctggaggtcttccgcgccgacttggatgaagatggcagctttgacgacgccgtcgccggctgcgactacgccttcctagtcgccgctccagtgaacctccacacgaagaatcctgagaaagagctgatcgagcccgctgtcaggggaactctgaacgtcatgcggtcgtgcgtgaaggccgggacggtgaggcgcgtggtcctgacctcgtcggcggcctcggtctccagcaggccgcagctgcaaggcgacgggcacgtgctggacgaagactcctggtccgatgtcgagtaccttagagcccacaagcctgcagggccctgggcgtacccggtgtccaaggtgctcctggagaaggaggcgtgcaggttctcggaggagcatggcatcagcctcgtcaccgtctgccccgtcgccaccgtcggcgaggcgccggccccgaccgtgcgcaccagcgtcccaaactgcctctcccttctatccggcgacgaggcagagttcgcggtgctggacgccatcgagagggccacggggtgcgtgccgctggtgcacgtcgacgacctctgccgcgccgagctgttcgtcgccgaggaggtatctgccgcggggaggtacatctgctgcagcatcaacacgaccatcgccgagctcgcgcgtttcctcgcggacaagtacccgcagtacgacgtgaaaacgagcctgctctccggcgagcggcttgagaagccgagagtgcgtctgtcgtccgagaagctggtgaaggaagggttcgagttcaggtacagaacgctggatgacatgtacgacgacatggtcgagtatggcaagaccctgggaatcctgcccagctga

SEQ ID NO: 166 - protein, 341 aa, Sorghum bicolor
  misc_feature: Ceres ANNOT ID no. 6006774
  misc_feature (10)..(266): Pfam Id: Epimerase Pfam Desc: NAD dependent epimerase/dehydratase family
  misc_feature (12)..(261): Pfam Id: NAD_binding_4 Pfam Desc: Male sterility protein
  misc_feature (11)..(302): Pfam Id: 3Beta_HSD Pfam Desc: 3-beta hydroxysteroid dehydrogenase/isomerase family
  misc_feature (1)..(340): NCBI GI: 115460754 NCBI Desc: os04g0630800 [oryza sativa (japonica cultivar-group)]
  misc_feature (1)..(340): NCBI GI: 90399264 NCBI Desc: h0105c05.4 [oryza sativa (indica cultivar-group)]
  misc_feature (1)..(340): NCBI GI: 21741066 NCBI Desc: osjnbb0015d13.10 [oryza sativa (japonica cultivar-group)]
  misc_feature (1)..(340): NCBI GI: 90399263 NCBI Desc: h0105c05.3 [oryza sativa (indica cultivar-group)]
  misc_feature (1)..(340): NCBI GI: 90399306 NCBI Desc: h0323c08.18 [oryza sativa (indica cultivar-group)]
MSAGDMKKTACVTGGNGYIASALIKMLLEKGYAVKTTVRNPDDMEKNSHLKDLQALGHLEVFRADLDEDGSFDDAVAGCDYAFLVAAPVNLHTKNPEKELIEPAVRGTLNVMRSCVKAGTVRRVVLTSSAASVSSRPQLQGDGHVLDEDSWSDVEYLRAHKPAGPWAYPVSKVLLEKEACRFSEEHGISLVTVCPVATVGEAPAPTVRTSVPNCLSLLSGDEAEFAVLDAIERATGCVPLVHVDDLCRAELFVAEEVSAAGRYICCSINTTIAELARFLADKYPQYDVKTSLLSGERLEKPRVRLSSEKLVKEGFEFRYRTLDDMYDDMVEYGKTLGILPS

SEQ ID NO: 167 - DNA, 1020 bp, Sorghum bicolor
  misc_feature: Ceres ANNOT ID no. 6006775
  misc_feature: Encodes the peptide sequence at SEQ ID NO 168
atgtcagcgggtgccaggaagaagacggcgtgcgtgaccggaggtaacgggtacatcgcctcggtgctcatcaagatgctgctggagaaagggtacgccgtgaagacgacggtcaggaaccccgatgacatggagaagagctcccacctcagggacctgcaggcgcttggccccctggaagtcctcggcgccgacctggacaaagaaggcagtttcgacgacgccgtcgccggctgcgactacgccttcctcgtcgccgctccagtgaacctccattcgaagaatcctgaggaagaattgatcgagcctgctgtccgaggaaccctgaacgtcatgaggtcgtgcgccaaggcagggacagtgaagcgcgtggttctgacctcgtcggcggccgcagtctccggcaggccgttgcaaggcagcgggcacgttctggacgaggagtcctggtccgacgtcgagtacctcactgccaacaaatccggtccctgggggtaccccgtctccaaggtgctctcggagaaggcggcgtgcaggttcgcggaggagcacggcatcagcctcgtcaccgtctgccccgtcctcaccgtcggcgcggcgccggcaccaaagatccacacgagcgtccctgccagcctctccctgctatccggcgacgaagcagcgttcggcgtgctgaaaggcatcgagatggccacgggctgcgtgtcgctcgttcacgttgccgacctgtgccgtgccgaggtgttcgtcgccgaggaagacgccgccgccgggaggtacgtctgctgcagcgtcaacaccaccatcgtcgagctcgcccgtttcctggcggacaagtacccgcagtacaccgtgaagacggacctctccaccggcgaggtccttgagaagcggagagtgagcctgtcgtcggcgaggctggtcagtgaagggttcgagttcgaatacgagacgctgggcaagatctacggcgacgtggtggagcacggcaaggccctggggattctgcccaactga

SEQ ID NO: 168 - protein, 339 aa, Sorghum bicolor
  misc_feature: Ceres ANNOT ID no. 6006775
  misc_feature (10)..(264): Pfam Id: Epimerase Pfam Desc: NAD dependent epimerase/dehydratase family
  misc_feature (12)..(225): Pfam Id: NAD_binding_4 Pfam Desc: Male sterility protein
  misc_feature (11)..(251): Pfam Id: 3Beta_HSD Pfam Desc: 3-beta hydroxysteroid dehydrogenase/isomerase family
  misc_feature (8)..(145): Pfam Id: adh_short Pfam Desc: short chain dehydrogenase
  misc_feature (1)..(339): NCBI GI: 115460754 NCBI Desc: os04g0630800 [oryza sativa (japonica cultivar-group)]
  misc_feature (1)..(338): NCBI GI: 90399264 NCBI Desc: h0105c05.4 [oryza sativa (indica cultivar-group)]
  misc_feature (1)..(338): NCBI GI: 21741066 NCBI Desc: osjnbb0015d13.10 [oryza sativa (japonica cultivar-group)]
  misc_feature (1)..(339): NCBI GI: 90399263 NCBI Desc: h0105c05.3 [oryza sativa (indica cultivar-group)]
  misc_feature (1)..(339): NCBI GI: 90399306 NCBI Desc: h0323c08.18 [oryza sativa (indica cultivar-group)]
MSAGARKKTACVTGGNGYIASVLIKMLLEKGYAVKTTVRNPDDMEKSSHLRDLQALGPLEVLGADLDKEGSFDDAVAGCDYAFLVAAPVNLHSKNPEEELIEPAVRGTLNVMRSCAKAGTVKRVVLTSSAAAVSGRPLQGSGHVLDEESWSDVEYLTANKSGPWGYPVSKVLSEKAACRFAEEHGISLVTVCPVLTVGAAPAPKIHTSVPASLSLLSGDEAAFGVLKGIEMATGCVSLVHVADLCRAEVFVAEEDAAAGRYVCCSVNTTIVELARFLADKYPQYTVKTDLSTGEVLEKRRVSLSSARLVSEGFEFEYETLGKIYGDVVEHGKALGILPN

SEQ ID NO: 169 - DNA, 1029 bp, Sorghum bicolor
  misc_feature: Ceres ANNOT ID no. 6006779
  misc_feature: Encodes the peptide sequence at SEQ ID NO 170
atgtcagagggcggcaggaagcagaagacggcgtgcgtgaccggaggtaacgggtacatcgcctcggtgctcatcaagatgctgctcgagaatggctacgccgtgaagacgacggtcaggaaccccgatgacatggccaagaattcccacctcaaggacatgcaggcggtcggccccctgacagtcctccgcgccgacctgctagaagaaggcagcttcgacgaggccgtcgccggctgcgactacgccttcctcatcgccgctccgaaagaactgatcgagcctgctgtccgaggaatcctgaacgtcatgaggtcgtgtgccaaggcagggacagtgaagcgcgtgattctgacctcgtcggcggctgcagtcgccggcaggccgttgcaaggcggcggccacgttctggacgaggagtcctggaccgacgtcgagtacctcactgccaaaaagtccagtcactgggtaataaggaaatggcaccataaatgtcctgtccccgttctcgtccgaatcggaagaatggcaccatccatttctgctgatgacgagtatggcacaccatccaacatccatgtgcttgcatcgcaggggtacggggtctccaaggtgctcgcggagaaggaggcgtgcaggtttgcgaaggagcacggcatcaacttcgtcagcgtctgccccgtcctcaccgtcggcgcagcacctgccacaaagatggacacgagcctccacgctagcctctcctgctatccgatgttcgtcgccgaggaggacgcggccgccgggaggtacatctgctgcagcgtcaacaccaccatcgtcgagctcgcccatttcctggcggacaagtacccgcagtacaccgtgaagacacatctgctctcctccggggtccttgaaaagccgagagtgagcctgtcgtcggcgaggctgctcggcgaagggttcaagttcaagtacgagacgctggacgagatctacgacgacgtggtggcgcagggcaaggccctgggggttctgcccaactga

SEQ ID NO: 170 - protein, 342 aa, Sorghum bicolor
  misc_feature: Ceres ANNOT ID no. 6006779
  misc_feature (11)..(267): Pfam Id: Epimerase Pfam Desc: NAD dependent epimerase/dehydratase family
  misc_feature (13)..(276): Pfam Id: NAD_binding_4 Pfam Desc: Male sterility protein
  misc_feature (7)..(148): NCBI GI: 39546252 NCBI Desc: osjnba0089n06.22 [oryza sativa (japonica cultivar-group)]
  misc_feature (7)..(156): NCBI GI: 90399306 NCBI Desc: h0323c08.18 [oryza sativa (indica cultivar-group)]
  misc_feature (7)..(156): NCBI GI: 32492151 NCBI Desc: osjnbb0015d13.3 [oryza sativa (japonica cultivar-group)]
  misc_feature (7)..(156): NCBI GI: 115460754 NCBI Desc: os04g0630800 [oryza sativa (japonica cultivar-group)]
  misc_feature (7)..(154): NCBI GI: 39546249 NCBI Desc: osjnba0089n06.19 [oryza sativa (japonica cultivar-group)]
MSEGGRKQKTACVTGGNGYIASVLIKMLLENGYAVKTTVRNPDDMAKNSHLKDMQAVGPLTVLRADLLEEGSFDEAVAGCDYAFLIAAPKELIEPAVRGILNVMRSCAKAGTVKRVILTSSAAAVAGRPLQGGGHVLDEESWTDVEYLTAKKSSHWVIRKWHHKCPVPVLVRIGRMAPSISADDEYGTPSNIHVLASQGYGVSKVLAEKEACRFAKEHGINFVSVCPVLTVGAAPATKMDTSLHASLSCYPMFVAEEDAAAGRYICCSVNTTIVELAHFLADKYPQYTVKTHLLSSGVLEKPRVSLSSARLLGEGFKFKYETLDEIYDDVVAQGKALGVLPN

SEQ ID NO: 171 - DNA, 948 bp, Sorghum bicolor
  misc_feature: Ceres ANNOT ID no. 6006780
  misc_feature: Encodes the peptide sequence at SEQ ID NO 172
atgtcgtcgtccgtggtcgaaaagaagaagatggcgtgcgtgaccggcggcaacgggtacatcgcctccgcgctcatcaagatgctgctggagaacgggtacgccgtcaagacgactgtcaggaaccccgatgacatgtccaagaactcccacctcaagaacttgaaggcgctcggccatctggaggtcctccgcgccgacctggaccaagaaggcagcttcgacgaggccgtcgctggctgccactacgccttcctcgtcgccgctccgaaagatgtgatcgagcctgctgtccggggaacgctgaacgtgatgaggtcgtgcgcgagagccaggacgttgcggcgcgtgatcctgacctcgtcgtcggccggcgtgtacatcaggccggagctgccgcagcagggggacgacgacgacgggcacgtcgtcctggacgaggactcctggtccgacgtcgagtacctaagagccgagaaaccgccgctctggtgggcctactgcgtgtccaaggtgctcctggagaaggcggcgtgcaggttcgcggaggagcacggcatcagcctggtcaccatctgccccgtcgtcaccgtcggcgaggcgccggctccggtcgtcaacaccagcgtccccctctgcctctcgtttcttaccggcaacgaggcactgctcgcggcgctcaaaggcatcgagaagacctccggcggggtgcagctggtgcacgtcgacgacctctgccgcgccgagctgttcgtcgccgaggaggcggccgccgcggggagcaccgacgacgacgagcagctcctggagaagccgagagtgagcctgtcgtctgcaaagctggttggggaagggttcgagttcaagtacaagaccctagacgagatatacggtgacgtcgtacgtcgagtacggcaaggcactgggaattctgccctactgatatag

SEQ ID NO: 172 - protein, 315 aa, Sorghum bicolor
  misc_feature: Ceres ANNOT ID no. 6006780
  misc_feature (12)..(277): Pfam Id: Epimerase Pfam Desc: NAD dependent epimerase/dehydratase family
  misc_feature (14)..(249): Pfam Id: NAD_binding_4 Pfam Desc: Male sterility protein
  misc_feature (4)..(269): NCBI GI: 115460754 NCBI Desc: os04g0630800 [oryza sativa (japonica cultivar-group)]
  misc_feature (10)..(260): NCBI GI: 90399263 NCBI Desc: h0105c05.3 [oryza sativa (indica cultivar-group)]
  misc_feature (4)..(260): NCBI GI: 21741066 NCBI Desc: osjnbb0015d13.10 [oryza sativa (japonica cultivar-group)]
  misc_feature (4)..(260): NCBI GI: 90399264 NCBI Desc: h0105c05.4 [oryza sativa (indica cultivar-group)]
  misc_feature (4)..(262): NCBI GI: 90399306 NCBI Desc: h0323c08.18 [oryza sativa (indica cultivar-group)]
MSSSVVEKKKMACVTGGNGYIASALIKMLLENGYAVKTTVRNPDDMSKNSHLKNLKALGHLEVLRADLDQEGSFDEAVAGCHYAFLVAAPKDVIEPAVRGTLNVMRSCARARTLRRVILTSSSAGVYIRPELPQQGDDDDGHVVLDEDSWSDVEYLRAEKPPLWWAYCVSKVLLEKAACRFAEEHGISLVTICPVVTVGEAPAPVVNTSVPLCLSFLTGNEALLAALKGIEKTSGGVQLVHVDDLCRAELFVAEEAAAAGSTDDDEQLLEKPRVSLSSAKLVGEGFEFKYKTLDEIYGDVVRRVRQGTGNSALLI

SEQ ID NO: 173 - DNA, 1020 bp, Sorghum bicolor
  misc_feature: Ceres ANNOT ID no. 6006786
  misc_feature: Encodes the peptide sequence at SEQ ID NO 174
atgtcgtcatccgtagtggagaataagacggcgtgcgtgacagggggcagtgggtacgtcgcctcggcgctcatcaagacgctgctggagaagggctacgccgtcaaggcgacggtcaggaaccccgatgacatggccaagaactcccacctcaaggacttgcaggcgcttggccccttgcaagtcctccgcgccgacctcgacgaagaaggcagcttcgacgaggccgttgcctgctgcgactacgccttcctcgtcgccgctccgatcaacctcgcctcaggggaggatccagagaaagagctgatcgagcctgccgtccgggggacgctgaacgtgatgaggtcgtgcgtgaaggccgccacggtgcggcgcgtggtcctcacctcgtcggcggccgcggtgtacatgaggccggatctgcgaggcggcgacgacgggcatgtcctggacgacgagtcctggtccgacgtcgagtacctcagagccaacaagccgccgacctgggggtacagcgcgtccaaggtgttcgcggaggagcacggcgtcagcctcgtcaccgtctgccccgtcatcaccgtcggcgccgcgccggcgccgaccacccgcacctgcatcccttactgcctctcacttctatcaggcgacaaggcatcgctgggcgtgctcaaagtactcgaggaggtctccggcggggtgcagctggtccacatcgacgacctctgccgcgccgagctgttcgtcgccgaggaggccgccgccgaggggaggtacaactgctgcagccacaacacgaccgtcgtcgagctggcgcgtttcctggcacacaagtacccgcaatacgacgtaaaacggaatctgcacacctacgatcaggatgagctcctggagaagccgagggcctgcattttgtcggcgaagctggccagggaagggttccagttcaagcacaacaccctggatgagatctacgacaatgtcatcgagtacggcaaggccttgggtattctgcccaactga

SEQ ID NO: 174 - protein, 339 aa, Sorghum bicolor
  misc_feature: Ceres ANNOT ID no. 6006786
  misc_feature (11)..(261): Pfam Id: Epimerase Pfam Desc: NAD dependent epimerase/dehydratase family
  misc_feature (13)..(245): Pfam Id: NAD_binding_4 Pfam Desc: Male sterility protein
  misc_feature (12)..(290): Pfam Id: 3Beta_HSD Pfam Desc: 3-beta hydroxysteroid dehydrogenase/isomerase family
  misc_feature (4)..(339): NCBI GI: 115460754 NCBI Desc: os04g0630800 [oryza sativa (japonica cultivar-group)]
  misc_feature (4)..(169): NCBI GI: 32492151 NCBI Desc: osjnbb0015d13.3 [oryza sativa (japonica cultivar-group)]
  misc_feature (4)..(339): NCBI GI: 90399306 NCBI Desc: h0323c08.18 [oryza sativa (indica cultivar-group)]
  misc_feature (4)..(339): NCBI GI: 90399263 NCBI Desc: h0105c05.3 [oryza sativa (indica cultivar-group)]
  misc_feature (4)..(338): NCBI GI: 90399264 NCBI Desc: h0105c05.4 [oryza sativa (indica cultivar-group)]
MSSSVVENKTACVTGGSGYVASALIKTLLEKGYAVKATVRNPDDMAKNSHLKDLQALGPLQVLRADLDEEGSFDEAVACCDYAFLVAAPINLASGEDPEKELIEPAVRGTLNVMRSCVKAATVRRVVLTSSAAAVYMRPDLRGGDDGHVLDDESWSDVEYLRANKPPTWGYSASKVFAEEHGVSLVTVCPVITVGAAPAPTTRTCIPYCLSLLSGDKASLGVLKVLEEVSGGVQLVHIDDLCRAELFVAEEAAAEGRYNCCSHNTTVVELARFLAHKYPQYDVKRNLHTYDQDELLEKPRACILSAKLAREGFQFKHNTLDEIYDNVIEYGKALGILPN

SEQ ID NO: 175 - DNA, 2388 bp, Sorghum bicolor
  misc_feature: Ceres ANNOT ID no. 6006787
  misc_feature: Encodes the peptide sequence at SEQ ID NO 176
atgcctcgcaagcacgcgccggcgttcacgccggaggcggccaccgcctccgcgacagttggggctggccagccgcacaacctccccgtgcttcaggcgaagatgaagcgcgacccggagggctacgaggaggagctccgccagctccaccgccacttcgagtcctcggtgttcctcttccagcagcaggcggcgctggctacgacctcctcctcgggaggtggcggggaggtggccaaggagctcggggacctcgccctgttcctcgcccacgtcgcgcctttctacccggatgacctcgccgatttgcccgaccagattgggggtttgctcgacaccaacgcgcgcgggctgccgccggggctcagggcgcacctcgtgcaggcgcttatactgctggtgaatcggaagattgtcgatcttgaggacacaatggagttattcatggagcttcaagttattggagaccgagctgtaaaaaagctagcattttcgcatattgtacacagtatcaggaggatgaatcagaagcacaagaatgaattgtcgaatcgtaaactgcaaaacgtcctttttaaattcttacaggctgaagaagagtcacgagccaagagagcatttactatcctgtgcgatctacaccgtcggagggtatggtttgatgaacgcacaacaaatgcaatatgcgatgcttgtttccacccttcctctaggattatgatagcggctatttcattccttcttggatatgaaaatgctccacaagaggatgacagcgaagcatcaagcagtgaagatgaagcagatcaaaaccctcaaattcttctcagtaaacaggatgtttataaggcaaatcacaagggtacagctgctagtaagaaaaagaagaaagctaaattacagcgtgtcattcgtagcatgaaaaggcaacagcggaaatctgttgaggagactggttccagtttctattcacccctgacatatttaaaggatgcccagggttttgctgagaagcttttctctcggttgcagaaatgcaatgagcgatttgaggtaaggatgatgatgctaaaagtaattgcgaggactattgggctgcatcacttggttttgttgaacttctacccatatcttcaaagatatgttcaagtacctccagatgctgttgaaccactgttcaaacagatagtaaatcagtttgtgcatgaccgctctcgcccagagatgatgaatgaggatctgctccaagaccttgttttatacaaaaagtcccatgagaaagctgtttccattgctgctcgttcgctggtcacattgttcagagagatatgcccttcattgttagtcaagaaagatcgtggccgtcctgtggatccaaaggctcggcccaaagcatttggagaagtcactgttgctagcaacgtgcctggtgccgagttgctagatgaaaatatttcttcagaaggggaaggctcggacgatgagtctgatgcttttgattcggatgatgagatggacttggcatctgcttctcctgcaacagaagaaaatatggagggtttatctgttgcaaacaaacatggtgctgatggagataccaaagaggaagatgaagcatctgatgatgaagatggtacaggtcaagatgactccaacaatgatagcgatgaactagacgatgactctgacatggatgctgatactgatatgtctgatgaagacgaagatgatgatgatgaactgaaagaaagcataaatggttcagaggatgaagcttcaggccaggatgaagacagcgatgaggaagacaaatcgaaaggcagtggctctaaagtggagaagaggaagttaagtgattatattggagagctaaatgcagctgatgcaagccttcgagctctgaagaggttagcaactgccaagaaggctgaagtttcatctgatgaaactggtaaaattttatccgatgaagattttaaacgcatcaaagaactcaaggcaaagaaagaggcaaagctggctttggctcaacatggactaatcaagggtggtgacacgagatctgtaacctttaagatgccatcttctgatcaactcagtaggaagcgtgttgatccacttgagcttgaggctcacgtcaggagaaagatgtcgaaggaagaaaggttagcgttagtgaaagctgggagagaggatagaggtgcatacatggcgagaacggctgtgaaacagaaaaagaccggtggcctgagcaataaacagaagcagcacaagaagaggatgcccctggcagcgactagagccaaggcagcacgttcccggcaggagaagaagcaacagcgcaagcgctctgggaatcagtttaggggccgcaaggcgtggaaatga

SEQ ID NO: 176 - protein, 795 aa, Sorghum bicolor
  misc_feature: Ceres ANNOT ID no. 6006787
  misc_feature (410)..(794): Pfam Id: SDA1 Pfam Desc: SDA1
  misc_feature (88)..(139): Pfam Id: NUC130_3NT Pfam Desc: NUC130/3NT domain
  misc_feature (1)..(746): NCBI GI: 39546248 NCBI Desc: osjnba0089n06.18 [oryza sativa (japonica cultivar-group)]
  misc_feature (1)..(746): NCBI GI: 90399297 NCBI Desc: h0323c08.9 [oryza sativa (indica cultivar-group)]
  misc_feature (407)..(795): NCBI GI: 115460742 NCBI Desc: os04g0630000 [oryza sativa (japonica cultivar-group)]
  misc_feature (10)..(782): NCBI GI: 4850399 NCBI Desc: f3f19.18 [arabidopsis thaliana]
  misc_feature (384)..(795): NCBI GI: 140054117 NCBI Desc: sda1 [medicago truncatula]
  misc_feature: Useful for making plants with altered alkaloid content
  misc_feature: GREAT-hit functional homolog of the protein sequence given in SEQ ID NO 13315
MPRKHAPAFTPEAATASATVGAGQPHNLPVLQAKMKRDPEGYEEELRQLHRHFESSVFLFQQQAALATTSSSGGGGEVAKELGDLALFLAHVAPFYPDDLADLPDQIGGLLDTNARGLPPGLRAHLVQALILLVNRKIVDLEDTMELFMELQVIGDRAVKKLAFSHIVHSIRRMNQKHKNELSNRKLQNVLFKFLQAEEESRAKRAFTILCDLHRRRVWFDERTTNAICDACFHPSSRIMIAAISFLLGYENAPQEDDSEASSSEDEADQNPQILLSKQDVYKANHKGTAASKKKKKAKLQRVIRSMKRQQRKSVEETGSSFYSPLTYLKDAQGFAEKLFSRLQKCNERFEVRMMMLKVIARTIGLHHLVLLNFYPYLQRYVQVPPDAVEPLFKQIVNQFVHDRSRPEMMNEDLLQDLVLYKKSHEKAVSIAARSLVTLFREICPSLLVKKDRGRPVDPKARPKAFGEVTVASNVPGAELLDENISSEGEGSDDESDAFDSDDEMDLASASPATEENMEGLSVANKHGADGDTKEEDEASDDEDGTGQDDSNNDSDELDDDSDMDADTDMSDEDEDDDDELKESINGSEDEASGQDEDSDEEDKSKGSGSKVEKRKLSDYIGELNAADASLRALKRLATAKKAEVSSDETGKILSDEDFKRIKELKAKKEAKLALAQHGLIKGGDTRSVTFKMPSSDQLSRKRVDPLELEAHVRRKMSKEERLALVKAGREDRGAYMARTAVKQKKTGGLSNKQKQHKKRMPLAATRAKAARSRQEKKQQRKRSGNQFRGRKAWK

SEQ ID NO: 177 - DNA, 2370 bp, Sorghum bicolor
  misc_feature: Ceres ANNOT ID no. 6006789
  misc_feature: Encodes the peptide sequence at SEQ ID NO 178
atggcctcgtctctgccgccgcgcagctcctaccagaagaaggagaacgcggggctggcgcgccgggagatggggtacaggtcgacgccgcgccgcaacgtgctctcggctctcaacaacggcgaggccaacggtgggacgccggcggatggcggcggcgccgccggtggcgcggcagaggcggcgcccgtgatcgagttcagtgggagggaggatgtggagcgcctgctcgccgagaaaatgaagggcaaaagcaagaacgatttcaaggggagagttgatcagatgagtgactacatcaagaagctcagggcgtgcatccggtggtacatagagctggaggatgcctatttggtggagcaggagaagctccgaggtgctatggactctgagaacgctcgtcatactgaattggagacccagctcagcaatgctattgaagagctaaaagctgcaaacttggacttgacaaggcgttgtgagtctctagaggagagcttcaacaaggagaagtctgaaaaactgatcgctatggagtcttacgagaaagaaaagcacgaaagagaatcagctgagagttcacgagatgtactcactgtggacctagaaagggtcactcatgatgctaagcggtttagcgagcagctaaaaatggtccaagacacgaataaaaggcttcaagaatacaacaccagcctgcaacaatacaacagtaaccttcaggctgatgcctcaaagagtggtgagactatctcaaaacttcagaaagagaagagtgccatgatggaaactatggctattctgagagaaagcaacagctcaatgggcaatcagcttgaatcttctagagtttctcaacaagaagctattagggtgaaggaagagctcaggaaagaagtggagtgccttagagttgagttgaagcaagttagagatgatcgtgatcattcagttattcaactgaatagtctgaatattgaacttactaattacaaggaagaaattggtaaaacttcaaaagaatgtgaaagtttccgcacaaaagtatccaaacttgaggaaacgtgcaatacacaacaagaacagattcagacatttcagaagcagcttgcagttgcgaccgagaagttgaagcttgctgatgtaactgcgatagaggcgatgacaggatatgaagaacagaaggaaaaaataaaataccttgaggagcgtttagcacaggcggagtctcaaattgtagaaggtgacgagttacggaaaaaactgcacaacactatattggaattaaaaggaaacattagagttttttgtagagttcgaccactacttagatttgatggtgattcaaatggttcagaaggtgcctctatctcttttccaacatctgtagaatctactggacgtgctattgatttgataaaccaaggtcaaaagctctccttctcgtatgataaggtttttgaccataatgcttcacaggaagatgtgtttgtggaaatatcacaactagtccaaagtgctcttgatggatacaaggtatgcatatttgcatatggtcaaactggatctggtaaaacttatacaatgatgggtaaaccagggattgatcaaaaagggataatacctcgttctttggagcaaatttttaagaccagccgatttctagaatctcaaggatggaattattctatgcaagcatcaatgttggaaatatacaatgagaccattcgtgatttgttagtgcctggtcggtctaacggttttgaaatgacgccaaataaacaatacactataaagcatgaccctcatgggaatacgaccgtgtctgagcttacaattatcgatgtctttggtattactgatgtgactagtctactggagaaagcatcccagagtaggtctgtgggtaagactcagatgaatgaacagtcttccagaagtcattttgtgttcacattgaagatatccggatctaatgagaacacaggccaacatgtccaaggagtccttaacttgattgatttagctgggagtgaacgtcttgctaaaagtggctccacaggtgatcgcttgaaggaaactcagtcaatcaataaaagcttgtcggctttgagtgatgtaatctttgcgattgcaaaaggagatgaccacgttcccttcagaaattcaaaacttacatacctattgcagccttgccttggaggtgactcgaaagctctcatgtttgtcaacatttcacctgaggcatcctctgttggtgagacgatatgctcattgaggtttgcttcaagggtgaatgcttgtgagattggaataccaagacgtcagacacaagcccgctcctttgattctaggctcagttatgggtga

SEQ ID NO: 178 - protein, 789 aa, Sorghum bicolor
  misc_feature: Ceres ANNOT ID no. 6006789
  misc_feature (438)..(769): Pfam Id: Kinesin Pfam Desc: Kinesin motor domain
  misc_feature (1)..(789): NCBI GI: 115460740 NCBI Desc: os04g0629700 [oryza sativa (japonica cultivar-group)]
  misc_feature (11)..(789): NCBI GI: 7267279 NCBI Desc: kinesin-like protein [arabidopsis thaliana]
  misc_feature (21)..(789): NCBI GI: 34849893 NCBI Desc: at4g05190 [arabidopsis thaliana]
  misc_feature (6)..(789): NCBI GI: 303502 NCBI Desc: kinesin-like motor protein heavy chain [arabidopsis thaliana]
  misc_feature (32)..(788): NCBI GI: 144923762 NCBI Desc: kinesin, motor region; prefoldin [medicago truncatula]
MASSLPPRSSYQKKENAGLARREMGYRSTPRRNVLSALNNGEANGGTPADGGGAAGGAAEAAPVIEFSGREDVERLLAEKMKGKSKNDFKGRVDQMSDYIKKLRACIRWYIELEDAYLVEQEKLRGAMDSENARHTELETQLSNAIEELKAANLDLTRRCESLEESFNKEKSEKLIAMESYEKEKHERESAESSRDVLTVDLERVTHDAKRFSEQLKMVQDTNKRLQEYNTSLQQYNSNLQADASKSGETISKLQKEKSAMMETMAILRESNSSMGNQLESSRVSQQEAIRVKEELRKEVECLRVELKQVRDDRDHSVIQLNSLNIELTNYKEEIGKTSKECESFRTKVSKLEETCNTQQEQIQTFQKQLAVATEKLKLADVTAIEAMTGYEEQKEKIKYLEERLAQAESQIVEGDELRKKLHNTILELKGNIRVFCRVRPLLRFDGDSNGSEGASISFPTSVESTGRAIDLINQGQKLSFSYDKVFDHNASQEDVFVEISQLVQSALDGYKVCIFAYGQTGSGKTYTMMGKPGIDQKGIIPRSLEQIFKTSRFLESQGWNYSMQASMLEIYNETIRDLLVPGRSNGFEMTPNKQYTIKHDPHGNTTVSELTIIDVFGITDVTSLLEKASQSRSVGKTQMNEQSSRSHFVFTLKISGSNENTGQHVQGVLNLIDLAGSERLAKSGSTGDRLKETQSINKSLSALSDVIFAIAKGDDHVPFRNSKLTYLLQPCLGGDSKALMFVNISPEASSVGETICSLRFASRVNACEIGIPRRQTQARSFDSRLSYG

SEQ ID NO: 179 - DNA, 1035 bp, Sorghum bicolor
  misc_feature: Ceres ANNOT ID no. 6006817
  misc_feature: Encodes the peptide sequence at SEQ ID NO 180
atgggtttcaggcttctcttcggatttgtcattcctctcttcctacaattctcatcatcagcgcaatccaatccattacaactagggctacaacaaccctctccatcagggctgagggttggtttttaccagtacacgtgtccgaatgcagaggccattgttcgcgacgaaatgaccaagatcatctcccaagtcccaagcctcgctgggcctctgctccggctgcacttccatgactgctttgtcaatggctgtgatggttctgttcttctgaatagcagcataccgggagtaccaaccgagaaggaagcaattccgaacctcaccttgcgaggctttggcacgatcgaccgtgtgaaggcgaagctggagcgggcctgccctggagtggtgtcctgtgctgatatcttggctctggtagcaagggacgttgttgtactgaccaaagggcctcattgggatgttccaaccgggcggagagacggaagaatatcagtgaagcaagatgctctgaacaacctccctgcgcccttctttgatgctggtcggaacctgttccagttcttcatccccaagggcctcgatgccaaggatcagattgttctgctaggagggcacactctgggtacctcgcactgctcgtcgttcgcggaccggctgtacaacttcagcggcacgatgacggcggacccgtcgctggacaagcggtacctgccgcggctgaagagcaaatgcagcaaccccggcgacacgacgacgctggtggagatggaccccggcagcttccgcacgttcgacgcgagctactaccggcacgtcgccagaggccggtcgctcttcttctccgaccagacgctcatgaacgacgccttcgccagggcctacgtccagcgccaggccgccgtggccgacgccggcgcctaccccgccgagttcttcgccgacttcgccgcgtccatggtcaagatgggcggcgtgcaggtgctcaccggcgcgcagggggaggtccggaggcactgcgccctcgtcaactag

SEQ ID NO: 180 - protein, 344 aa, Sorghum bicolor
  misc_feature: Ceres ANNOT ID no. 6006817
  misc_feature (54)..(302): Pfam Id: peroxidase Pfam Desc: Peroxidase
  misc_feature (1)..(344): NCBI GI: 116312014 NCBI Desc: osigba0117n13.15 [oryza sativa (indica cultivar-group)]
  misc_feature (42)..(344): NCBI GI: 287401 NCBI Desc: peroxidase [oryza sativa (japonica cultivar-group)]
  misc_feature (42)..(344): NCBI GI: 114150550 NCBI Desc: peroxidase 1 precursor
  misc_feature (38)..(344): NCBI GI: 55701061 NCBI Desc: tpa: class iii peroxidase 97 precursor [oryza sativa (japonica cultivar-group)]
  misc_feature (38)..(340): NCBI GI: 115468152 NCBI Desc: os06g0490400 [oryza sativa (japonica cultivar-group)]
  misc_feature (42)..(344): SWISSPROT Homolog: EC 1.11.1.7 Peroxidase 1 precursor
  misc_feature: Useful for making plants with altered cell wall content and/or composition
  misc_feature: Useful for making plants with modulated phosphate use efficiency
  misc_feature: Functional homolog of the protein sequence given in SEQ ID NO 13134
  misc_feature: Useful for making plants with altered carbohydrate content
  misc_feature: Functional homolog of the protein sequence given in SEQ ID NO 13757
  misc_feature: Useful for making plants with altered cell wall content and/or composition
  misc_feature: Useful for making plants with modulated phosphate use efficiency
  misc_feature: Functional homolog of the protein sequence given in SEQ ID NO 13134
  misc_feature: Useful for making plants with modulated nitrogen use efficiency
  misc_feature: Functional homolog of the protein sequence given in SEQ ID NO 13758
  misc_feature: Useful for making plants with modulated oxidative stress sensitivity
  misc_feature: Functional homolog of the protein sequence given in SEQ ID NO 13607
MGFRLLFGFVIPLFLQFSSSAQSNPLQLGLQQPSPSGLRVGFYQYTCPNAEAIVRDEMTKIISQVPSLAGPLLRLHFHDCFVNGCDGSVLLNSSIPGVPTEKEAIPNLTLRGFGTIDRVKAKLERACPGVVSCADILALVARDVVVLTKGPHWDVPTGRRDGRISVKQDALNNLPAPFFDAGRNLFQFFIPKGLDAKDQIVLLGGHTLGTSHCSSFADRLYNFSGTMTADPSLDKRYLPRLKSKCSNPGDTTTLVEMDPGSFRTFDASYYRHVARGRSLFFSDQTLMNDAFARAYVQRQAAVADAGAYPAEFFADFAASMVKMGGVQVLTGAQGEVRRHCALVN

SEQ ID NO: 181 - DNA, 1041 bp, Sorghum bicolor
  misc_feature: Ceres ANNOT ID no. 6006850
  misc_feature: Encodes the peptide sequence at SEQ ID NO 182
atggaggcgctcgttgttcggcggctgggcgacccgacgctggcccccggcggcgaagcctccccgttcgccgcggtctctggggatcatcctgtgccggaaatctcgtcgccaacggcagttagagtgcgagtcgcggcgaccagcctcaacttcgccacgttcctccaggtgcagggcaagtaccaggagcggcccccgctgccgttcgtgcctggatccgactactctggcgtggtcgacgcagtcgggcccggcgtgcgtgggctccggcccggcgatcgcgtctgctcctttaccggcctcgggtccttcgctgacttcatcgtcgccgaggagaagcagctatttttagtgcctgatggatgcgacctggtcacagctggggctttacctgttgcatttggtacatcacatctggcccttgttcaccgagcccaattgaaggctggccaggtgctacttgttcttggtgctgctggtggtgtcggggtatctgctgtgcaaataggaaaagtttgtggtgctgttgttattgcagttgctaggggggctgagaaatcggaatatctcaagtccataggagctgatcatgtagttgactcaagcaaggataatgttgtcgaaagtgccaagtccttcttaaaggctagaggcttgaaaggcgttgatgttttatatgacccagtcggggggaaactaactcaggatagcctgaaacttctcagttggggtgcacacattcttgtcatcggatttgccagtggtgatgttccagttattcgagcaaatattgctcttgttaagaactggacagttcatggtttgtactggggaagctacttaattcatcggccacgagtgctcattgattccctcaatgaactcttgtcgtggctttcaaagggtctgataaaagttcaaatttcacactgctacagacttgttgaggcccatcttgcgttctctgccctgagagataggaaggcggttggcaaagtgatgattgtaatgggcccctcagcagtatcaaggctctga

SEQ ID NO: 182 - protein, 346 aa, Sorghum bicolor
  misc_feature: Ceres ANNOT ID no. 6006850
  misc_feature (150)..(295): Pfam Id: ADH_zinc_N Pfam Desc: Zinc-binding dehydrogenase
  misc_feature (38)..(119): Pfam Id: ADH_N Pfam Desc: Alcohol dehydrogenase GroES-like domain
  misc_feature (39)..(338): NCBI GI: 110740865 NCBI Desc: quinone reductase-like protein [arabidopsis thaliana]
  misc_feature (31)..(338): NCBI GI: 126729204 NCBI Desc: oxidoreductase, zinc-binding dehydrogenase family protein [sagittula stellata e-37]
  misc_feature (29)..(336): NCBI GI: 118734767 NCBI Desc: alcohol dehydrogenase, zinc-binding domain protein [dinoroseobacter shibae dfl 12]
  misc_feature (32)..(341): NCBI GI: 84500272 NCBI Desc: zinc-binding dehydrogenase [oceanicola batsensis htcc2597]
  misc_feature (41)..(336): NCBI GI: 83837749 NCBI Desc: oxidoreductase, zinc-binding dehydrogenase family protein [roseovarius nubinhibens ism]
MEALVVRRLGDPTLAPGGEASPFAAVSGDHPVPEISSPTAVRVRVAATSLNFATFLQVQGKYQERPPLPFVPGSDYSGVVDAVGPGVRGLRPGDRVCSFTGLGSFADFIVAEEKQLFLVPDGCDLVTAGALPVAFGTSHLALVHRAQLKAGQVLLVLGAAGGVGVSAVQIGKVCGAVVIAVARGAEKSEYLKSIGADHVVDSSKDNVVESAKSFLKARGLKGVDVLYDPVGGKLTQDSLKLLSWGAHILVIGFASGDVPVIRANIALVKNWTVHGLYWGSYLIHRPRVLIDSLNELLSWLSKGLIKVQISHCYRLVEAHLAFSALRDRKAVGKVMIVMGPSAVSRL

SEQ ID NO: 183 - DNA, 1104 bp, Sorghum bicolor
  misc_feature: Ceres ANNOT ID no. 6006869
  misc_feature: Encodes the peptide sequence at SEQ ID NO 184
atggcgttgatcacgaatctctctgactatgaggagcttgcgaggcagaagctgcctaagatggtttatgacttctatgccgggggtgcagaagaccagtggacgctcaaggagaataaggaggcattctccaagattttgtttcgaccacgggtgctgattgatgtgtctcgtattgacatgtctacgagtatactgggttacaaaatttccatgcctattatggtggctcccactgctttgcacaaactggcccaccgagaaggagaggttgcttctgcccaggcaacagctgctgcaggaactataatgacattgtcttcatggtcatcttgcagcattgaggaagttaactcaagtgcaccaggactccgtttcttccaactttcagtattcaaggacagggatattgtgcaacaacttgtcagaagggctgaaaatgctggctataaggcaattgctgtcacagtcgatgctccacggcttggtcgcagggaagctgatgttaggaacagattcacactgcctgaaaatgtggtattgaagtgctttgaaggactggatctcagcaagatcgacaagactaatgctttaggccttgctgcatatgtcactagccagattgacagctctctttcttggaaggatatcaagtggctacagacgattacccggttgcctatcttagtgaaaggagtcataacagcagaagatgctcgacttgctattgaatgcggtgttgccggcattattatgtctaaccacgggggccgccagctagactatcttcctgcaaccatcagctgcctggaagaggttgtaagagaagcaaagggtcgtgtgcctgtgttccttgacagcggcatccgccgtggcactgacgtgttcaaggccttggcactgggagcctcaggagtatttattggaaggcctgtactgttcgcccttgctgtagacggcaaggcaggggtgaggaatgcactgcaaatgctgagggatgagctcgagatcaccatggcgctgagcggttgcacgtcgctgaaagatatcacccgcgatcatgttatcactgagagcgacatgatccgtcgctctcggatgtag

SEQ ID NO: 184 - protein, 367 aa, Sorghum bicolor
  misc_feature: Ceres ANNOT ID no. 6006869
  misc_feature (14)..(357): Pfam Id: FMN_dh Pfam Desc: FMN-dependent dehydrogenase
  misc_feature (1)..(367): NCBI GI: 38344169 NCBI Desc: osjnba0053k19.8 [oryza sativa (japonica cultivar-group)]
  misc_feature (1)..(367): NCBI GI: 116309753 NCBI Desc: h0215f08.7 [oryza sativa (indica cultivar-group)]
  misc_feature (4)..(367): NCBI GI: 27549566 NCBI Desc: glycolate oxidase [zantedeschia aethiopica]
  misc_feature (4)..(365): NCBI GI: 16226772 NCBI Desc: at3g14420/moa2_2 [arabidopsis thaliana]
  misc_feature (4)..(358): NCBI GI: 54043095 NCBI Desc: glycolate oxidase [brassica napus]
  misc_feature (4)..(360): SWISSPROT Homolog: EC 1.1.3.15 Peroxisomal (S)-2-hydroxy-acid oxidase
MALITNLSDYEELARQKLPKMVYDFYAGGAEDQWTLKENKEAFSKILFRPRVLIDVSRIDMSTSILGYKISMPIMVAPTALHKLAHREGEVASAQATAAAGTIMTLSSWSSCSIEEVNSSAPGLRFFQLSVFKDRDIVQQLVRRAENAGYKAIAVTVDAPRLGRREADVRNRFTLPENVVLKCFEGLDLSKIDKTNALGLAAYVTSQIDSSLSWKDIKWLQTITRLPILVKGVITAEDARLAIECGVAGIIMSNHGGRQLDYLPATISCLEEVVREAKGRVPVFLDSGIRRGTDVFKALALGASGVFIGRPVLFALAVDGKAGVRNALQMLRDELEITMALSGCTSLKDITRDHVITESDMIRRSRM

SEQ ID NO: 185 - DNA, 1104 bp, Sorghum bicolor
  misc_feature: Ceres ANNOT ID no. 6006870
  misc_feature: Encodes the peptide sequence at SEQ ID NO 186
atggagctgatcacaaatgtcaccgagtatgagaagctcgccaaggagaagctgcccaagatggtgtacgactactatgcctccggcgcagaagatcagtggacgctcaaggagaacagggaggccttctccagaattctgtttcgaccacgggtactgattgacgtctcccgtatcgacatggccacaaacgtcctgggcttcaacatttccatgcctatcatgatcgctccttcagccatgcagaaaatggctcatcctgatggagagcttgctacggcaagagcagcagcctctgcaggaacaataatgacactgtcctcatggtctacttccagcgttgacgaggtcaactcagttgggccagggatacgtttcttccagctctatgtctacaaggacaggaatatagtacggcaactcgtgaaaagggctgaaatggctggctttaaggctattgcactcactgtagatactccaatacttggccgcagggaagctgatataaaaaacagattcaccttacctccacatctgacgttgaaaaactttgaagcgctggatctcggcacgatggacaagacaaacgactctggacttgcttcctatgttgctggtcaagttgatcgcactctttcctggaaggacatcaagtggctgcagacaattacctcactgccaatcctagtgaaaggagtcgtgacagcagaagacactagacttgcaattgaatatggcgctgctgggatcattgtgtccaaccacggcgcacgccagctagattatgttcctgcaactatcagctgcctggaagaggtcgtcagggaagcgaaaggccggctgccggtgttcctcgacggcggcgttcgccgtggcacggacgtgtttaaggcccttgcgttgggagcttcaggagtattcatcggccggccggtgttgttctcgctggcagtggacggcgaggccggcgtgcggaaggtgctgcagatgctgagggacgagctggagctcaccatggcgctcagcggctgcacgtcgctgagggagatcacccgcgcccacgtcatcaccgacagcgacaggatcggccgctcgcggctgtag

SEQ ID NO: 186 - protein, 367 aa, Sorghum bicolor
  misc_feature: Ceres ANNOT ID no. 6006870
  misc_feature (14)..(357): Pfam Id: FMN_dh Pfam Desc: FMN-dependent dehydrogenase
  misc_feature (1)..(367): NCBI GI: 38344169 NCBI Desc: osjnba0053k19.8 [oryza sativa (japonica cultivar-group)]
  misc_feature (1)..(367): NCBI GI: 116309753 NCBI Desc: h0215f08.7 [oryza sativa (indica cultivar-group)]
  misc_feature (1)..(360): NCBI GI: 27549566 NCBI Desc: glycolate oxidase [zantedeschia aethiopica]
  misc_feature (1)..(367): NCBI GI: 1773330 NCBI Desc: glycolate oxidase [mesembryanthemum crystallinum]
  misc_feature (1)..(358): NCBI GI: 54043095 NCBI Desc: glycolate oxidase [brassica napus]
  misc_feature (1)..(360): SWISSPROT Homolog: EC 1.1.3.15 Peroxisomal (S)-2-hydroxy-acid oxidase
MELITNVTEYEKLAKEKLPKMVYDYYASGAEDQWTLKENREAFSRILFRPRVLIDVSRIDMATNVLGFNISMPIMIAPSAMQKMAHPDGELATARAAASAGTIMTLSSWSTSSVDEVNSVGPGIRFFQLYVYKDRNIVRQLVKRAEMAGFKAIALTVDTPILGRREADIKNRFTLPPHLTLKNFEALDLGTMDKTNDSGLASYVAGQVDRTLSWKDIKWLQTITSLPILVKGVVTAEDTRLAIEYGAAGIIVSNHGARQLDYVPATISCLEEVVREAKGRLPVFLDGGVRRGTDVFKALALGASGVFIGRPVLFSLAVDGEAGVRKVLQMLRDELELTMALSGCTSLREITRAHVITDSDRIGRSRL

SEQ ID NO: 187 - DNA, 1446 bp, Sorghum bicolor
  misc_feature: Ceres ANNOT ID no. 6006874
  misc_feature: Encodes the peptide sequence at SEQ ID NO 188
atgtcaggttcatttggtgaaaatgctaggagaaagccacacacaccaaccgctattgttattggtggtgggtttgcaggtcttgctgctgcagatgcgctcagaaatgcctccttccaggttattcttctggaatcccgtgataggattggtggcagagttcacactgactactcgtttgggtttccagtcgatctgggagcatcttggcttcatggcgtctgtgaagaaaatcccttagcaccaataattggaaggcttgggcttccactgtaccgcacaagtggagatgattctgtgctgtttgatcatgatctggagagttatgcactctatgacactaatggacgtcaagtaccacaagagttggtagaaaagattgggaaggtgtttgagaccatactggaagagactggcaaattgagggaaggaaccaatgaagatatgtctattgcaaaagccattgcaattgttatggatagaaatccacacttcaggcaagaagggattgctcatgaggtccttcagtggtatttgtgccgtatggagggttggtttgccaccgacgctgattcaatttcactacagggttgggatcaggaggtgctgctgccaggtggtcatggcctcatggttcgtggatatcgtccggttataaatactcttgcgaaaggcttagatatacgcctcaaccataaggttgtggaaattgttcgccacaggaacagggtagaggttactgtaagcagtggcaaaacatttgttgcggatgctgcagtggtcgctgttccgttgggtgtcctgaaagcacaaaccattaaatttgagccgaggctgccagactggaaagaagaagcaattagagaacttacagttggaattgaaaacaaaattgttcttcacttcggccaggttttctggcctaacgtggagttcctcggcgtcgtttcctctagcacgtatggttgcagctatttcctcaaccttcacaaggcaacaggccaccctgtccttgtttacatgcctgctggccgccttgctcgtgacatcgagaaaatgtcagatgaggctgctgcccagtttgccttttctcagttgaagaagatccttcccaatgcagctgagccgataaattacctggtgtcacactggggctcagacgagaactcacttggttcctacacgttcgatggggtgaacaaaccccgggacctgtacgagaagctgcgcatccccgtggacaacctgttcttcgcgggtgaggcgacgagtctcaagtacacgggcacggtgcacggcgccttctccactggtgtcatggcggccgaggagtgcaagatgcgggttctggagcggttcagggagctggacatgctggagatgtgccaccctgccatgggcgaagacagccccgtctctgtcccgctgctcatctcccggctgtaa

SEQ ID NO: 188 - protein, 481 aa, Sorghum bicolor
  misc_feature: Ceres ANNOT ID no. 6006874
  misc_feature (25)..(446): Pfam Id: Amino_oxidase Pfam Desc: Flavin containing amine oxidoreductase
  misc_feature (17)..(350): Pfam Id: DAO Pfam Desc: FAD dependent oxidoreductase
  misc_feature (17)..(439): Pfam Id: FAD_binding_2 Pfam Desc: FAD binding domain
  misc_feature (2)..(481): NCBI GI: 38345715 NCBI Desc: osjnbb0085c12.17 [oryza sativa (japonica cultivar-group)]
  misc_feature (2)..(481): NCBI GI: 116309749 NCBI Desc: h0215f08.3 [oryza sativa (indica cultivar-group)]
  misc_feature (10)..(481): NCBI GI: 102139789 NCBI Desc: amine oxidase family protein [musa acuminata]
  misc_feature (5)..(481): NCBI GI: 18650598 NCBI Desc: at2g43020/mfl8.12 [arabidopsis thaliana]
  misc_feature (6)..(481): NCBI GI: 90265249 NCBI Desc: h0624f09.10 [oryza sativa (indica cultivar-group)]
MSGSFGENARRKPHTPTAIVIGGGFAGLAAADALRNASFQVILLESRDRIGGRVHTDYSFGFPVDLGASWLHGVCEENPLAPIIGRLGLPLYRTSGDDSVLFDHDLESYALYDTNGRQVPQELVEKIGKVFETILEETGKLREGTNEDMSIAKAIAIVMDRNPHFRQEGIAHEVLQWYLCRMEGWFATDADSISLQGWDQEVLLPGGHGLMVRGYRPVINTLAKGLDIRLNHKVVEIVRHRNRVEVTVSSGKTFVADAAVVAVPLGVLKAQTIKFEPRLPDWKEEAIRELTVGIENKIVLHFGQVFWPNVEFLGVVSSSTYGCSYFLNLHKATGHPVLVYMPAGRLARDIEKMSDEAAAQFAFSQLKKILPNAAEPINYLVSHWGSDENSLGSYTFDGVNKPRDLYEKLRIPVDNLFFAGEATSLKYTGTVHGAFSTGVMAAEECKMRVLERFRELDMLEMCHPAMGEDSPVSVPLLISRL

SEQ ID NO: 189 - DNA, 288 bp, Sorghum bicolor
  misc_feature: Ceres ANNOT ID no. 6006879
  misc_feature: Encodes the peptide sequence at SEQ ID NO 190
atggcgacgccggacaaggggcaggggcgtccgctgcccaagtttggggagtgggacgtgaagaatcccgccacgtccgagggcttcaccgtcatattccagaaagcccgcgacggcaagaagactaccggcggccccgggaacgtccgcgcaggcataccgccggccttcaggaacggcgatggcgccgacgacggcgggtacaggcctgacttcaaatacggcgacagcagccagcacacgccgcccaaacgcatcaagaagaagtgggccttctgtggctgctga

SEQ ID NO: 190 - protein, 95 aa, Sorghum bicolor
  misc_feature: Ceres ANNOT ID no. 6006879
  misc_feature (1)..(95): Pfam Id: NOI Pfam Desc: Nitrate-induced NOI protein
  misc_feature (1)..(95): NCBI GI: 38344338 NCBI Desc: osjnba0058k23.20 [oryza sativa (japonica cultivar-group)]
  misc_feature (1)..(95): NCBI GI: 116309950 NCBI Desc: h0714h04.8 [oryza sativa (indica cultivar-group)]
  misc_feature (9)..(47): NCBI GI: 86361426 NCBI Desc: nitrate-induced noi protein-like protein [oryza sativa (indica cultivar-group)]
  misc_feature (8)..(62): NCBI GI: 79537400 NCBI Desc: noi [arabidopsis thaliana]
  misc_feature (6)..(65): NCBI GI: 140069656 NCBI Desc: nitrate-induced noi [medicago truncatula]
MATPDKGQGRPLPKFGEWDVKNPATSEGFTVIFQKARDGKKTTGGPGNVRAGIPPAFRNGDGADDGGYRPDFKYGDSSQHTPPKRIKKKWAFCGC

SEQ ID NO: 191 - DNA, 2328 bp, Sorghum bicolor
  misc_feature: Ceres ANNOT ID no. 6006881
  misc_feature: Encodes the peptide sequence at SEQ ID NO 192
atgttttggcacgtgcctggactctccgctgcatcacctgtggatactattttggacaaggaaaattttaagttggaggatcttcttgatgaggatgaaataattcaggagtgcaaagcactgaatacccgcttaatcaattttctgcgggacagggttcaagtggaacaattgctccgctacattgtagaggagactcctgaagatgcagaaaagaaaaggatatttagatttccatttatagcttgtgaaatatttacatgtgaagtggatgtcatcatgaagacattggtggaggatgaagatcttatgaatttgcttttctccttcctgaaacctgaccaccctcatgggacattgtcggctggttactttgccaaggtagtgatttgcttgatgatgaggaagacactcccactagttagttatgtgcagggccatcctgaaatagttagccaacttgttgatcttattgggattacttctatcatggaggttttgattcgcttaatcggtgcggatgaagctatgtattcaagctatgcagattctatgcaatggttagatgacatacaagtccttgagatgattgttgacaagttcagcacatcagattctcctgaggttcatgcaaatgctgctgaaatcctttgtgcagtaactagatatgcccctccagcacttgctgcaaagatttccagtccaagctttgtggggagattatttcaacatgcttttgaagattcaaggcctaaatcggtgctggtccactcattatcagtgtgcatatctttgttagatcctaagagacttgtatcggcttcctaccaggctttccgtagtcagttgagccatggaacacttgtcactgcaagtccagagacagtaaatggcatgctggatagcctaggggatttgttgaagctgctggatgtttcatctgcagaaaatgttctgccaacgacctacggaagcttacaacctccactcgggaaacatcgcttaaagattgttgagttcatctccgttctactatcaattggtagtgaagctgccgaaacgcgactgattcaactaggagcaatcaagcacgctatagatctattttttgagtacccatttaacaactttttgcaccaccatgttgagaatatcattgggtcatgtctggagagtaagcaggatcaactgatttaccatgtccttgatgagtgtaaacttgttacaagaattctggaagcagagaagaactccgctctgtcgtcagatttaactaagcatacattggcttcagagggaagatctccaccaaggataggaattgttggtcatatgacacggatagctaacaagctccttcagctggccaatactaacatcatggttcaatcacatttgcagcaaaattctgattggattgagtggcatgccagtaccctaacgaagcgtaatgcattagaaaatgtttaccagtgggcttgcggtcgaccaacgtcactgcaggatcgtggtagggatagcgatgatgaagacttccgagatagggactacgatgtggctgcacttgctagtaatttaagccaggcatttaaatatggtatttacagtaatgaggatattgacgaggctcaagcatcacttgagcgggatgatgaggatgtatattttgatgatgaatctgcagaggtagtaatctcctcccttcgccttggagacgaacaagaaagtggctcgctctttacaaattccaactggtttgcatttgacgaggacaaaccactgaatgatggtttggttagttcagaagcttccccatctccaaattcggaaatgtccgcactaaaagaggatgatgaaaatgatgaagtcattcttggcgaggaggttatggatgacacaaaaggttctgaaccacctctacctgtccccaacaaagacgcaaatgaagagtctggtcacaccggcttggcaaatggtaccattgacacattggaagatgatatcagaccaccaactccggatgtaaaagagagtcaacctgagtttgtagaatggaaggaggaagaagctgaacgtggtgatgttgctgagaaggatactgcagttcttgatatggaggttgaaagtgagaagcagctggattccatggattgcgatgccaagtttggagaggaaaagaatagtgatgatatgcttggatcttcagtgtctgagacagaagcagcatcgcctgtttcatctgatattgattcaatcaagcaccctgaaccagttgctgacagtgctgtatcagagtatccaatgggtgaacaaaatcctgagaaatga

SEQ ID NO: 192 - protein, 775 aa, Sorghum bicolor
  misc_feature: Ceres ANNOT ID no. 6006881
  misc_feature (129)..(489): Pfam Id: SAPS Pfam Desc: SIT4 phosphatase-associated protein
  misc_feature (1)..(774): NCBI GI: 116309949 NCBI Desc: h0714h04.7 [oryza sativa (indica cultivar-group)]
  misc_feature (1)..(774): NCBI GI: 38344337 NCBI Desc: osjnba0058k23.19 [oryza sativa (japonica cultivar-group)]
  misc_feature (1)..(666): NCBI GI: 115460612 NCBI Desc: os04g0620400 [oryza sativa (japonica cultivar-group)]
  misc_feature (1)..(762): NCBI GI: 42562411 NCBI Desc: sit4 phosphatase-associated family protein [arabidopsis thaliana]
  misc_feature (143)..(774): NCBI GI: 6634768 NCBI Desc: contains similarity to gbd21822 orf from lilium longiflorum. ests gbt03978, gbr89954, gbai995107, gbt20998, gbr65384 come from this gene. [arabidopsis thaliana]
MFWHVPGLSAASPVDTILDKENFKLEDLLDEDEIIQECKALNTRLINFLRDRVQVEQLLRYIVEETPEDAEKKRIFRFPFIACEIFTCEVDVIMKTLVEDEDLMNLLFSFLKPDHPHGTLSAGYFAKVVICLMMRKTLPLVSYVQGHPEIVSQLVDLIGITSIMEVLIRLIGADEAMYSSYADSMQWLDDIQVLEMIVDKFSTSDSPEVHANAAEILCAVTRYAPPALAAKISSPSFVGRLFQHAFEDSRPKSVLVHSLSVCISLLDPKRLVSASYQAFRSQLSHGTLVTASPETVNGMLDSLGDLLKLLDVSSAENVLPTTYGSLQPPLGKHRLKIVEFISVLLSIGSEAAETRLIQLGAIKHAIDLFFEYPFNNFLHHHVENIIGSCLESKQDQLIYHVLDECKLVTRILEAEKNSALSSDLTKHTLASEGRSPPRIGIVGHMTRIANKLLQLANTNIMVQSHLQQNSDWIEWHASTLTKRNALENVYQWACGRPTSLQDRGRDSDDEDFRDRDYDVAALASNLSQAFKYGIYSNEDIDEAQASLERDDEDVYFDDESAEVVISSLRLGDEQESGSLFTNSNWFAFDEDKPLNDGLVSSEASPSPNSEMSALKEDDENDEVILGEEVMDDTKGSEPPLPVPNKDANEESGHTGLANGTIDTLEDDIRPPTPDVKESQPEFVEWKEEEAERGDVAEKDTAVLDMEVESEKQLDSMDCDAKFGEEKNSDDMLGSSVSETEAASPVSSDIDSIKHPEPVADSAVSEYPMGEQNPEK

SEQ ID NO: 193 - DNA, 4884 bp, Sorghum bicolor
  misc_feature: Ceres ANNOT ID no. 6006883
  misc_feature: Encodes the peptide sequence at SEQ ID NO 194
atggggttcgacccactggagtggtactgccagccggtcaagaatggtgtgtggtcacttgtggtggagaatgcgttcggcgcctacactccgtgtggcactgacaccctggtggtctgcatctcatacctcgcactctttggcgtttgcttctatcgcatatggaggacgacgagggactacacagtgcagcggtacaagttacgttcaccgtactacaactacctgcttggactacttgtggtgtactgcatagcagagccgctttatcggattgccactggcacctctatcatgaacttggatgggcagcctggccttgctccatttgagattgtctcattgatcattgagtctgctgcttggtgctgtatgcttgtaatgattctgctcgagacaagaatttacatcaatgagttcagatggtacattcggtttgtggtcatttacgtgatggttggtgaggctgctatgttcaatcttgtgctctcggtgaggcagtactacagttcaagttcaatcttttacctatactgtagtgagattgcatgccagctcttgtttggaattctcatggtggtttatctgcctagtgtggatccatatccgggttataccccgatcaggaatgaggtgctggttgataatactgattatgaacctcttcccggcggtgagcagatttgccctgagagacatgtcaatgtatttgccagaatattcttttcatggatgactcctctaatgcaacaaggatttagaaggcccattacagataaggatatctggaaattggacagctgggacgagactgaaactttgtatagccaattccagaaatgctggaatgatgagcttcgaaaaccaaaaccttggctgttacgagctcttcacagtagtctttggggaaggttctggctgggtggatttttcaagattggcaatgatgcttctcaatttgttggtccacttgtattgaacctgttgttagagtctatgcaaaaaggtgatccatcttggagcgggtacatctatgctttctcgatctttgcaggagtgtcacttggggttcttgctgaggcacagtactttcagaatgtcatgcgtgtgggtttcaggttgaggtccacattgattgcagctgttttccgcaagtctttgcgactaactaatgagagtcgtagaaagtttgcttctgggaggattaccaatttgatttcaactgatgcggagtcccttcagcaagtgtgccagcagcttcacagcctatggtctgctcctttccgcattgttatttccatggtccttctatatgcacagcttggtcctgcagcattagtcggtgcacttatgctggttcttttgtttccaattcagacagtaatcatcagcaaaatgcaaaaacttactaaggaggggttgcaaaggaccgacaagcgaatcagtctcatgaatgaagtattagctgccatggatacggtcaagtgctatgcttgggagcaaagtttccagtcaaaggtgcaggacatccgcgatgatgaactttcttggttccgcagggctcagttgcttgctgcgctgaatagctttatcctgaacagtataccggtcgttgtcactgttgtttcgtttggtgtatattctctactgggaggtgatttgacaccagcgaaggcgtttacttccctttcattatttgcagtcttaaggttcccacttttcatgctcccgaatctgataactcaggtagttaattgtaaggtgtcattgaagcgtctagaagatcttttgttggctgaagagagattacttctgccaaatccacctattgatcctgatcttccagccatttctatcaagaatgggtatttttcatgggaatcagaggctcagagaccaactttatcaaatgtcaatctggatgtacctgttggaagtttagttgcaatagttggaagcactggtgagggtaaaacttctctcatatctgcaatgcttggagaaataccaccagtatctggatcaggtacctcagtggtcattcgtggatcagtggcttatgttcctcaagtttcctggatcttcaatgctaccgtacgggacaatattttgtttgggtctccctttcaacccccacgctatgagaaagcgatcgatgtcacttcattgcggcatgaccttgacctactcccaggaggcgatctgacagagattggtgaaagaggagttaatattagtggagggcagaagcaaagagtttcaatggcaagagctgtgtattctgattcagatgtgtacatatttgatgatccactcagtgcattagatgcccatgttggccgtcaggtatttgataaatgtatcaaaggggaactacagcataaaacccgggttcttgttaccaatcagctgcattttctgccatatgttgataaaatactgctaattcatgatggtgtaattaaagaggagggtacttttgatgaacttagcaacagtggggagctcttcaagaagctcatggaaaatgctggaaaaatggaggagcaggtggaagaggatgaaagtaaaccaaaggatgttgcaaaacaaactgaaaatggggatgttataatagctgatgaaggttcacagaagagccaggatagttctagtaaaacaaaaccaggaaaatctgtgcttattaaacaagaggaaagggaaactggggttgtcagtgcgaatgtcctttcacgttacaaaaatgcactgggagggatgtgggtggtgtccatactcttcttttgctatgcactgactgaagttcttcgcatttcaagtagcacatggttgagcatttggactgatcagggttctctgaaaattcatggccctggttactacaatttgatctatggaattctttcttttgggcaggttttagtcactctctcaaattcatactggctgattatatcaagtcttcgggcagccaaaaggcttcatgatgccatgctccgatcaatattgagagctcccatggtattttttcatacaaacccacttggacggatcatcaacagattttcgaaggatttgggtgacattgaccgaaatgttgctgtatttgtcaatatgtttatggcacaaatatctcagttgctctcaacttttgttctcatcggttttgtcagcaccatgtctctttgggctatcatgccactcctgattttgttttatgcagcttacctctattaccaggcaacatctcgcgaggtgaagcgtctggattccattaccaggtctcctgtgtatgctcagttttcagaggctttgaatggtctgtccacaatccgtgcctataaagcctatgatagaatggcaaacatcaacgggagatcaatggacaacaacattaggttcacacttgtgaacatgagtgcaaataggtggctagctattcgtctggaaacattgggtggcatcatgatatggtttacagcaacttttgctgttatgcaaaatcaacgagcagagaaccagaaagcctttgcttctacaatgggtcttcttcttacttacactctcaatattaccaatttactcacagctgttcttcgtcttgctagtcttgccgaaaatagtttaaatgctgttgaacgggttggaacatacattgagttaccttcagaagctcctcctgtcattgaggatcataggccacccccgggttggccatcatcaggtgtcatcaagtttgaagacgttgtgcttcgatatcgaccagaacttccccctgttcttcatggcatttcttttcttattaatggaagtgagaaggtaggaatagttggcagaacaggtgctggtaaatctagcatgcttaatgctttgttccgtattgtggagcttgaacgagggagaatattaattgatgattgtgacacttctaagtttggaatttgggacctgcgcaaggttctaggaataataccacaggcaccagttctattttcaggttctgttcggtttaatctggatccctttaacgagcacaatgatgcggatctctgggaggctctggaaagggctcatctaaaagatgttataaggaggaatcctttaggattagatgctgaggtctctgaagctggtgaaaatttcagtgttggacaacggcaactgttgagcttagctcgtgcgctgctgagaagagcaaagatacttgttcttgatgaggcaactgcagcagttgacgtgcggactgatgctcttattcagaaaacaatccgagaagaattcaagagttgcacaatgctcataattgcccaccgtttgaacactgtcattgactgtgacaggttgcttattttaagtgctgggcaggttctggaatttgactctcctgagaatcttctaagcaatgaggagagtgctttctccaagatggtgcaaagtacaggacctagcaacgcagaatacctcaagagtcttgtatttggaagtggagaagagaggtcccggagggaagaaatcaaactgcaagatatccaaaggagatgggttgcatcaaaccgatgggctgaagctgcccagtttgcacttgctagaagcctcacatcatcacatagtgacctccttgcactagaagctgccgagggaaataatattctgaggagaacaaaggatgctgtaatcactctgcaaagcgtactagaagggaagcacaatactgaaatcgatgaatctctaactctgtatcaggtcccagctgatcgatggtggtcgtcactttacaaagtggtcgaaggcctcgccacgatgagcagattggcccgcaaccgtctgcagcaacctgcttataattttgagaacaacggttctattgactgggaccaaatgtag

SEQ ID NO: 194 - protein, 1627 aa, Sorghum bicolor
  misc_feature: Ceres ANNOT ID no. 6006883
  misc_feature (645)..(819): Pfam Id: ABC_tran Pfam Desc: ABC transporter
  misc_feature (1271)..(1454): Pfam Id: ABC_tran Pfam Desc: ABC transporter
  misc_feature (305)..(573): Pfam Id: ABC_membrane Pfam Desc: ABC transporter transmembrane region
  misc_feature (923)..(1195): Pfam Id: ABC_membrane Pfam Desc: ABC transporter transmembrane region
  misc_feature (1)..(1627): NCBI GI: 38344335 NCBI Desc: osjnba0058k23.17 [oryza sativa (japonica cultivar-group)]
  misc_feature (1)..(1627): NCBI GI: 116309947 NCBI Desc: h0714h04.5 [oryza sativa (indica cultivar-group)]
  misc_feature (1)..(1626): NCBI GI: 27263148 NCBI Desc: mrp-like abc transporter [oryza sativa (japonica cultivar-group)]
  misc_feature (1)..(1627): NCBI GI: 3132479 NCBI Desc: abc transporter (atmrp2) [arabidopsis thaliana]
  misc_feature (1)..(1627): NCBI GI: 2909781 NCBI Desc: mgatp-energized glutathione s-conjugate pump [arabidopsis thaliana]
  misc_feature (1)..(1627): SWISSPROT Homolog: EC 3.6.3.44 Multidrug resistance-associated protein 2
MGFDPLEWYCQPVKNGVWSLVVENAFGAYTPCGTDTLVVCISYLALFGVCFYRIWRTTRDYTVQRYKLRSPYYNYLLGLLVVYCIAEPLYRIATGTSIMNLDGQPGLAPFEIVSLIIESAAWCCMLVMILLETRIYINEFRWYIRFVVIYVMVGEAAMFNLVLSVRQYYSSSSIFYLYCSEIACQLLFGILMVVYLPSVDPYPGYTPIRNEVLVDNTDYEPLPGGEQICPERHVNVFARIFFSWMTPLMQQGFRRPITDKDIWKLDSWDETETLYSQFQKCWNDELRKPKPWLLRALHSSLWGRFWLGGFFKIGNDASQFVGPLVLNLLLESMQKGDPSWSGYIYAFSIFAGVSLGVLAEAQYFQNVMRVGFRLRSTLIAAVFRKSLRLTNESRRKFASGRITNLISTDAESLQQVCQQLHSLWSAPFRIVISMVLLYAQLGPAALVGALMLVLLFPIQTVIISKMQKLTKEGLQRTDKRISLMNEVLAAMDTVKCYAWEQSFQSKVQDIRDDELSWFRRAQLLAALNSFILNSIPVVVTVVSFGVYSLLGGDLTPAKAFTSLSLFAVLRFPLFMLPNLITQVVNCKVSLKRLEDLLLAEERLLLPNPPIDPDLPAISIKNGYFSWESEAQRPTLSNVNLDVPVGSLVAIVGSTGEGKTSLISAMLGEIPPVSGSGTSVVIRGSVAYVPQVSWIFNATVRDNILFGSPFQPPRYEKAIDVTSLRHDLDLLPGGDLTEIGERGVNISGGQKQRVSMARAVYSDSDVYIFDDPLSALDAHVGRQVFDKCIKGELQHKTRVLVTNQLHFLPYVDKILLIHDGVIKEEGTFDELSNSGELFKKLMENAGKMEEQVEEDESKPKDVAKQTENGDVIIADEGSQKSQDSSSKTKPGKSVLIKQEERETGVVSANVLSRYKNALGGMWVVSILFFCYALTEVLRISSSTWLSIWTDQGSLKIHGPGYYNLIYGILSFGQVLVTLSNSYWLIISSLRAAKRLHDAMLRSILRAPMVFFHTNPLGRIINRFSKDLGDIDRNVAVFVNMFMAQISQLLSTFVLIGFVSTMSLWAIMPLLILFYAAYLYYQATSREVKRLDSITRSPVYAQFSEALNGLSTIRAYKAYDRMANINGRSMDNNIRFTLVNMSANRWLAIRLETLGGIMIWFTATFAVMQNQRAENQKAFASTMGLLLTYTLNITNLLTAVLRLASLAENSLNAVERVGTYIELPSEAPPVIEDHRPPPGWPSSGVIKFEDVVLRYRPELPPVLHGISFLINGSEKVGIVGRTGAGKSSMLNALFRIVELERGRILIDDCDTSKFGIWDLRKVLGIIPQAPVLFSGSVRFNLDPFNEHNDADLWEALERAHLKDVIRRNPLGLDAEVSEAGENFSVGQRQLLSLARALLRRAKILVLDEATAAVDVRTDALIQKTIREEFKSCTMLIIAHRLNTVIDCDRLLILSAGQVLEFDSPENLLSNEESAFSKMVQSTGPSNAEYLKSLVFGSGEERSRREEIKLQDIQRRWVASNRWAEAAQFALARSLTSSHSDLLALEAAEGNNILRRTKDAVITLQSVLEGKHNTEIDESLTLYQVPADRWWSSLYKVVEGLATMSRLARNRLQQPAYNFENNGSIDWDQM

SEQ ID NO: 195 - DNA, 1245 bp, Sorghum bicolor
  misc_feature: Ceres ANNOT ID no. 6006913
  misc_feature: Encodes the peptide sequence at SEQ ID NO 196
atgccaacaaccccaagaagcagaagccaggctaggaccactaggccttggatcttgtcagggatggactttgctgattcgcgacggaagcctaatttcacggggaagattgccgtggcagctgcactcacggtgatgtgcataatcgtgttgaaacagtcccccagtttcagcggtaccagcgtgttctctcgccgtgaaactggggtgacccatgtgttagtaacagggggagctgggtatattggctcacatgctactcttcgtctccttagtgacaactaccgagttaccattgtggataacttatcaagagggaacatgggagctgttagagttcttcaacggctatttccagaacctggaaggcttcaatttatttatgctgatttgggcgatgccaaagtgaacaaaatattttcggagaatgcatttgatgctgttatgcactttgctgctgttgcttatgttggtgagagcacaatggagccactcaggtactaccacaacataacatcaaacacattgacagttcttgaggcaatggcagcacacaatgtaaatactctgatttactcgagtacatgtgcaacctacggtgaacctgatacgatgcctattgtagaaacaactcctcagaatcctatcaatccatatggtaaggcaaagaagatggcagaggacatcatcttagattttacaaaatcaaagaaacaatcaaacatggctgtcatgattttaagatacttcaatgtgattggatcagacccagagggacgtctaggagaagctccaaggccagagcttcgtgagcatggacggatatctggtgcttgctttgatgcagctctgggaatcattccagggctaaaggttcgtggaactgattaccccactgcagatggaacttgcattagggactacatcgatgtcacagatcttgtagatgcccatgtcaaagctcttggtaaagctgagccaggcaaagttggaatctacaatgtcggaacaggacaaggtagatcagtgaatgagtttgtgaaagcttgcatgaaggcaacaggagcttccatcaaggttgaatatcttgcccgtagacccggagattatgctgaggtatacagtgatccatcgaaaatctacaaggacctcaactggacagcccaatacactgatcttggccaaagccttgcccaggcatggaaatggcagaaagcgcacccaaacggatatggatcagcctga

SEQ ID NO: 196 - protein, 414 aa, Sorghum bicolor
  misc_feature: Ceres ANNOT ID no. 6006913
  misc_feature (73)..(336): Pfam Id: Epimerase Pfam Desc: NAD dependent epimerase/dehydratase family
  misc_feature (74)..(330): Pfam Id: 3Beta_HSD Pfam Desc: 3-beta hydroxysteroid dehydrogenase/isomerase family
  misc_feature (75)..(322): Pfam Id: NAD_binding_4 Pfam Desc: Male sterility protein
  misc_feature (22)..(414): NCBI GI: 115460580 NCBI Desc: os04g0618200 [oryza sativa (japonica cultivar-group)]
  misc_feature (21)..(413): NCBI GI: 27529690 NCBI Desc: udp-galactose 4-epimerase-like protein [oryza sativa (japonica cultivar-group)]
  misc_feature (12)..(413): NCBI GI: 84873496 NCBI Desc: udp-d-xylose epimerase 3 [hordeum vulgare]
  misc_feature (1)..(412): NCBI GI: 113610395 NCBI Desc: os07g0139400 [oryza sativa (japonica cultivar-group)]
  misc_feature (1)..(412): NCBI GI: 25553524 NCBI Desc: udp-galactose 4-epimerase-like protein [oryza sativa (japonica cultivar-group)]
  misc_feature (6)..(412): SWISSPROT Homolog: EC 5.1.3.5 UDP-arabinose 4-epimerase 1
  misc_feature: Useful for making plants with altered cell wall content and/or composition
  misc_feature: GREAT-hit functional homolog of the protein sequence encoded by LOCUS at1g30620
  misc_feature: GREAT-hit functional homolog of the protein sequence encoded by LOCUS at2g34850
  misc_feature: GREAT-hit functional homolog of the protein sequence encoded by LOCUS at4g20460
  misc_feature: GREAT-hit functional homolog of the protein sequence encoded by LOCUS at5g44480
  misc_feature: Useful for making plants with altered carbohydrate content
  misc_feature: Functional homolog of the protein sequence given in SEQ ID NO 13764
  misc_feature: Useful for making plants with altered cell wall content and/or composition
  misc_feature: Functional homolog of the protein sequence given in SEQ ID NO 13765
MPTTPRSRSQARTTRPWILSGMDFADSRRKPNFTGKIAVAAALTVMCIIVLKQSPSFSGTSVFSRRETGVTHVLVTGGAGYIGSHATLRLLSDNYRVTIVDNLSRGNMGAVRVLQRLFPEPGRLQFIYADLGDAKVNKIFSENAFDAVMHFAAVAYVGESTMEPLRYYHNITSNTLTVLEAMAAHNVNTLIYSSTCATYGEPDTMPIVETTPQNPINPYGKAKKMAEDIILDFTKSKKQSNMAVMILRYFNVIGSDPEGRLGEAPRPELREHGRISGACFDAALGIIPGLKVRGTDYPTADGTCIRDYIDVTDLVDAHVKALGKAEPGKVGIYNVGTGQGRSVNEFVKACMKATGASIKVEYLARRPGDYAEVYSDPSKIYKDLNWTAQYTDLGQSLAQAWKWQKAHPNGYGSA

SEQ ID NO: 197 - DNA, 798 bp, Sorghum bicolor
  misc_feature: Ceres ANNOT ID no. 6006916
  misc_feature: Encodes the peptide sequence at SEQ ID NO 198
atgaccaccgcgcggttcgtctcaacctgccccacccgcctatcctccacgtcgacttccccgattcgaacctcggggtgggttatcggtcgggtccccgctaggccgctcggtttctcgcttcgtctcaagcccgccatggccgccgccggcgtcggcggcaacggctccccgaccgcacccggagactccataggatcttctaggattggagaggttaagagggtgactaaggagacaaatgtgcacgtgaagatcaaccttgatggcactggtgtcgccgagtgtagcacagggataccgttcttggatcacatgctcgatcagctggcatcacatggactctttgatgtgtacgtgaaggcaacaggtgacacacatattgatgaccatcactcaaatgaggacattgctttggcaattgggacggcactacttgaagcacttggtgatcgaaagggaattaaccgttttgggcattttacagcaccgctcgatgaggcagcggttgaggttatactggatctgtctggtcgccctcatttaagctgtggcttagatattcctactcagagagttggcacatatgatacacagctggttgaacactttttccaatctgtggtgaacacatctgggatgactcttcacatccgtcagcttgctgggaaaaactcacaccatattatcgaggcatctttcaaagcatttgctagggcacttcgacaagcaacagaatatgacttgcgccgccaaggcactgtccccagctccaaaggtgttttgtcaagatcataa

SEQ ID NO: 198 - protein, 265 aa, Sorghum bicolor
  misc_feature: Ceres ANNOT ID no. 6006916
  misc_feature (98)..(242): Pfam Id: IGPD Pfam Desc: Imidazoleglycerol-phosphate dehydratase
  misc_feature (1)..(265): NCBI GI: 38345609 NCBI Desc: osjnba0093o08.11 [oryza sativa (japonica cultivar-group)]
  misc_feature (1)..(256): NCBI GI: 90399324 NCBI Desc: h0313f03.7 [oryza sativa (indica cultivar-group)]
  misc_feature (71)..(265): NCBI GI: 462275 NCBI Desc: imidazoleglycerol-phosphate dehydratase (igpd)
  misc_feature (71)..(265): NCBI GI: 551331 NCBI Desc: imidazoleglycerolphosphate dehydratase
  misc_feature (7)..(265): NCBI GI: 1381086 NCBI Desc: imidazoleglycerol-phosphate dehydratase
  misc_feature (7)..(265): SWISSPROT Homolog: EC 4.2.1.19 Imidazoleglycerol-phosphate dehydratase
MTTARFVSTCPTRLSSTSTSPIRTSGWVIGRVPARPLGFSLRLKPAMAAAGVGGNGSPTAPGDSIGSSRIGEVKRVTKETNVHVKINLDGTGVAECSTGIPFLDHMLDQLASHGLFDVYVKATGDTHIDDHHSNEDIALAIGTALLEALGDRKGINRFGHFTAPLDEAAVEVILDLSGRPHLSCGLDIPTQRVGTYDTQLVEHFFQSVVNTSGMTLHIRQLAGKNSHHIIEASFKAFARALRQATEYDLRRQGTVPSSKGVLSRS

SEQ ID NO: 199 - DNA, 2748 bp, Sorghum bicolor
  misc_feature: Ceres ANNOT ID no. 6006918
  misc_feature: Encodes the peptide sequence at SEQ ID NO 200
atggtggagatgcggcagcggaggaagccgctggtgctcgcctccacgcaggcgctcctcgactcgctcccgggggaccgcccgccgccgccgccgttggagccggtgtgccttaggaccggcgtcctccgcttcccctccggccccggcgccggcgccgagttcggggagctcgcgtccttcgtcgccctccctgcctccgcgctccgacggctcacggtcgtcaccggcacgccggtgcttgtcaagaatactgacaataatgttgggaggattgtcaaagcagtattgtttgatgacatgtcccttcgcaagtcccactcagaatatactgatcaagtggtctctgcttctccttctgatcgtgcaatgggcttcttaccttgtcgcatgttccctgctactggtttggcatccatggatgaagttgttgcttatgtcagcccacttttggcattcaacttggggttgcatgtttcttgcctcaagcttcttattcaaagaggagggcagcctttcaagttctgttctcgagctgaagagattgatgcaactgctggtgctggaagtgatctttctcttcacttagaccttcttccatgccctcaagtgcctaaatatgcgttgcatttacgagtttctgttgtgaggattcctgattgtggtgtgcttgcttctttaaagataaattcatcctttggaggaagtgactaccaagacatggtagatcaagctttgaacgagtactttaagtttgataggttcctagcaagaggagatgttttttgtatacaaaacagttggaactgtggctcaagctgctgcctggcatgcaataagcaggataataaactgcatccccgtaatatgatctactttaaggtgactggcatggaaccatcagatgaacctatacttcgtgttaattgcaatgaaacagcccttgtgcttggtggagctgcttctgccgcaatccccccttattccttctttgctgcttctggtaattcagtacctttgcaaagtgaaatagtggagcatttagcatctatcattgcgccagcattgtgcccttcggatattttaccaaaaatcaagttttctacttttttatatggcccgtcaggatgcggaaagcgcacagtggttcggcatgttgctaaccatcttggtctgcatgtggtcgagtgtagctgtcacgatctaatgacgtcatcagaaagtggggcacctgctgcacttgcaactgccttcaaagaagctcagaagtattctccttgtataatacttcttcgccactttgatgcaattgggaatgcatcctccaacgaaggtccacagtctgagcaatctgggattgcatcgagcattgaatctatcattaagcagtacactggacaatgttgggttgctaaggattcactgccagggaaagatgtaaatgggagctcataccttgtggagcctggatgtgtgagctcccttcaaattatactagttgcaactgcagacagttctgaaggaatgcaacagtcaattagaagatgcttccgccatgagatcgacatgaagactatgaatgaagaacagagaaacaaattgatatctgagatgcttcaaggcattcctaaagttgctgatgagagtattggtgacaagtttgtaaaagatttagcagcgcaaacgtcaggtttcatgcccagggacatacttgcactggtcgcagatgctggtgtgtcttttgcgcataaaattgcagcagggaaagatagcaaaggaatcagtaagcatgagatccttccagaaagctcttctgccactcaaaatgaggaaaaacatttctgcaaagaagatattatgtcttccatggaacgagccaagaaaaggaatcgtgctgcgctaggcacacccaaagttcctaatgtcaaatgggaggatgttggtgggctagaggaagtgaaaaaggttattctagatactattcagttgcctctgatgtacaagcacctgttttcttctaaattgcgcaagcgatcaggtgtcctgctatatggacctccaggaacagggaagaccttactcgcgaaagcagtagcaactgaatgctcattgaactttcttagcgtgaaaggtccagaactgataaacatgtatgttggagaatcagagaagaatgttcgggatatttttgaaaaggctagatctgcacgcccatgtgtcattttctttgatgagcttgattcccttgcccctgcacgaggatcctcagcagattctggcggtgttatggacagggttgtttcccaggaccttttcattattggggctaccaataggcctgaccttcttgattctgcccttcttcgccctggtcggtttgacaagctcctttatgtcggcgtaaatactgatgcatcatacagggaaaggatccttaaagcacagacgcgcaagtataagcttcacaagaatgtttctcttttgtcagttgctcagcgttgtccaccaaactttactggtgctgatatttatgcgctgtgtgcggatgcatggtttcacgcagcaaagcgatcagttaagacatttgaaattgatccttcaagaagtaatgatgccagtgctgaggaagtcattgtcgagatcgatgattttattacagtgttaggagacatcgcaccatcactatctctggaggagctacaaaactacgaacagttgaggcagaagattgaaggaccttctagatga

SEQ ID NO: 200 - protein, 915 aa, Sorghum bicolor
  misc_feature: Ceres ANNOT ID no. 6006918
  misc_feature (368)..(583): Pfam Id: AAA Pfam Desc: ATPase family associated with various cellular activities(AAA)
  misc_feature (680)..(856): Pfam Id: AAA Pfam Desc: ATPase family associated with various cellular activities(AAA)
  misc_feature (1)..(915): NCBI GI: 124360532 NCBI Desc: aaa atpase, central region; l-lactate dehydrogenase [medicago truncatula]
  misc_feature (4)..(914): NCBI GI: 19310449 NCBI Desc: at1g03000/f22d16.27 [arabidopsis thaliana]
  misc_feature (80)..(914): NCBI GI: 4587578 NCBI Desc: belongs to pf00004 atpases associated with various cellular activities. [arabidopsis thaliana]
  misc_feature (281)..(914): NCBI GI: 14571708 NCBI Desc: peroxin 6 [helianthus annuus]
  misc_feature (497)..(909): NCBI GI: 16923976 NCBI Desc: peroxisomal biogenesis factor 6 [rattus norvegicus]
  misc_feature: The sequence is a functional homolog of SEQ ID NO. 462 in the 11/188,298 US application
  misc_feature: The sequence is a functional homolog of SEQ ID NO. 471 in the 11/188,298 US application
MVEMRQRRKPLVLASTQALLDSLPGDRPPPPPLEPVCLRTGVLRFPSGPGAGAEFGELASFVALPASALRRLTVVTGTPVLVKNTDNNVGRIVKAVLFDDMSLRKSHSEYTDQVVSASPSDRAMGFLPCRMFPATGLASMDEVVAYVSPLLAFNLGLHVSCLKLLIQRGGQPFKFCSRAEEIDATAGAGSDLSLHLDLLPCPQVPKYALHLRVSVVRIPDCGVLASLKINSSFGGSDYQDMVDQALNEYFKFDRFLARGDVFCIQNSWNCGSSCCLACNKQDNKLHPRNMIYFKVTGMEPSDEPILRVNCNETALVLGGAASAAIPPYSFFAASGNSVPLQSEIVEHLASIIAPALCPSDILPKIKFSTFLYGPSGCGKRTVVRHVANHLGLHVVECSCHDLMTSSESGAPAALATAFKEAQKYSPCIILLRHFDAIGNASSNEGPQSEQSGIASSIESIIKQYTGQCWVAKDSLPGKDVNGSSYLVEPGCVSSLQIILVATADSSEGMQQSIRRCFRHEIDMKTMNEEQRNKLISEMLQGIPKVADESIGDKFVKDLAAQTSGFMPRDILALVADAGVSFAHKIAAGKDSKGISKHEILPESSSATQNEEKHFCKEDIMSSMERAKKRNRAALGTPKVPNVKWEDVGGLEEVKKVILDTIQLPLMYKHLFSSKLRKRSGVLLYGPPGTGKTLLAKAVATECSLNFLSVKGPELINMYVGESEKNVRDIFEKARSARPCVIFFDELDSLAPARGSSADSGGVMDRVVSQDLFIIGATNRPDLLDSALLRPGRFDKLLYVGVNTDASYRERILKAQTRKYKLHKNVSLLSVAQRCPPNFTGADIYALCADAWFHAAKRSVKTFEIDPSRSNDASAEEVIVEIDDFITVLGDIAPSLSLEELQNYEQLRQKIEGPSR

SEQ ID NO: 201 - DNA, 1650 bp, Sorghum bicolor
  misc_feature: Ceres ANNOT ID no. 6006931
  misc_feature: Encodes the peptide sequence at SEQ ID NO 202
atgcctcgatttatccggacccgctggcgtaatcgcaagccctggaaaccgggtgagcgcgccatcgccgctctccgcccggtccaccgctcccgcctcagctctgccataggtaagaagagttcatccctgcccctgcgtgcgtcgtcttatagtgatgaccgcgtcagtgccctcgccgacgatctgctgctcctcatcttacgccgcctggatacccgcagcgccctcgccactgcagccctttcaaagcgctgggctagcatcccacgcgagcttgacgccctcagtttcagtgtcaacgatattcttcctcggcgctaccaccagtgcatcaggatccacagggaagccaattttaatgcatatggctacttcgctaatttcagggcgctctgcgccaatgttgtgcgttatgagcgacatgccatgcgctccatgtccatctccatcaacaacttactggatgcggatgacatccatgacaatgaccctgatggccgaggtttgcggagtgtttctacactgagagttgagttctttgctacctggccctcctcgggctgcatcaaccgcttgatagccaaggctgtggacacttggggggttaaagatctcgaggtttcagcgaagtctacattctttaggcaggattcccacagttttcctcatcattgtctctgcaatgatccgcacaagtctcgcctgcgaagcctgaagctagcagcttgccatcttccagtattgcaggacttctgcacactcaccagtctggtcttgcaaggtttgccagactcaactccaactgcagcatatgtggctgtgttcaccttgtgcccacagctacaagcagtgcacatcaagtcttgcaatatcaagcaaggtgatatggctgtccatgcccccagatcagagattaagcagcttatcattgagcattgctattttggacggttcaagctgcacactctcccaatgcttgaaagcatggctgtcattgacacttcagtgtcttacaatcttagctccttcccatgcctcaaatacttgaatattacccgatgctatggcgtcttcaaaagacgtagagttccctgtatacctggttggaacctcaatatgtttcttgggggcaacccaggaataactgatcttgttgtccgctttactggatatgatagatggtttaagacatggagctccgcactgttgttacctaaactcaggaggctcctgatcgctgatgtgccttcatcctgggatgtttcttggccccgtctcctcatcgaagcggcaccgtgccttgagagccttcacatccatattagccgttgggaagaggatccttgtgatgacatcgtatggcaatcccctaagttctgccacaatcagcttaaggagttggtgataactggttttgaaggaacagaaagacagatttactttgttagctttgtcatgaaagtagcaacaaagttgcagtctgtttctttgttaaaaaatgggcttgttcagggcagaggccattgggactgggacatggtgaagcagcaacaccaatggggcaatgaagaaagaatcaacatacttaaccagattgctaaagatgttccttgctcaacaactcctgttcaagtggttctggagtaa

SEQ ID NO: 202 - protein, 549 aa, Sorghum bicolor
  misc_feature: Ceres ANNOT ID no. 6006931
  misc_feature (54)..(101): Pfam Id: F-box Pfam Desc: F-box domain
  misc_feature (47)..(548): NCBI GI: 115455907 NCBI Desc: os03g0796100 [oryza sativa (japonica cultivar-group)]
  misc_feature (53)..(515): NCBI GI: 21743052 NCBI Desc: osjnba0083d01.2 [oryza sativa (japonica cultivar-group)]
  misc_feature (53)..(549): NCBI GI: 38346115 NCBI Desc: osjnbb0006n15.10 [oryza sativa (japonica cultivar-group)]
  misc_feature (62)..(515): NCBI GI: 32526680 NCBI Desc: plant disease resistance polyprotein -like protein [oryza sativa (japonica cultivar-group)]
  misc_feature (39)..(211): NCBI GI: 21743054 NCBI Desc: osjnba0083d01.4 [oryza sativa (japonica cultivar-group)]
MPRFIRTRWRNRKPWKPGERAIAALRPVHRSRLSSAIGKKSSSLPLRASSYSDDRVSALADDLLLLILRRLDTRSALATAALSKRWASIPRELDALSFSVNDILPRRYHQCIRIHREANFNAYGYFANFRALCANVVRYERHAMRSMSISINNLLDADDIHDNDPDGRGLRSVSTLRVEFFATWPSSGCINRLIAKAVDTWGVKDLEVSAKSTFFRQDSHSFPHHCLCNDPHKSRLRSLKLAACHLPVLQDFCTLTSLVLQGLPDSTPTAAYVAVFTLCPQLQAVHIKSCNIKQGDMAVHAPRSEIKQLIIEHCYFGRFKLHTLPMLESMAVIDTSVSYNLSSFPCLKYLNITRCYGVFKRRRVPCIPGWNLNMFLGGNPGITDLVVRFTGYDRWFKTWSSALLLPKLRRLLIADVPSSWDVSWPRLLIEAAPCLESLHIHISRWEEDPCDDIVWQSPKFCHNQLKELVITGFEGTERQIYFVSFVMKVATKLQSVSLLKNGLVQGRGHWDWDMVKQQHQWGNEERINILNQIAKDVPCSTTPVQVVLE

SEQ ID NO: 203 - DNA, 1650 bp, Sorghum bicolor; identical to SEQ ID NO: 201
  misc_feature: Ceres ANNOT ID no. 6006935
  misc_feature: Encodes the peptide sequence at SEQ ID NO 204

SEQ ID NO: 204 - protein, 549 aa, Sorghum bicolor; identical to SEQ ID NO: 202
  misc_feature: Ceres ANNOT ID no. 6006935
  misc_feature (54)..(101): Pfam Id: F-box Pfam Desc: F-box domain
  misc_feature (47)..(548): NCBI GI: 115455907 NCBI Desc: os03g0796100 [oryza sativa (japonica cultivar-group)]
  misc_feature (53)..(515): NCBI GI: 21743052 NCBI Desc: osjnba0083d01.2 [oryza sativa (japonica cultivar-group)]
  misc_feature (53)..(549): NCBI GI: 38346115 NCBI Desc: osjnbb0006n15.10 [oryza sativa (japonica cultivar-group)]
  misc_feature (62)..(515): NCBI GI: 32526680 NCBI Desc: plant disease resistance polyprotein -like protein [oryza sativa (japonica cultivar-group)]
  misc_feature (39)..(211): NCBI GI: 21743054 NCBI Desc: osjnba0083d01.4 [oryza sativa (japonica cultivar-group)]

SEQ ID NO: 205 - DNA, 300 bp, Sorghum bicolor
  misc_feature: Ceres ANNOT ID no. 6006948
  misc_feature: Encodes the peptide sequence at SEQ ID NO 206
atgagctaccaggctcctcctcccggcaccgccgcctacccgccgccgggcacggcctaccctccgccgggccagcaggcgtaccctccgccgggccagcaggcgtaccctccgccgggccagcaggcgtacccgccgcctgcctacggcgcgccgccacccatggccgccggcgggtacccgccgccgccgccaccgcagcagcagcagcaggactccaagggcggcagcaacgacggcttcttgaaaggatgcttggccgcgctctgctgctgctgcatgctcgacatgtgcttctga

SEQ ID NO: 206 - protein, 99 aa, Sorghum bicolor
  misc_feature: Ceres ANNOT ID no. 6006948
  misc_feature (29)..(99): NCBI GI: 38344255 NCBI Desc: osjnba0008m17.8 [oryza sativa (japonica cultivar-group)]
  misc_feature (6)..(98): NCBI GI: 45736092 NCBI Desc: proline-rich protein family-like [oryza sativa (japonica cultivar-group)]
  misc_feature (7)..(99): NCBI GI: 42565788 NCBI Desc: proline-rich family protein [arabidopsis thaliana]
  misc_feature (6)..(98): NCBI GI: 115480077 NCBI Desc: os09g0510000 [oryza sativa (japonica cultivar-group)]
  misc_feature (5)..(99): NCBI GI: 44983857 NCBI Desc: aer212wp [eremothecium gossypii]
MSYQAPPPGTAAYPPPGTAYPPPGQQAYPPPGQQAYPPPGQQAYPPPAYGAPPPMAAGGYPPPPPPQQQQQDSKGGSNDGFLKGCLAALCCCCMLDMCF

SEQ ID NO: 207 - DNA, 1602 bp, Sorghum bicolor
  misc_feature: Ceres ANNOT ID no. 6006949
  misc_feature: Encodes the peptide sequence at SEQ ID NO 208
  misc_feature: Up-regulated in root tissues in response to salicylic acid treatment
atgacgttactggaggagttgttccgggcgatagagctctggcttcggattgcaaaggagcaggtgcccttggtcgatcccacccttgacccagtgttacttgttcctggtattgctggctccatccttgaagctgtcgatgaggaaggaaacaaggagagagtttgggtgcgcatccttgctgctgagcatgagttcagagagaagctctggtccaaattcgatgcctccactggtaaaactgtttctgttaacgagaaaacaagaattactgtccctgaggacagatatggtttgtacgccattgacacattagacccagacctgatcattggtgatgacactgtgtactactatcatgacatgatagtggaaatgattaagtggggatatcaagaaggaaaaactctctttggatttggttacgatttccgtcaaagcaataggctctcagagacacttgacagattttccaaaaagctggagtcagtgtacacatcttctggtggaaaaaagatcaatctcattacccattccatggggggattacttgtgaaatgtttcatctctctgcacagtgatgtatttgaaaaatatgtgaagagttggatcgcaattgctgcaccattccaaggtgcccctgggtacataactactagtctgctgaatggaatgtctttcgttgaaggatgggaatcaagattctttatttccaaatggtgtatgcagaaattgctacttgagtgcccatcaatctatgagttgctggcgaaccctaacttcaagtggaaagacaccccactgctacagatttggagagaaaatttggataacgatggcaagaaaagtgccctgttagagtcatatgagcctgaggaagcaattaagatgattgaaaaggctctttccagtaatgagatcattgctgatggcatgcatattccggtgccccttaatttggatatattgaattgggcaaaggaaacttatgatcttttaagcagtacaaagcttccggaatcagtgaaattctacaatatttatgggattgattatgatactccacatactgtctgctatggcagtgaaaagcatccggtttcaaatcttagtcacctcttatatgctcagggaaaatatgtctatgttgatggtgacgggtctgttcccacagaatcagcaaaggcagacggatttgatgcagtagcaagagttggtgttgctgctgaccaccggggaatcgtctgcagtcaccatgtgttccggatcgtccagcactggctgcacgcaggagaacctgacccgttctatgacccgctgaccgactacgttatactcccagcactctatgacatagagaagcattgtgagaaacatggggatgtcatgtcagttacggaggactgggagatcatctcccagagtgacggcaggaccacgaggccaggtgagcttcctcctatgatcagcacactgaccactagtcgggaaggcaaggagggcacactggaagaggcacaggccaccgtggtcgttcacccagagaaacaagggcggcagcatgtggaagttagggctgtgggtgtcagccatggtggctaa

SEQ ID NO: 208 - protein, 533 aa, Sorghum bicolor
  misc_feature: Ceres ANNOT ID no. 6006949
  misc_feature (52)..(418): Pfam Id: LACT Pfam Desc: Lecithin:cholesterol acyltransferase
  misc_feature (1)..(533): NCBI GI: 38344254 NCBI Desc: osjnba0008m17.7 [oryza sativa (japonica cultivar-group)]
  misc_feature (3)..(530): NCBI GI: 33317918 NCBI Desc: lecithine cholesterol acyltransferase-like protein [lycopersicon esculentum]
  misc_feature (1)..(530): NCBI GI: 124359659 NCBI Desc: lecithin:cholesterol acyltransferase [medicago truncatula]
  misc_feature (3)..(530): NCBI GI: 33312310 NCBI Desc: lecithine cholesterol acyltransferase-like protein [arabidopsis thaliana]
  misc_feature (30)..(428): NCBI GI: 33318329 NCBI Desc: phospholipase a1 [nicotiana tabacum]
  misc_feature: Up-regulated in root tissues in response to salicylic acid treatment
MTLLEELFRAIELWLRIAKEQVPLVDPTLDPVLLVPGIAGSILEAVDEEGNKERVWVRILAAEHEFREKLWSKFDASTGKTVSVNEKTRITVPEDRYGLYAIDTLDPDLIIGDDTVYYYHDMIVEMIKWGYQEGKTLFGFGYDFRQSNRLSETLDRFSKKLESVYTSSGGKKINLITHSMGGLLVKCFISLHSDVFEKYVKSWIAIAAPFQGAPGYITTSLLNGMSFVEGWESRFFISKWCMQKLLLECPSIYELLANPNFKWKDTPLLQIWRENLDNDGKKSALLESYEPEEAIKMIEKALSSNEIIADGMHIPVPLNLDILNWAKETYDLLSSTKLPESVKFYNIYGIDYDTPHTVCYGSEKHPVSNLSHLLYAQGKYVYVDGDGSVPTESAKADGFDAVARVGVAADHRGIVCSHHVFRIVQHWLHAGEPDPFYDPLTDYVILPALYDIEKHCEKHGDVMSVTEDWEIISQSDGRTTRPGELPPMISTLTTSREGKEGTLEEAQATVVVHPEKQGRQHVEVRAVGVSHGG

SEQ ID NO: 209 - DNA, 1518 bp, Sorghum bicolor
  misc_feature: Ceres ANNOT ID no. 6006953
  misc_feature: Encodes the peptide sequence at SEQ ID NO 210
  misc_feature: Up-regulated in root tissues in response to salicylic acid treatment
  misc_feature: Up-regulated in shoot tissues in response to salicylic acid treatment
atgatcgcgcgacgcctgctccgatccaatgcccccgcccagcatgtaactggcactgcgagtttgcaagggcatgcggatagtttgttggatgcctcagtcagacattttagttcagctccatctgcacagtctgcctcaactgaagaaaatgggtttaagggccatggcatgttggcaccttttacagctggctggcagagcaatgatttgcatccactgattattgagagatctgagggttcctatgtttatgacattaatgggaacaagtacctggattctcttgcaggattatggtgcacagcgttaggtggtagcgagcctcgattagtcaaagcagcaactgagcaattaaacaagttacccttctaccattccttttggaaccgtactaccaaaccttcgttggatcttgcacaggagatccttagcatattcactgcaaggaaaatgggaaaagttttcttcacaaacagcggttcagaagcaaatgactctcaggtcaaactagtatggtattataacaatgcattggggaggccaaacaagaagaaatttattgcacgatcaaaagcataccatggatctacattgatatcagcgagtctaactggtcttcctgccctgcaccagaagtttgatctaccagcaccttttgttctgcacactgactgccctcactactggagatatcatcttcctggtgagacagaagaagaatttgcgactagacttgccaccaatttagagaatcttattctcaaagaaggaccagaaacaatcgctgctttcattgctgaacctgtgatgggtgctggtggtgtcatccctcctccaaaaacctattttgaaaaggttcaagcagtggtcaagaagtatgacattcttttcatagcagatgaggttatcactgcatttggaaggttggggactatgtttggatgtgattattataacatcaagccagatctagtttcattggccaaggctctttcaaatgcctatgtacccatcggggcaactcttgttagccaagagatatcagatgtgattcattcccagagcaataagcttggttcatttgctcatgggtttacatactctggtcatccagttgcctgtgctgtggccatagaagctctgaaactttatcgcgaaagggatattcctggtcatgtcaagcaaatcgctccaaagttccaggacggaattagggcgttcgcagacagtccaattattggggagatacgcggcttagggatgataatgggaaccgaattcactaacaacaaatcaccgaccgatctattccctgccgaatggggggttggtgcgatctttggagaggagtgccagaagcgcggcatgttggtcagggttgccggcgacgcaatcatgatgtcgccgacgctgatcatgacacccgctgaagtcgacgagctggtgagcatctatggggaagccctcaaggccacggaggagagggtggcagccctgaaatccaagaagaactag

SEQ ID NO: 210 - protein, 505 aa, Sorghum bicolor
  misc_feature: Ceres ANNOT ID no. 6006953
  misc_feature (75)..(430): Pfam Id: Aminotran_3 Pfam Desc: Aminotransferase class-III
  misc_feature (1)..(505): NCBI GI: 116309877 NCBI Desc: osigba0126b18.7 [oryza sativa (indica cultivar-group)]
  misc_feature (1)..(505): NCBI GI: 38344251 NCBI Desc: osjnba0008m17.4 [oryza sativa (japonica cultivar-group)]
  misc_feature (14)..(504): NCBI GI: 38344250 NCBI Desc: osjnba0008m17.3 [oryza sativa (japonica cultivar-group)]
  misc_feature (14)..(504): NCBI GI: 116309876 NCBI Desc: osigba0126b18.6 [oryza sativa (indica cultivar-group)]
  misc_feature (14)..(504): NCBI GI: 29837282 NCBI Desc: gamma-aminobutyrate transaminase subunit precursor isozyme 1 [lycopersicon esculentum]
  misc_feature: Up-regulated in root tissues in response to salicylic acid treatment
  misc_feature: Up-regulated in shoot tissues in response to salicylic acid treatment
MIARRLLRSNAPAQHVTGTASLQGHADSLLDASVRHFSSAPSAQSASTEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSIFTARKMGKVFFTNSGSEANDSQVKLVWYYNNALGRPNKKKFIARSKAYHGSTLISASLTGLPALHQKFDLPAPFVLHTDCPHYWRYHLPGETEEEFATRLATNLENLILKEGPETIAAFIAEPVMGAGGVIPPPKTYFEKVQAVVKKYDILFIADEVITAFGRLGTMFGCDYYNIKPDLVSLAKALSNAYVPIGATLVSQEISDVIHSQSNKLGSFAHGFTYSGHPVACAVAIEALKLYRERDIPGHVKQIAPKFQDGIRAFADSPIIGEIRGLGMIMGTEFTNNKSPTDLFPAEWGVGAIFGEECQKRGMLVRVAGDAIMMSPTLIMTPAEVDELVSIYGEALKATEERVAALKSKKN

SEQ ID NO: 211 - DNA, 2742 bp, Sorghum bicolor
  misc_feature: Ceres ANNOT ID no. 6006954
  misc_feature: Encodes the peptide sequence at SEQ ID NO 212
atggcaccgagctccccgtcccccgccgcgcccacgcgtgtctccggccggaagcgtgccgccaaggcagaggagatccaggaggaggaggttgtggtggcgtcctccgccaagcgcagccgcaaggcgccgtcttccggcaagaagcccaagccgacgcccaagcaggccaaaccggccaaggcggcgaggaagaagaagggggaggccgagaggaaggagcccgtggaggacgacgtgtgtgccgaggagcccgatgaggaggagctggccatgggcgaggaggaggcggaggcggcggccgatgagcaggccatgcaggaggaggtggccgcggtcgtggccgggtcgcccgggaagaagagggtggggagaaggagcgccgccgctggcggcgaccacgagccggagttcgtcggcaacgccgttcccgcggccgaggcgcgcagcaactggcctaagcgctacgagcgcagcactgccgcaaagaaaccggaggaggacgaagagctcaatgccaagtgccactaccggagcgccaaggtggacaacgtcgtctactgcctcggggatgacgtctatgtcaaggctggagaaaatgaggcagattacattggccgcattactgaattttttgaagggactgatcggtgtcactattttacttgccgttggttcttccgtgcagaggatacggttatcaattctttggtgtccattaatgttgatggccacaagcatgaccctagacgtgtttttctttctgaggaaaagaatgacaatgtgcttgattgcatcatctccaaggtcaagatagtccatgtggatccaaatatggatccaaaagccaaggctcagctgatagagcattgtgacctatactatgacatgtcgtactctgttgcatattctacatttgctaatatctcatcagaaaatgggcagtcaggtagtgaaaccgcttcgggtatttcttctgatgatgtggatctggaggcgccatctagtatgccagagaggacagcaacccttcttgatctgtattctggctgtgggggcatgtccactggtctttgcttgggtgcagctctttctggcttgaaacttgaaactcgatgggctgttgatcttaacagttttgcgtgccaaagtttgaagtacaatcatccccagactgaagtgcgaaatgagaaagccgatgagtttcttgctctcctcaaggaatgggcagtcctatgtgagaaatatgtccatcaagatgtggattcgaatttagcaggttcagaggatcaagaggatgaaggcagccctcttgacaaggacgaatttgttgtagagaagcttattggaatatgctatggtggtagtggaaggaaagatggcatctattttaaggtccagtgggaaggatatggtcctgaagaggatacatgggaaccgattgataacctgagtgactgcccgctgaaaattagagagtttgtacaagaagggcacagaagaagaattctcccgctgcctggtgatgttgatgtcatatgtggaggtccaccatgtcaaggtatcagtgggtttaatcggttcagaaaccgtgatgagccacttaaagatgagaaaaacaagcaaatggtgactttcatggatattgtggcttacttgaagcccaagtatgttctcatggaaaatgttgtagacatactcaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtgctccctaagtatcctctgcctacatatgatgttgtagtacgtggaaacaccccaaatgccttttcgcaatgtatggttgcatatgatgagaaacaaaaaccacacctgaagaaagctttgcttcttggtgatgcaatttcagatttaccaaaggttgaaaaccatcaacctaaagaggtaatggagtatggtggttcccccaagacggaattccagcgttacattcgacttagtcgtaaagacatgttggattggtcctttggtgaggaggctggtccagacaaaggcaagctcttggatcaccagcccttacggcttaataacgatgattatgagcgggttcaacaaattcctgtcaagaagggagccaacttccgtgacctaaagggtgtcaaggttggagcaaacaatattgttgagtgggatccagaaatcgagcgtgtgaaactttcatctgggaaaccactggttcctgactatgcgatgtcattcatcaagggtaaatcactcaagccatttggacgcctgtggtgggatgagacagttcctacagttgtaaccagagcagagcctcacaaccagattatattgcatccgactcaagcaagagtcctgactatccgggagaacgcaaggttgcagggcttccctgattactaccgattgtttggccccatcaaggagaagtatattcaagttggaaatgcagtagctgtccctgttgcccgggcactgggctactgtctggggcaagcctacctgggcgaatctgaggggagtcaccctctgtaccagctgcctccaagtttcaccgctttggggcgaactgcggtgcaggcgagggcctctcctgttggcactcctgtaggggaggttgttgagcagtaa

SEQ ID NO: 212 - protein, 913 aa, Sorghum bicolor
  misc_feature: Ceres ANNOT ID no. 6006954
  misc_feature (443)..(497): Pfam Id: Chromo Pfam Desc: 'chromo' (CHRromatin Organisation MOdifier) domain
  misc_feature (342)..(869): Pfam Id: DNA_methylase Pfam Desc: C-5 cytosine-specific DNA methylase
  misc_feature (185)..(310): Pfam Id: BAH Pfam Desc: BAH domain
  misc_feature (1)..(913): NCBI GI: 13021690 NCBI Desc: dna cytosine methyltransferase met2a [zea mays]
  misc_feature (1)..(913): NCBI GI: 20977600 NCBI Desc: dna methyltransferase 105 [zea mays]
  misc_feature (1)..(913): NCBI GI: 13272199 NCBI Desc: chromomethylase [zea mays]
  misc_feature (180)..(913): NCBI GI: 68655470 NCBI Desc: chromomethylase 1 [hordeum vulgare subsp. vulgare]
  misc_feature (420)..(891): NCBI GI: 27529842 NCBI Desc: chromomethylase-like protein [nicotiana tabacum]
  misc_feature (1)..(913): SWISSPROT Homolog: EC 2.1.1.37 DNA (cytosine-5)-methyltransferase 1
MAPSSPSPAAPTRVSGRKRAAKAEEIQEEEVVVASSAKRSRKAPSSGKKPKPTPKQAKPAKAARKKKGEAERKEPVEDDVCAEEPDEEELAMGEEEAEAAADEQAMQEEVAAVVAGSPGKKRVGRRSAAAGGDHEPEFVGNAVPAAEARSNWPKRYERSTAAKKPEEDEELNAKCHYRSAKVDNVVYCLGDDVYVKAGENEADYIGRITEFFEGTDRCHYFTCRWFFRAEDTVINSLVSINVDGHKHDPRRVFLSEEKNDNVLDCIISKVKIVHVDPNMDPKAKAQLIEHCDLYYDMSYSVAYSTFANISSENGQSGSETASGISSDDVDLEAPSSMPERTATLLDLYSGCGGMSTGLCLGAALSGLKLETRWAVDLNSFACQSLKYNHPQTEVRNEKADEFLALLKEWAVLCEKYVHQDVDSNLAGSEDQEDEGSPLDKDEFVVEKLIGICYGGSGRKDGIYFKVQWEGYGPEEDTWEPIDNLSDCPLKIREFVQEGHRRRILPLPGDVDVICGGPPCQGISGFNRFRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGNTPNAFSQCMVAYDEKQKPHLKKALLLGDAISDLPKVENHQPKEVMEYGGSPKTEFQRYIRLSRKDMLDWSFGEEAGPDKGKLLDHQPLRLNNDDYERVQQIPVKKGANFRDLKGVKVGANNIVEWDPEIERVKLSSGKPLVPDYAMSFIKGKSLKPFGRLWWDETVPTVVTRAEPHNQIILHPTQARVLTIRENARLQGFPDYYRLFGPIKEKYIQVGNAVAVPVARALGYCLGQAYLGESEGSHPLYQLPPSFTALGRTAVQARASPVGTPVGEVVEQ

SEQ ID NO: 213 - DNA, 753 bp, Sorghum bicolor
  misc_feature: Ceres ANNOT ID no. 6006955
  misc_feature: Encodes the peptide sequence at SEQ ID NO 214
atggggcgtggaaaagtagagctcaagaagattgagaatccaacaaaccgccaagttaccttctccaagaggcggatggggttgttcaagaaggcaaacgagctagccattctttgtgatgcgcaaatcggagtcatcatattctctggaagtggcaggatgtatgagtactccagtcctccatggagatacctcaaagcccctagtacccgttttgaggagatggatatccagcagaaaatcatccaggagatgactaggatgaaggatgagaggaacaggctgaggatgatcatggcacagtacatgggggaggatctggccacattctccgtgcaagatctgagcaaccttgaacagcagatcgagttctcgctctacaaagttcgcctgaggaagcaagagctacttgaccaccagcagctgctcgagatccgccaaagggagatgcacataccaggagagcagagcggctacctatgcctcatgaaccaggctattgcgagggggcagcagcagcagcaggctcaggcaggcgagatggcgggaattaaccagaggccattcccgtggtgggacgtgggggccagtggcagtggcagccagagtcagcagcagcagctgcccggccgggacgcggcggagtcgtcgatgacggcgctgcagctgtcgccgcagctgcacgagtacaggctccagccacggcagcccaacctgcagcaggacgccaacgtccatggctggctctggtaa

SEQ ID NO: 214 - protein, 250 aa, Sorghum bicolor
  misc_feature: Ceres ANNOT ID no. 6006955
  misc_feature (9)..(59): Pfam Id: SRF-TF Pfam Desc: SRF-type transcription factor (DNA-binding and dimerisationdomain)
  misc_feature (64)..(166): Pfam Id: K-box Pfam Desc: K-box region
  misc_feature (1)..(229): NCBI GI: 116309872 NCBI Desc: osigba0126b18.2 [oryza sativa (indica cultivar-group)]
  misc_feature (1)..(148): NCBI GI: 75297944 NCBI Desc: mads-box transcription factor 31 (osmads31)
  misc_feature (1)..(148): NCBI GI: 30313681 NCBI Desc: transcription factor mads31 [oryza sativa (japonica cultivar-group)]
  misc_feature (1)..(240): NCBI GI: 75290460 NCBI Desc: mads-box transcription factor 29 (osmads29)
  misc_feature (1)..(240): NCBI GI: 66473798 NCBI Desc: fst [oryza sativa (japonica cultivar-group)]
  misc_feature: Abnormal phyllotaxy, leaf number higher than wild-type
  misc_feature: The plant flowers significantly earllier than wild-type.
  misc_feature: The sequence is a functional homolog of SEQ ID NO 14 in the 10/374,780US patent application
  misc_feature: The sequence is a functional homolog of SEQ ID NO 328 in the 10/225,066US patent application
  misc_feature: The sequence is a functional homolog of SEQ ID NO 34 in the 10/286,264US patent application
  misc_feature: The sequence is a functional homolog of SEQ ID NO 468 in the 11/435,388US patent application
  misc_feature: The sequence is a functional homolog of SEQ ID NO 68 in the 10/412,699US patent application
  misc_feature: The sequence is a functional homolog of SEQ ID NO 729 in the 10/666,642US patent application
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12958
  misc_feature: The sequence is a functional homolog of SEQ ID NO 34 in the 20030093837 US patent application
  misc_feature: The sequence is a functional homolog of SEQ ID NO 729 in the 20070033671 US patent application
  misc_feature: The sequence is a functional homolog of SEQ ID NO 729 in the 10/666,642 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1949 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO. 273 in the 11/188,298 US application
  misc_feature: The sequence is a functional homolog of SEQ ID NO. 359 in the 11/188,298 US application
  misc_feature: The sequence is a functional homolog of SEQ ID NO. 361 in the 11/188,298 US application
  misc_feature: The sequence is a functional homolog of SEQ ID NO. 518 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGKVELKKIENPTNRQVTFSKRRMGLFKKANELAILCDAQIGVIIFSGSGRMYEYSSPPWRYLKAPSTRFEEMDIQQKIIQEMTRMKDERNRLRMIMAQYMGEDLATFSVQDLSNLEQQIEFSLYKVRLRKQELLDHQQLLEIRQREMHIPGEQSGYLCLMNQAIARGQQQQQAQAGEMAGINQRPFPWWDVGASGSGSQSQQQQLPGRDAAESSMTALQLSPQLHEYRLQPRQPNLQQDANVHGWLW

SEQ ID NO: 215 - DNA, 894 bp, Sorghum bicolor
  misc_feature: Ceres ANNOT ID no. 6006956
  misc_feature: Encodes the peptide sequence at SEQ ID NO 216
atggagtccccgttccgcgcggacgtggtcaagggcaaggcggcgctggtcaccggcgggggatccggcatctgctttgagatcgccgcccagctcgcgcggcacggcgcgcaggtcgccatcatgggccgccgccgcgaggtcctcgacaaggccgtctccgcgctccgctcccagggcctccaggctgttggttttgatggagatgtccgcaagcaggaggatgcggacagagttctcgctgcgacagttgcgcatttcggcaagcttgacattcttgtaaatggtgcagccggcaacttccttgcttccccggaggatttgacgcccaagggattccggactgttcttgagattgacactttgggtacatacacaatgtgctatgaagccctcaagtatctgaaaaagggtgggcctggaaaaggcccgtccactggtggcctaatcattaacataagtgcaacactgcattacactgcgtcttggtaccaaattcatgtctctgctgctaaggctggggttgatagcatcacaagatcactggctctggaatggggaacagattatgacattagagtcaatgggattgcacctggaccaattcaagacaccccaggagtgaggaaacttgcacctgaagagatgagcaaggggctgcgagaactgatgccattattcaaatttggggagaagcaggacatagcaatggctgcactctaccttgcttctgatgcaggcaaatatgtaaatgggactacactagtggttgatggaggtctttggttaagtcaccctcgccatattcccaaagaggaagtgagggagctttcaaaggttgtcgagaaaaaagttaggacctctggtgttggtgcgccgaccagcaaattgtga

SEQ ID NO: 216 - protein, 297 aa, Sorghum bicolor
  misc_feature: Ceres ANNOT ID no. 6006956
  misc_feature (13)..(187): Pfam Id: adh_short Pfam Desc: short chain dehydrogenase
  misc_feature (1)..(297): NCBI GI: 38347363 NCBI Desc: osjnba0070c17.24 [oryza sativa (japonica cultivar-group)]
  misc_feature (5)..(263): NCBI GI: 121607231 NCBI Desc: short-chain dehydrogenase/reductase sdr [verminephrobacter eiseniae ef01-2]
  misc_feature (1)..(277): NCBI GI: 89286747 NCBI Desc: oxidoreductase, short chain dehydrogenase/reductase family protein [tetrahymena thermophila sb210]
  misc_feature (2)..(262): NCBI GI: 115375317 NCBI Desc: peroxisomal 2,4-dienoyl-coa reductase [stigmatella aurantiaca dw4/3-1]
  misc_feature (5)..(260): NCBI GI: 15805153 NCBI Desc: oxidoreductase, short-chain dehydrogenase/reductase family [deinococcus radiodurans r1]
  misc_feature (1)..(297): SWISSPROT Homolog: EC 1.3.1.34 Peroxisomal 2,4-dienoyl-CoA reductase
  misc_feature: The sequence is a functional homolog of SEQ ID NO. 389 in the 11/188,298 US application
MESPFRADVVKGKAALVTGGGSGICFEIAAQLARHGAQVAIMGRRREVLDKAVSALRSQGLQAVGFDGDVRKQEDADRVLAATVAHFGKLDILVNGAAGNFLASPEDLTPKGFRTVLEIDTLGTYTMCYEALKYLKKGGPGKGPSTGGLIINISATLHYTASWYQIHVSAAKAGVDSITRSLALEWGTDYDIRVNGIAPGPIQDTPGVRKLAPEEMSKGLRELMPLFKFGEKQDIAMAALYLASDAGKYVNGTTLVVDGGLWLSHPRHIPKEEVRELSKVVEKKVRTSGVGAPTSKL

SEQ ID NO: 217 - DNA, 2418 bp, Sorghum bicolor
  misc_feature: Ceres ANNOT ID no. 6006961
  misc_feature: Encodes the peptide sequence at SEQ ID NO 218
atggcatcgctgtcagaaagtgagctgacaaaccggggaagcatgtgggagctagatcagaaccttgatcaacccatggatgaggaggcgggcaggctgaagaatatgtacagagaaaagaagttctcgtcagctttattactacggctggcatttcagagccttggggtggtatttggtgacttgggcacgtcacctttatatgtgttctataatatatttcctcgtggaataggtgagggtgaggatgaggatgttattggagctctttccttgattatttacaccctcactctcataccacttctgaagtatgtatttgttgtcttgagggcaaatgacaatggtcaaggcggtacatttgctctttattccctattatgtcgtcatgcaaagatcaacaccatacctaatcaacacaggaccgatgaggaattgacgacatatagtcggcaaacctatgaagaaaattcagttgcagcaaaaataaagagatggatagagtcacatgcatataaaagaaacattcttcttattcttgttttaattggtacttgtacagcaattggagatgggatccttacacctgctatatctgttctttctgcatcaggtggcattaaggtccagaatcagaacatgagtactgatattgttgtgctcgtcgctgtggtcatcttaattggattgtttagcatgcaacactatggaacagataaagtgggatggctctttgcaccaatagttctcctctggttcatcctaattggaagcgtcggagctataaacatacacaagtatgataactctgtgttaaaagcatacaacccaatatatatataccgctttttccaacggagaaggaattctgatgtctggacgtctctgggaggaatcatgcttagcatcacaggaactgaagcgttatttgctgatctctgtcactttcctgtgttggcaattcagattgctttcaccttgattgtgtttccatgccttctactggcgtacacagggcaggctgcctacataatttccaacaaaacacatgtggctgacgccttctatcggtcaattccaggtgccatatactggccagcctttgtcatagcaactgctgcagcaattgtagcgagtcaagccaccatatctgcaacctactcaatcataaagcaagctcttgcacttggttgcttcccccgcgtgaagatagtccacacctcgaagaaattccttgggcagatttacatccctgacatcaactggatccttctggttctctgcattgctgtaactgctggattcaagaaccaaagccagataggaaatgcgtatggtactgcagtggttatagtgatgctagttacgacattcctgatggtgccaataatgctgctggtatggaagagccactggatcctggtggtcaccttcatcgtgctgtcgctcatggtggaggttccctacttcgtggcgtgcatcctgaagatcgaccagggcggctgggtgccgctggtggtggcgacggccttcttcgccatcatgtacgtgtggcacttctgcacggtgaagcggtacgagttcgagatgcacagcaaggtgtccatggcgtggatcctggggctgggtccgagcctgggcctggtgagggtccccgggatcggcttcgtgtacacggagctggcgagcggcgtgccgcacatcttctcccacttcatcaccaacctccccgcgatccactcggtggtggtgttcgtgtgcgtcaagtacctccccgtgtacacggtgccgacggaggagcggttcctggtgcggcggatcgggcccaagaacttccacatgttccggtgcgtggcgaggtacgggtacaaggacctgcacaagagggacgaggacttcgagaggatgctcttcgactgcgtcctcttcttcgtccggctggagagcatgatggagggatactccgactcggacgagttcagcgtgccggagcagatcaccagctccagccgcggccaggcggcgttcctgcagggcgagcgggcctgcgcgaccatgtgctccaacggcggcgagctgagcttctcgtcgcaggactcgatcgtgcccgccgcgcagtcgccgagggggctgcggctgcagctgcagctgcagtgctccgcgtcggcggtggggctggccagcggcggcgatacggtgggcgacgagctggagttcctgaaccggtgcaaggacgccggcgtggtgcacatcctcgggaacaccatcgtgcgcgcgcggcgggactcgggcgtcgtgaagaagctcgccgtcgactacatgtacgccttcatgaggagagtgtgcagggagaacagcgtcatcttcaacgtgccccatgagagcctgctcaacgtcggccagatatactacatctga

SEQ ID NO: 218 - protein, 805 aa, Sorghum bicolor
  misc_feature: Ceres ANNOT ID no. 6006961
  misc_feature (49)..(805): Pfam Id: K_trans Pfam Desc: K+ potassium transporter
  misc_feature (1)..(805): NCBI GI: 82592898 NCBI Desc: probable potassium transporter 11 (oshak11)
  misc_feature (1)..(805): NCBI GI: 113565430 NCBI Desc: os04g0613900 [oryza sativa (japonica cultivar-group)]
  misc_feature (188)..(805): NCBI GI: 38568028 NCBI Desc: osjnba0070c17.23 [oryza sativa (japonica cultivar-group)]
  misc_feature (4)..(662): NCBI GI: 79324347 NCBI Desc: kup11; potassium ion transporter [arabidopsis thaliana]
  misc_feature (161)..(805): NCBI GI: 115475283 NCBI Desc: os08g0206400 [oryza sativa (japonica cultivar-group)]
  misc_feature: The sequence is a functional homolog of SEQ ID NO. 279 in the 11/188,298 US application
MASLSESELTNRGSMWELDQNLDQPMDEEAGRLKNMYREKKFSSALLLRLAFQSLGVVFGDLGTSPLYVFYNIFPRGIGEGEDEDVIGALSLIIYTLTLIPLLKYVFVVLRANDNGQGGTFALYSLLCRHAKINTIPNQHRTDEELTTYSRQTYEENSVAAKIKRWIESHAYKRNILLILVLIGTCTAIGDGILTPAISVLSASGGIKVQNQNMSTDIVVLVAVVILIGLFSMQHYGTDKVGWLFAPIVLLWFILIGSVGAINIHKYDNSVLKAYNPIYIYRFFQRRRNSDVWTSLGGIMLSITGTEALFADLCHFPVLAIQIAFTLIVFPCLLLAYTGQAAYIISNKTHVADAFYRSIPGAIYWPAFVIATAAAIVASQATISATYSIIKQALALGCFPRVKIVHTSKKFLGQIYIPDINWILLVLCIAVTAGFKNQSQIGNAYGTAVVIVMLVTTFLMVPIMLLVWKSHWILVVTFIVLSLMVEVPYFVACILKIDQGGWVPLVVATAFFAIMYVWHFCTVKRYEFEMHSKVSMAWILGLGPSLGLVRVPGIGFVYTELASGVPHIFSHFITNLPAIHSVVVFVCVKYLPVYTVPTEERFLVRRIGPKNFHMFRCVARYGYKDLHKRDEDFERMLFDCVLFFVRLESMMEGYSDSDEFSVPEQITSSSRGQAAFLQGERACATMCSNGGELSFSSQDSIVPAAQSPRGLRLQLQLQCSASAVGLASGGDTVGDELEFLNRCKDAGVVHILGNTIVRARRDSGVVKKLAVDYMYAFMRRVCRENSVIFNVPHESLLNVGQIYYI

SEQ ID NO: 219 - DNA, 1788 bp, Sorghum bicolor
  misc_feature: Ceres ANNOT ID no. 6006962
  misc_feature: Encodes the peptide sequence at SEQ ID NO 220
atgccgctccacctgctctcgtccccggccgccgccgccaagctcgccgcaggcctgcgcgcggcgcctctccgtcgctgccacagcttcgccccggcgccgcgccacacggaccgtgtggccctggcgtcgtccctctcggtggcggcgcggtctgcaagccccgccgtggctgcggcgcagaccgagctcagcgtttcaggaaagaaacaagtattgatatcgttgtcggataaaacggacttggcttatcttggcaacggtcttcagggtttggggtattccatcgtctccaccggtggaacagcatccagcctggaagcagcaggagtcagtgtaacaaaagttgaagaaatcacacatttccctgaaatgcttgatggacgagtgaaaacattgcatccaagtatacatggtggtattcttgccaggagagaccaggagcatcatttgaaggcactgaaggatcatggaattgggacatttgatgtggttgtggtgaatttgtatcccttttatgacaaagtcacctctggtaacatctcttttgaggatggcattgaaaatattgatattggtggtcccacaatgatcagagctgcagccaagaaccataaggatgttcttattgtggtggatcataatgattaccctgctttactggagtaccttaaaaggaaagcaagaggatcagcagttccgcaggatgtttggcatggaaagcttttccagcatgttgcctcttacgattctgttgtgtcagaatggttttggaagcaatcgaataaagtaggagagatgtttcccccaagctttactgtgccacttgagctgaagtctacactccggtatggcgaaaatcctcatcagagtgctgcgttctatgctgacaagagcctttctcgtgttggtgctggtggtattgccactgctattcaacaccatggaaaggaaatgtcttacaacaattacttggatgcggatgctgcatggaactgcgtatcagagtttgatagtcctacttgtgttgtggtgaagcacacaaatccatgtggcgttgcttcacgacaggacattcttgaagcttacaggttagctgtaaagggagatgccgtcagtgcatttggtgggatagttgcattcaacacaacaattgatgaggatcttgcgaaggaaattcgtgagttcaggagtcctacagatggtcagacacggatgttctatgagatagtggttgctcccggctatacagataagggtcttgagattctccgaggcaagtcaaagacgctgagaatacttgaggcgaagagaagtggaaaagggatgctttcactcaggcaggtgagtggtgggtggttggctcaggagtctgatgatctaacccctgaagagatcacctttactgcaaagtctgagaggtctccgcaagaaaacgagcttgccgatgccaaatttgcctggctttgcgcaaaacatgtcaagagcaatgccattgtgatagccaagaacaactgcatgctgggaatgggcagtggtcagccaaacagacgagagagcgtcagaatcgccttcaggaaggcaggagaagaggccaagggagctgcattggctagcgacgccttctttccttttgcctggaacgacgccgttgaggaggcgtgtcagaatggcatcggaatcatcgctcagccaggaggcagtaagaaggacgaggacgccatcgcgtgctgcaacaagtacggcgtgtcgctcgtcctcaccggcgttagacacttcaagcattag

SEQ ID NO: 220 - protein, 595 aa, Sorghum bicolor
  misc_feature: Ceres ANNOT ID no. 6006962
  misc_feature (201)..(528): Pfam Id: AICARFT_IMPCHas Pfam Desc: AICARFT/IMPCHase bienzyme
  misc_feature (81)..(196): Pfam Id: MGS Pfam Desc: MGS-like domain
  misc_feature (27)..(595): NCBI GI: 11878280 NCBI Desc: phosphoribosylaminoimidazolecarboxamide formyltransferase/imp cyclohydrolase [nicotiana tabacum]
  misc_feature (48)..(595): NCBI GI: 28412960 NCBI Desc: aminoimidazolecarboximide ribonucleotide transformylase/inosine monophosphate cyclohydrolase [vigna unguiculata]
  misc_feature (67)..(595): NCBI GI: 140039558 NCBI Desc: aicarft/impchase bienzyme; mgs-like [medicago truncatula]
  misc_feature (71)..(595): NCBI GI: 73749102 NCBI Desc: phosphoribosylaminoimidazolecarboxamide formyltransferase [dehalococcoides sp. cbdb1]
  misc_feature (71)..(595): NCBI GI: 88932938 NCBI Desc: aicarft/impchase bienzyme [dehalococcoides sp. bav1]
MPLHLLSSPAAAAKLAAGLRAAPLRRCHSFAPAPRHTDRVALASSLSVAARSASPAVAAAQTELSVSGKKQVLISLSDKTDLAYLGNGLQGLGYSIVSTGGTASSLEAAGVSVTKVEEITHFPEMLDGRVKTLHPSIHGGILARRDQEHHLKALKDHGIGTFDVVVVNLYPFYDKVTSGNISFEDGIENIDIGGPTMIRAAAKNHKDVLIVVDHNDYPALLEYLKRKARGSAVPQDVWHGKLFQHVASYDSVVSEWFWKQSNKVGEMFPPSFTVPLELKSTLRYGENPHQSAAFYADKSLSRVGAGGIATAIQHHGKEMSYNNYLDADAAWNCVSEFDSPTCVVVKHTNPCGVASRQDILEAYRLAVKGDAVSAFGGIVAFNTTIDEDLAKEIREFRSPTDGQTRMFYEIVVAPGYTDKGLEILRGKSKTLRILEAKRSGKGMLSLRQVSGGWLAQESDDLTPEEITFTAKSERSPQENELADAKFAWLCAKHVKSNAIVIAKNNCMLGMGSGQPNRRESVRIAFRKAGEEAKGAALASDAFFPFAWNDAVEEACQNGIGIIAQPGGSKKDEDAIACCNKYGVSLVLTGVRHFKH

SEQ ID NO: 221 - DNA, 966 bp, Sorghum bicolor
  misc_feature: Ceres ANNOT ID no. 6006968
  misc_feature: Encodes the peptide sequence at SEQ ID NO 222
atggcgaacattcccccctccttcgccggggtctcgccgccgtccccctctccgatggctggaagcagcggtggcctggccccgggccaggcggccaaggataagaagatggcgtcggcggagcagctggtcctggagctctgcgaccctgaactgcgcgagaacgcgctgcttgagctctccaagaaaagggagatttttcaagatcttgccccgctgctttggcactcgtttggcacaattgctgcactactccaggagattatttctatttacccgtcactctcaccccctacgctgtcacctggagcatcaaaccgagtttgcaatgctcttgcacttctgcagtgtgttgcatcgcaccctgagaccaggatccttttcttaaatgctcatattccactgtacctgtacccattcctcaacactaccagcaaaacgagaccttttgagtacctaaggcttactagcttgggggtcatcggtgctcttgtcaaggttgatgatactgaagtcatcagttttttgctgcaaactgaaataattcctctgtgcttgcgaaccatggagatgggtagtgagctatccaaaactgtggcaactttcattgtccaaaagattcttctagatgatgttgggctgcgctacatttgtgccactgctgagcgcttctttgctgtaggcagtgttttagcaaacatggttgtttcacttgctgatcagccctccacaaggctgctgaagcacatcattcgctgttacctcaggctgtcagataaccctagggcctgtgctgcattgcagagctgccttccagacatgctcaaagatgggacattcaataactgtcttagggatgatccagcgacaaggcgctggctccaacagctcctgcacaatgtgacaggcggaggcatgggaggaggtcctcaaccaggcatggatcccatgaacatgggaatatga

SEQ ID NO: 222 - protein, 321 aa, Sorghum bicolor
  misc_feature: Ceres ANNOT ID no. 6006968
  misc_feature (42)..(304): Pfam Id: Rcd1 Pfam Desc: Cell differentiation family, Rcd1-like
  misc_feature (16)..(309): NCBI GI: 9294407 NCBI Desc: rcd1 [arabidopsis thaliana]
  misc_feature (41)..(301): NCBI GI: 121077911 NCBI Desc: required-for-cell-differentiation 1 protein [volvox carteri f. nagariensis]
  misc_feature (42)..(304): NCBI GI: 119591031 NCBI Desc: rcd1 required for cell differentiation1 homolog (s. pombe), isoform cra_b [homo sapiens]
  misc_feature (42)..(304): NCBI GI: 47938747 NCBI Desc: mgc78923 protein [xenopus laevis]
  misc_feature (23)..(317): NCBI GI: 116117043 NCBI Desc: ensangp00000015668 [anopheles gambiae str. pest]
MANIPPSFAGVSPPSPSPMAGSSGGLAPGQAAKDKKMASAEQLVLELCDPELRENALLELSKKREIFQDLAPLLWHSFGTIAALLQEIISIYPSLSPPTLSPGASNRVCNALALLQCVASHPETRILFLNAHIPLYLYPFLNTTSKTRPFEYLRLTSLGVIGALVKVDDTEVISFLLQTEIIPLCLRTMEMGSELSKTVATFIVQKILLDDVGLRYICATAERFFAVGSVLANMVVSLADQPSTRLLKHIIRCYLRLSDNPRACAALQSCLPDMLKDGTFNNCLRDDPATRRWLQQLLHNVTGGGMGGGPQPGMDPMNMGI

SEQ ID NO: 223 - DNA, 888 bp, Sorghum bicolor
  misc_feature: Ceres ANNOT ID no. 6006969
  misc_feature: Encodes the peptide sequence at SEQ ID NO 224
atggcgttcctccttcccaagctcacaacgccgtcaggcccgtcatgcaagttgcccccgagtcccctcctcaagccccagctagcccagccgggccacagcggcggcaagatccaaggctccgtctccggcgctggcgctgcgcaggtcgcggccccgggccacctcagtctccttctcctactcagcgccccgcagcaggcagcggacccagcgtccaagtccacggcgaccaagaaccggggcaagggcggcggggatccgcaaaggtcggatttttacctcaacctcgggacggcggtgcgcacgctgcgggacgacctgcccgacgtcttcgaccgggaacccaactacgatatctaccgtgaagacatcacatttgtcgacccactaaacacttttcatgggattgacaactacaagactatcttctgggcacttagattccatgggcgcctactattcagagaaattgggcttgatgtatcacgcatttggcaactgacagagacttcaatagttgtccggtgggagctgtggggcactccacgtgtcccatgggaatcatatggctgcttcagtgggacgtcgagatacaaggttgacaggaatgggaaaatttacgagcacaaagtcgacaacttggcattggacttcccacgatcagtagcgaaagtgggcagcattgctgacatggtagtcgccacaccaagccccaatttaacgttttggaatgtggttgggccaggtgatggttgctcatggacaaagctttatgaagccgtggtggaagctgtggaacgggaagaacatggttccactggcattggcgttggaggtctacctgtaccctgcagctttggctgcggctgtggcagcagtttttga

SEQ ID NO: 224 - protein, 295 aa, Sorghum bicolor
  misc_feature: Ceres ANNOT ID no. 6006969
  misc_feature (1)..(286): NCBI GI: 38347356 NCBI Desc: osjnba0070c17.17 [oryza sativa (japonica cultivar-group)]
  misc_feature (61)..(244): NCBI GI: 115462667 NCBI Desc: os05g0215600 [oryza sativa (japonica cultivar-group)]
  misc_feature (39)..(122): NCBI GI: 115435348 NCBI Desc: os01g0221500 [oryza sativa (japonica cultivar-group)]
  misc_feature: Useful for making plants with modulated drought sensitivity
  misc_feature: Useful for making plants with modulated nitrogen use efficiency
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13482
  misc_feature: GREAT-hit functional homolog of the protein sequence given in SEQ ID NO 13483
  misc_feature: Useful for making plants with modulated nitrogen use efficiency
  misc_feature: Functional homolog of the protein sequence given in SEQ ID NO 13483
MAFLLPKLTTPSGPSCKLPPSPLLKPQLAQPGHSGGKIQGSVSGAGAAQVAAPGHLSLLLLLSAPQQAADPASKSTATKNRGKGGGDPQRSDFYLNLGTAVRTLRDDLPDVFDREPNYDIYREDITFVDPLNTFHGIDNYKTIFWALRFHGRLLFREIGLDVSRIWQLTETSIVVRWELWGTPRVPWESYGCFSGTSRYKVDRNGKIYEHKVDNLALDFPRSVAKVGSIADMVVATPSPNLTFWNVVGPGDGCSWTKLYEAVVEAVEREEHGSTGIGVGGLPVPCSFGCGCGSSF

SEQ ID NO: 225 - DNA, 1095 bp, Sorghum bicolor
  misc_feature: Ceres ANNOT ID no. 6006974
  misc_feature: Encodes the peptide sequence at SEQ ID NO 226
  misc_feature: Up-regulated in root tissues in response to salicylic acid treatment
atgggggctgtgaagcataccttgaaagtgtttccatggctcctactcttcgcacaattggctgtagccactacctccaagtgcacaaatgccacaaatgggactgagactgacagcctgggtgctatgaaactgaagctgattgccattgcatccatcctcacagctggagcagctggtgtgctggtgccagtacttgggcgctccatggccgcgctacatcctgatggtgacatctttttcgctgtcaaggcatttgcagctggtgtcatcctggccacaggcatggtccacattctgccagcagcatttgatgggctgacatccccatgcctctacaaaggtggcagtggtgggaacattttcccctttgcaggcctcattgcaatgtctgctgcaatggctacaatggtgatagactcactagctgctgggtactaccgccggtctcacttcaagaaggcacggccaatcgacaacctagagatccatgaacaacctggagatgaggagaggactgggcatgcacaacatgtgcatgtgcacacccatgcaacacatggccattcacacggagaggcagatggcatcaattcaccagaggaggcttcaatagctgacacaatccggcacagggtggtccttgagcttggaatcttggtgcattcagtgataattggggtgtccttaggtgcatctgtgaggccaaacaccatcaggcctcttgttggtgcccttagcttccatcaattctttgaaggcattggcttgggtggttgcattgtgcaggcaaatttcaagttgcgagctaccgtcatgatggcaatttttttctccctgactgcacccattggcattgcattagggattgcaatttcatctagctacaatggccatagcactacagccttcattgttgaaggagtgttcaactcagcctcagcaggaattttgatctacatgtcattagtcgatcttctggccacagatttcaataaacccaaactgcagacgaatacaaagcttcagctgatgacataccttgcacttttcttaggtgcagggatgatgtccatgcttgctatatgggcatag

SEQ ID NO: 226 - protein, 364 aa, Sorghum bicolor
  misc_feature: Ceres ANNOT ID no. 6006974
  misc_feature (43)..(361): Pfam Id: Zip Pfam Desc: ZIP Zinc transporter
  misc_feature (1)..(364): NCBI GI: 58221593 NCBI Desc: zinc transporter zip [triticum aestivum]
  misc_feature (8)..(364): NCBI GI: 60592456 NCBI Desc: zinc transporter protein zip2 [fragaria x ananassa]
  misc_feature (8)..(364): NCBI GI: 60592454 NCBI Desc: zinc transporter protein zip1 [fragaria x ananassa]
  misc_feature (1)..(364): NCBI GI: 38036019 NCBI Desc: metal transport protein [medicago truncatula]
  misc_feature (1)..(364): NCBI GI: 38036047 NCBI Desc: metal transport protein [medicago truncatula]
  misc_feature: Up-regulated in root tissues in response to salicylic acid treatment
  misc_feature: The sequence is a functional homolog of SEQ ID NO. 287 in the 11/188,298 US application
MGAVKHTLKVFPWLLLFAQLAVATTSKCTNATNGTETDSLGAMKLKLIAIASILTAGAAGVLVPVLGRSMAALHPDGDIFFAVKAFAAGVILATGMVHILPAAFDGLTSPCLYKGGSGGNIFPFAGLIAMSAAMATMVIDSLAAGYYRRSHFKKARPIDNLEIHEQPGDEERTGHAQHVHVHTHATHGHSHGEADGINSPEEASIADTIRHRVVLELGILVHSVIIGVSLGASVRPNTIRPLVGALSFHQFFEGIGLGGCIVQANFKLRATVMMAIFFSLTAPIGIALGIAISSSYNGHSTTAFIVEGVFNSASAGILIYMSLVDLLATDFNKPKLQTNTKLQLMTYLALFLGAGMMSMLAIWA

SEQ ID NO: 227 - DNA, 984 bp, Sorghum bicolor
  misc_feature: Ceres ANNOT ID no. 6006976
  misc_feature: Encodes the peptide sequence at SEQ ID NO 228
  misc_feature: Down-regulated in root tissues in response to methyl jasmonate treatment
atggggagcaactcgaatcaccaaaccgacgagacgacagagcggagtcgaggactcgagagcaccctcccggatctctctaccaccagcgcctcgtcgccgccgtccactgccgcagcgatggcctcccccgacctgctcttcaatctgcggaacctcttctacctgggcgcctaccaggcggccatcaacaacagcgacgtcccgggcctcgacgccgacgcagccgccgagcgcgacgccatcgtcttccgctcctacatcgccctcggctcctaccagctggtgatcagcgagatcgactcgtcggccgcgacctcgctgcaggccgtgaagctgctcgcgctgtacctcaccggagacaaggaaggtgctatctccagtctcaaggaatggttgagcgattcagcaattggaagcaatcctgttttgcgattgattgctggaattatatttatgcatgagcaggactacaatgaggctctcaagcacacacactctggaggaactctggatttgcatgcattgaatgtacagatcttcatcaagatgcatcgttcagactatgctgagaagcaattgaagatcatgcaacaaattgatgaagaccacacactgacacaacttgcaaatgcatggctgggcattgctgttggtggctctaagatccgtgaagcttatctcatattccaagacttcgctgaaaagtacccaatgacagggatggttctaaatgggaaggcagtctgctgtatgcacatgggaagctttgaggaggccgagactctattgcttgaagcgctgaacaaggatgcaaaagatcctgaaactcttgccaatctaattgtatgcaatctccaccttggcaaaccatcatcacgattcctcagccaactgaagctatcgcatcctgatcatgtgctcgttaagaacgcggcatcatcagaagcaaccttcgagagggccctccaagctgtcgcttga

SEQ ID NO: 228 - protein, 327 aa, Sorghum bicolor
  misc_feature: Ceres ANNOT ID no. 6006976
  misc_feature (43)..(327): Pfam Id: Coatomer_E Pfam Desc: Coatomer epsilon subunit
  misc_feature (41)..(327): NCBI GI: 7677264 NCBI Desc: epsilon-cop [zea mays]
  misc_feature (41)..(327): NCBI GI: 21593069 NCBI Desc: coatomer-like protein, epsilon subunit [arabidopsis thaliana]
  misc_feature (41)..(325): NCBI GI: 7670062 NCBI Desc: epsilon1-cop [glycine max]
  misc_feature (41)..(327): NCBI GI: 56311392 NCBI Desc: coatomer epsilon subunit [medicago truncatula]
  misc_feature (43)..(325): NCBI GI: 7670064 NCBI Desc: epsilon2-cop [glycine max]
  misc_feature: Down-regulated in root tissues in response to methyl jasmonate treatment
MGSNSNHQTDETTERSRGLESTLPDLSTTSASSPPSTAAAMASPDLLFNLRNLFYLGAYQAAINNSDVPGLDADAAAERDAIVFRSYIALGSYQLVISEIDSSAATSLQAVKLLALYLTGDKEGAISSLKEWLSDSAIGSNPVLRLIAGIIFMHEQDYNEALKHTHSGGTLDLHALNVQIFIKMHRSDYAEKQLKIMQQIDEDHTLTQLANAWLGIAVGGSKIREAYLIFQDFAEKYPMTGMVLNGKAVCCMHMGSFEEAETLLLEALNKDAKDPETLANLIVCNLHLGKPSSRFLSQLKLSHPDHVLVKNAASSEATFERALQAVA

SEQ ID NO: 229 - DNA, 447 bp, Sorghum bicolor
  misc_feature: Ceres ANNOT ID no. 6006977
  misc_feature: Encodes the peptide sequence at SEQ ID NO 230
atggccacgaccacgaacaaccgccgcattgtggccctcctgctggccacactgctcgcgcaggccgcggcgtgcccctactgcccgacgccgacgccgccaccgccgccgccgccgccgaaggtgaagccgccgccgtcgtccacgccgtgccctcccccgccctactcgccgtcgacgccgacgggaaagtgccccgtgaacacgctgaagctgctggcgtgcgtggacgcgctcaacggcctcgtgcacgccgtcatcgggaccaaggcaagcgacacctgctgcccgctgctctccggcgtggccgacctcgacgccgcgctctgcctctgcaccaccatcaaggccaaggcgctcagcgtcagcgtcgtgctccccgtcgccatctcggtgctcgtcaacgagtgcggcaagcacgtgccctccagcttcacgtgcccgtaa

SEQ ID NO: 230 - protein, 148 aa, Sorghum bicolor
  misc_feature: Ceres ANNOT ID no. 6006977
  misc_feature (65)..(147): Pfam Id: Tryp_alpha_amyl Pfam Desc: Protease inhibitor/seed storage/LTP family
  misc_feature (22)..(148): NCBI GI: 38568018 NCBI Desc: osjnba0070c17.10 [oryza sativa (japonica cultivar-group)]
  misc_feature (29)..(148): NCBI GI: 1657851 NCBI Desc: cold acclimation protein wcor518 [triticum aestivum]
  misc_feature (26)..(148): NCBI GI: 433707 NCBI Desc: prolin rich protein [zea mays]
  misc_feature (26)..(148): NCBI GI: 437329 NCBI Desc: hybrid proline-rich protein;cytokinin-induced;haustoria
  misc_feature (26)..(148): NCBI GI: 19390 NCBI Desc: proline rich protein [lycopersicon esculentum]
  misc_feature: Useful for making plants with modulated salt sensitivity
  misc_feature: Functional homolog of the protein sequence given in SEQ ID NO 13766
  misc_feature: Useful for making plants with modulated oxidative stress sensitivity
  misc_feature: Functional homolog of the protein sequence given in SEQ ID NO 13086
MATTTNNRRIVALLLATLLAQAAACPYCPTPTPPPPPPPPKVKPPPSSTPCPPPPYSPSTPTGKCPVNTLKLLACVDALNGLVHAVIGTKASDTCCPLLSGVADLDAALCLCTTIKAKALSVSVVLPVAISVLVNECGKHVPSSFTCP

SEQ ID NO: 231 - DNA, 1188 bp, Sorghum bicolor
  misc_feature: Ceres ANNOT ID no. 6006986
  misc_feature: Encodes the peptide sequence at SEQ ID NO 232
atggcgtcctccctcctctccaccccgtcccgaaccctagccccggcccccgcccccgccggcctccgggggcgggcgccggcccaggcgcacctcccgcgcggcgtcgccctcggcccccgccgcagccgcgcgctccgcgtgcgcgcctcggtggcgatcgagaaggagacgccggagagcgagccgccgccgacgttcctccgcgaggacgggcagggcgccgggtccgggtccgtgcgggcgcggttcgaggccatgatccggcgggtgcagggggaggtctgcgccgcgctcgaggaggccgacggcggcggcgcgcgcttcgtcgaggacgtctggtcgcgccccggcggcggcgggggcatcagccgcgtcctgcaggacggccgcgtcttcgagaaggccggggtcaacgtctccgtcgtctacggcgtcatgccgcccgacgcctaccgcgccgccaagggggaggccggcaagaacggggccgccgccgcggatggccagaagcctggccccgtgccgttcttcgccgcggggattagttcggtgcttcaccccaagaatccatttgctccaacattgcattttaactaccgttactttgagacggatgcatcaaaagatgcacctggtgcaccaagacaatggtggtttggcggtggtactgacttgactccttcatacatcatcgaagaggatgtgaagcatttccattctgttcaaaagcaagcatgtgataaatttgatccaagttttcacccaagattcaaaaaatggtgtgatgattatttttatattaagcaccgtaatgagcggcgtgggcttggtggaatattttttgatgaccttaatgattatgatcaagaaatgcttctcaactttgctacagaatgtgcggactctgtacttcctgcatacataccaatcgtagaacggcggaaggacactccattcaatgaggagcacaaagcatggcagcaattgcggagaggtcgttatgtggagttcaaccttgtctacgaccgtggtacaacattcggcctaaagactggaggaaggattgagagcatactcgtgtcccttccactcacagcacggtgggagtatgatcataaaccggaagaagggaccgaggaatggaaacttctggacgcgtgcataaacccgaaggattggatctga

SEQ ID NO: 232 - protein, 395 aa, Sorghum bicolor
  misc_feature: Ceres ANNOT ID no. 6006986
  misc_feature (77)..(395): Pfam Id: Coprogen_oxidas Pfam Desc: Coproporphyrinogen III oxidase
  misc_feature (1)..(395): NCBI GI: 82469921 NCBI Desc: plastid coproporphyrinogen iii oxidase [zea mays]
  misc_feature (1)..(395): NCBI GI: 38345797 NCBI Desc: osjnba0085i10.14 [oryza sativa (japonica cultivar-group)]
  misc_feature (1)..(395): NCBI GI: 116309971 NCBI Desc: osigba0152l12.9 [oryza sativa (indica cultivar-group)]
  misc_feature (41)..(395): NCBI GI: 82469923 NCBI Desc: coproporphyrinogen iii oxidase [zea mays]
  misc_feature (1)..(395): NCBI GI: 2493809 NCBI Desc: coproporphyrinogen iii oxidase, chloroplast precursor (coproporphyrinogenase) (coprogen oxidase)
  misc_feature (1)..(395): SWISSPROT Homolog: EC 1.3.3.3 Coproporphyrinogen III oxidase, chloroplast precursor
MASSLLSTPSRTLAPAPAPAGLRGRAPAQAHLPRGVALGPRRSRALRVRASVAIEKETPESEPPPTFLREDGQGAGSGSVRARFEAMIRRVQGEVCAALEEADGGGARFVEDVWSRPGGGGGISRVLQDGRVFEKAGVNVSVVYGVMPPDAYRAAKGEAGKNGAAAADGQKPGPVPFFAAGISSVLHPKNPFAPTLHFNYRYFETDASKDAPGAPRQWWFGGGTDLTPSYIIEEDVKHFHSVQKQACDKFDPSFHPRFKKWCDDYFYIKHRNERRGLGGIFFDDLNDYDQEMLLNFATECADSVLPAYIPIVERRKDTPFNEEHKAWQQLRRGRYVEFNLVYDRGTTFGLKTGGRIESILVSLPLTARWEYDHKPEEGTEEWKLLDACINPKDWI

SEQ ID NO: 233 - DNA, 2559 bp, Sorghum bicolor
  misc_feature: Ceres ANNOT ID no. 6006989
  misc_feature: Encodes the peptide sequence at SEQ ID NO 234
atggcgtcgtcggcggaatcgtcggcggccggcggcatgcggaaggcgccgtcgctggaatggcggtgggtgtccacggaggaggatgacgacgaggaccgcgccggggccgggacccccgcggccgtcggggcggtgggcaggggcgggagcttcgagtcggaggacgacgaggatgacgaggaggaggaggaggaggagaagaagaaggggaggaagaggctgatccggaccgtgccgtccgtggactggttcgacgtcgaggggaacgaggtgtccgtcgcgcagcagctcgacgactccgaggagtttgattttggcaggacaatgtttcttgctcttcagactcttgctgtggtgtttggagatattggaattggtccattgtatacatttgatgtcatgtttaccaagtaccctattgttggagaggatgatgttcttggagcactctcactagttctgtatactcttatattgatgccattagtgaagtatgttttggttgtcctttgggccaatgatgacggtgaaggtggtatatttgccttgtattctttgatttgtagaaatgcaaaagtgagtctcattcccaaccaagtacagtctgagaagaggatgtcaagttttcgactcaagcttccaacaccagagcttgagagatccataaaagtaaaagagaaacttgaatcatcactactgttgaagaagttgcttctaggcttagtcttgtttgggacttctatgttcatatccaatggagttatcacaccagcaatgtcagtgttatctgctgtcagtggcttgaaagttgggctaccaaatacctcacaagatgctgttgtgatgatttcagttgcacttcttgtagtattgtttagtgtacagaggtatgccactagcaaagtggggtttgcaattggcccttctttacttttatggttttgttgccttggagggattggaatatacaatctgagtctatatggcccaacagcttttaaggcatttaatcctctctacattatttattattttgggaggaatccttttcaggcttggctgtccctcggtggttgtcttttatgtgcaacaggatctgaggccatcttttcgaatctttgttactttcccgtaagatatgttcagtatatgtttgtgcttcttgttcttccttgccttgtcttggcgtatctaggacaagctgcctttctcattgcgaaccaaaagtcatctgagcaggtcttcttttcatctattccaagtggacttttctggcctgttttcttagtggcgaatctggctgcactaattgccagtaggacaatgacggttgctatattccagtgcctaaagcagtctatagcacttggttgttttccccggctcaaaattgttcatacatctcgaaaatttatggctaagatatacattcccgttgtaaactggtttctgttggtttcctgcttgggctttatcattctgttcggaaacatatatgatgttggcaatgcatatgctattgctgaggttggggtgatgataatggccacggtttatgttacaataataatgcttctaatatgggagttcaatattatgaaggttctgtcatttgttatcacattcctattcttggagctgattttcttctcgtcggctctgagcagtgttggagatgggggctgggcgttgttgatttttgcatctgttctactcatgatcatgtttatatggaactacgggagcatactaaagtatgacagtgaagtcaagcagaagctttcaaaggatttgatgaggaagttggggcccaaccttggtaccatcagagctcctggactaggcttagtctgcagtgatattgtgaaaggagttcctgcaatttttggtcattttctgacctccctccctgcgatacactcgataattgtatttgtgtgtatcaggaatgtgccagttcctgtggttccccaaagtgaaaggtttcttttccaacgcgtatgctcaaggggctatcacatgttccgctgtatagcgagatatgggtacaaagacaagaagcaagagcaccatagtgtatttgagcgtcttctgattgaaggcctcgagaaattcatacaaagagaggcagtagagctatccctacaaagcgaagacgacgtcgactcggatgaagagcctccgacccctgtgaagattatcacagcaccaaacggcagcctctactcactcgacgtccctctgctggcagactatgtgccttcaacagaactcattcctgaagccagctgctcaacaccccagcacgatcctgtactggactatgcacagaaccttgaactggagctagcattcatcaagcagtccaagcggtccggggctgtctacctcattgacaaccccatcgtcaaggccaggaaggactcgtggttcttcaagaagctgatgataaactatttctttgcattcctgaggaacaactgccgccgggcgatcatgttgatgagcatcccgcactcgaacatgatgcaggtgcgcatgacttcttatgtctga

SEQ ID NO: 234 - protein, 852 aa, Sorghum bicolor
  misc_feature: Ceres ANNOT ID no. 6006989
  misc_feature (111)..(852): Pfam Id: K_trans Pfam Desc: K+ potassium transporter
  misc_feature (2)..(852): NCBI GI: 75143740 NCBI Desc: probable potassium transporter 15 (oshak15)
  misc_feature (2)..(852): NCBI GI: 38345796 NCBI Desc: osjnba0085i10.13 [oryza sativa (japonica cultivar-group)]
  misc_feature (2)..(852): NCBI GI: 116309970 NCBI Desc: osigba0152l12.8 [oryza sativa (indica cultivar-group)]
  misc_feature (25)..(852): NCBI GI: 38503183 NCBI Desc: potassium transporter 7 (atpot7) (athak7)
  misc_feature (2)..(848): NCBI GI: 75118707 NCBI Desc: probable potassium transporter 14 (oshak14)
  misc_feature: The sequence is a functional homolog of SEQ ID NO. 279 in the 11/188,298 US application
MASSAESSAAGGMRKAPSLEWRWVSTEEDDDEDRAGAGTPAAVGAVGRGGSFESEDDEDDEEEEEEEKKKGRKRLIRTVPSVDWFDVEGNEVSVAQQLDDSEEFDFGRTMFLALQTLAVVFGDIGIGPLYTFDVMFTKYPIVGEDDVLGALSLVLYTLILMPLVKYVLVVLWANDDGEGGIFALYSLICRNAKVSLIPNQVQSEKRMSSFRLKLPTPELERSIKVKEKLESSLLLKKLLLGLVLFGTSMFISNGVITPAMSVLSAVSGLKVGLPNTSQDAVVMISVALLVVLFSVQRYATSKVGFAIGPSLLLWFCCLGGIGIYNLSLYGPTAFKAFNPLYIIYYFGRNPFQAWLSLGGCLLCATGSEAIFSNLCYFPVRYVQYMFVLLVLPCLVLAYLGQAAFLIANQKSSEQVFFSSIPSGLFWPVFLVANLAALIASRTMTVAIFQCLKQSIALGCFPRLKIVHTSRKFMAKIYIPVVNWFLLVSCLGFIILFGNIYDVGNAYAIAEVGVMIMATVYVTIIMLLIWEFNIMKVLSFVITFLFLELIFFSSALSSVGDGGWALLIFASVLLMIMFIWNYGSILKYDSEVKQKLSKDLMRKLGPNLGTIRAPGLGLVCSDIVKGVPAIFGHFLTSLPAIHSIIVFVCIRNVPVPVVPQSERFLFQRVCSRGYHMFRCIARYGYKDKKQEHHSVFERLLIEGLEKFIQREAVELSLQSEDDVDSDEEPPTPVKIITAPNGSLYSLDVPLLADYVPSTELIPEASCSTPQHDPVLDYAQNLELELAFIKQSKRSGAVYLIDNPIVKARKDSWFFKKLMINYFFAFLRNNCRRAIMLMSIPHSNMMQVRMTSYV

SEQ ID NO: 235 - DNA, 1170 bp, Sorghum bicolor
  misc_feature: Ceres ANNOT ID no. 6007012
  misc_feature: Encodes the peptide sequence at SEQ ID NO 236
atggaaggagatggagaggcgaagaaagaggtgaacatgtcacagttggctggcgttcagtttcttctcaacaatgaaggaaaggaagtacctctgtcctccattgaagggaagacgacctgcctcttcttctcagctcactggtgcaggccatgcaggagcttcaccccaaatcttgtccagatctacacagcgctccggaacaccggcaagaatattgaaataatcttcatatcactggaccatgacgaggcaagcttctgggatcacttcaaaggcatgtcgtggcttgcgttaccatttgacactggcttaagtcaaaagttgtgtgcgcactttggcattgagcatatccccgcattgatccctttgtcagcaacaccatccagtggggtgggatttgaagaggatgcagtgaggctggttgacgagtatggagaagatgcataccccttcagtgcacagaggagaagggagctggaggccatggatgatgccaggagaaaaggaggtaagcttcaggagcttcttggctgcaaggagagagactatgtcataagtgcagatgacataaagattcctatagctgaccttactggcaagacagtcggcctgtattttggagcacattggtgcccaccttgccatgtattcaccaaacaactcaaggaggtgtataatgagctgaaaatcttgagacctgaaagcttcgaggtcatcttcatttctatagaccgcaataagggggaattccaagcaagcatgagttcaatgccatggcttgccatcccttattctgacactgccaggcaaaagcttacaagaatcttcgctgtcaagggcatcccaggactcctgatacttggtttggatggtaaagttctaaaaacagatggcaggacagcaatatcaacttatggtgcaacagcattcccattcacggaatctagagtttctgaagtggatgaagccctcagaaaggaaggagacaagctgcctcgccaagtgaatgatccaaaacacagacacgtgcttgagttggacatggctaaggcctatgtttgtgatgaatgccagaagaaggggaggtattgggtgttctcctgtaagcagtgcaactttgatcttcatccctcttgtgtattagaaaataaaatagacatcatctaa

SEQ ID NO: 236 - protein, 389 aa, Sorghum bicolor
  misc_feature: Ceres ANNOT ID no. 6007012
  misc_feature (353)..(381): Pfam Id: C1_3 Pfam Desc: C1-like domain
  misc_feature (2)..(384): NCBI GI: 115460430 NCBI Desc: os04g0608600 [oryza sativa (japonica cultivar-group)]
  misc_feature (2)..(384): NCBI GI: 51477394 NCBI Desc: protein disulfide isomerase (pdi)-like protein 3 [cucumis melo]
  misc_feature (2)..(382): NCBI GI: 21592996 NCBI Desc: pdi-like protein [arabidopsis thaliana]
  misc_feature (2)..(388): NCBI GI: 53370754 NCBI Desc: c1-like domain containing protein [oryza sativa (japonica cultivar-group)]
  misc_feature (2)..(388): NCBI GI: 115453461 NCBI Desc: os03g0405900 [oryza sativa (japonica cultivar-group)]
MEGDGEAKKEVNMSQLAGVQFLLNNEGKEVPLSSIEGKTTCLFFSAHWCRPCRSFTPNLVQIYTALRNTGKNIEIIFISLDHDEASFWDHFKGMSWLALPFDTGLSQKLCAHFGIEHIPALIPLSATPSSGVGFEEDAVRLVDEYGEDAYPFSAQRRRELEAMDDARRKGGKLQELLGCKERDYVISADDIKIPIADLTGKTVGLYFGAHWCPPCHVFTKQLKEVYNELKILRPESFEVIFISIDRNKGEFQASMSSMPWLAIPYSDTARQKLTRIFAVKGIPGLLILGLDGKVLKTDGRTAISTYGATAFPFTESRVSEVDEALRKEGDKLPRQVNDPKHRHVLELDMAKAYVCDECQKKGRYWVFSCKQCNFDLHPSCVLENKIDII

SEQ ID NO: 237 - DNA, 516 bp, Sorghum bicolor
  misc_feature: Ceres ANNOT ID no. 6007020
  misc_feature: Encodes the peptide sequence at SEQ ID NO 238
atggagcagtccggcgccaagaagtcgaacaagatcaccgagatcgtgcgcatgcagcagatgctgaagaagtggcgcaagctctcggtcacccccaaggacaaggagccaagctcgcccaccgccgccggcggcggcggcaatgccggcgagagcaaggccaagaagttcctgaagcggacgctttccttcacggacggcccgccgtcgggctcccctccgccgccgcccaagggccacctcgccgtgtgcgtgggccccgcgatgcagaggttcgtgatcccgatggagtacctgaagcaccgcgccttcgcggcgctgctgcgggaggccgaggaggagttcggcttccagcaggagggcgtgctccgcatcccctgcgaggtccccgtcttcgagtccatcctcaaggccgtcgagaagaacaagaaggacgccgccttctgttactgcagcgtcgagtacgccgccgacgaggtcggacgtggcacgcccaacaacccgctctgcagatag

SEQ ID NO: 238 - protein, 171 aa, Sorghum bicolor
  misc_feature: Ceres ANNOT ID no. 6007020
  misc_feature (27)..(140): Pfam Id: Auxin_inducible Pfam Desc: Auxin responsive protein
  misc_feature (70)..(155): NCBI GI: 45736190 NCBI Desc: auxin-induced protein-like [oryza sativa (japonica cultivar-group)]
  misc_feature (1)..(145): NCBI GI: 79328260 NCBI Desc: calmodulin binding [arabidopsis thaliana]
  misc_feature (70)..(133): NCBI GI: 115444179 NCBI Desc: os02g0143400 [oryza sativa (japonica cultivar-group)]
  misc_feature (1)..(147): NCBI GI: 24943206 NCBI Desc: auxin-regulated protein [phaseolus vulgaris]
  misc_feature (77)..(141): NCBI GI: 92870682 NCBI Desc: auxin responsive saur protein [medicago truncatula]
  misc_feature: Useful for making plants with modulated cold sensitivity
  misc_feature: GREAT-hit functional homolog of the protein sequence encoded by LOCUS at2g24400
MEQSGAKKSNKITEIVRMQQMLKKWRKLSVTPKDKEPSSPTAAGGGGNAGESKAKKFLKRTLSFTDGPPSGSPPPPPKGHLAVCVGPAMQRFVIPMEYLKHRAFAALLREAEEEFGFQQEGVLRIPCEVPVFESILKAVEKNKKDAAFCYCSVEYAADEVGRGTPNNPLCR

SEQ ID NO: 239 - DNA, 663 bp, Sorghum bicolor
  misc_feature: Ceres ANNOT ID no. 6007028
  misc_feature: Encodes the peptide sequence at SEQ ID NO 240
atgtccgcttccgctgcggccgcctcccccgccctccgcttctcctccgccactccaccactagctcctctccatcgaccgccccgccggcggctcccgaccgtccggtgctccctcgccgccgcccccggtgtccgggcgccaccggagctcgtcgactccatcctctccaaggtgaagggaactgaccgtggagtgctgctgcctcaagaaggtcaccaggaagtggctgatgtcgcgctgcagctagggaagtactgcatagacgaccccgtcaagtccccgcttatatttggagaatgggaggtcatgtactgctcggtgccaacctcgccaggagggctttaccggacgcctctgggccgcctgatattcaaaactgatgagatgattcaggtggtggaagcacctgacatagtgaggaacaaggtgtcattctccatctttggcctagagggcgcagtatcattgaaaggtaagctgaatgtgttggacagtaaatggattcaggtcatatttgaagccccggaattgaaggtaggctccttggggttccaatacggtggcgagagtgaagtcaagctggagatcacctacgtcgacgagaagatcaggctaggaaaaggatccagaggctcgctcttcgtcttccttagacgatga

SEQ ID NO: 240 - protein, 220 aa, Sorghum bicolor
  misc_feature: Ceres ANNOT ID no. 6007028
  misc_feature (49)..(218): Pfam Id: PAP_fibrillin Pfam Desc: PAP_fibrillin
  misc_feature (4)..(220): NCBI GI: 38346556 NCBI Desc: osjnba0035m09.17 [oryza sativa (japonica cultivar-group)]
  misc_feature (4)..(220): NCBI GI: 116309738 NCBI Desc: osigba0113i13.8 [oryza sativa (indica cultivar-group)]
  misc_feature (5)..(216): NCBI GI: 115472009 NCBI Desc: os07g0470700 [oryza sativa (japonica cultivar-group)]
  misc_feature (55)..(174): NCBI GI: 67923185 NCBI Desc: pap fibrillin [crocosphaera watsonii wh 8501]
  misc_feature (53)..(216): NCBI GI: 92873786 NCBI Desc: pap fibrillin [medicago truncatula]
MSASAAAASPALRFSSATPPLAPLHRPPRRRLPTVRCSLAAAPGVRAPPELVDSILSKVKGTDRGVLLPQEGHQEVADVALQLGKYCIDDPVKSPLIFGEWEVMYCSVPTSPGGLYRTPLGRLIFKTDEMIQVVEAPDIVRNKVSFSIFGLEGAVSLKGKLNVLDSKWIQVIFEAPELKVGSLGFQYGGESEVKLEITYVDEKIRLGKGSRGSLFVFLRR

SEQ ID NO: 241 - DNA, 3279 bp, Sorghum bicolor
  misc_feature: Ceres ANNOT ID no. 6007042
  misc_feature: Encodes the peptide sequence at SEQ ID NO 242
atggagtcctcttcgtcgggcggcgggctggcgctgcggcggaatagcggcggcggcggcggtggcggcagcagcggccggggcagcttcggcggcgacgccgacccgttcgacatccccgctaagggcgcacccctcgagcggctcaggaagtggaggcaagcagcccttgtgctgaatgcatcaaggcgctttaggtacactctcgatttgaaaaaggaggaacaaaaggaggaaatcaggagaaaaatccgtgcacaggcacatgttataagggccgcttttcgtttcaaagaggctggccgaatccatgttcagtctgaagaaacaaaagtacctagtgctgatggggcacttggcttcggaatcaaagaagaccagcttacagcactgacaagggatcacaactactctggtctgcagcaatacggaggggtttctggtgtagcacatatgctaaaaaccgatacagagaaggggattagtggagatgactcagatttgatggcaaggaaaaatgcatttggatcaaatacatatcctcgtaagaaaggaagaagctttttggcttttgtgtgggatgcttgtaaagatttgacgctaatcatcctcatggttgctgctgctgtttcactggccttgggcataacaacagagggcataaaagaaggctggtatgatggagcgagcattgcctttgctgttcttctagttgtatttgttacagctatcagtgactacaagcaatcactgcaattccaaaatctgaatgaagaaaaacagaacattcgtttggaggttgttagaggtggaaggcgaatcatggtatcaatatatgatttggttgttggagatgttgttccactcaaaattggtgaccaggtccctgcagatggtatccttgtctgtgggcactccctttccatagatgaatcaagcatgacgggagaaagtaaaattgtacacaaagatcagaagtcaccatttttaatgtcaggttgcaaagttgctgatggctatggcacaatgctggtaactgctgttggaatcaacactgaatggggattgctaatggcaagcatatctgaagattcgggtgaagagacaccacttcaggttcgtttgaatggtgtcgctactttcattggaatggttggactgtctgttgctcttgcagttctggttgtacttttggccaggtacttcactgggcatacttataatcctgatggatctgtgcaatatgtgaaagggaagatgggtgtaggccagacgatacgtggagtagttagaatattcacagtggctgtcaccattgtggtcgtggctgttccagaaggactaccattagctgtcacactgacgcttgctttctcaatgcgcaaaatgatgaaggacaaggctctggtgaggaggctttctgcatgtgaaacgatgggttccgccacaacaatctgcagtgacaagactggcaccttgactttaaatcagatgactgttgttgaggcatattttggtggaaagaagatggactcacctgataatgctcagatgttatctgctgatgtcacatcgctgattgttgaaggaattgcacagaacacttctggaagcatatttgagcccgagcatggtggtcaagaaccggaggtgactggatcacctacagaaaaggctatactgtcttgggggctaaagctgggtatgaaattcaatgaaacaagatcgaaatcatctattcttcatgtatttcctttcaactcagagaaaaagcgaggcggggttgcggtgcacctgggtggctctgaggtccatatacactggaaaggagcagctgaaattattttggattcatgcacaggctgggttgacactgatggttcgaagcattcaatgactccagaaaaagttgctgaattcaagaaatttattgaagacatggctgctgcaagcctccgctgtgttgcgtttgcctatagaactcatgagatggatgatgttccagacgaagatcacagggaagagtggaaactgcctgaagataacctgattatgcttggcattgtgggaataaaggatccctgccgtccaggagttcgagattctgttcgtttatgtcaggcagctggcattaaggtgcgtatggttactggtgataatcttcaaaccgcaagagccattgccctggagtgcgggatacttgatgatcccaatgtgttggagcctgtcatcattgaaggaaaaacattccgggcactgtcagacttagaaagggaggaagctgctgaaaaaatctctgtgatggggaggtcttcaccaaatgataaactattacttgttaaggcactgagggcaagaggtcacgttgttgctgttactggagatggcacaaatgatgccccagcactgcatgaggcagatattggtctatcaatgggcattcagggaactgaagttgccaaggagagttctgatattattatcttggatgataattttgcatcagtcgtgagggttgtcagatggggtcgttcggtgtatgcaaacatacagaagtttatacagttccaactaacggtcaacgtcgcagctctgataatcaatgtagttgctgccgtcagttctggaaacgtgccgttgaatgctgtccagttgctgtgggttaacctaattatggacactttgggtgcccttgcattggcgacagaaccaccgacaaaccatcttatggagagaccccccgtagggagaagggagccattgataacaaatatcatgtggagaaacctgattatcatggctttgtttcaagtttcagtccttcttactctcaacttcaagggaataagcctcttgcagttgaaaaatgatgataaagcacatgcagataaagtgaaaaataccttcatattcaacacatttgttctctgccaggtgttcaacgaattcaattcacgtaaaccagatgagctcaatatattcaagggcatttcagggaaccacctctttattggcatcatagcaataacagttatactccaggcgcttatcgttgagttccttggcaagtttgcctcaacagtaaagttaagctggcagctgtggttggtatccataggccttgctttcttcagctggccgctggcattcgtgggaaagcttattcctgttcctagacgtccacttggagaattcttcacctgctgctgtagggggagcaaacaagcccctgatgacgcaacctctaatgacaaggaagacaacaaacccgagccttga

SEQ ID NO: 242 - protein, 1092 aa, Sorghum bicolor
  misc_feature: Ceres ANNOT ID no. 6007042
  misc_feature (230)..(478): Pfam Id: E1-E2_ATPase Pfam Desc: E1-E2 ATPase
  misc_feature (482)..(816): Pfam Id: Hydrolase Pfam Desc: haloacid dehalogenase-like hydrolase
  misc_feature (912)..(1059): Pfam Id: Cation_ATPase_C Pfam Desc: Cation transporting ATPase, C-terminus
  misc_feature (138)..(216): Pfam Id: Cation_ATPase_N Pfam Desc: Cation transporter/ATPase, N-terminus
  misc_feature (1)..(1086): NCBI GI: 38346912 NCBI Desc: osjnbb0015n08.12 [oryza sativa (japonica cultivar-group)]
  misc_feature (11)..(1062): NCBI GI: 8919831 NCBI Desc: plasma membrane ca2+-atpase [arabidopsis thaliana]
  misc_feature (11)..(1062): NCBI GI: 8843813 NCBI Desc: ca2+-transporting atpase-like protein [arabidopsis thaliana]
  misc_feature (35)..(1066): NCBI GI: 9280219 NCBI Desc: ca2+-transporting atpase [arabidopsis thaliana]
  misc_feature (146)..(1074): NCBI GI: 115444569 NCBI Desc: os02g0176700 [oryza sativa (japonica cultivar-group)]
  misc_feature (11)..(1062): SWISSPROT Homolog: EC 3.6.3.8 Calcium-transporting ATPase 8, plasma membrane-type
MESSSSGGGLALRRNSGGGGGGGSSGRGSFGGDADPFDIPAKGAPLERLRKWRQAALVLNASRRFRYTLDLKKEEQKEEIRRKIRAQAHVIRAAFRFKEAGRIHVQSEETKVPSADGALGFGIKEDQLTALTRDHNYSGLQQYGGVSGVAHMLKTDTEKGISGDDSDLMARKNAFGSNTYPRKKGRSFLAFVWDACKDLTLIILMVAAAVSLALGITTEGIKEGWYDGASIAFAVLLVVFVTAISDYKQSLQFQNLNEEKQNIRLEVVRGGRRIMVSIYDLVVGDVVPLKIGDQVPADGILVCGHSLSIDESSMTGESKIVHKDQKSPFLMSGCKVADGYGTMLVTAVGINTEWGLLMASISEDSGEETPLQVRLNGVATFIGMVGLSVALAVLVVLLARYFTGHTYNPDGSVQYVKGKMGVGQTIRGVVRIFTVAVTIVVVAVPEGLPLAVTLTLAFSMRKMMKDKALVRRLSACETMGSATTICSDKTGTLTLNQMTVVEAYFGGKKMDSPDNAQMLSADVTSLIVEGIAQNTSGSIFEPEHGGQEPEVTGSPTEKAILSWGLKLGMKFNETRSKSSILHVFPFNSEKKRGGVAVHLGGSEVHIHWKGAAEIILDSCTGWVDTDGSKHSMTPEKVAEFKKFIEDMAAASLRCVAFAYRTHEMDDVPDEDHREEWKLPEDNLIMLGIVGIKDPCRPGVRDSVRLCQAAGIKVRMVTGDNLQTARAIALECGILDDPNVLEPVIIEGKTFRALSDLEREEAAEKISVMGRSSPNDKLLLVKALRARGHVVAVTGDGTNDAPALHEADIGLSMGIQGTEVAKESSDIIILDDNFASVVRVVRWGRSVYANIQKFIQFQLTVNVAALIINVVAAVSSGNVPLNAVQLLWVNLIMDTLGALALATEPPTNHLMERPPVGRREPLITNIMWRNLIIMALFQVSVLLTLNFKGISLLQLKNDDKAHADKVKNTFIFNTFVLCQVFNEFNSRKPDELNIFKGISGNHLFIGIIAITVILQALIVEFLGKFASTVKLSWQLWLVSIGLAFFSWPLAFVGKLIPVPRRPLGEFFTCCCRGSKQAPDDATSNDKEDNKPEP

SEQ ID NO: 243 - DNA, 1125 bp, Sorghum bicolor
  misc_feature: Ceres ANNOT ID no. 6007065
  misc_feature: Encodes the peptide sequence at SEQ ID NO 244
atggatgagcacatgggaagacgaacagttggcggcctcctcttcaccaagggaggctcaattcttctcttcagagaagacggttcgcgccccaagtccaagaactgctgctcgcgccatggctgtagtggtcagcattctgctgacaaagccaaaggcaaggaggtgcacagggcggcggcgcccaatgaatcaacgccagccacccctgggagatcacagatttttcggaagcccaacagaaagcctccacatgaaagcagtgcttcaggcagcatcagcagggatgcaggaggctcttgtagcgaaaccggcaacaggtcaagagacactcctgggcccgggcgtgatctactggctaggcttaaggagagggtcaacacatcaaggaaacgatcgttgaacagggagaacagcccacagtcaccgagtggattcagtgctggttccccgagcaatagtcgatcggtctcaaggccgtcgcatcgggcagcttcgaggataagaaaagctgatgaaggtgcagcaaatgcaggagctgacggtgtgcgcagaaatggtgctggagatgctaggaggagttcagagaggagtgacgacgacttgctgctagttgagcaggtaacaagaaaccatgtgccttctgaagggtttctttctggattcatggcgagatacagaagcggccttcagggagacctttcatctctggacgacagcatggaggactcaaatggatacttgcgctttgatgtgggtggaatagaagagcttgagaactacttcatattcaatgatcggcatagaggaatgaggatggatatcgacggcatgtcctacgaagagctgcttgctttgggagagcgaattggtactgtaaacactggtctttcagacaatgcattgtccacgtgcctgaacaggagcctctacatgcccacagcttcaggttctcatgaagattgtgaaagaaaatgcagcatatgccaggaggagtatttagccggcgaggaggtgggaaagatggcatgtaagcactactaccacctttcctgcatacagcattggcttcggcagaagaactggtgtcctatctgcaaatctgttgccctgaaaatcaactag

SEQ ID NO: 244 - protein, 374 aa, Sorghum bicolor
  misc_feature: Ceres ANNOT ID no. 6007065
  misc_feature (326)..(366): Pfam Id: zf-C3HC4 Pfam Desc: Zinc finger, C3HC4 type (RING finger)
  misc_feature (1)..(374): NCBI GI: 38344153 NCBI Desc: osjnba0041a02.20 [oryza sativa (japonica cultivar-group)]
  misc_feature (1)..(374): NCBI GI: 116309663 NCBI Desc: osigba0118p15.2 [oryza sativa (indica cultivar-group)]
  misc_feature (1)..(330): NCBI GI: 115460358 NCBI Desc: os04g0603200 [oryza sativa (japonica cultivar-group)]
  misc_feature (262)..(370): NCBI GI: 58652060 NCBI Desc: at5g10650 [arabidopsis thaliana]
  misc_feature (262)..(370): NCBI GI: 20466428 NCBI Desc: pspzf zinc finger protein-like [arabidopsis thaliana]
  misc_feature: Useful for making plants with altered Lignin content
  misc_feature: Functional homolog of the protein sequence given in SEQ ID NO 13036
  misc_feature: The sequence is a functional homolog of SEQ ID NO. 271 in the 11/188,298 US application
  misc_feature: The sequence is a functional homolog of SEQ ID NO. 329 in the 11/188,298 US application
MDEHMGRRTVGGLLFTKGGSILLFREDGSRPKSKNCCSRHGCSGQHSADKAKGKEVHRAAAPNESTPATPGRSQIFRKPNRKPPHESSASGSISRDAGGSCSETGNRSRDTPGPGRDLLARLKERVNTSRKRSLNRENSPQSPSGFSAGSPSNSRSVSRPSHRAASRIRKADEGAANAGADGVRRNGAGDARRSSERSDDDLLLVEQVTRNHVPSEGFLSGFMARYRSGLQGDLSSLDDSMEDSNGYLRFDVGGIEELENYFIFNDRHRGMRMDIDGMSYEELLALGERIGTVNTGLSDNALSTCLNRSLYMPTASGSHEDCERKCSICQEEYLAGEEVGKMACKHYYHLSCIQHWLRQKNWCPICKSVALKIN

SEQ ID NO: 245 - DNA, 1125 bp, Sorghum bicolor; identical to SEQ ID NO: 243
  misc_feature: Ceres ANNOT ID no. 6007067
  misc_feature: Encodes the peptide sequence at SEQ ID NO 246

SEQ ID NO: 246 - protein, 374 aa, Sorghum bicolor; identical to SEQ ID NO: 244
  misc_feature: Ceres ANNOT ID no. 6007067
  misc_feature (326)..(366): Pfam Id: zf-C3HC4 Pfam Desc: Zinc finger, C3HC4 type (RING finger)
  misc_feature (1)..(374): NCBI GI: 38344153 NCBI Desc: osjnba0041a02.20 [oryza sativa (japonica cultivar-group)]
  misc_feature (1)..(374): NCBI GI: 116309663 NCBI Desc: osigba0118p15.2 [oryza sativa (indica cultivar-group)]
  misc_feature (1)..(330): NCBI GI: 115460358 NCBI Desc: os04g0603200 [oryza sativa (japonica cultivar-group)]
  misc_feature (262)..(370): NCBI GI: 58652060 NCBI Desc: at5g10650 [arabidopsis thaliana]
  misc_feature (262)..(370): NCBI GI: 20466428 NCBI Desc: pspzf zinc finger protein-like [arabidopsis thaliana]
  misc_feature: Useful for making plants with altered Lignin content
  misc_feature: Functional homolog of the protein sequence given in SEQ ID NO 13036
  misc_feature: The sequence is a functional homolog of SEQ ID NO. 271 in the 11/188,298 US application
  misc_feature: The sequence is a functional homolog of SEQ ID NO. 329 in the 11/188,298 US application

SEQ ID NO: 247 - DNA, 969 bp, Sorghum bicolor
  misc_feature: Ceres ANNOT ID no. 6007068
  misc_feature: Encodes the peptide sequence at SEQ ID NO 248
atggccaccgtgtcgtcgtcctcgacgccgccaacgccgcaccggccatccgtggagcgcacgaagggtcccaccggcctcgagaagctcgtcctccgcgagtcgcgcggctggtccgcggaggtccatatttatggaggtcaagtaacctcttggaagaatgaccatggagatgaattgctttttatgagcagcaaggccattttcaagcctccaaaagcaatccatggtggaatacccatttgttttccccaatttggaacacatggaaatcttgagaaacatggatttgcaaggaaccgtttctgggctattgatgataatcctccacctttcccagtaaacactgctataaaaacttttgctgatctcattctgaagccttctgaagaagatctcaagatttggcctcatagctttgaatttcgattaagagttgctcttgcgcctggaggagatttgattctcacttctcgaatcagaaatacaaatattgatggaagacctttctcatttacttttgcataccatacgtacttctcggtatctgacataagtgaagtacgtgttgaagggctggagaccttggactaccttgacaaccttacaaaagagcgattcacagagcaaggagatgcaatcgtgtttgaaacagagattgacaaaatttatttagacgtgccatcaaaagttgcgataattgatcatgagaagaaaagaacatatgtcttaagaaaagatgggcttccggatactgttttatggaacccatgggataagaggtcaaaaatcatgcaagatttcggagatgaagaatacaaacacatgctgtgcgttggacctgcaaatgttgagaaacacattaccttgaaacctggtgaagagtggaaaggaaagatggagctcacagctgttccttccagttactatagtggacagttagatccagagaaggttcttcagggatga

SEQ ID NO: 248 - protein, 322 aa, Sorghum bicolor
  misc_feature: Ceres ANNOT ID no. 6007068
  misc_feature (28)..(303): Pfam Id: Aldose_epim Pfam Desc: Aldose 1-epimerase
  misc_feature (1)..(322): NCBI GI: 38344152 NCBI Desc: osjnba0041a02.19 [oryza sativa (japonica cultivar-group)]
  misc_feature (1)..(322): NCBI GI: 116309662 NCBI Desc: osigba0118p15.1 [oryza sativa (indica cultivar-group)]
  misc_feature (21)..(322): NCBI GI: 124360080 NCBI Desc: galactose mutarotase-like [medicago truncatula]
  misc_feature (5)..(322): NCBI GI: 549984 NCBI Desc: possible apospory-associated protein
  misc_feature (1)..(185): NCBI GI: 115460356 NCBI Desc: os04g0603000 [oryza sativa (japonica cultivar-group)]
MATVSSSSTPPTPHRPSVERTKGPTGLEKLVLRESRGWSAEVHIYGGQVTSWKNDHGDELLFMSSKAIFKPPKAIHGGIPICFPQFGTHGNLEKHGFARNRFWAIDDNPPPFPVNTAIKTFADLILKPSEEDLKIWPHSFEFRLRVALAPGGDLILTSRIRNTNIDGRPFSFTFAYHTYFSVSDISEVRVEGLETLDYLDNLTKERFTEQGDAIVFETEIDKIYLDVPSKVAIIDHEKKRTYVLRKDGLPDTVLWNPWDKRSKIMQDFGDEEYKHMLCVGPANVEKHITLKPGEEWKGKMELTAVPSSYYSGQLDPEKVLQG

SEQ ID NO: 249 - DNA, 1050 bp, Sorghum bicolor
  misc_feature: Ceres ANNOT ID no. 6007074
  misc_feature: Encodes the peptide sequence at SEQ ID NO 250
atggcgacgaagtctggatacacacgcccgctcccgctcgctggggacaccgctcctccgcctcccagcgccgtcctctatgtggccaactgcgggcccgcggtgggagtgaccgacgccgacgtccgctcggcgttcggcgccttcggggaggtagcaggggtccaggccgccgacgagagcggcgcccgcatcatcgtccggttccacgagcccgccgccgcggaggccgccatggctgcgctccacgggcgcccctgcgacctccttgcgggtcgcgtgctgcacatacggtattcggtgcccgtgaagccaaaggctcgcccagggggctctgtaccggtggctctcgcggcatcggagctcggaatcccggggatttacatggttcaggagttcgtgactgccgctgaggaacaggagttactttcagctgtggatagcaagacgtggaaaagactggcgaagagacgagttcagcattatggttatgagtttctgtacgaaacaaggaatgttgattcaaagcagttcttgggtgaattacctacgtttgtttcaaccgtccttgagaagattgcttcttttcccggtgtgaaggactgtaccaccagcttagttgatcaattgacagtaaatgaatatccttgtggtgtaggtttgtctccacacatagacacacactcagcatttgaggaaatgatttttagcctttctttggctggaccttgcatcatggagttcaggaaatatactaaaggcagttggcgtgctccaagtgtggtcaatggagttgatgaagatagcagtcaagagccaggatgcataagaaaagccattttcctacctcctcggtcaatgttattgatgtcaggagaaggtcgttatgcctggcatcactacataccacatcataaaattgatgcagtgggtggtcaagtcatcaaaaggaattcaaggcgggtttctttcactttccgaaaggtgaggatgggtccttgtgactgtgagtacaagcaattttgtgattctcatagcaagagatgttaa

SEQ ID NO: 250 - protein, 349 aa, Sorghum bicolor
  misc_feature: Ceres ANNOT ID no. 6007074
  misc_feature (5)..(346): NCBI GI: 115460350 NCBI Desc: os04g0602700 [oryza sativa (japonica cultivar-group)]
  misc_feature (21)..(347): NCBI GI: 42571709 NCBI Desc: oxidoreductase, 2og-fe(ii) oxygenase family protein [arabidopsis thaliana]
  misc_feature (22)..(344): NCBI GI: 67609385 NCBI Desc: 2og-fe oxygenase superfamily (67.4 kd) (3e801) [cryptosporidium hominis]
  misc_feature (22)..(344): NCBI GI: 54658038 NCBI Desc: 2og-fe oxygenase superfamily (67.4 kd) (3e801) [cryptosporidium hominis]
  misc_feature (113)..(250): NCBI GI: 24658267 NCBI Desc: cg17807-pa [drosophila melanogaster]
MATKSGYTRPLPLAGDTAPPPPSAVLYVANCGPAVGVTDADVRSAFGAFGEVAGVQAADESGARIIVRFHEPAAAEAAMAALHGRPCDLLAGRVLHIRYSVPVKPKARPGGSVPVALAASELGIPGIYMVQEFVTAAEEQELLSAVDSKTWKRLAKRRVQHYGYEFLYETRNVDSKQFLGELPTFVSTVLEKIASFPGVKDCTTSLVDQLTVNEYPCGVGLSPHIDTHSAFEEMIFSLSLAGPCIMEFRKYTKGSWRAPSVVNGVDEDSSQEPGCIRKAIFLPPRSMLLMSGEGRYAWHHYIPHHKIDAVGGQVIKRNSRRVSFTFRKVRMGPCDCEYKQFCDSHSKRC

SEQ ID NO: 251 - DNA, 2373 bp, Sorghum bicolor
  misc_feature: Ceres ANNOT ID no. 6007075
  misc_feature: Encodes the peptide sequence at SEQ ID NO 252
atgtctcctgctccccgctgctccgtctcgctccctccgcctcctactaatgcctccactaccagcaccagcggcggcgggggcgggatgaaggcgcagcggcacccgacggcgtcgcaggtgaggcggctgtgcaaacagggccgcctggacggcgcgcggcggctgctcctcgacgcgctcccgcgcccgccgccgccgccgctctacaacgcgctcctcatcgcctacgtggcccgctccctcccggaacacgcgctgcggctctacgcgctcctcaaccacgccgcgcgccccgcgccacgctccgaccactacacctactcctgcgcgctcaccgcctgtgcccgcacccgccgcctccgcctagggaaatcagtccacgcgcatctcctccgccgcgcgcgctcgctgcccgacaccgcggtgctccgcaactcgctcctcaacctctacgcctcctgcatgcggtaccgaggcgacggcggcgtcgacgtcgtccgcaggctgttcgacgtgatgcccaagcggaacgcggtttcctggaacacactgttcggttggtacgtcaagaccggacgtccccaggaagctctggagctgttcgcgcgtatgctggaggatggcatcaagcccacgccggtcagcttcgtcaatgtcttccccgcagtggccaaggaagatcccagctggtcctttgtgctctacggcctacttgtgaagcatgggagggaatatgtcaatgatctcttcgttgtcagctcggccatcgcgatgttctctgaacttggggatttgcagtcagcttggagggtgtttgagtacactgccaagaagaacaccgaggtttggaacacgatgatcactgggtacgtgcagaatgggaaatttgctgaagctatggatctcgttatccggttaatgggatctaaagaggttccattggatgtcgtgaccttcttgtcagcactcacggcagcatcacagtcccaggatggcaggttgggtcagcagctgcatggctacttgatcaaaggaactcacgccactttgccagtgatacttggtaatgcactggttgtaatgtactcgagatgtggcaatgtccaaactgcctttaagctctttgaccgcttaccagagaaggacattgtttcttggaacaccatggtcactgcttttgtgcagaacgattttgatttggaaggcctgctgctcgtttatcagatgcaaaaatcatgttttgcagctgattcagtgacattgactgcagttctctctgccgcgtccaatacaggagaccttcagattggtaaacaagcccacggttatctcgtaaggcgtggcattgaggatgagggcttggagagctatctgattgacatgtatgccaagtccggtcgcatagaaatagctcagagagtatttgacgactatggtaatgtcaaaagagatgaagtcacctggaatgccatgatagcagggtacacacagagtgggcagcctgaacaagcaatcttgacattccgggcaatgcttcaggcaagtcttgaacctacttcagtgacacttgcctcggtgctccctgcatgtgatcctctaggaggaggtttatgtgcggggaagcagatccattgttttgctttgcgccgttgtttggacaccaatgtctttgtaggtacagctcttgttgacatgtactccaagtgtggcgagatttctactgcagaacatgtctttgctgttatgattgaaaagagcaccgtctcctatacaacaatgatttctggtcttggacagcatggttttggcgaaagagcattgtcacttttctactacatgcaagagaaggggctaaaacctgatggtgtgaccttcttggcagcaatttcagcatgtaattactctgggctggtcgatgaagggcttgctttgtacaggtcaatggaaacttttggggttgcagttactcctcagcaccgttgctgcattgtggacatgttagctaaagccggcagagtggaggaagcttatgaatttgtgcaggagctgggggaggagggtaacttcatttctatctggggatcactgctcgtgtcctgcaaagcacaggacaagcaggaattggtgaatttagcgacagagagattgctctgcattgagaagaagtatggccatgctggttacaacgttttgttgtcacatatttttgctgctgagggcaactggagtagtgctgatagcctgaggaaggagatgaggttgagagggttgcggaagatggcaggttctagttggattaaagtccaggatgcagcattacaaagctcccctaaaaatgaccatgaatactcattgctgcatgggggttga

SEQ ID NO: 252 - protein, 790 aa, Sorghum bicolor
  misc_feature: Ceres ANNOT ID no. 6007075
  misc_feature (180)..(214): Pfam Id: PPR Pfam Desc: PPR repeat
  misc_feature (282)..(316): Pfam Id: PPR Pfam Desc: PPR repeat
  misc_feature (487)..(521): Pfam Id: PPR Pfam Desc: PPR repeat
  misc_feature (589)..(623): Pfam Id: PPR Pfam Desc: PPR repeat
  misc_feature (4)..(789): NCBI GI: 38344148 NCBI Desc: osjnba0041a02.15 [oryza sativa (japonica cultivar-group)]
  misc_feature (4)..(789): NCBI GI: 116310930 NCBI Desc: b0403h10-osigba0105a11.20 [oryza sativa (indica cultivar-group)]
  misc_feature (102)..(771): NCBI GI: 30694644 NCBI Desc: pentatricopeptide (ppr) repeat-containing protein [arabidopsis thaliana]
  misc_feature (70)..(769): NCBI GI: 54695180 NCBI Desc: ppr986-12 [physcomitrella patens]
  misc_feature (69)..(787): NCBI GI: 78183583 NCBI Desc: ppr1106-17 [physcomitrella patens]
MSPAPRCSVSLPPPPTNASTTSTSGGGGGMKAQRHPTASQVRRLCKQGRLDGARRLLLDALPRPPPPPLYNALLIAYVARSLPEHALRLYALLNHAARPAPRSDHYTYSCALTACARTRRLRLGKSVHAHLLRRARSLPDTAVLRNSLLNLYASCMRYRGDGGVDVVRRLFDVMPKRNAVSWNTLFGWYVKTGRPQEALELFARMLEDGIKPTPVSFVNVFPAVAKEDPSWSFVLYGLLVKHGREYVNDLFVVSSAIAMFSELGDLQSAWRVFEYTAKKNTEVWNTMITGYVQNGKFAEAMDLVIRLMGSKEVPLDVVTFLSALTAASQSQDGRLGQQLHGYLIKGTHATLPVILGNALVVMYSRCGNVQTAFKLFDRLPEKDIVSWNTMVTAFVQNDFDLEGLLLVYQMQKSCFAADSVTLTAVLSAASNTGDLQIGKQAHGYLVRRGIEDEGLESYLIDMYAKSGRIEIAQRVFDDYGNVKRDEVTWNAMIAGYTQSGQPEQAILTFRAMLQASLEPTSVTLASVLPACDPLGGGLCAGKQIHCFALRRCLDTNVFVGTALVDMYSKCGEISTAEHVFAVMIEKSTVSYTTMISGLGQHGFGERALSLFYYMQEKGLKPDGVTFLAAISACNYSGLVDEGLALYRSMETFGVAVTPQHRCCIVDMLAKAGRVEEAYEFVQELGEEGNFISIWGSLLVSCKAQDKQELVNLATERLLCIEKKYGHAGYNVLLSHIFAAEGNWSSADSLRKEMRLRGLRKMAGSSWIKVQDAALQSSPKNDHEYSLLHGG

SEQ ID NO: 253 - DNA, 1596 bp, Sorghum bicolor
  misc_feature: Ceres ANNOT ID no. 6007080
  misc_feature: Encodes the peptide sequence at SEQ ID NO 254
atggagggccagccgctccatctcctcctcgcccagccccaccaccctcccctccgcggtctcatccccaaccgccctactcactacctgcccacctcccgcctccgattccgcgtacaccgtcgcaagccgaagcagctcgccgcagtgccttcgagacgtccatcgggcagccaggccgacgcacctggccgtagcggctgggagcgggtgccgaacgcggtggcggcggcggtgttccagctggccgtatgctcgctcctttttctcttccccaaccgtgcccgagtcctcgcgctcccgcctcctccgggcgccgctgcggtggttgaggcgacgcaggaggaggaggacaaggagtgggaggctgcgctgcagaagtggaagaccaagacctacgcgctctcggtgcccctccgggtggtcgcgctccgcggctccttccctccatcttggattaaggatttcgttgaagttcaggggaagaggctcaaattcagtcccgagctccgtgctaatcttgatgggatcttctctgagatgtcacaatgtatggacaagggtcaagttcagccaaagtccgcaatggctgctgatgccgttacccttggggactcctggctcggctatgccatccgccagggattgctagagcctgtcaagaatgctgaagaacaggattggtttcgtagcctgagtgacagatggaaggttcatttgtgcaggaaccagaatggagaagcagatcctaatggtacaatatggggagttccatacagatggggcaccatggtcattgcttacaagaaaaacaagttcaaaagacataatctgaagccaatacaggattgggaggacttgtggaggcctgagcttgccggcaggatttcaatggtcgattctcctagagagattattggtgcagttctgaagcatctggggtcatcatataacacagttgatatggaaatagatgtcaatggtggtagagaagcagtcctaaatagctttacacaactacagaagcaggtccaactattcgatagcatggactatctgaaatcatttagtgttggagatgtatgggttgcagtgggttggagcagcgatgtgatccctgctgcaaagcgaatgtctaatgtcgcggtggttgttcccaagtcaggcagcagcatatgggctgatctatgggcaataccatgcgcgacaagatttcagactgaccaaatcggtagccgaaccagaggcccatctccactgatccaccagtggttcgacttctgcctgcagagtgctaggagcctacccttccgccaagacgtcatccccggagcatccccgctgtacctcgagaaccctgtgccagaggtccctcaagataagaacaagaggaagccgaagctggagacgaaccttgtcaggggagtgcctccgcccgagatcctggagagatgcgagtttttggagcccctgtcaggtaaggcgctggaggattaccagtggctgatgtctaaggtgcagagacctcgacttggtttttttgggaacgtgttgcaaaagatgtcagctgtactagacttcaaaagaagattttag

SEQ ID NO: 254 - protein, 531 aa, Sorghum bicolor
  misc_feature: Ceres ANNOT ID no. 6007080
  misc_feature (1)..(530): NCBI GI: 116310926 NCBI Desc: b0403h10-osigba0105a11.16 [oryza sativa (indica cultivar-group)]
  misc_feature (165)..(530): NCBI GI: 115460340 NCBI Desc: os04g0602200 [oryza sativa (japonica cultivar-group)]
  misc_feature (69)..(530): NCBI GI: 51536594 NCBI Desc: at1g31410 [arabidopsis thaliana]
  misc_feature (139)..(430): NCBI GI: 17227795 NCBI Desc: periplasmic polyamine-binding protein of abc transporter [nostoc sp. pcc 7120]
  misc_feature (139)..(403): NCBI GI: 113476419 NCBI Desc: periplasmic polyamine-binding protein of abc transporter [trichodesmium erythraeum ims101]
MEGQPLHLLLAQPHHPPLRGLIPNRPTHYLPTSRLRFRVHRRKPKQLAAVPSRRPSGSQADAPGRSGWERVPNAVAAAVFQLAVCSLLFLFPNRARVLALPPPPGAAAVVEATQEEEDKEWEAALQKWKTKTYALSVPLRVVALRGSFPPSWIKDFVEVQGKRLKFSPELRANLDGIFSEMSQCMDKGQVQPKSAMAADAVTLGDSWLGYAIRQGLLEPVKNAEEQDWFRSLSDRWKVHLCRNQNGEADPNGTIWGVPYRWGTMVIAYKKNKFKRHNLKPIQDWEDLWRPELAGRISMVDSPREIIGAVLKHLGSSYNTVDMEIDVNGGREAVLNSFTQLQKQVQLFDSMDYLKSFSVGDVWVAVGWSSDVIPAAKRMSNVAVVVPKSGSSIWADLWAIPCATRFQTDQIGSRTRGPSPLIHQWFDFCLQSARSLPFRQDVIPGASPLYLENPVPEVPQDKNKRKPKLETNLVRGVPPPEILERCEFLEPLSGKALEDYQWLMSKVQRPRLGFFGNVLQKMSAVLDFKRRF

SEQ ID NO: 255 - DNA, 1056 bp, Sorghum bicolor
  misc_feature: Ceres ANNOT ID no. 6007081
  misc_feature: Encodes the peptide sequence at SEQ ID NO 256
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
atggcgggagcgagcttcctctcgaccgcgccgctcgttgcccgcggcgtcgctgcctgctcttccatttcgactccgacgcggaggcacccgcacattcgagtttgctgccgggctgacgctgagggctcggaggctgctgctcatgaagagcgtctgcgattccgccggagagatttcattggcacctgcgtcgggagcgccattggtttggaattgatcgacggttctacaagattctctggagtggctactgcagctgatctcattgagcgtagacaacggtcggagttccagtcaaaaatcaaagatacgctctacgtagccataaaggctaagccagagctcgttccatcattgttgaccttggcactgaatgatgccatgacatatgacaaggccacaaaaactggaggagcaaatgggtctatcaggctagaaacaagcagacctgaaaacagtgggctctctgctgcattggatttgctgactgaagccaaaaaggagatagattccttttccaagggaggtcccatttcatttgcagatctgatccagtttgcagcacaatcagcactgaagagatcatttcttgacgcggccattgccaaatgtggtggaaatgaagagaagggaagaaccctatactctgcatatggttcaaatgggcagtggggtctgttcgatagaacattcgggagagcagatgcacaggaagcagatccagagggaagagtgcctgagtggagcaaagcttctgtgcaggagatgaaggataggttcgtcgctgttgggctgggtcctcgccagcttgctgttatgtcagcattccttggacctgaccaggctgctaccgaggaacgactgatagctgatccagattgccgtccatgggtggagaagtaccagcggagccgcgagactgtctcccggactgactacgaagttgacctgattaccacactcacaaagctgagctccttcggccagaacataaactatgaagcctacacataccctaagcaaaagattgacctgggcaaattgaaactgtaa

SEQ ID NO: 256 - protein, 351 aa, Sorghum bicolor
  misc_feature: Ceres ANNOT ID no. 6007081
  misc_feature (102)..(305): Pfam Id: peroxidase Pfam Desc: Peroxidase
  misc_feature (1)..(351): NCBI GI: 115460338 NCBI Desc: os04g0602100 [oryza sativa (japonica cultivar-group)]
  misc_feature (109)..(194): NCBI GI: 1019946 NCBI Desc: ascorbate peroxidase
  misc_feature (86)..(194): NCBI GI: 3288066 NCBI Desc: ascorbate peroxidase [arabidopsis thaliana]
  misc_feature (86)..(314): NCBI GI: 55709892 NCBI Desc: ascorbate peroxidase [populus tomentosa]
  misc_feature (109)..(196): NCBI GI: 5804780 NCBI Desc: chloroplast ascorbate peroxidase [chlamydomonas sp. w80]
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
MAGASFLSTAPLVARGVAACSSISTPTRRHPHIRVCCRADAEGSEAAAHEERLRFRRRDFIGTCVGSAIGLELIDGSTRFSGVATAADLIERRQRSEFQSKIKDTLYVAIKAKPELVPSLLTLALNDAMTYDKATKTGGANGSIRLETSRPENSGLSAALDLLTEAKKEIDSFSKGGPISFADLIQFAAQSALKRSFLDAAIAKCGGNEEKGRTLYSAYGSNGQWGLFDRTFGRADAQEADPEGRVPEWSKASVQEMKDRFVAVGLGPRQLAVMSAFLGPDQAATEERLIADPDCRPWVEKYQRSRETVSRTDYEVDLITTLTKLSSFGQNINYEAYTYPKQKIDLGKLKL

SEQ ID NO: 257 - DNA, 333 bp, Sorghum bicolor
  misc_feature: Ceres ANNOT ID no. 6007083
  misc_feature: Encodes the peptide sequence at SEQ ID NO 258
atggatgcgaacaggcgccagagtggaatccaacagttgttggctgcagagcaagaggctcagcagattgtaaatgcagctagggctgctaagtcagcaaggcttaggcaagccaaggaggaggctgagagggaaatagctgaataccgtgcccagatggaggctgaattccagaggaaggttgcagagagcagcggtgactctggtgcaaatgttaaacgtcttgaggaagagacaacagcaaaaattgaacaactcagtcaacaggctgcaagtatatccccagaagtcattcagatgcttctgaggcatgtcaccactgtgaagaactga

SEQ ID NO: 258 - protein, 110 aa, Sorghum bicolor
  misc_feature: Ceres ANNOT ID no. 6007083
  misc_feature (5)..(109): Pfam Id: V-ATPase_G Pfam Desc: Vacuolar (H+)-ATPase G subunit
  misc_feature (1)..(110): NCBI GI: 6692259 NCBI Desc: vacuolar membrane atpase subunit g (avma10) [arabidopsis thaliana]
  misc_feature (1)..(110): NCBI GI: 3717987 NCBI Desc: g subunit of vacuolar-type h+-atpase [nicotiana tabacum]
  misc_feature (1)..(107): NCBI GI: 26986108 NCBI Desc: vacuolar atpase subunit g [mesembryanthemum crystallinum]
  misc_feature (1)..(110): NCBI GI: 5917785 NCBI Desc: vacuolar membrane atpase subunit g [citrus limon]
  misc_feature (1)..(110): NCBI GI: 82621172 NCBI Desc: atpase-like [solanum tuberosum]
  misc_feature (1)..(110): SWISSPROT Homolog: EC 3.6.3.14 Vacuolar ATP synthase subunit G 1
MDANRRQSGIQQLLAAEQEAQQIVNAARAAKSARLRQAKEEAEREIAEYRAQMEAEFQRKVAESSGDSGANVKRLEEETTAKIEQLSQQAASISPEVIQMLLRHVTTVKN

SEQ ID NO: 259 - DNA, 519 bp, Sorghum bicolor
  misc_feature: Ceres ANNOT ID no. 6007087
  misc_feature: Encodes the peptide sequence at SEQ ID NO 260
atgggacaagcctggggtaatctccaagacaaacttcaagggcggcggtggaaggagcaccaggtgaggaagatcaccgacaaggtgttcgaccgcctcacggaggacgcccagaagcgcgagaaggaggccctcagattcgaggaggtctacatcgccgtcctctgcgtctacaatgacatcaacaagtacttgccagggccgcaccacgatcccccgtccaaggagaagctcaaggccatgatggatgagtacgacgtgaacctggacgggctcctggaccgcgaggagttcgcggagttcatccggaagctgaccgcggactcgctgtgcacgatcagcgtgaagctgctgatcacgctggtggcggcgccggcgctggcgatggcgaccaagcgggcgacggagggcgtccccggcgtgggcaaggtggtgcgcaagatgcccaacgcgctctacgcctccgccatcaccctgggcgtcctgctggcgcagaaatccgccgagggcgtcgagtga

SEQ ID NO: 260 - protein, 172 aa, Sorghum bicolor
  misc_feature: Ceres ANNOT ID no. 6007087
  misc_feature (77)..(105): Pfam Id: efhand Pfam Desc: EF hand
  misc_feature (1)..(170): NCBI GI: 38345783 NCBI Desc: osjnba0083n12.21 [oryza sativa (japonica cultivar-group)]
  misc_feature (1)..(170): NCBI GI: 116310921 NCBI Desc: b0403h10-osigba0105a11.11 [oryza sativa (indica cultivar-group)]
  misc_feature (1)..(170): NCBI GI: 115460330 NCBI Desc: os04g0601500 [oryza sativa (japonica cultivar-group)]
  misc_feature: Useful for making plants with modulated cold sensitivity
  misc_feature: GREAT-hit functional homolog of the protein sequence given in SEQ ID NO 13072
  misc_feature: Useful for making plants with modulated cold sensitivity
  misc_feature: Functional homolog of the protein sequence given in SEQ ID NO 13072
MGQAWGNLQDKLQGRRWKEHQVRKITDKVFDRLTEDAQKREKEALRFEEVYIAVLCVYNDINKYLPGPHHDPPSKEKLKAMMDEYDVNLDGLLDREEFAEFIRKLTADSLCTISVKLLITLVAAPALAMATKRATEGVPGVGKVVRKMPNALYASAITLGVLLAQKSAEGVE

SEQ ID NO: 261 - DNA, 1131 bp, Sorghum bicolor
  misc_feature: Ceres ANNOT ID no. 6007090
  misc_feature: Encodes the peptide sequence at SEQ ID NO 262
atgccctttgcctccctgtctccggcagccgaccaccgcccctcctccctcctccccttctgccgcgccgcccctctctccgcggtgggagaggacgccgcgcagcaccaccagcagcagcagcagcagcacacgatgagcggcaggtgggcggcgaggccggcgctcttcacggcggcgcagtacgaggagctggagcaccaggcgctcatatacaagtacctcgtcgccggcgtgcccgtcccgccggacctcctcgtccccttacgccgaggcttcgtctaccaccagcccgcccttggctatgggacctacttcggcaagaaggtggacccggagcccgggcggtgccggcgtacggacggcaagaagtggcggtgctccaaggaggctgccccggactccaagtactgcgagcgccacatgcaccgcggccgcaaccgttcaagaaagcctgtggaagcgccgctcgtgcccccgccgcacgccccccagcagcagcagcagcagcagcagccgccgcccgcccccgttgctggcttccagaaccactcgctgtacccgtcggtcctcgccggcaacggcggcgtcggggtaggaggtggtggcggtggcacgttcggcatggggcccacctctcagctgcacatggacagtgccgctgcttacgcgactgctgctggtggagggagcaaagatctcaggtactctgcatacggggcgaaatctctgtctgatgatcacagccagctgttgcccggcggcatggatccgtccatggacaactcatggcgcctgttgccatcccaaaccaccacatttcaagccacaagctaccctgtgtttggcacgctgagcggtctggatgagagcaccatcgcctcactgccgaagacgcagagggagcctctctctttcttcgggagcgactatgtgaccgccaagcaggagaaccagacgctgcgccctttcttcgacgaatggcccaagtcaagggagtcgtggccagagctggctgaggacaaccaccttggcttctcagccacccagctctccatctccattcccatggcgacctcagacttctccaacaccagctccagatcgccgaacggaataccgtcaaggtaa

SEQ ID NO: 262 - protein, 376 aa, Sorghum bicolor
  misc_feature: Ceres ANNOT ID no. 6007090
  misc_feature (111)..(156): Pfam Id: WRC Pfam Desc: WRC
  misc_feature (55)..(91): Pfam Id: QLQ Pfam Desc: QLQ
  misc_feature (1)..(376): NCBI GI: 38345778 NCBI Desc: osjnba0083n12.16 [oryza sativa (japonica cultivar-group)]
  misc_feature (1)..(238): NCBI GI: 51039835 NCBI Desc: tpa: growth-regulating factor 3 [oryza sativa (japonica cultivar-group)]
  misc_feature (1)..(371): NCBI GI: 115460326 NCBI Desc: os04g0600900 [oryza sativa (japonica cultivar-group)]
  misc_feature (1)..(371): NCBI GI: 116310919 NCBI Desc: b0403h10-osigba0105a11.9 [oryza sativa (indica cultivar-group)]
  misc_feature (179)..(371): NCBI GI: 46367640 NCBI Desc: transcription activator grf2 [oryza sativa (japonica cultivar-group)]
  misc_feature: The plant flowers significantly late compared to wild-type.
  misc_feature: The plant is abnormally large.
  misc_feature: The sequence is a functional homolog of SEQ ID NO 1781 in the 10/374,780US patent application
  misc_feature: The sequence is a functional homolog of SEQ ID NO 1800 in the 11/479,226US patent application
  misc_feature: The sequence is a functional homolog of SEQ ID NO 1803 in the 11/479,226US patent application
  misc_feature: Useful for biocontainment applications
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated nitrogen use efficiency
  misc_feature: Functional homolog of the protein sequence encoded by LOCUS at3g13960
  misc_feature: The sequence is a functional homolog of SEQ ID NO 1781 in the 20060162006 US patent application
  misc_feature: The sequence is a functional homolog of SEQ ID NO 1800 in the 20070022495 US patent application
  misc_feature: The sequence is a functional homolog of SEQ ID NO 1803 in the 20070022495 US patent application
MPFASLSPAADHRPSSLLPFCRAAPLSAVGEDAAQHHQQQQQQHTMSGRWAARPALFTAAQYEELEHQALIYKYLVAGVPVPPDLLVPLRRGFVYHQPALGYGTYFGKKVDPEPGRCRRTDGKKWRCSKEAAPDSKYCERHMHRGRNRSRKPVEAPLVPPPHAPQQQQQQQQPPPAPVAGFQNHSLYPSVLAGNGGVGVGGGGGGTFGMGPTSQLHMDSAAAYATAAGGGSKDLRYSAYGAKSLSDDHSQLLPGGMDPSMDNSWRLLPSQTTTFQATSYPVFGTLSGLDESTIASLPKTQREPLSFFGSDYVTAKQENQTLRPFFDEWPKSRESWPELAEDNHLGFSATQLSISIPMATSDFSNTSSRSPNGIPSR

SEQ ID NO: 263 - DNA, 636 bp, Sorghum bicolor
  misc_feature: Ceres ANNOT ID no. 6007093
  misc_feature: Encodes the peptide sequence at SEQ ID NO 264
atgctggcatgcattgcgtgctcgtcgaaggaaggcggagaggacggctcccgtgccgcggccacgacgcctcacggcaaagaagccgtcaagtctctcacctcacagctcaaggacatggtgctcaagttctccggctccagcaagcagtgcaaggggacgacggccgggacccagtcgttcaggagcggtgggggcagcaggtaccgccgcccggcctaccccagcttcatcgacgacaccggcttcacgccggcgagcaaggttctcggcgaggactactacccaaggaccgcattggcgccaggggcaggcggcgccgccggtggtggggcgcgaaccgcgccgtcggatacgttggacatgaccaggagcaaccgcaagagccccgggattagcggctggattccgagcaaggaggcggcggccgacgatgtcatcgttgtggaggacgccgccgtgcccagggagtggacggcgcaggtggagcctggcgtccagatcaccttcggcaccatcccgagcggcggcaacgacctcaagcgcatccgcttcagccgggagaggttcggcgaggagagggcaaaggtgtggtgggagcagaaccgagagagaatacaagctgaatatctgtag

SEQ ID NO: 264 - protein, 211 aa, Sorghum bicolor
  misc_feature: Ceres ANNOT ID no. 6007093
  misc_feature (175)..(210): Pfam Id: DZC Pfam Desc: Disease resistance/zinc finger/chromosome condensation-likeregion
  misc_feature (1)..(211): NCBI GI: 38345776 NCBI Desc: osjnba0083n12.14 [oryza sativa (japonica cultivar-group)]
  misc_feature (1)..(211): NCBI GI: 116310917 NCBI Desc: b0403h10-osigba0105a11.7 [oryza sativa (indica cultivar-group)]
  misc_feature (138)..(210): NCBI GI: 109020194 NCBI Desc: brevis radix [arabidopsis thaliana]
  misc_feature (102)..(211): NCBI GI: 56461772 NCBI Desc: at1g54180 [arabidopsis thaliana]
  misc_feature (102)..(211): NCBI GI: 57222218 NCBI Desc: at1g54180 [arabidopsis thaliana]
MLACIACSSKEGGEDGSRAAATTPHGKEAVKSLTSQLKDMVLKFSGSSKQCKGTTAGTQSFRSGGGSRYRRPAYPSFIDDTGFTPASKVLGEDYYPRTALAPGAGGAAGGGARTAPSDTLDMTRSNRKSPGISGWIPSKEAAADDVIVVEDAAVPREWTAQVEPGVQITFGTIPSGGNDLKRIRFSRERFGEERAKVWWEQNRERIQAEYL

SEQ ID NO: 265 - DNA, 774 bp, Sorghum bicolor
  misc_feature: Ceres ANNOT ID no. 6007101
  misc_feature: Encodes the peptide sequence at SEQ ID NO 266
atgttgcgggggagctacggctgtggcggggcggcgtcacgggaccccaagccgcggctgcggtggacgccggacctccaccagcgcttcgtcgaagccgtcaccaggctcggcggcccggacaaagcaacacccaagtcagtgctcagattgatgggcatcaaaggcctcactctttaccatctaaaaagccacctccagaagtatagactgggaatacagggcaagaaaagcacaggcttggaacttgccactggcggtgttcctgatgaaggaaagagcacgagagaaatagcacttagcaatgcactaaggtatcaaattcaagtccaaaggaaactacaagaacaaattgaggtgcaaaagaagctgcagatgcgaattgaggcccaagggaagtacttaaagacaatactagagaaagctcagacaaatatttcctttgacacagatgcatccaatggcatagaatcaaccagatcacagctcatgggcctcaaccaagctctatcaggtttcatggacaatgcaactcaagtatgcaaagaaaataggaagcaattggtgaaagctttgtcagatgacaacgataaagataatctaggctttcagctgtaccatgtaggaagtcaggaggctaaggaagtcaaatgcacaccaaaaactgaagactcgctcctactagacttaaatattgaaggaggatatgacctctcttctagaggaatgcaagcatgtgaactagaattgaaaatcaaccagcagataggataa

SEQ ID NO: 266 - protein, 257 aa, Sorghum bicolor
  misc_feature: Ceres ANNOT ID no. 6007101
  misc_feature (19)..(70): Pfam Id: Myb_DNA-binding Pfam Desc: Myb-like DNA-binding domain
  misc_feature (4)..(237): NCBI GI: 115448117 NCBI Desc: os02g0700300 [oryza sativa (japonica cultivar-group)]
  misc_feature (9)..(171): NCBI GI: 115469404 NCBI Desc: os06g0664800 [oryza sativa (japonica cultivar-group)]
  misc_feature (9)..(169): NCBI GI: 49388972 NCBI Desc: myb family transcription factor-like [oryza sativa (japonica cultivar-group)]
  misc_feature (9)..(169): NCBI GI: 115444531 NCBI Desc: os02g0174000 [oryza sativa (japonica cultivar-group)]
  misc_feature (9)..(155): NCBI GI: 56269839 NCBI Desc: myb family transcription factor-related protein [populus tomentosa]
  misc_feature: The sequence is a functional homolog of SEQ ID NO 1233 in the 10/666,642US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 933 in the 10/666,642US patent application
  misc_feature: Useful for making plants with modulated growth and phenotype characteristics
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1233 in the 20070033671 US patent application
  misc_feature: The sequence is a functional homolog of SEQ ID NO 933 in the 20070033671 US patent application
  misc_feature: Useful for making plants with altered alkaloid content
  misc_feature: Useful for making plants with altered lignin content
  misc_feature: Functional homolog of the protein sequence given in SEQ ID NO 13089
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: Useful for making plants with altered terpenoid content
  misc_feature: Functional homolog of the protein sequence given in SEQ ID NO 13070
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MLRGSYGCGGAASRDPKPRLRWTPDLHQRFVEAVTRLGGPDKATPKSVLRLMGIKGLTLYHLKSHLQKYRLGIQGKKSTGLELATGGVPDEGKSTREIALSNALRYQIQVQRKLQEQIEVQKKLQMRIEAQGKYLKTILEKAQTNISFDTDASNGIESTRSQLMGLNQALSGFMDNATQVCKENRKQLVKALSDDNDKDNLGFQLYHVGSQEAKEVKCTPKTEDSLLLDLNIEGGYDLSSRGMQACELELKINQQIG

SEQ ID NO: 267 - DNA, 1758 bp, Sorghum bicolor
  misc_feature: Ceres ANNOT ID no. 6007102
  misc_feature: Encodes the peptide sequence at SEQ ID NO 268
atggatttcatgaaggttttcgatcagactgtgcgcgagataaagagggaggtaaatctgaaggtgctcaaggtccccgagatggagcagaaggtacttgatgcaacaagtgatgaaccgtggggccctcatggaagtgccctttcagagcttgcacacgctaccaagaagtttgctgagtgccagatggtaatgaatgtcctctggactaggctgtccgagagaggcgcgaactggcgtcatgtgtataaggcattgacaattattgagtacttgatagccaatggttctgagagggcagttgatgacattctagatcattattctaagatctcggttctttcgagttttgaatatgttgagcctaatggtaaagacgctggaataaatgtgaggaaaaaagtagaaaccattgtgggcatcataaatgacaaggagagaataaaggccgtgagagacaaagcagccagtaatcgtgataagtacgttggactatcatccacaggcataacatataaatcaagctcagcctcatttggtagcaactacagttcaggcgaacgttatgggagtttcagtggtgaaaaggaagctgactcatatggtgacagttacagggacaaagaacctgttaaaacctccacaagtaatagtggcgtccggaaatctggcagcaagctgaggaaggatgcgaagcctgataggagctctttcaacccctcatctaatacaaataacactgaggacggctttgatgacttcgatcctcgcggatcaaatggaaaaacaactgctaaaccaaatgaggtggatctgtttggcccaaacttgatggatgattttattgatacatctgcagcaactccagcaacagagagtgctgtagagccacaggtcgatctgtttgctgatgcagatttccaatcggcaacagagacagctgcaaatacagatgtccagggcaatgttgacctttttgcggaaaaggcatcttttcctgcagcatttccaccacaggctgggtttattccaccaccaagtgccgggacatcttctgaaaatacttctgtatccaagaaggctgctcctgaaccttttgatccttttggtgctattcccttgaacagttttgatggatctgacccatttggtggcttcagctcaaatgctggatcatctactgcagcaccacccacccacagttctacaggaaatatcagcacacgagaccagaaccttcaggctgcatccgacttcggtgccttcgtatcaaacaatgagggagcagctaaagatccatttgatctttcttcaagtgccaatgtcagaaaaacacctttggcagctccgaagattgatgcatctgattttggtgcatttgtctctagtactgaggaagcagctaaggaccctttcgatctttcttcgggtagcaaccttggaaggacagaccaagcacccgcggcagctcccaagcctaacatgaagaaagaaaattttcaggtcaagtctggcatatgggcagactccttgagcaaaggattgattgatcttaacataactgcaccgaagaaggtgaacctagctgatattggcatcgttggtggccttggtgatgggtccgatgagaaggccatgccctcgtggaccatgggcaccggatctgggctaggaatatctgggattccaccatcaacacaaggcggtggcatcgagagcttagccaactacaacaagcatcaattcggcttcaaataa

SEQ ID NO: 268 - protein, 585 aa, Sorghum bicolor
  misc_feature: Ceres ANNOT ID no. 6007102
  misc_feature (25)..(148): Pfam Id: ENTH Pfam Desc: ENTH domain
  misc_feature (1)..(585): NCBI GI: 38345770 NCBI Desc: osjnba0083n12.8 [oryza sativa (japonica cultivar-group)]
  misc_feature (1)..(585): NCBI GI: 116310911 NCBI Desc: b0403h10-osigba0105a11.1 [oryza sativa (indica cultivar-group)]
  misc_feature (1)..(557): NCBI GI: 1724114 NCBI Desc: af10-protein [avena fatua]
  misc_feature (1)..(477): NCBI GI: 7573385 NCBI Desc: clathrin binding protein-like [arabidopsis thaliana]
  misc_feature (5)..(484): NCBI GI: 15215854 NCBI Desc: at2g43170/f14b2.11 [arabidopsis thaliana]
  misc_feature: The sequence is a functional homolog of SEQ ID NO. 322 in the 11/188,298 US application
MDFMKVFDQTVREIKREVNLKVLKVPEMEQKVLDATSDEPWGPHGSALSELAHATKKFAECQMVMNVLWTRLSERGANWRHVYKALTIIEYLIANGSERAVDDILDHYSKISVLSSFEYVEPNGKDAGINVRKKVETIVGIINDKERIKAVRDKAASNRDKYVGLSSTGITYKSSSASFGSNYSSGERYGSFSGEKEADSYGDSYRDKEPVKTSTSNSGVRKSGSKLRKDAKPDRSSFNPSSNTNNTEDGFDDFDPRGSNGKTTAKPNEVDLFGPNLMDDFIDTSAATPATESAVEPQVDLFADADFQSATETAANTDVQGNVDLFAEKASFPAAFPPQAGFIPPPSAGTSSENTSVSKKAAPEPFDPFGAIPLNSFDGSDPFGGFSSNAGSSTAAPPTHSSTGNISTRDQNLQAASDFGAFVSNNEGAAKDPFDLSSSANVRKTPLAAPKIDASDFGAFVSSTEEAAKDPFDLSSGSNLGRTDQAPAAAPKPNMKKENFQVKSGIWADSLSKGLIDLNITAPKKVNLADIGIVGGLGDGSDEKAMPSWTMGTGSGLGISGIPPSTQGGGIESLANYNKHQFGFK

SEQ ID NO: 269 - DNA, 1173 bp, Sorghum bicolor
  misc_feature: Ceres ANNOT ID no. 6007103
  misc_feature: Encodes the peptide sequence at SEQ ID NO 270
atgtcggccaccgctgcgcggctgctgcttccaagggtggccaagaccacagccaccgctctagtccgcggccccctcgattccttctcgagtcgcttccgaacgctcgggccgccgcttctgcggccgctggcgctggatacacgcatccccgccaccgtcatcaccggcttcctcggctccggcaagacaactctcctgaaccacattttgacctcacagcatgggaagagaattgctgctattgaaaatgagtttggcgaggtggatattgatagctcgcttgttgctagccactcatctattactgaggatattgtaatggtgaataatggctgcttgtgttgcactgtccgaggagatcttgtaaagatgcttctgaagctagtgaagcaaaagggggacaagtttgatcatattgttattgaaacaacaggtaaatcttattggaataaagtcctttgtcctgtcattgagacattctcttcagatgagttggtctctaagtatgtgaaacttgatggtgtcgttacaatggttgactgcaagcatgccatgaagcatttgaatgaagtgaaagccaggtgggttgtaaatgaggcagtagaacaagttgcttatgcagaccgaattatattgaacaaggttgatttggttgatgatgcagaattggaggcattgactaacaaactcaagttcataaatgggatggcacaaatgaaaacagcgaagtttggtgatgttgacatggactttgtgctgggaattggaggctatgaccttgacaggattgaggcggaagtccaagatagcaaggagacatatcattgtcaccatggagatgaacatgggcaccatcatgatcatgtccatgattcagctgtcactagtgtgagcattgtttcagagggattacttgatctcgatgaggttaatgattggctggagagactggttgatgagaaaggggaagatctgtacagattaaaaggtgttatatctgtaaatgagtccactggacgtttcatgtttcagggcgtgcactgtatgctggaaggatgcccagcaaagccgtgggaacctgatgagaagagaatcaacaaactcgtgtttatttgcagaaatttggacgaagctgcacttcgaaaggccttcaacggttgcttactctga

SEQ ID NO: 270 - protein, 390 aa, Sorghum bicolor
  misc_feature: Ceres ANNOT ID no. 6007103
  misc_feature (51)..(242): Pfam Id: cobW Pfam Desc: CobW/HypB/UreG, nucleotide-binding domain
  misc_feature (295)..(389): Pfam Id: CobW_C Pfam Desc: Cobalamin synthesis protein cobW C-terminal domain
  misc_feature (12)..(390): NCBI GI: 38345768 NCBI Desc: osjnba0083n12.6 [oryza sativa (japonica cultivar-group)]
  misc_feature (47)..(390): NCBI GI: 51090705 NCBI Desc: prli-interacting factor l-like [oryza sativa (japonica cultivar-group)]
  misc_feature (49)..(293): NCBI GI: 118716638 NCBI Desc: cobalamin synthesis protein, p47k [burkholderia multivorans atcc 17616]
  misc_feature (49)..(264): NCBI GI: 124026612 NCBI Desc: cobalamin synthesis protein/p47k [prochlorococcus marinus str. natl1a]
  misc_feature (49)..(389): NCBI GI: 118036801 NCBI Desc: cobalamin synthesis protein, p47k [burkholderia phytofirmans psjn]
MSATAARLLLPRVAKTTATALVRGPLDSFSSRFRTLGPPLLRPLALDTRIPATVITGFLGSGKTTLLNHILTSQHGKRIAAIENEFGEVDIDSSLVASHSSITEDIVMVNNGCLCCTVRGDLVKMLLKLVKQKGDKFDHIVIETTGKSYWNKVLCPVIETFSSDELVSKYVKLDGVVTMVDCKHAMKHLNEVKARWVVNEAVEQVAYADRIILNKVDLVDDAELEALTNKLKFINGMAQMKTAKFGDVDMDFVLGIGGYDLDRIEAEVQDSKETYHCHHGDEHGHHHDHVHDSAVTSVSIVSEGLLDLDEVNDWLERLVDEKGEDLYRLKGVISVNESTGRFMFQGVHCMLEGCPAKPWEPDEKRINKLVFICRNLDEAALRKAFNGCLL

SEQ ID NO: 271 - DNA, 1026 bp, Sorghum bicolor
  misc_feature: Ceres ANNOT ID no. 6007105
  misc_feature: Encodes the peptide sequence at SEQ ID NO 272
atgcggtggctaccgaggctgctctctcacgccgccgcggccgggagggcctccgcggcggcgaggtccaccactggtctcgtcaagggaggaggatcccacgggttcgccagcggcggctgggatgggtcaacggcggtgccccgggagtggctgcggaagctgtgggtagacgagctgaggaagcagaaggaggccgcgaggaggtggggcgtcggcgcgtcatcttggaacaccggcggcggtgcggagccttcgctcggcgcgttcgcgagttctgtggaggttgcgggagcagccagggaggcaccgtcaaggagctctcagtacaaataccaggacctcaaccccttcgaggccagactggctccacttcttgcaagagctaacctcatcattgccagggatattgagtgggcgaacatcatgtttgcttttgagcaggagagcaggtatatcataatggacccactctttccacaatctccagtaggttttattcgagagaaaagcaacgtcatctttaggcagctactcagaacaagaaggccatttgttgcagaaataacagatgctatgggtaacgagatatttaaggttcgcaggccattttggtggattaacagctcaatttatgcagaagtggatggtaaggagataggtgtagttcacaggcgttggcacctttggcggagaatttatgacctgtacttagggaataggcaatttgcagttgttgagaatccaggattctggaactggacctttagcctggtgaatgaagatgataaactgttggctcagattgatcgtaactggaggggcattggctttgagctcttcacggatgctggccagtatgctatccggtttggtgatgagggacagagccacaagtttgctcttgctgcagatgttgatgaactgcatgtggttcgccagctgactttgcctgaaagggcagtggctcttgctctcgcgatttccctggacagtgattacttctctagaagaggtggctggtaa

SEQ ID NO: 272 - protein, 341 aa, Sorghum bicolor
  misc_feature: Ceres ANNOT ID no. 6007105
  misc_feature (112)..(337): Pfam Id: Scramblase Pfam Desc: Scramblase
  misc_feature (1)..(341): NCBI GI: 38345767 NCBI Desc: osjnba0083n12.4 [oryza sativa (japonica cultivar-group)]
  misc_feature (120)..(341): NCBI GI: 115445239 NCBI Desc: os02g0238500 [oryza sativa (japonica cultivar-group)]
  misc_feature (143)..(341): NCBI GI: 50252849 NCBI Desc: scramblase-like [oryza sativa (japonica cultivar-group)]
  misc_feature (117)..(340): NCBI GI: 19114338 NCBI Desc: possible involvement in lipid metabolism by similarity [schizosaccharomyces pombe]
  misc_feature (117)..(340): NCBI GI: 5706507 NCBI Desc: spac343.06c [schizosaccharomyces pombe]
MRWLPRLLSHAAAAGRASAAARSTTGLVKGGGSHGFASGGWDGSTAVPREWLRKLWVDELRKQKEAARRWGVGASSWNTGGGAEPSLGAFASSVEVAGAAREAPSRSSQYKYQDLNPFEARLAPLLARANLIIARDIEWANIMFAFEQESRYIIMDPLFPQSPVGFIREKSNVIFRQLLRTRRPFVAEITDAMGNEIFKVRRPFWWINSSIYAEVDGKEIGVVHRRWHLWRRIYDLYLGNRQFAVVENPGFWNWTFSLVNEDDKLLAQIDRNWRGIGFELFTDAGQYAIRFGDEGQSHKFALAADVDELHVVRQLTLPERAVALALAISLDSDYFSRRGGW

SEQ ID NO: 273 - DNA, 816 bp, Sorghum bicolor
  misc_feature: Ceres ANNOT ID no. 6007119
  misc_feature: Encodes the peptide sequence at SEQ ID NO 274
atgcatcacgaccccaaccccttcgacgagggcggcgccgaggacaaccccttctccaatggaggaggtggaggcggcaagcagcagtacgggttccggccgactgagcccgtcgggttcggcggcgccggcagggggggcgacgccgtcgtcgacgtcccgctcgagaccatgggggactctaagagcaagtcgagggagctctcgtcgtgggaatcagatctgaagcggcgagaggcggatatcaagaggagggaggaggcgctgaagaatgctggtgtgccgatggaggagaagaactggccaccattcttccccatcatccaccatgacattgccaatgagataccagccaatgtgcagaagttacagtatcttgcattcgcaagctggcttggaattgtgctttgcctgtcctggaacttcattgctgtcatagtctgctggatcaaggagggagattcaaagttgtttttccttgcaacaatctatgctttgcttggaattcctctgtcatatctgatatggtataggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacaccttctctgagcatgtgataattgggatcttttactttgttgggtttgcactgttttgtctggagacattgctgagcattggggtccttcagaaagtgtacatgtacttcagagggaacaagtga

SEQ ID NO: 274 - protein, 271 aa, Sorghum bicolor
  misc_feature: Ceres ANNOT ID no. 6007119
  misc_feature (97)..(271): Pfam Id: SCAMP Pfam Desc: SCAMP family
  misc_feature (1)..(271): NCBI GI: 115460268 NCBI Desc: os04g0595800 [oryza sativa (japonica cultivar-group)]
  misc_feature (14)..(261): NCBI GI: 32492338 NCBI Desc: osjnba0006a01.24 [oryza sativa (japonica cultivar-group)]
  misc_feature (3)..(269): NCBI GI: 3941289 NCBI Desc: similarity to scamp37 [pisum sativum]
  misc_feature (3)..(270): NCBI GI: 15220305 NCBI Desc: secretory carrier membrane protein (scamp) family protein [arabidopsis thaliana]
  misc_feature (3)..(270): NCBI GI: 7109232 NCBI Desc: secretory carrier membrane protein [oryza sativa]
  misc_feature: Useful for biocontainment applications
  misc_feature: Functional homolog of the protein sequence given in SEQ ID NO 13043
MHHDPNPFDEGGAEDNPFSNGGGGGGKQQYGFRPTEPVGFGGAGRGGDAVVDVPLETMGDSKSKSRELSSWESDLKRREADIKRREEALKNAGVPMEEKNWPPFFPIIHHDIANEIPANVQKLQYLAFASWLGIVLCLSWNFIAVIVCWIKEGDSKLFFLATIYALLGIPLSYLIWYRPLYRAMRTNSAFSFGWFFLCYLIHIGFCIIAAIAPPIVFHGKSLTGILAAIDTFSEHVIIGIFYFVGFALFCLETLLSIGVLQKVYMYFRGNK

SEQ ID NO: 275 - DNA, 2361 bp, Sorghum bicolor
  misc_feature: Ceres ANNOT ID no. 6007121
  misc_feature: Encodes the peptide sequence at SEQ ID NO 276
atgcctcgcaaggttgtatctggacccgactatgatgatgagtacgatgactatgatgagtatgatgatgatgatgagtatgatgaaaatgaatacgccaacaatcatcctgttaagatggggaaagaatcattgaagaagtcctcaattacagtgccggttcattggacgtgttccatgtgcacgttcagtaatcatgaaagcatggtgtattgtgagatgtgtggggttttccgtgagacctttgtcaaatctgcgaaggatggtcttttaaaagatgcagccgttgcagtgtcaagtgagcctaggacatctgctgcatcaaaaatcgattctgcaaagacgccagtgaagactcgtgccgcagattctgatagtgattctgcgagaaagcatgctagtatgtcttacgataaagccaattccatgcggttaccatctgctggtagctcactaggtgctgaaaaaaagaagaaaactcctgtactttctgatgcagtacctgtggagaggatacctctgttggcttccgatggttttcagccaaagggtaaccagagtggcggggctagcagttcttcacagagtgacagtgtgatccagaaactctcttctgacataggccagctaaatgtagacaagaacaatgtgaatgttacaaaaccttgtttgcctgaagaatataagcctgagaagtggatgttagctgatccggagtcaggggcgctgagccaactaaaccttgcaatagtcggtcatgttgattctggcaagtcgacactatctgggagattactgcatcttttaggaaggatatcaaaaaaagatatgcacaagaatgaaaaggaatcgaaagagaaagggaaggggtcatttgcttttgcatgggccatggatgagagcagtgaagaaagggaacggggtgtgacaatgactgtggctgtggcttatttggagaccaagaaattccgtgtagttttgcttgactcacctggccacaaagattttgtgccaaatatgatatctggtgcaacacaagctgatgcagctattcttgtcattgatgcttccactggttcttttgaagctggcatggatggtgaaggaggaaaaggtgttggccagactaaagagcatgctcagcttgttagaagctttggtgtcgaacagcttgttattgcagtcaacaagatggatgctgttgcatatgcaaaagaaaggtttgatttcatcaaactacaacttggtagtttcctgcggtcatgcaacttcaaggactcagctattacctggattcctcttagtgctgtagaaaaccaaaacttgatcagcgctccttcagatgctcgtctgacctcctggtatcaagggttttgtctcttggatgctatagattccctgcagcttccttctcgggatgtttcaaagcccttgattcttccaatctgtgatgttataaagtctcagtcaacaggacagttggcagcttatggaaaattggaaactggagccattaaaaatggttctaaggtgttagttctaccttctgggcaagaggcaactgtgaaaaccattgagcgggactctaattcatgcaccatagcgagagctggtgataatgtggcaatttgtttacagggtattgatggaaatcaactaatacctggcggggttctttgccaccctggtttccctgtggctgtagctaaccacttggagctgaaggttctagtcttggacatcactactcctattctttttggctctcaggtggagtttcacatacatcatgtgaaggaggccgcaagagtaaccaaaatcgttgcattacttgacaggactggcaaaccaagtaaatcagcacctcgatttcttaaatccaagcagaatgctcttatacaggtcacactagatggagctgtctgtgttcaggaattctctaagagccgagctcttgggagggcatacttgaggtcgtctgggcgcactattgctgttggcgtggttaataggataattgatataaaggatccagagcacccatactcactggaacagctgaatgtggtaactgaaaactcaattgaactcaatgatgaaagtaatcatgtcagggttactttcaccccaacagtggagcactgcagtatggcaactattattggcctttgcatacgtgtgaaacttgtacggagtctccctcctcgttacaaggtggacataagagttgcccctggatcacacgcaactgaagctgccgtgaataagcaactgaatgacaaagaacgtgttgcagctgcattggaaaacccaaacctactggacatggttgaagaatgcttatcaccaacatttgattga

SEQ ID NO: 276 - protein, 786 aa, Sorghum bicolor
  misc_feature: Ceres ANNOT ID no. 6007121
  misc_feature (243)..(469): Pfam Id: GTP_EFTU Pfam Desc: Elongation factor Tu GTP binding domain
  misc_feature (493)..(560): Pfam Id: GTP_EFTU_D2 Pfam Desc: Elongation factor Tu domain 2
  misc_feature (566)..(673): Pfam Id: GTP_EFTU_D3 Pfam Desc: Elongation factor Tu C-terminal domain
  misc_feature (246)..(399): Pfam Id: MMR_HSR1 Pfam Desc: GTPase of unknown function
  misc_feature (179)..(673): NCBI GI: 115460266 NCBI Desc: os04g0595300 [oryza sativa (japonica cultivar-group)]
  misc_feature (136)..(673): NCBI GI: 115434174 NCBI Desc: os01g0116600 [oryza sativa (japonica cultivar-group)]
  misc_feature (83)..(677): NCBI GI: 140055706 NCBI Desc: zinc finger, ranbp2-type; translation elongation factor tu [medicago truncatula]
  misc_feature (133)..(672): NCBI GI: 115461336 NCBI Desc: os04g0677800 [oryza sativa (japonica cultivar-group)]
  misc_feature (184)..(672): NCBI GI: 38344203 NCBI Desc: osjnba0064g10.19 [oryza sativa (japonica cultivar-group)]
MPRKVVSGPDYDDEYDDYDEYDDDDEYDENEYANNHPVKMGKESLKKSSITVPVHWTCSMCTFSNHESMVYCEMCGVFRETFVKSAKDGLLKDAAVAVSSEPRTSAASKIDSAKTPVKTRAADSDSDSARKHASMSYDKANSMRLPSAGSSLGAEKKKKTPVLSDAVPVERIPLLASDGFQPKGNQSGGASSSSQSDSVIQKLSSDIGQLNVDKNNVNVTKPCLPEEYKPEKWMLADPESGALSQLNLAIVGHVDSGKSTLSGRLLHLLGRISKKDMHKNEKESKEKGKGSFAFAWAMDESSEERERGVTMTVAVAYLETKKFRVVLLDSPGHKDFVPNMISGATQADAAILVIDASTGSFEAGMDGEGGKGVGQTKEHAQLVRSFGVEQLVIAVNKMDAVAYAKERFDFIKLQLGSFLRSCNFKDSAITWIPLSAVENQNLISAPSDARLTSWYQGFCLLDAIDSLQLPSRDVSKPLILPICDVIKSQSTGQLAAYGKLETGAIKNGSKVLVLPSGQEATVKTIERDSNSCTIARAGDNVAICLQGIDGNQLIPGGVLCHPGFPVAVANHLELKVLVLDITTPILFGSQVEFHIHHVKEAARVTKIVALLDRTGKPSKSAPRFLKSKQNALIQVTLDGAVCVQEFSKSRALGRAYLRSSGRTIAVGVVNRIIDIKDPEHPYSLEQLNVVTENSIELNDESNHVRVTFTPTVEHCSMATIIGLCIRVKLVRSLPPRYKVDIRVAPGSHATEAAVNKQLNDKERVAAALENPNLLDMVEECLSPTFD

SEQ ID NO: 277 - DNA, 1026 bp, Sorghum bicolor
  misc_feature: Ceres ANNOT ID no. 6007127
  misc_feature: Encodes the peptide sequence at SEQ ID NO 278
atggcgatgaagattttttctatgcgtgaagcagagttccatgttgatgctgtatactatatgaagaagttcatacttatgtgtgcggcaagcacgcttagtactgtgaaggtgagcaatgtatcactgaaagcagcacagcgtgatataaaggaattcttttccttttctggtgacattgtgcatgttgaaatgcagagtggcgatgagctttctcaagttgcctacattacttttaaagacaatcaaggagctgagactgcaatgcttctcacgggggccacaatagtttatatggctgtaatcgtgacgccagccaatgattatgagctaccggcttctgttttagctgctcttgagcccaaagacacaaaaccttctgcccttcaaaaggctgaagacattgttgggaccatgctggcaaagggatttatccttggtagggatgcactggacaaagcaaaagctttggatgagaagcatcagctcacgtcgactgccacagccagagtatcttcctttgacaagagaattggtctaagtgagaagatcagtgttggtacttcagttgtaaatgacaaagtgaaggaaatggatcagaagtaccaagtctctgagaagacaaagtcagcactggcagctgctgaacagagtgtctcgactgccggatctgctatcatgaagaacaggtatgtcctcaccggagcagcatgggtaactggtgctttcagcaaggtcaccagtgcagccaacgatgttggtgcaaaggcaaaggagaaaatagcagtcgagcaggagcacaagaatgctgaggccgggcctgcacaagcaaacatctcagagttccctgcagcacccagggaattggacagcgaattcacgaagatacatgttgctgaaacccctgaagaaattcccgtctctacggtgactgtccctgctgttacagaggaggagctcagcgaggcctctccaccagctgatgttcctacaaagccagaagctgcacagggtttggtactataa

SEQ ID NO: 278 - protein, 341 aa, Sorghum bicolor
  misc_feature: Ceres ANNOT ID no. 6007127
  misc_feature (33)..(319): NCBI GI: 38344181 NCBI Desc: osjnba0053k19.20 [oryza sativa (japonica cultivar-group)]
  misc_feature (33)..(319): NCBI GI: 116309761 NCBI Desc: h0215f08.15 [oryza sativa (indica cultivar-group)]
  misc_feature (33)..(333): NCBI GI: 89274206 NCBI Desc: rna recognition motif. (a.k.a. rrm, rbd, or rnp domain) containing protein [brassica oleracea]
  misc_feature (33)..(303): NCBI GI: 89257671 NCBI Desc: rna recognition motif (rrm)-containing protein [brassica oleracea]
  misc_feature (25)..(275): NCBI GI: 115465990 NCBI Desc: os06g0112400 [oryza sativa (japonica cultivar-group)]
  misc_feature: The plant is abnormally small.
  misc_feature: Useful for making plants with altered alkaloid content
  misc_feature: Useful for making plants with modulated biomass
  misc_feature: Functional homolog of the protein sequence given in SEQ ID NO 13029
  misc_feature: GREAT-hit functional homolog of the protein sequence given in SEQ ID NO 13167
  misc_feature: Useful for making plants with altered alkaloid content
  misc_feature: Functional homolog of the protein sequence given in SEQ ID NO 13167
  misc_feature: Useful for making plants with altered lignin content
  misc_feature: Functional homolog of the protein sequence given in SEQ ID NO 13052
  misc_feature: Useful for making plants with modulated biomass
  misc_feature: Functional homolog of the protein sequence given in SEQ ID NO 13029
MAMKIFSMREAEFHVDAVYYMKKFILMCAASTLSTVKVSNVSLKAAQRDIKEFFSFSGDIVHVEMQSGDELSQVAYITFKDNQGAETAMLLTGATIVYMAVIVTPANDYELPASVLAALEPKDTKPSALQKAEDIVGTMLAKGFILGRDALDKAKALDEKHQLTSTATARVSSFDKRIGLSEKISVGTSVVNDKVKEMDQKYQVSEKTKSALAAAEQSVSTAGSAIMKNRYVLTGAAWVTGAFSKVTSAANDVGAKAKEKIAVEQEHKNAEAGPAQANISEFPAAPRELDSEFTKIHVAETPEEIPVSTVTVPAVTEEELSEASPPADVPTKPEAAQGLVL

SEQ ID NO: 279 - DNA, 1881 bp, Sorghum bicolor
  misc_feature: Ceres ANNOT ID no. 6007137
  misc_feature: Encodes the peptide sequence at SEQ ID NO 280
atgcctcggaagtcgcacaagccgaggggcgcggccgcgcacgcccccgttggtctcacggccgggccgaggcctcccctgaaggccgcggccccaaaccctagccccgcgtccgagcttccccaggctggcgtagcagaggccgagggccttaaggcacctgacgccggggcgtccgccgccgctgaggccctggagcgcctccacgtcggccctgcttctgatggtgacccgccgtcgctgccgccttctgagcccgtggacgaggcctccgcgccgcctcagccgccgccggtcgaggcgtcgtcttccgggaggtctgcggcgggcgggagttgggaggaggaggctgtaaggaagctgcacgagctggcggaggttggtggggatgaggtggagttgaccgaggaggaggtgcgcgccaatgatcagaggcaggaggacgagatctgtgccctcgaagcaatttttggagatgctgtagtgattttggacagaaagggaggccagcggtctttccaggttcttgtgcatattgagatcccagattctatagatgtatcaacaaagctcaattatggtgatggaacattaaattatggggcaacatgtgatgatgatgatgaccttttctacaagttcagagttgagcatttgcctccaatcctgctaacatgtctcctgcctacatcatacccaagtcaccgtcctccctttttcactatatccacatattggcttgataaacggatgatttcattgttatgtcgcatgcttgatatgctttgggaagagcaacaagggatggaagtagcatatcaatgggtgcaatggctccaaagttcttccctttctcacttagggtttgataatggagtaattttgagcaagagtgatgtgacatgtgatgcagatggtgaagataagcgtgcttgtccagacaatgctccaccagatgttataattccaaggctgatgagatacaatgacaataagcatcatgaagctttcttacatgctatccatgattgcatgatttgtttcagcgagtgtcctggtgttgatttcatcaaacttccgtgtcatcatttcttttgctggaaatgcatgcaaacatactgcaaaatgaatgtcaaggaaggaaatgtagtgaagttgctatgtcctgatacaaaatgtgaaggtgctgttcctccgaatgtattgaaaaggctgcttgaagaggatgaatatgaacgttgggagggattactgcttcagagaactcttgatgccatgaaagatgttgtgtactgtccaagatgtcaaactgcttgcttggaggatgtagcttttgcaccctttgtagaaatcgccgccatgttggagagcaataaacgccaagaatctgggaatgtgcaaggagatcagatgaaaattctagaggaactacgcagcctgaaggaaattatgaaggattcaaaacagtgcccaaaatgcaggatggccatatctaagacagaaggatgcaataagatgcattgtgggaactgtggggagtacttttgctatcaatgcaaccgtgcgatcactggatatgagcatttcaggggttcttgtgtgcttttccctcaagaggaactggacagatgggaattgcaaatgaatcaaagggtccgacgccaagttgttgcacatgcgcatgctgaaatgcatgggcgggatggtcaagctcatccttgccctacttgtcggcaaccgtctccaaagatcggaaacaacaaccacctcttctgttgggcatgccagaagcatttttgtgccctgtgccataagactgtccaaaagcctgcacagcattatggtcccaaaggatgcaagcaacattcggcggatccctga

SEQ ID NO: 280 - protein, 626 aa, Sorghum bicolor
  misc_feature: Ceres ANNOT ID no. 6007137
  misc_feature (141)..(283): Pfam Id: RWD Pfam Desc: RWD domain
  misc_feature (22)..(626): NCBI GI: 58532138 NCBI Desc: osjnba0009p12.27 [oryza sativa (japonica cultivar-group)]
  misc_feature (117)..(442): NCBI GI: 116311049 NCBI Desc: osigba0142i02-osigba0101b20.23 [oryza sativa (indica cultivar-group)]
  misc_feature (30)..(442): NCBI GI: 116311052 NCBI Desc: osigba0142i02-osigba0101b20.26 [oryza sativa (indica cultivar-group)]
  misc_feature (431)..(626): NCBI GI: 116311048 NCBI Desc: osigba0142i02-osigba0101b20.22 [oryza sativa (indica cultivar-group)]
  misc_feature (159)..(442): NCBI GI: 115460250 NCBI Desc: os04g0594000 [oryza sativa (japonica cultivar-group)]
  misc_feature: The sequence is a functional homolog of SEQ ID NO 1727 in the 10/374,780US patent application
  misc_feature: Useful for making plants with modulated growth and phenotype characteristics
  misc_feature: The sequence is a functional homolog of SEQ ID NO 1727 in the 20060162006 US patent application
  misc_feature: The sequence is a functional homolog of SEQ ID NO. 493 in the 11/188,298 US application
MPRKSHKPRGAAAHAPVGLTAGPRPPLKAAAPNPSPASELPQAGVAEAEGLKAPDAGASAAAEALERLHVGPASDGDPPSLPPSEPVDEASAPPQPPPVEASSSGRSAAGGSWEEEAVRKLHELAEVGGDEVELTEEEVRANDQRQEDEICALEAIFGDAVVILDRKGGQRSFQVLVHIEIPDSIDVSTKLNYGDGTLNYGATCDDDDDLFYKFRVEHLPPILLTCLLPTSYPSHRPPFFTISTYWLDKRMISLLCRMLDMLWEEQQGMEVAYQWVQWLQSSSLSHLGFDNGVILSKSDVTCDADGEDKRACPDNAPPDVIIPRLMRYNDNKHHEAFLHAIHDCMICFSECPGVDFIKLPCHHFFCWKCMQTYCKMNVKEGNVVKLLCPDTKCEGAVPPNVLKRLLEEDEYERWEGLLLQRTLDAMKDVVYCPRCQTACLEDVAFAPFVEIAAMLESNKRQESGNVQGDQMKILEELRSLKEIMKDSKQCPKCRMAISKTEGCNKMHCGNCGEYFCYQCNRAITGYEHFRGSCVLFPQEELDRWELQMNQRVRRQVVAHAHAEMHGRDGQAHPCPTCRQPSPKIGNNNHLFCWACQKHFCALCHKTVQKPAQHYGPKGCKQHSADP

SEQ ID NO: 281 - DNA, 1881 bp, Sorghum bicolor; identical to SEQ ID NO: 279
  misc_feature: Ceres ANNOT ID no. 6007142
  misc_feature: Encodes the peptide sequence at SEQ ID NO 282

SEQ ID NO: 282 - protein, 626 aa, Sorghum bicolor; identical to SEQ ID NO: 280
  misc_feature: Ceres ANNOT ID no. 6007142
  misc_feature (141)..(283): Pfam Id: RWD Pfam Desc: RWD domain
  misc_feature (22)..(626): NCBI GI: 58532138 NCBI Desc: osjnba0009p12.27 [oryza sativa (japonica cultivar-group)]
  misc_feature (117)..(442): NCBI GI: 116311049 NCBI Desc: osigba0142i02-osigba0101b20.23 [oryza sativa (indica cultivar-group)]
  misc_feature (30)..(442): NCBI GI: 116311052 NCBI Desc: osigba0142i02-osigba0101b20.26 [oryza sativa (indica cultivar-group)]
  misc_feature (431)..(626): NCBI GI: 116311048 NCBI Desc: osigba0142i02-osigba0101b20.22 [oryza sativa (indica cultivar-group)]
  misc_feature (159)..(442): NCBI GI: 115460250 NCBI Desc: os04g0594000 [oryza sativa (japonica cultivar-group)]
  misc_feature: The sequence is a functional homolog of SEQ ID NO 1727 in the 10/374,780US patent application
  misc_feature: Useful for making plants with modulated growth and phenotype characteristics
  misc_feature: The sequence is a functional homolog of SEQ ID NO 1727 in the 20060162006 US patent application
  misc_feature: The sequence is a functional homolog of SEQ ID NO. 493 in the 11/188,298 US application

SEQ ID NO: 283 - DNA, 2664 bp, Sorghum bicolor
  misc_feature: Ceres ANNOT ID no. 6007151
  misc_feature: Encodes the peptide sequence at SEQ ID NO 284
atggcttcgacgcatgctctaaagaagaactaccgctgcgaccgctccctgcagcagttctacactggcgggccctttgcggtcgggctcgcccccggcggcgatggcgagggcgagggcggcgcccaggctgaggccttcctcgcgtgcgcatgcggtggggaggtgcgcgtggtgtccgccgcggacgcctccgccataggggagcccgtcgacggcgactcggaggccatcaccgcgctggcgctgtcccccgactcacggctcatcttcgccgcgggccacagcaggcttattagggtctgggacctcgcgtcccgaacttgcatacgcagctggaaggggcatgatggtcctatcatggccatggcatgccatgcttctggtggtttgcttgcaactgccggagcagacaagaaggtctgcgtatgggatgtcgatggtggattttgcacccatttccttagaggccatacaggtgttgtgacgaccattatgttccacaaagatccaaagcgccttctgttgttttcaggaagtgaagatggcaccgtgcgagtgtggaaccttgaaaccaaaaaatgtgttgctgtgcttaaagagcatttttcggcagtcacttcattgacattgtctgatgatggacaaacattgctcagtgctggaagggataagattgttactgcatgggatattcgtaagtacagctcaaagaagacaataccgacatatgaaatgatagaagctgtttccttcattggatcaggaagtgagctcttggcttgtttgggcatagaactggcaaatataaaggagaaagcggccagttattttcttacagttggtgaacgtggggtcgtgcgcatctggtgcttggagagttcgctttgcgtgttcgagcagcaaacatctgatgtaactgttaactcagagaacgaggaaaccaggaggggctttacatctgctgttatgttgccaaatgatcaaggattactatgtgttactgccgatcagcagtttttgttctattgtcccaaaagaactgatgatgggacctttgaactgtctctatatagacgactaataggttataatgatgagattcttgacttgaagtttgttggggaggaggaacaatatcttgctgtagctaccaacttggagcaggtccgtgtttatgatgttgcgtcgatgtcatgttcttatgtacttgctggccacaccgaaatagttgtttgcattgacacctgtgtctctgcttctgggaagacacttgttgtaactgggagcaaggataatactgtgaggttatgggatgttgaaagaaaaagctgtattggcattggcaaaggccatctgggtgctgttggttctgttgccttctcaaagaaaacaaagaacttctttgttagtggcagcagcgatcggaccatcaaggtatggacctgggacgatgcacttggtgatgctgaggatgaagtctctcttaaagcaaaggctgttgtagctgcacatgataaagatattaattctctggcaatttcacctaatgatggccttgtttgcagtggttctgaggaccgaactgcctgcatatggaaactccctaacctagtgtcctctattgtccttaagggacacaaaagaggaatctggtcagttgagttttctcccattgaacaatgtgtcatgacatcctctggtgatagaacaatcaaaatatggtctgttgctgatggctcatgcttgaagacatttgagggccatacatcaagtgttctgcgagcttctttcctttcacgtggaactcaaattgtttcttgtggaagtgatggcctagtgaagttatggacaatcaagacaaatgaatgcattgctacttatgataagcatgatgggaaggtctgggcattggctgttggcatgaaaactgaaatggttgcaactggtggaaccgattctgtcctcaacctatggcatgattgtaccaaggaagataagcaggaagatttccgtaagaaggaggaagaagttttaagaggccaggaattggaaaatgctgtgtcagattctgactatgcaaaggcaatacaacttgcatttgagcttagaagaccacacaggcttctagatttattctcacagcttgccaggagagctgatgcagaggatccaatagaaaaggctcttcttggtcttccaaaggatggcctccgcgtgcttcttgagtatgttcgtgaatggaatacgaagcccaagttctgtcatgttgcacagtttgtgctttttcgggtattgaggagtttctctcccactgatatcctggagataaagggcatcagtgagctccttgagggccttattccgtattcgcagaggcatttcagcagagtcgacagactagttcgaagcacgtttctgttggactatacactgatgcgaatgtccgtggtagattcagatgtagatgcgggcacaatcaaagatgaaatgaatggttcatctgtggagaatggtgaacttgcagagcctcggcctgcttcacctgtaccagagaagtcaagcaagaagagaaagtccagcaaatcaagtaaaaagggtaaggagaagaaggtgaaggttgcctcgagtggacacagcaatgatgtttctgttgaagcctga

SEQ ID NO: 284 - protein, 887 aa, Sorghum bicolor
  misc_feature: Ceres ANNOT ID no. 6007151
  misc_feature (107)..(145): Pfam Id: WD40 Pfam Desc: WD domain, G-beta repeat
  misc_feature (149)..(189): Pfam Id: WD40 Pfam Desc: WD domain, G-beta repeat
  misc_feature (193)..(231): Pfam Id: WD40 Pfam Desc: WD domain, G-beta repeat
  misc_feature (398)..(439): Pfam Id: WD40 Pfam Desc: WD domain, G-beta repeat
  misc_feature (443)..(482): Pfam Id: WD40 Pfam Desc: WD domain, G-beta repeat
  misc_feature (496)..(534): Pfam Id: WD40 Pfam Desc: WD domain, G-beta repeat
  misc_feature (538)..(576): Pfam Id: WD40 Pfam Desc: WD domain, G-beta repeat
  misc_feature (580)..(618): Pfam Id: WD40 Pfam Desc: WD domain, G-beta repeat
  misc_feature (622)..(660): Pfam Id: WD40 Pfam Desc: WD domain, G-beta repeat
  misc_feature (681)..(816): Pfam Id: Utp13 Pfam Desc: Utp13 specific WD40 associated domain
  misc_feature (1)..(887): NCBI GI: 116311044 NCBI Desc: osigba0142i02-osigba0101b20.18 [oryza sativa (indica cultivar-group)]
  misc_feature (5)..(885): NCBI GI: 9755727 NCBI Desc: wd40-repeat protein [arabidopsis thaliana]
  misc_feature (5)..(829): NCBI GI: 21539573 NCBI Desc: wd40-repeat protein [arabidopsis thaliana]
  misc_feature (45)..(877): NCBI GI: 55250840 NCBI Desc: zgc:101778 [danio rerio]
  misc_feature (277)..(817): NCBI GI: 55250084 NCBI Desc: tbl3 protein [rattus norvegicus]
  misc_feature: The sequence is a functional homolog of SEQ ID NO. 502 in the 11/188,298 US application
  misc_feature: The sequence is a functional homolog of SEQ ID NO. 485 in the 11/188,298 US application
MASTHALKKNYRCDRSLQQFYTGGPFAVGLAPGGDGEGEGGAQAEAFLACACGGEVRVVSAADASAIGEPVDGDSEAITALALSPDSRLIFAAGHSRLIRVWDLASRTCIRSWKGHDGPIMAMACHASGGLLATAGADKKVCVWDVDGGFCTHFLRGHTGVVTTIMFHKDPKRLLLFSGSEDGTVRVWNLETKKCVAVLKEHFSAVTSLTLSDDGQTLLSAGRDKIVTAWDIRKYSSKKTIPTYEMIEAVSFIGSGSELLACLGIELANIKEKAASYFLTVGERGVVRIWCLESSLCVFEQQTSDVTVNSENEETRRGFTSAVMLPNDQGLLCVTADQQFLFYCPKRTDDGTFELSLYRRLIGYNDEILDLKFVGEEEQYLAVATNLEQVRVYDVASMSCSYVLAGHTEIVVCIDTCVSASGKTLVVTGSKDNTVRLWDVERKSCIGIGKGHLGAVGSVAFSKKTKNFFVSGSSDRTIKVWTWDDALGDAEDEVSLKAKAVVAAHDKDINSLAISPNDGLVCSGSEDRTACIWKLPNLVSSIVLKGHKRGIWSVEFSPIEQCVMTSSGDRTIKIWSVADGSCLKTFEGHTSSVLRASFLSRGTQIVSCGSDGLVKLWTIKTNECIATYDKHDGKVWALAVGMKTEMVATGGTDSVLNLWHDCTKEDKQEDFRKKEEEVLRGQELENAVSDSDYAKAIQLAFELRRPHRLLDLFSQLARRADAEDPIEKALLGLPKDGLRVLLEYVREWNTKPKFCHVAQFVLFRVLRSFSPTDILEIKGISELLEGLIPYSQRHFSRVDRLVRSTFLLDYTLMRMSVVDSDVDAGTIKDEMNGSSVENGELAEPRPASPVPEKSSKKRKSSKSSKKGKEKKVKVASSGHSNDVSVEA

SEQ ID NO: 285 - DNA, 765 bp, Sorghum bicolor
  misc_feature: Ceres ANNOT ID no. 6007152
  misc_feature: Encodes the peptide sequence at SEQ ID NO 286
atggggcgggacgagaggttcccggtgtgggaggccgcgctcggcgccggggtcgccgccgccttcgccgctgggctcgtcggggtctacctttccatgccggactccgactacagcttcctcaagttgccacgtaatctcgaggaactccaaatcctcactggccatcttgagaactatactagtgattacaccctacaggtgttagtaggttattgcgctgtgtacatcttcatgcagaccttcatgatcccagggacaatattcatgtctctgcttgctggtgctctatttgggcaactccggggcttggccctggtggtctttgctgccactgctggtgcttcttcgtgctatttcctgtcgaagatgattgggaagccactggtgttcacactgtggccagataagctcagcttcttccagagacaggttgctaaaagaagagagaagctgttgaattacatacttttcctcagggtgaccccaacgttgccaaatactttcatcaacttagcttcacccatagtagatgtcccctaccatacattcttactgggaactctcattggtcttatcccagctgcttatgtgactgtcagggctggaattgctctaggagagttaacttcgctgagtgacctttacgacacccagtctatagcactgctattcctgatcggtgttgtttcagtcacaccagcattgttgggcaaggacgaggcacaagaaaaaccatcagaaatggtggtaggcgcgtcatga

SEQ ID NO: 286 - protein, 254 aa, Sorghum bicolor
  misc_feature: Ceres ANNOT ID no. 6007152
  misc_feature (84)..(205): Pfam Id: SNARE_assoc Pfam Desc: SNARE associated Golgi protein
  misc_feature (1)..(254): NCBI GI: 115460234 NCBI Desc: os04g0592600 [oryza sativa (japonica cultivar-group)]
  misc_feature (1)..(254): NCBI GI: 116311043 NCBI Desc: osigba0142i02-osigba0101b20.17 [oryza sativa (indica cultivar-group)]
  misc_feature (6)..(201): NCBI GI: 51997111 NCBI Desc: gtk16 protein [gerbera hybrid cultivar]
  misc_feature (1)..(245): NCBI GI: 54643111 NCBI Desc: ga21055-pa [drosophila pseudoobscura]
  misc_feature (18)..(244): NCBI GI: 436224 NCBI Desc: kiaa0033 [homo sapiens]
MGRDERFPVWEAALGAGVAAAFAAGLVGVYLSMPDSDYSFLKLPRNLEELQILTGHLENYTSDYTLQVLVGYCAVYIFMQTFMIPGTIFMSLLAGALFGQLRGLALVVFAATAGASSCYFLSKMIGKPLVFTLWPDKLSFFQRQVAKRREKLLNYILFLRVTPTLPNTFINLASPIVDVPYHTFLLGTLIGLIPAAYVTVRAGIALGELTSLSDLYDTQSIALLFLIGVVSVTPALLGKDEAQEKPSEMVVGAS

SEQ ID NO: 287 - DNA, 837 bp, Sorghum bicolor
  misc_feature: Ceres ANNOT ID no. 6007165
  misc_feature: Encodes the peptide sequence at SEQ ID NO 288
atggcgctctcgctcgcgcgcagccccagccccggcgcggcgctccccgccgcgcgggttccccactttgcccttcctctcctcccgctccgctcccctcgccaccagtgccaggcgcgcctccgcctccgcctccgcgtcgcggcatcctcgcccccggcggcgcaggcagccgccgcccccgtggtggcggaggaggaggaggagcagggggagaagcggcggaagctctacgtggccaacctgccctggtccttcccggcgccggagatcgagaaactcttcgcgcagcacggcaccgtcaaggacgtcgaggtcatcaaggggaaggatggcaggaacagggggttcgcgttcgtgacgatgtcgacgacggaggaggcagctgcggcagctgagaagcttaactcccatgatgtaatggggcggacaatcaaggtggagttttcaagaagcttcagaaaaccagctccgcttcctcccattatagagaggcacaagctttacgtgtccaatcttccatggaaagcaagggctcccaatgttaaagagttctttgcaaagtttaacccgctttctgctaacgttatattcgataatggaaaagcagctgggtattgttttgtttcctttgggacaaaagaagaagcagaggctgctctcactgagcttgatggaaaggaacttatgggaagacctgtacgcttgtattggcgggaaagtggtgatgataaggttgaagttgcaaaggccgacagtgaagttgaagttgtaaatattgaaggagcaagcgttgatgatgccagcacagatggaggtgaagataaacaggaatag

SEQ ID NO: 288 - protein, 278 aa, Sorghum bicolor
  misc_feature: Ceres ANNOT ID no. 6007165
  misc_feature (77)..(147): Pfam Id: RRM_1 Pfam Desc: RNA recognition motif. (a.k.a. RRM, RBD, or RNP domain)
  misc_feature (168)..(236): Pfam Id: RRM_1 Pfam Desc: RNA recognition motif. (a.k.a. RRM, RBD, or RNP domain)
  misc_feature (2)..(278): NCBI GI: 116311029 NCBI Desc: osigba0142i02-osigba0101b20.3 [oryza sativa (indica cultivar-group)]
  misc_feature (2)..(278): NCBI GI: 38346724 NCBI Desc: osjnba0086o06.22 [oryza sativa (japonica cultivar-group)]
  misc_feature (56)..(278): NCBI GI: 92878611 NCBI Desc: rna-binding region rnp-1 (rna recognition motif) [medicago truncatula]
  misc_feature (2)..(139): NCBI GI: 58532112 NCBI Desc: osjnba0009p12.1 [oryza sativa (japonica cultivar-group)]
  misc_feature (59)..(236): NCBI GI: 168526 NCBI Desc: nucleic acid-binding protein
  misc_feature: The sequence is a functional homolog of SEQ ID NO. 339 in the 11/188,298 US application
  misc_feature: The sequence is a functional homolog of SEQ ID NO. 458 in the 11/188,298 US application
MALSLARSPSPGAALPAARVPHFALPLLPLRSPRHQCQARLRLRLRVAASSPPAAQAAAAPVVAEEEEEQGEKRRKLYVANLPWSFPAPEIEKLFAQHGTVKDVEVIKGKDGRNRGFAFVTMSTTEEAAAAAEKLNSHDVMGRTIKVEFSRSFRKPAPLPPIIERHKLYVSNLPWKARAPNVKEFFAKFNPLSANVIFDNGKAAGYCFVSFGTKEEAEAALTELDGKELMGRPVRLYWRESGDDKVEVAKADSEVEVVNIEGASVDDASTDGGEDKQE

SEQ ID NO: 289 - DNA, 939 bp, Sorghum bicolor
  misc_feature: Ceres ANNOT ID no. 6007176
  misc_feature: Encodes the peptide sequence at SEQ ID NO 290
atggccggcctcgacctcggcaccgctgcgacgcgctacgttcatcagctccaccacctccaccccgacctccagctgcagcacagctacgccaagcagccggagccctccgaggatgaccctcatggcagcggcggcggcggcggcaacagcaacaacggcgggccgtatggtgagcacgacggcgggtcgtcctcatccggcccaggcgccggagacgcccccggtggcagcggcggtaacggggagatggtagcccgccgaccgcgcggccgcccgccgggctcgaagaataagcccaagcccccggtgatcatcacgcgggagagcgccaacacgctgcgcgcccacatcctggaggtcgggagcggctgcgacgtgttcgagagcgtctccacgtacgcgcgccggcggcagcgcggcgtctgcgtgctgagcggcagcggcgtggtcaccaacgtgacgctgcggcagccgtcggcgcccacgggcgccgtcgtgacgctgcacgggaggttcgagatcctgtcgctctcgggttctttcctcccgccgccggctccgcccggcgccaccagcctcaccatcttcctcgcggggggccaggggcaggtggtcggcgggaatgtcgtgggtgcgctctacgccgcaggccccgtcatcgtcatcgccgcgtccttcgccaacgtcgcctacgagcgtctcccgctggaggaggaagaggctcaggcagcgccacccggcctccagatgcagccacccggcggtggtgtcgatggcgctggtggaggcatgggcggtgggccgttccctcccgacccgtcggctgccgggctgccgttcttcaacctgccgctcaacaacatggccggtggcgggtcgcagctcccgcccggcgccgacggccatggttgggccggtgcacggccgccgttctga

SEQ ID NO: 290 - protein, 312 aa, Sorghum bicolor
  misc_feature: Ceres ANNOT ID no. 6007176
  misc_feature (1)..(312): NCBI GI: 38346718 NCBI Desc: osjnba0086o06.16 [oryza sativa (japonica cultivar-group)]
  misc_feature (42)..(312): NCBI GI: 115474893 NCBI Desc: os08g0159700 [oryza sativa (japonica cultivar-group)]
  misc_feature (73)..(298): NCBI GI: 119331582 NCBI Desc: at-hook dna-binding protein [catharanthus roseus]
  misc_feature (23)..(312): NCBI GI: 119331584 NCBI Desc: at-hook dna-binding protein [catharanthus roseus]
  misc_feature (1)..(312): NCBI GI: 41052877 NCBI Desc: dna-binding protein-like [oryza sativa (japonica cultivar-group)]
  misc_feature: The plant flowers significantly late compared to wild-type.
  misc_feature: The sequence is a functional homolog of SEQ ID NO 10 in the 10/669,824US patent application
  misc_feature: The sequence is a functional homolog of SEQ ID NO 10 in the 10/870,198US patent application
  misc_feature: The sequence is a functional homolog of SEQ ID NO 1098 in the 10/225,066US patent application
  misc_feature: The sequence is a functional homolog of SEQ ID NO 1395 in the 10/374,780US patent application
  misc_feature: The sequence is a functional homolog of SEQ ID NO 1399 in the 10/374,780US patent application
  misc_feature: The sequence is a functional homolog of SEQ ID NO 14 in the 11/375,241US patent application
  misc_feature: The sequence is a functional homolog of SEQ ID NO 1400 in the 10/374,780US patent application
  misc_feature: The sequence is a functional homolog of SEQ ID NO 1402 in the 10/374,780US patent application
  misc_feature: The sequence is a functional homolog of SEQ ID NO 1403 in the 10/374,780US patent application
  misc_feature: The sequence is a functional homolog of SEQ ID NO 1404 in the 10/374,780US patent application
  misc_feature: The sequence is a functional homolog of SEQ ID NO 1406 in the 10/374,780US patent application
  misc_feature: The sequence is a functional homolog of SEQ ID NO 1408 in the 10/374,780US patent application
  misc_feature: The sequence is a functional homolog of SEQ ID NO 1410 in the 10/374,780US patent application
  misc_feature: The sequence is a functional homolog of SEQ ID NO 1414 in the 10/374,780US patent application
  misc_feature: The sequence is a functional homolog of SEQ ID NO 1415 in the 10/374,780US patent application
  misc_feature: The sequence is a functional homolog of SEQ ID NO 1416 in the 10/374,780US patent application
  misc_feature: The sequence is a functional homolog of SEQ ID NO 1417 in the 10/374,780US patent application
  misc_feature: The sequence is a functional homolog of SEQ ID NO 150 in the 10/412,699US patent application
  misc_feature: The sequence is a functional homolog of SEQ ID NO 1507 in the 10/412,699US patent application
  misc_feature: The sequence is a functional homolog of SEQ ID NO 1509 in the 10/412,699US patent application
  misc_feature: The sequence is a functional homolog of SEQ ID NO 1510 in the 10/412,699US patent application
  misc_feature: The sequence is a functional homolog of SEQ ID NO 1515 in the 11/479,226US patent application
  misc_feature: The sequence is a functional homolog of SEQ ID NO 16 in the 10/669,824US patent application
  misc_feature: The sequence is a functional homolog of SEQ ID NO 16 in the 10/870,198US patent application
  misc_feature: The sequence is a functional homolog of SEQ ID NO 18 in the 10/412,699US patent application
  misc_feature: The sequence is a functional homolog of SEQ ID NO 18 in the 10/669,824US patent application
  misc_feature: The sequence is a functional homolog of SEQ ID NO 18 in the 10/870,198US patent application
  misc_feature: The sequence is a functional homolog of SEQ ID NO 184 in the 10/412,699US patent application
  misc_feature: The sequence is a functional homolog of SEQ ID NO 1840 in the 10/412,699US patent application
  misc_feature: The sequence is a functional homolog of SEQ ID NO 2080 in the 10/374,780US patent application
  misc_feature: The sequence is a functional homolog of SEQ ID NO 22 in the 10/669,824US patent application
  misc_feature: The sequence is a functional homolog of SEQ ID NO 22 in the 10/870,198US patent application
  misc_feature: The sequence is a functional homolog of SEQ ID NO 226 in the 10/374,780US patent application
  misc_feature: The sequence is a functional homolog of SEQ ID NO 24 in the 10/669,824US patent application
  misc_feature: The sequence is a functional homolog of SEQ ID NO 24 in the 10/870,198US patent application
  misc_feature: The sequence is a functional homolog of SEQ ID NO 258 in the 10/225,066US patent application
  misc_feature: The sequence is a functional homolog of SEQ ID NO 26 in the 10/669,824US patent application
  misc_feature: The sequence is a functional homolog of SEQ ID NO 26 in the 10/870,198US patent application
  misc_feature: The sequence is a functional homolog of SEQ ID NO 28 in the 10/669,824US patent application
  misc_feature: The sequence is a functional homolog of SEQ ID NO 28 in the 10/870,198US patent application
  misc_feature: The sequence is a functional homolog of SEQ ID NO 302 in the 11/435,388US patent application
  misc_feature: The sequence is a functional homolog of SEQ ID NO 304 in the 10/714,887US patent application
  misc_feature: The sequence is a functional homolog of SEQ ID NO 304 in the 11/435,388US patent application
  misc_feature: The sequence is a functional homolog of SEQ ID NO 306 in the 10/714,887US patent application
  misc_feature: The sequence is a functional homolog of SEQ ID NO 316 in the 11/435,388US patent application
  misc_feature: The sequence is a functional homolog of SEQ ID NO 318 in the 10/714,887US patent application
  misc_feature: The sequence is a functional homolog of SEQ ID NO 32 in the 10/669,824US patent application
  misc_feature: The sequence is a functional homolog of SEQ ID NO 32 in the 10/870,198US patent application
  misc_feature: The sequence is a functional homolog of SEQ ID NO 340 in the 11/435,388US patent application
  misc_feature: The sequence is a functional homolog of SEQ ID NO 342 in the 10/714,887US patent application
  misc_feature: The sequence is a functional homolog of SEQ ID NO 344 in the 11/435,388US patent application
  misc_feature: The sequence is a functional homolog of SEQ ID NO 346 in the 10/714,887US patent application
  misc_feature: The sequence is a functional homolog of SEQ ID NO 346 in the 11/435,388US patent application
  misc_feature: The sequence is a functional homolog of SEQ ID NO 348 in the 10/714,887US patent application
  misc_feature: The sequence is a functional homolog of SEQ ID NO 348 in the 11/435,388US patent application
  misc_feature: The sequence is a functional homolog of SEQ ID NO 350 in the 10/714,887US patent application
  misc_feature: The sequence is a functional homolog of SEQ ID NO 350 in the 11/435,388US patent application
  misc_feature: The sequence is a functional homolog of SEQ ID NO 352 in the 10/714,887US patent application
  misc_feature: The sequence is a functional homolog of SEQ ID NO 352 in the 11/435,388US patent application
  misc_feature: The sequence is a functional homolog of SEQ ID NO 354 in the 10/714,887US patent application
  misc_feature: The sequence is a functional homolog of SEQ ID NO 38 in the 10/669,824US patent application
  misc_feature: The sequence is a functional homolog of SEQ ID NO 38 in the 10/870,198US patent application
  misc_feature: The sequence is a functional homolog of SEQ ID NO 386 in the 11/435,388US patent application
  misc_feature: The sequence is a functional homolog of SEQ ID NO 388 in the 10/714,887US patent application
  misc_feature: The sequence is a functional homolog of SEQ ID NO 388 in the 11/435,388US patent application
  misc_feature: The sequence is a functional homolog of SEQ ID NO 390 in the 10/714,887US patent application
  misc_feature: The sequence is a functional homolog of SEQ ID NO 390 in the 11/435,388US patent application
  misc_feature: The sequence is a functional homolog of SEQ ID NO 392 in the 10/714,887US patent application
  misc_feature: The sequence is a functional homolog of SEQ ID NO 397 in the 11/479,226US patent application
  misc_feature: The sequence is a functional homolog of SEQ ID NO 420 in the 10/374,780US patent application
  misc_feature: The sequence is a functional homolog of SEQ ID NO 46 in the 10/374,780US patent application
  misc_feature: The sequence is a functional homolog of SEQ ID NO 46 in the 10/669,824US patent application
  misc_feature: The sequence is a functional homolog of SEQ ID NO 46 in the 10/870,198US patent application
  misc_feature: The sequence is a functional homolog of SEQ ID NO 52 in the 10/669,824US patent application
  misc_feature: The sequence is a functional homolog of SEQ ID NO 52 in the 10/870,198US patent application
  misc_feature: The sequence is a functional homolog of SEQ ID NO 54 in the 10/669,824US patent application
  misc_feature: The sequence is a functional homolog of SEQ ID NO 54 in the 10/870,198US patent application
  misc_feature: The sequence is a functional homolog of SEQ ID NO 56 in the 10/225,066US patent application
  misc_feature: The sequence is a functional homolog of SEQ ID NO 590 in the 11/435,388US patent application
  misc_feature: The sequence is a functional homolog of SEQ ID NO 6 in the 10/225,068US patent application
  misc_feature: The sequence is a functional homolog of SEQ ID NO 64 in the 10/669,824US patent application
  misc_feature: The sequence is a functional homolog of SEQ ID NO 64 in the 10/870,198US patent application
  misc_feature: The sequence is a functional homolog of SEQ ID NO 726 in the 10/412,699US patent application
  misc_feature: The sequence is a functional homolog of SEQ ID NO 728 in the 10/412,699US patent application
  misc_feature: The sequence is a functional homolog of SEQ ID NO 830 in the 11/435,388US patent application
  misc_feature: The sequence is a functional homolog of SEQ ID NO 86 in the 10/669,824US patent application
  misc_feature: The sequence is a functional homolog of SEQ ID NO 90 in the 10/669,824US patent application
  misc_feature: Useful for making plants with modulated flowering time
  misc_feature: Useful for making plants with modulated growth and phenotype characteristics
  misc_feature: Useful for making plants with modulated low light sensitivity
  misc_feature: Useful for making plants with modulated light quality response
  misc_feature: Functional homolog of the protein sequence given in SEQ ID NO 13229
  misc_feature: The sequence is a functional homolog of SEQ ID NO 150 in the 20040045049 US patent application
  misc_feature: The sequence is a functional homolog of SEQ ID NO 1507 in the 20040045049 US patent application
  misc_feature: The sequence is a functional homolog of SEQ ID NO 1509 in the 20040045049 US patent application
  misc_feature: The sequence is a functional homolog of SEQ ID NO 1510 in the 20040045049 US patent application
  misc_feature: The sequence is a functional homolog of SEQ ID NO 18 in the 20040045049 US patent application
  misc_feature: The sequence is a functional homolog of SEQ ID NO 184 in the 20040045049 US patent application
  misc_feature: The sequence is a functional homolog of SEQ ID NO 1840 in the 20040045049 US patent application
  misc_feature: The sequence is a functional homolog of SEQ ID NO 726 in the 20040045049 US patent application
  misc_feature: The sequence is a functional homolog of SEQ ID NO 16 in the 20040128712 US patent application
  misc_feature: The sequence is a functional homolog of SEQ ID NO 18 in the 20040128712 US patent application
  misc_feature: The sequence is a functional homolog of SEQ ID NO 24 in the 20040128712 US patent application
  misc_feature: The sequence is a functional homolog of SEQ ID NO 26 in the 20040128712 US patent application
  misc_feature: The sequence is a functional homolog of SEQ ID NO 28 in the 20040128712 US patent application
  misc_feature: The sequence is a functional homolog of SEQ ID NO 32 in the 20040128712 US patent application
  misc_feature: The sequence is a functional homolog of SEQ ID NO 38 in the 20040128712 US patent application
  misc_feature: The sequence is a functional homolog of SEQ ID NO 46 in the 20040128712 US patent application
  misc_feature: The sequence is a functional homolog of SEQ ID NO 64 in the 20040128712 US patent application
  misc_feature: The sequence is a functional homolog of SEQ ID NO 86 in the 20040128712 US patent application
  misc_feature: The sequence is a functional homolog of SEQ ID NO 90 in the 20040128712 US patent application
  misc_feature: The sequence is a functional homolog of SEQ ID NO 1414 in the 20060162006 US patent application
  misc_feature: The sequence is a functional homolog of SEQ ID NO 1406 in the 10/374,780 US patent application
  misc_feature: The sequence is a functional homolog of SEQ ID NO 26 in the 10/669,824 US patent application
  misc_feature: The sequence is a functional homolog of SEQ ID NO 26 in the 10/870,198 US patent application
  misc_feature: The sequence is a functional homolog of SEQ ID NO 352 in the 11/435,388 US patent application
  misc_feature: The sequence is a functional homolog of SEQ ID NO 354 in the 10/714,887 US patent application
  misc_feature: The sequence is a functional homolog of SEQ ID NO 1415 in the 10/374,780 US patent application
  misc_feature: The sequence is a functional homolog of SEQ ID NO 24 in the 10/669,824 US patent application
  misc_feature: The sequence is a functional homolog of SEQ ID NO 24 in the 10/870,198 US patent application
  misc_feature: The sequence is a functional homolog of SEQ ID NO 386 in the 11/435,388 US patent application
  misc_feature: The sequence is a functional homolog of SEQ ID NO 388 in the 10/714,887 US patent application
  misc_feature: The sequence is a functional homolog of SEQ ID NO 1416 in the 10/374,780 US patent application
  misc_feature: The sequence is a functional homolog of SEQ ID NO 16 in the 10/669,824 US patent application
  misc_feature: The sequence is a functional homolog of SEQ ID NO 16 in the 10/870,198 US patent application
  misc_feature: The sequence is a functional homolog of SEQ ID NO 388 in the 11/435,388 US patent application
  misc_feature: The sequence is a functional homolog of SEQ ID NO 390 in the 10/714,887 US patent application
  misc_feature: The sequence is a functional homolog of SEQ ID NO 1840 in the 10/412,699 US patent application
  misc_feature: The sequence is a functional homolog of SEQ ID NO 2080 in the 10/374,780 US patent application
  misc_feature: The sequence is a functional homolog of SEQ ID NO 258 in the 10/225,066 US patent application
  misc_feature: The sequence is a functional homolog of SEQ ID NO 304 in the 11/435,388 US patent application
  misc_feature: The sequence is a functional homolog of SEQ ID NO 306 in the 10/714,887 US patent application
  misc_feature: The sequence is a functional homolog of SEQ ID NO 54 in the 10/669,824 US patent application
  misc_feature: The sequence is a functional homolog of SEQ ID NO 54 in the 10/870,198 US patent application
  misc_feature: The sequence is a functional homolog of SEQ ID NO 728 in the 10/412,699 US patent application
  misc_feature: The sequence is a functional homolog of SEQ ID NO 1515 in the 11/479,226 US patent application
  misc_feature: The sequence is a functional homolog of SEQ ID NO 226 in the 10/374,780 US patent application
  misc_feature: The sequence is a functional homolog of SEQ ID NO 302 in the 11/435,388 US patent application
  misc_feature: The sequence is a functional homolog of SEQ ID NO 304 in the 10/714,887 US patent application
  misc_feature: The sequence is a functional homolog of SEQ ID NO 52 in the 10/669,824 US patent application
  misc_feature: The sequence is a functional homolog of SEQ ID NO 52 in the 10/870,198 US patent application
  misc_feature: The sequence is a functional homolog of SEQ ID NO 56 in the 10/225,066 US patent application
  misc_feature: The sequence is a functional homolog of SEQ ID NO 726 in the 10/412,699 US patent application
  misc_feature: The sequence is a functional homolog of SEQ ID NO 1417 in the 10/374,780 US patent application
  misc_feature: The sequence is a functional homolog of SEQ ID NO 18 in the 10/669,824 US patent application
  misc_feature: The sequence is a functional homolog of SEQ ID NO 18 in the 10/870,198 US patent application
  misc_feature: The sequence is a functional homolog of SEQ ID NO 390 in the 11/435,388 US patent application
  misc_feature: The sequence is a functional homolog of SEQ ID NO 392 in the 10/714,887 US patent application
  misc_feature: The sequence is a functional homolog of SEQ ID NO 12 in the 10/669,824 US patent application
  misc_feature: The sequence is a functional homolog of SEQ ID NO 12 in the 10/870,198 US patent application
  misc_feature: The sequence is a functional homolog of SEQ ID NO 1405 in the 10/374,780 US patent application
  misc_feature: The sequence is a functional homolog of SEQ ID NO 34 in the 10/669,824 US patent application
  misc_feature: The sequence is a functional homolog of SEQ ID NO 34 in the 10/870,198 US patent application
  misc_feature: The sequence is a functional homolog of SEQ ID NO 354 in the 11/435,388 US patent application
  misc_feature: The sequence is a functional homolog of SEQ ID NO 356 in the 10/714,887 US patent application
  misc_feature: The sequence is a functional homolog of SEQ ID NO 1395 in the 10/374,780 US patent application
  misc_feature: The sequence is a functional homolog of SEQ ID NO 1507 in the 10/412,699 US patent application
  misc_feature: The sequence is a functional homolog of SEQ ID NO 22 in the 10/669,824 US patent application
  misc_feature: The sequence is a functional homolog of SEQ ID NO 22 in the 10/870,198 US patent application
  misc_feature: The sequence is a functional homolog of SEQ ID NO 346 in the 11/435,388 US patent application
  misc_feature: The sequence is a functional homolog of SEQ ID NO 348 in the 10/714,887 US patent application
  misc_feature: The sequence is a functional homolog of SEQ ID NO 222 in the 10/374,780 US patent application
  misc_feature: The sequence is a functional homolog of SEQ ID NO 240 in the 10/714,887 US patent application
  misc_feature: The sequence is a functional homolog of SEQ ID NO 240 in the 11/435,388 US patent application
  misc_feature: The sequence is a functional homolog of SEQ ID NO 254 in the 10/225,066 US patent application
  misc_feature: The sequence is a functional homolog of SEQ ID NO 42 in the 10/669,824 US patent application
  misc_feature: The sequence is a functional homolog of SEQ ID NO 42 in the 10/870,198 US patent application
  misc_feature: The sequence is a functional homolog of SEQ ID NO 64 in the 10/225,068 US patent application
  misc_feature: The sequence is a functional homolog of SEQ ID NO 722 in the 10/412,699 US patent application
  misc_feature: The sequence is a functional homolog of SEQ ID NO 94 in the 11/375,241 US patent application
  misc_feature: The sequence is a functional homolog of SEQ ID NO 1411 in the 10/374,780 US patent application
  misc_feature: The sequence is a functional homolog of SEQ ID NO 36 in the 10/669,824 US patent application
  misc_feature: The sequence is a functional homolog of SEQ ID NO 36 in the 10/870,198 US patent application
  misc_feature: The sequence is a functional homolog of SEQ ID NO 392 in the 11/435,388 US patent application
  misc_feature: The sequence is a functional homolog of SEQ ID NO 394 in the 10/714,887 US patent application
  misc_feature: The sequence is a functional homolog of SEQ ID NO 1908 in the 10/412,699 US patent application
  misc_feature: The sequence is a functional homolog of SEQ ID NO 2166 in the 10/374,780 US patent application
  misc_feature: The sequence is a functional homolog of SEQ ID NO 318 in the 11/435,388 US patent application
  misc_feature: The sequence is a functional homolog of SEQ ID NO 320 in the 10/714,887 US patent application
  misc_feature: The sequence is a functional homolog of SEQ ID NO 8 in the 10/669,824 US patent application
  misc_feature: The sequence is a functional homolog of SEQ ID NO 8 in the 10/870,198 US patent application
  misc_feature: The sequence is a functional homolog of SEQ ID NO 94 in the 10/225,066 US patent application
  misc_feature: The sequence is a functional homolog of SEQ ID NO 150 in the 10/225,066 US patent application
  misc_feature: The sequence is a functional homolog of SEQ ID NO 1511 in the 11/479,226 US patent application
  misc_feature: The sequence is a functional homolog of SEQ ID NO 2 in the 10/669,824 US patent application
  misc_feature: The sequence is a functional homolog of SEQ ID NO 2 in the 10/870,198 US patent application
  misc_feature: The sequence is a functional homolog of SEQ ID NO 224 in the 10/374,780 US patent application
  misc_feature: The sequence is a functional homolog of SEQ ID NO 300 in the 11/435,388 US patent application
  misc_feature: The sequence is a functional homolog of SEQ ID NO 302 in the 10/714,887 US patent application
  misc_feature: The sequence is a functional homolog of SEQ ID NO 724 in the 10/412,699 US patent application
  misc_feature: The sequence is a functional homolog of SEQ ID NO 1402 in the 10/374,780 US patent application
  misc_feature: The sequence is a functional homolog of SEQ ID NO 1410 in the 10/374,780 US patent application
  misc_feature: The sequence is a functional homolog of SEQ ID NO 344 in the 11/435,388 US patent application
  misc_feature: The sequence is a functional homolog of SEQ ID NO 346 in the 10/714,887 US patent application
  misc_feature: The sequence is a functional homolog of SEQ ID NO 38 in the 10/669,824 US patent application
  misc_feature: The sequence is a functional homolog of SEQ ID NO 38 in the 10/870,198 US patent application
  misc_feature: The sequence is a functional homolog of SEQ ID NO 1409 in the 10/374,780 US patent application
  misc_feature: The sequence is a functional homolog of SEQ ID NO 40 in the 10/669,824 US patent application
  misc_feature: The sequence is a functional homolog of SEQ ID NO 40 in the 10/870,198 US patent application
  misc_feature: The sequence is a functional homolog of SEQ ID NO 412 in the 11/435,388 US patent application
  misc_feature: The sequence is a functional homolog of SEQ ID NO 414 in the 10/714,887 US patent application
  misc_feature: The sequence is a functional homolog of SEQ ID NO 66 in the 10/669,824 US patent application
  misc_feature: The sequence is a functional homolog of SEQ ID NO 66 in the 10/870,198 US patent application
  misc_feature: The sequence is a functional homolog of SEQ ID NO 64 in the 10/669,824 US patent application
  misc_feature: The sequence is a functional homolog of SEQ ID NO 64 in the 10/870,198 US patent application
  misc_feature: The sequence is a functional homolog of SEQ ID NO 14 in the 10/669,824 US patent application
  misc_feature: The sequence is a functional homolog of SEQ ID NO 14 in the 10/870,198 US patent application
  misc_feature: The sequence is a functional homolog of SEQ ID NO 384 in the 11/435,388 US patent application
  misc_feature: The sequence is a functional homolog of SEQ ID NO 386 in the 10/714,887 US patent application
  misc_feature: The sequence is a functional homolog of SEQ ID NO 1413 in the 10/374,780 US patent application
  misc_feature: The sequence is a functional homolog of SEQ ID NO 1928 in the 11/479,226 US patent application
  misc_feature: The sequence is a functional homolog of SEQ ID NO 86 in the 10/870,198 US patent application
  misc_feature: The sequence is a functional homolog of SEQ ID NO 248 in the 10/714,887 US patent application
  misc_feature: The sequence is a functional homolog of SEQ ID NO 248 in the 11/435,388 US patent application
  misc_feature: The sequence is a functional homolog of SEQ ID NO 456 in the 10/374,780 US patent application
  misc_feature: The sequence is a functional homolog of SEQ ID NO 498 in the 10/225,066 US patent application
  misc_feature: The sequence is a functional homolog of SEQ ID NO 84 in the 10/870,198 US patent application
  misc_feature: The sequence is a functional homolog of SEQ ID NO 92 in the 10/225,068 US patent application
  misc_feature: The sequence is a functional homolog of SEQ ID NO 1418 in the 10/374,780 US patent application
  misc_feature: The sequence is a functional homolog of SEQ ID NO 2154 in the 10/374,780 US patent application
  misc_feature: The sequence is a functional homolog of SEQ ID NO 314 in the 11/435,388 US patent application
  misc_feature: The sequence is a functional homolog of SEQ ID NO 316 in the 10/714,887 US patent application
  misc_feature: The sequence is a functional homolog of SEQ ID NO 318 in the 10/666,642 US patent application
  misc_feature: The sequence is a functional homolog of SEQ ID NO 44 in the 10/669,824 US patent application
  misc_feature: The sequence is a functional homolog of SEQ ID NO 44 in the 10/870,198 US patent application
  misc_feature: Useful for making plants with modulated flowering time
  misc_feature: Useful for making plants with modulated light quality response
  misc_feature: Useful for making plants with modulated low light sensitivity
  misc_feature: Functional homolog of the protein sequence given in SEQ ID NO 13229
  misc_feature: The sequence is a functional homolog of SEQ ID NO 86 in the 10/669,824 US patent application
  misc_feature: The sequence is a functional homolog of SEQ ID NO 92 in the 10/669,824 US patent application
  misc_feature: The sequence is a functional homolog of SEQ ID NO 88 in the 10/669,824 US patent application
  misc_feature: The sequence is a functional homolog of SEQ ID NO 90 in the 10/669,824 US patent application
  misc_feature: The sequence is a functional homolog of SEQ ID NO 87 in the 10/669,824 US patent application
  misc_feature: The sequence is a functional homolog of SEQ ID NO 89 in the 10/669,824 US patent application
MAGLDLGTAATRYVHQLHHLHPDLQLQHSYAKQPEPSEDDPHGSGGGGGNSNNGGPYGEHDGGSSSSGPGAGDAPGGSGGNGEMVARRPRGRPPGSKNKPKPPVIITRESANTLRAHILEVGSGCDVFESVSTYARRRQRGVCVLSGSGVVTNVTLRQPSAPTGAVVTLHGRFEILSLSGSFLPPPAPPGATSLTIFLAGGQGQVVGGNVVGALYAAGPVIVIAASFANVAYERLPLEEEEAQAAPPGLQMQPPGGGVDGAGGGMGGGPFPPDPSAAGLPFFNLPLNNMAGGGSQLPPGADGHGWAGARPPF

SEQ ID NO: 291 - DNA, 312 bp, Sorghum bicolor
  misc_feature: Ceres ANNOT ID no. 6007181
  misc_feature: Encodes the peptide sequence at SEQ ID NO 292
atgcagacggcgaaggtgaaggcgaaggacatggcgagcgaggcgaaggagaaggcgaaggaggcgacagccaagatgcagggcaagacgggcgaggcgacggcggccacgcacggcgagaaggagatggccaaggaggcggcccgcgccaagaaggaccaggccagcgccgacaagcaccaggagaaggccgagcaccgcgtggacgccgccgccacgactggccgccacggcgccggcgccggcgcggccgtcgaccgcgcgtacccgtccgccggcaccacgtacccggcgtcgggcaagtacatctag

SEQ ID NO: 292 - protein, 103 aa, Sorghum bicolor
  misc_feature: Ceres ANNOT ID no. 6007181
  misc_feature (1)..(73): Pfam Id: LEA_1 Pfam Desc: Late embryogenesis abundant (LEA) group 1
  misc_feature (1)..(102): NCBI GI: 38346714 NCBI Desc: osjnba0086o06.12 [oryza sativa (japonica cultivar-group)]
  misc_feature (1)..(97): NCBI GI: 21387075 NCBI Desc: late embryogenesis-abundant protein-like protein [arabidopsis thaliana]
  misc_feature (1)..(77): NCBI GI: 82394678 NCBI Desc: seed maturation protein [glycine tomentella]
  misc_feature (1)..(77): NCBI GI: 82394666 NCBI Desc: seed maturation protein [glycine tomentella]
  misc_feature (1)..(77): NCBI GI: 82394674 NCBI Desc: seed maturation protein [glycine tomentella]
MQTAKVKAKDMASEAKEKAKEATAKMQGKTGEATAATHGEKEMAKEAARAKKDQASADKHQEKAEHRVDAAATTGRHGAGAGAAVDRAYPSAGTTYPASGKYI

SEQ ID NO: 293 - DNA, 1245 bp, Sorghum bicolor
  misc_feature: Ceres ANNOT ID no. 6007185
  misc_feature: Encodes the peptide sequence at SEQ ID NO 294
atggcggcggcgggaggagaagttgccggcgcttcgtcgggaacgaggacgaagcggcttaagattgcagtcatccacccggatctcggaattggtggtgctgagagattgattgtcgatgcggcttgccagcttgctgcccacggccatgatgttcatgtcttcacatcacatcatgataaaaaccgttgctttgaggagactgtttctgttactgtatatggagatttcctgccccgtcatgtgttttaccgctttcatgctgtttgtgcttatcttcgctgcatttttgttgcactctgtgtgctactcagatggcccttctttgatgtcatattggtagaccaggtttctgttgtgattccactacttaaactaagggcatcatcaaagataatattttattgtcatttccctgatcttttacttgcgcaacatactactatgcttcgaaagttatatcgcaagccaattgacatgattgaggaaatcactactggtatggctgatttgattctagtcaatagcaagttcactgcagcaacttttgcaaggactttttcttgtttacatgctagaggaatcgagcctggtgttctatatcccgctgtctctgttgagcagtttcatgagccccatgcttataaattgaatttcctatcaatcaaccggtttgagaggaaaaagaatcttgatcttgccatttcagcatttgctttgctccgttctgttgcttcgactctacctggcgacgctctgcaagaagcaacattgacagtggcaggtggctatgataagcgtctgaaggaaaatgttgaataccttgaggaactcaaaagactcgcagtgactgaaggggtgtctggacaggttaattttgttacatcttgctcaacatctgaaagaaacgagcttctctccaactgcctctgtgttttatacactccaaaggatgaacatttcggtattgtacctcttgaagccatggcagcctataagcctgtaattgcctgcaatagtggtggcccagtggaaacagttgtgaatgaagtaacagggtttctatgtgatccctctcccacagaattctccaaagccatgctgaaacttgtgaatgatcatgatcttgctgtcagattgggtgaacaagcacgagaccatgtggtgcaaaaattctcaaccaagacatttggtgatctcctcaacggttatgtcctgaatgtctatcatgagaggatggaatga

SEQ ID NO: 294 - protein, 414 aa, Sorghum bicolor
  misc_feature: Ceres ANNOT ID no. 6007185
  misc_feature (203)..(387): Pfam Id: Glycos_transf_1 Pfam Desc: Glycosyl transferases group 1
  misc_feature (19)..(408): NCBI GI: 22330726 NCBI Desc: glycosyl transferase family 1 protein [arabidopsis thaliana]
  misc_feature (19)..(408): NCBI GI: 23308431 NCBI Desc: at1g78800/f9k20_16 [arabidopsis thaliana]
  misc_feature (19)..(408): NCBI GI: 3834314 NCBI Desc: similar to gene pi010 glycosyltransferase gi2257490 from s. pombe clone 1750 gbab004534. ests gbt46079 and gbaa394466 come from this gene. [arabidopsis thaliana]
  misc_feature (11)..(409): NCBI GI: 140071307 NCBI Desc: glycosyl transferase, group 1 [medicago truncatula]
  misc_feature (19)..(405): NCBI GI: 50417516 NCBI Desc: alg2-prov protein [xenopus laevis]
MAAAGGEVAGASSGTRTKRLKIAVIHPDLGIGGAERLIVDAACQLAAHGHDVHVFTSHHDKNRCFEETVSVTVYGDFLPRHVFYRFHAVCAYLRCIFVALCVLLRWPFFDVILVDQVSVVIPLLKLRASSKIIFYCHFPDLLLAQHTTMLRKLYRKPIDMIEEITTGMADLILVNSKFTAATFARTFSCLHARGIEPGVLYPAVSVEQFHEPHAYKLNFLSINRFERKKNLDLAISAFALLRSVASTLPGDALQEATLTVAGGYDKRLKENVEYLEELKRLAVTEGVSGQVNFVTSCSTSERNELLSNCLCVLYTPKDEHFGIVPLEAMAAYKPVIACNSGGPVETVVNEVTGFLCDPSPTEFSKAMLKLVNDHDLAVRLGEQARDHVVQKFSTKTFGDLLNGYVLNVYHERME

SEQ ID NO: 295 - DNA, 567 bp, Sorghum bicolor
  misc_feature: Ceres ANNOT ID no. 6007203
  misc_feature: Encodes the peptide sequence at SEQ ID NO 296
atgaagctcctgcaagctactgtctccctggtcttcctcctcgcctgttccacgtccaacgcttctgtcttacatgacgcctgccagtccttcgccgctatccgacacaaggatgccgactacaactactgcgtcaggttcttccaggccgacaaggagagcgccaccgcagaccaccgtggcctcgccgtcatcggagccaagctcatcgaggcaaccgctaagagcaccggctctctcatcgccaccatgctgacctcggagaaggataaggagaaactcggttgcctcgtcgcgtgcggcaagggttacttggacgccatggacgagatcggcaaggcggcgaagggcatcgtctcgagaaaggatgggggcgtagaggacgcggtgacggcactcggcggggcgctggacgcgcccttggactgcgaggatgggttccagaagcttcacaagccgtcgccactcgctgcggaggatgccaggttccgcaaggaggcgtccatcaccctgtttgtaacggggacgttacttccccaaatcaacagctctaagttagggatctag

SEQ ID NO: 296 - protein, 188 aa, Sorghum bicolor
  misc_feature: Ceres ANNOT ID no. 6007203
  misc_feature (18)..(173): Pfam Id: PMEI Pfam Desc: Plant invertase/pectin methylesterase inhibitor
  misc_feature (9)..(179): NCBI GI: 38605751 NCBI Desc: osjnbb0016d16.4 [oryza sativa (japonica cultivar-group)]
  misc_feature (9)..(179): NCBI GI: 115460178 NCBI Desc: os04g0587200 [oryza sativa (japonica cultivar-group)]
  misc_feature (15)..(173): NCBI GI: 83722842 NCBI Desc: pme/invertase inhibitor-like protein [musa acuminata]
  misc_feature (22)..(177): NCBI GI: 32395573 NCBI Desc: seed specific protein bn15d12a [brassica napus]
  misc_feature (37)..(179): NCBI GI: 20455196 NCBI Desc: pectinesterase inhibitor (pectin methylesterase inhibitor) (pmei)
MKLLQATVSLVFLLACSTSNASVLHDACQSFAAIRHKDADYNYCVRFFQADKESATADHRGLAVIGAKLIEATAKSTGSLIATMLTSEKDKEKLGCLVACGKGYLDAMDEIGKAAKGIVSRKDGGVEDAVTALGGALDAPLDCEDGFQKLHKPSPLAAEDARFRKEASITLFVTGTLLPQINSSKLGI

SEQ ID NO: 297 - DNA, 1473 bp, Sorghum bicolor
  misc_feature: Ceres ANNOT ID no. 6007207
  misc_feature: Encodes the peptide sequence at SEQ ID NO 298
atggatatcatgcagactagtgactcttcacatcatggaattgtagaaaatagcccgtacagaattccatatgacagacatgcagaaggtggtcaacttggtgcttcatggtattttagtagaaaagaaatagaggagaattccctatcgaggagagatggcattgatctgaagaaagagtcttatcttcgcaagtcatattgcacatttctgcaggatttggggatgaggcttaaagtgcctcaagtgacaattgctactgctatagtgttctgtcatcggttttttcttcgtcaatctcatgcgaaaaatgatagacggacaattgcaacagtatgtatgttcttggcgggaaaagttgaagaaacacccaggcctctgaaggatgtcatactcctttcatatgagatcatccacaaaaaggatcctgctgcagttcaacgaataaaacagaaggaagtatatgaacaacagaaggaacttattttacttggggaacgtgttgtgcttgtaacacttggttttgatttgaatgtgaaccatccttacaagcccttggttgaagcaataaaaaaattcaaggttgctcaaaatgcacttgctcaagttgcctggaattttgtcaatgatgggctccgcacttcactttgccttcaatttaaaccgcaccatattgcggctggcgcaatcttcctggctgcgaagtttctcaaagtcaagcttccatcagatggcgacaaggtctggtggcaagagtttgatgtaactccgcggcagttggaagaggttagcaaccagatgttggaactctatgagcaaaaccgtgttcaaccaacaccaccacaaggtaatgatactgaaggcagttctgcaagtgttgcgaatcaacgtgcttctggtaaagttccaggagtagctgatgaacctcctgcccatgaacataatcaagcacccagacaatcgagccaacagaacatgtcaggccaccatggctatgaccaccctcatccggagaagcaaaactataggatgccaccaaatgaagcaagggatggcactgctaatagcaacgaaggtcccaatgtatcatcctcgatgatggatgcaatgaagaagataaacaaggataaggtgaaagcggccctggagaagcggaggaaatcgaaaggtgacctttcaagaaaggctgatgtgatggatgatgatgacctcattgagagggagctggaacatggcgtggagttggctgtcgaggatgagaagatcaagcaggagagaaggcagggctggcctcatcctgcacaccgtgtagaccaccagagcaccaaccgtgagaatactgaagagggtgagctgtccatggacagtcaggaataccattctccggagcatgacaatcggaagagaaaggatgcacatgagcaccggaactatgatcgtgacgaaagggaccttaaaaggttaaggtcttga

SEQ ID NO: 298 - protein, 490 aa, Sorghum bicolor
  misc_feature: Ceres ANNOT ID no. 6007207
  misc_feature (35)..(178): Pfam Id: Cyclin_N Pfam Desc: Cyclin, N-terminal domain
  misc_feature (37)..(452): NCBI GI: 30694715 NCBI Desc: cyclin family protein [arabidopsis thaliana]
  misc_feature (37)..(418): NCBI GI: 145340421 NCBI Desc: cyclin-dependent protein kinase [arabidopsis thaliana]
  misc_feature (36)..(373): NCBI GI: 46805809 NCBI Desc: cyclin k-like [oryza sativa (japonica cultivar-group)]
  misc_feature (108)..(271): NCBI GI: 115444041 NCBI Desc: os02g0133000 [oryza sativa (japonica cultivar-group)]
  misc_feature (38)..(271): NCBI GI: 37703718 NCBI Desc: cyclin t1 [medicago truncatula]
  misc_feature: Useful for making plants with modulated flowering time
  misc_feature: Functional homolog of the protein sequence given in SEQ ID NO 13107
MDIMQTSDSSHHGIVENSPYRIPYDRHAEGGQLGASWYFSRKEIEENSLSRRDGIDLKKESYLRKSYCTFLQDLGMRLKVPQVTIATAIVFCHRFFLRQSHAKNDRRTIATVCMFLAGKVEETPRPLKDVILLSYEIIHKKDPAAVQRIKQKEVYEQQKELILLGERVVLVTLGFDLNVNHPYKPLVEAIKKFKVAQNALAQVAWNFVNDGLRTSLCLQFKPHHIAAGAIFLAAKFLKVKLPSDGDKVWWQEFDVTPRQLEEVSNQMLELYEQNRVQPTPPQGNDTEGSSASVANQRASGKVPGVADEPPAHEHNQAPRQSSQQNMSGHHGYDHPHPEKQNYRMPPNEARDGTANSNEGPNVSSSMMDAMKKINKDKVKAALEKRRKSKGDLSRKADVMDDDDLIERELEHGVELAVEDEKIKQERRQGWPHPAHRVDHQSTNRENTEEGELSMDSQEYHSPEHDNRKRKDAHEHRNYDRDERDLKRLRS

SEQ ID NO: 299 - DNA, 297 bp, Sorghum bicolor
  misc_feature: Ceres ANNOT ID no. 6007209
  misc_feature: Encodes the peptide sequence at SEQ ID NO 300
atggcgacgtcggtggcctgcgccttcttcttcgacgcggagccgctgggcgagcccgggcggcacgcgctggacgcctgcgcgctctgctccaagccgctcacccgcaacagcgacatcttcatgtacaagggcgacaccccgttctgcagcgaggactgccgctacgagcagatgcaccacgacgcggcctgcgcgcggcaggccgccagcagcagccggcggaagcagcagcagtcgcagcggagcaggggagcctctgtggccgccaaggcggacgtgtacgtggccagctag

SEQ ID NO: 300 - protein, 98 aa, Sorghum bicolor
  misc_feature: Ceres ANNOT ID no. 6007209
  misc_feature (1)..(98): NCBI GI: 38344285 NCBI Desc: osjnba0013k16.17 [oryza sativa (japonica cultivar-group)]
  misc_feature (1)..(79): NCBI GI: 38344284 NCBI Desc: osjnba0013k16.16 [oryza sativa (japonica cultivar-group)]
  misc_feature (19)..(76): NCBI GI: 116309823 NCBI Desc: h0307d04.5 [oryza sativa (indica cultivar-group)]
  misc_feature (17)..(87): NCBI GI: 115466098 NCBI Desc: os06g0125200 [oryza sativa (japonica cultivar-group)]
  misc_feature (17)..(92): NCBI GI: 115469958 NCBI Desc: os06g0714800 [oryza sativa (japonica cultivar-group)]
MATSVACAFFFDAEPLGEPGRHALDACALCSKPLTRNSDIFMYKGDTPFCSEDCRYEQMHHDAACARQAASSSRRKQQQSQRSRGASVAAKADVYVAS

SEQ ID NO: 301 - DNA, 330 bp, Sorghum bicolor
  misc_feature: Ceres ANNOT ID no. 6007213
  misc_feature: Encodes the peptide sequence at SEQ ID NO 302
atggcagcagcatcagcagcacatctcgcctgcgccttcttcttcgacgcggagcccgccgtcggcgagcgcagcctgcacgcgctcgacgcgtgcgcgctctgcgccaagccgctggcgcgcgacagcgacatcttcatgtacagaggggacacgcccttctgcagcgaggagtgccgctacgagcagatgcagctcgacgccatccgagccaggcagcaggcctccgccaggtccggcggcggccggcggcagccgtcgtactcgtcaggagcggaggcgcggcgcgggcaccgggacgccaggaaggtgtccgcggtggcgacctga

SEQ ID NO: 302 - protein, 109 aa, Sorghum bicolor
  misc_feature: Ceres ANNOT ID no. 6007213
  misc_feature (6)..(108): NCBI GI: 38344284 NCBI Desc: osjnba0013k16.16 [oryza sativa (japonica cultivar-group)]
  misc_feature (6)..(108): NCBI GI: 38344285 NCBI Desc: osjnba0013k16.17 [oryza sativa (japonica cultivar-group)]
  misc_feature (27)..(74): NCBI GI: 116309823 NCBI Desc: h0307d04.5 [oryza sativa (indica cultivar-group)]
  misc_feature (22)..(95): NCBI GI: 115469958 NCBI Desc: os06g0714800 [oryza sativa (japonica cultivar-group)]
  misc_feature (27)..(85): NCBI GI: 38344282 NCBI Desc: osjnba0013k16.14 [oryza sativa (japonica cultivar-group)]
MAAASAAHLACAFFFDAEPAVGERSLHALDACALCAKPLARDSDIFMYRGDTPFCSEECRYEQMQLDAIRARQQASARSGGGRRQPSYSSGAEARRGHRDARKVSAVAT

SEQ ID NO: 303 - DNA, 309 bp, Sorghum bicolor
  misc_feature: Ceres ANNOT ID no. 6007214
  misc_feature: Encodes the peptide sequence at SEQ ID NO 304
atggcctccgccttcttcttcgacgccgagccggtgtgcgaggtctccagcctgctgctgcccgcgctggacgcctgcgcgctctgcgccaagccgctgggacgcgacgacgacatcttcatgtacagaggcgacacgcccttctgcagcgaggagtgccgcgacgagcagatgcagctcgacgccatccgcgccaggcaggccgccaggtccgccgccggacggaggcagcagcagcagcagcagcagtactcctccagaacagagtccaggcaccaggagtccaggaaggtgtctgttgcgacctga

SEQ ID NO: 304 - protein, 102 aa, Sorghum bicolor
  misc_feature: Ceres ANNOT ID no. 6007214
  misc_feature (1)..(102): NCBI GI: 38344284 NCBI Desc: osjnba0013k16.16 [oryza sativa (japonica cultivar-group)]
  misc_feature (1)..(102): NCBI GI: 38344285 NCBI Desc: osjnba0013k16.17 [oryza sativa (japonica cultivar-group)]
  misc_feature (23)..(94): NCBI GI: 38344282 NCBI Desc: osjnba0013k16.14 [oryza sativa (japonica cultivar-group)]
  misc_feature (26)..(94): NCBI GI: 115460162 NCBI Desc: os04g0585900 [oryza sativa (japonica cultivar-group)]
  misc_feature (23)..(61): NCBI GI: 116309823 NCBI Desc: h0307d04.5 [oryza sativa (indica cultivar-group)]
MASAFFFDAEPVCEVSSLLLPALDACALCAKPLGRDDDIFMYRGDTPFCSEECRDEQMQLDAIRARQAARSAAGRRQQQQQQQYSSRTESRHQESRKVSVAT

SEQ ID NO: 305 - DNA, 1122 bp, Sorghum bicolor
  misc_feature: Ceres ANNOT ID no. 6007223
  misc_feature: Encodes the peptide sequence at SEQ ID NO 306
atggccaggccagcgcgcaaggccctgatgggcgcgcccccttccgccgcgcgctcgcgtggcggcccgaggcgcgcgctccgaagatccgctgccgctctcttcctcgccaccctcgtcgcgctgcccttcgcggtgctataccgcgccgccgtctggcgctcgctgggggcttcctgggggtgggagtgggactcgctgccctcctcgttcgccgcatccaaggaggagggcgccgaagccgacgatctggacagtgaagatctcaaacttgagcgagtcctaaagaaggcttctatgcgagacaatacagttatcttgactacacttaatgctgcatgggcttctcccgggtctgtgatagaccttttcaccggtagcttccgttctggtgttagaacaaatttgctgttgaaacaccttgtaattgtagcatttgatcggaaagcatacgagcaatgtgtcaaaatacatccctattgctttgctctgggaaccgagggtgtggatttctctgaagagaggaggttcctgacttcaggatatcttgaaatgatgtggagaaggctagatttcttgcggttggttcttgaaaaaggttacaacttcatattctcggatgcagacattatgtggtttcgcaatccattcccacatttctatcctgatgtagactttcagattgcatgtgatcactatgtcaggaatgcgaccgacttgagaaatattgctaatggaggcttcagctatgtgaaatcaaatgaacgaagcatagagttttacagtttctggtattcatcaagattgaggtatcctggctatcatgatcaggatgtattcaatgctataaagcatgatccttacattgtagacattggattgacaattaagtttctgagtacaaagtactttggagggttctgtgaaccaagcagagatttgaacgaagtctgcactatgcatgctaactgctgcattgggttgcgaagcaagattcatgatctgaggattatgatggaggattggaggagttatttgtccttgcccccaaatttgaaaagattgcagatatctgcttggcgagtgccacaaaattgcagtctttcatggtcgcaccgttaa

SEQ ID NO: 306 - protein, 373 aa, Sorghum bicolor
  misc_feature: Ceres ANNOT ID no. 6007223
  misc_feature (1)..(373): NCBI GI: 116309821 NCBI Desc: h0307d04.3 [oryza sativa (indica cultivar-group)]
  misc_feature (1)..(373): NCBI GI: 38344278 NCBI Desc: osjnba0013k16.10 [oryza sativa (japonica cultivar-group)]
  misc_feature (1)..(369): NCBI GI: 115447979 NCBI Desc: os02g0686300 [oryza sativa (japonica cultivar-group)]
  misc_feature (84)..(368): NCBI GI: 50198979 NCBI Desc: at1g14590 [arabidopsis thaliana]
  misc_feature (74)..(368): NCBI GI: 23306127 NCBI Desc: putataive insb from escherichia coli [oryza sativa (japonica cultivar-group)]
  misc_feature: The plant is abnormally small.
  misc_feature: Useful for making plants with modulated biomass
  misc_feature: Functional homolog of the protein sequence given in SEQ ID NO 13568
  misc_feature: Useful for making plants with modulated biomass
  misc_feature: Functional homolog of the protein sequence given in SEQ ID NO 13568
MARPARKALMGAPPSAARSRGGPRRALRRSAAALFLATLVALPFAVLYRAAVWRSLGASWGWEWDSLPSSFAASKEEGAEADDLDSEDLKLERVLKKASMRDNTVILTTLNAAWASPGSVIDLFTGSFRSGVRTNLLLKHLVIVAFDRKAYEQCVKIHPYCFALGTEGVDFSEERRFLTSGYLEMMWRRLDFLRLVLEKGYNFIFSDADIMWFRNPFPHFYPDVDFQIACDHYVRNATDLRNIANGGFSYVKSNERSIEFYSFWYSSRLRYPGYHDQDVFNAIKHDPYIVDIGLTIKFLSTKYFGGFCEPSRDLNEVCTMHANCCIGLRSKIHDLRIMMEDWRSYLSLPPNLKRLQISAWRVPQNCSLSWSHR

SEQ ID NO: 307 - DNA, 1779 bp, Sorghum bicolor
  misc_feature: Ceres ANNOT ID no. 6007224
  misc_feature: Encodes the peptide sequence at SEQ ID NO 308
atggcgaaatcgtcatcgtcatcgccgacggcgaccgcgtctgcctctaagaagcggcgttccagaggcgggaccgcaaccctagatgaggtgaagaagctgggaaccgagctcctttcctcgcgcgcgcacctcaaccacgcccccgccctcctcgctcttctctcccccaccgcaccgctcgacctcgctctcgaggcgctcatctcgctccagtccttcttcgtaccactcatcccatccatcccctccgcctctgcggcagccaccgcgggggatgcgggcagcgaccccgagctcgtgtttggagcctggctgcggcagcggttcgacgagctcgtcgcggcgctggtggagctcagcgtgtctccacacagcgatgacgcgatcagggatgtagcactggatgctctcatggattttgtgaagctggggaaggacgggaagttccaatcggcaatttaccacaagtttctctacgctgtcgttcatgctgctgatcctattgatacgttgttagagctgcttggatcaaagtacttcaaatacactgatgtttgttactttacgtacactagcttagacaagatcgccaacagtctgggcagtaaaatcactggctctggaaaagatgccttgcaaagtggaagtggcgggtcagaaaatagtagtatttttgtacacaacatatacaatcttttggcacatgttccttcaatggattttcaaaaggaatcaacatttgatatgtggagtactgttgggctgtcttctaaaggagaaaaggactcttccaaggacacttctactcacatcaagaaaaaattacaattgaagttcactaaagcatggctgtcttttctcaagttaccactgccgcttgatgtgtataaggaggtccttgcttcaattcatcaaaatgtcattccttcaatgtcaaacccttccatcttatgtgatttcttgactagatcatatgatattggtggtgttatcagtgtgatggccttaagtggccttttcattcttatgacgcaacacggtctggagtatccaaaattctatgaaaagctttatgcactacttactcctgctgttttcatggcaaaacaccggtcagtgttcttgcaacttcttgacacatgcctgaaatcttcttatcttcctgcatatcttgctgctgcatttgcaaaaagattgagtagacttgctctttcagttcctccagctggagctcttattattattgctttaattcataatctgctgcggagacatccctcagttaattttttggtccattgggaggttgatgagagtaatgccacaggagaagctagtcaatctaagaagatcggtgctgatccttttaacaataatgaggcagaccctgcaaaatctggtgcaatgcgaagttctttgtgggaaatagacacgcttcgccatcattactctcctgcagtttctagatttgtcgcatcacttgaggaggatctcactgtcagggccaaaactactgagatgaaaataacagacttcagttcaggttcctatgcaacagttttcagggacgaggtacgtcggcggataaaacaggtcccccttgcattctacagaaccacaccaacttcgttatttctaggatcagattttcctggatggacctttgggggccaacacaatagcaccgtagaaactattgtagagggcaatgaaaaaatcgaggtggtaggggctagcgacagcacaccttccaaacggttgcggatggaggcctga

SEQ ID NO: 308 - protein, 592 aa, Sorghum bicolor
  misc_feature: Ceres ANNOT ID no. 6007224
  misc_feature (332)..(493): Pfam Id: CBF Pfam Desc: CBF/Mak21 family
  misc_feature (8)..(590): NCBI GI: 115460154 NCBI Desc: os04g0585300 [oryza sativa (japonica cultivar-group)]
  misc_feature (8)..(591): NCBI GI: 116309820 NCBI Desc: h0307d04.2 [oryza sativa (indica cultivar-group)]
  misc_feature (8)..(590): NCBI GI: 38344277 NCBI Desc: osjnba0013k16.9 [oryza sativa (japonica cultivar-group)]
  misc_feature (13)..(556): NCBI GI: 18086412 NCBI Desc: at2g17250/t23a1.11 [arabidopsis thaliana]
  misc_feature (105)..(550): NCBI GI: 46249506 NCBI Desc: mgc81137 protein [xenopus laevis]
MAKSSSSSPTATASASKKRRSRGGTATLDEVKKLGTELLSSRAHLNHAPALLALLSPTAPLDLALEALISLQSFFVPLIPSIPSASAAATAGDAGSDPELVFGAWLRQRFDELVAALVELSVSPHSDDAIRDVALDALMDFVKLGKDGKFQSAIYHKFLYAVVHAADPIDTLLELLGSKYFKYTDVCYFTYTSLDKIANSLGSKITGSGKDALQSGSGGSENSSIFVHNIYNLLAHVPSMDFQKESTFDMWSTVGLSSKGEKDSSKDTSTHIKKKLQLKFTKAWLSFLKLPLPLDVYKEVLASIHQNVIPSMSNPSILCDFLTRSYDIGGVISVMALSGLFILMTQHGLEYPKFYEKLYALLTPAVFMAKHRSVFLQLLDTCLKSSYLPAYLAAAFAKRLSRLALSVPPAGALIIIALIHNLLRRHPSVNFLVHWEVDESNATGEASQSKKIGADPFNNNEADPAKSGAMRSSLWEIDTLRHHYSPAVSRFVASLEEDLTVRAKTTEMKITDFSSGSYATVFRDEVRRRIKQVPLAFYRTTPTSLFLGSDFPGWTFGGQHNSTVETIVEGNEKIEVVGASDSTPSKRLRMEA

SEQ ID NO: 309 - DNA, 1848 bp, Sorghum bicolor
  misc_feature: Ceres ANNOT ID no. 6007228
  misc_feature: Encodes the peptide sequence at SEQ ID NO 310
atggcgcggcgccacgggtggcagctccccgcccacaccctgcaggtggtggctataacagtgtacttcttgctttgtatagcattctatgctttcttctctccatttcttgggaaggacttgtatgaatatattgctgtgggtatttatagttttctggccttatccgtgctgattctatatgttagatgtactgcgattgatcccgctgaccctggcatcctgatttccatggatggcacactattttataagtcagaagcacctggagacactcaagaagaagctggtaagccaggattgagaaacggtgacagtgaggacatccaaaagcataaatcatgctttggaaggttttgcttttgttgcgctatatttacaactggggactgtcgtgaagaggatgaagctaaccatgaagaagattatggtgaagaggcactcttttgcaccctttgcaacgcggaggtgcgcacacatagcaagcactgtcgaagttgcgacaagtgtgttgatgggtttgatcatcactgccggtggctgaacaattgtgttggaagaaaaaattatatcacatttttatgccttatggctgtgagtctggcttggcttgctgttgagtgtggagttggtattgctgtttttgttcgttgcttcactgataagacagccatagaagatcagattggggaaaagctaggctatggtctttcacgagcaccctttgcaaccattgtggccctggctacagctctttctatgcttgcttcagtaccactaggagaactatttttcttccatatgatattaatccgaaagggcataacaacttatgaatatgttgtggccatgagggctcagagtgaacctcctggaccttctgtcattgatgaccaacaaagcttggcatcttctccaatgagttctacaccaacaggttttagtgggagctcgtttgcacggcactacaaaggcgcatggtgcactcccccacgtatcttcattgaccaggacgaaatcatcccacacctggagcctggccgagttccttcaactattgaccctgatactgcagacccaatggaaagaaccaaaacccatcctaaacgtccagtccgcatcagtgcgtggaagcttgcgaagctcgattcaaatgaggccatgaaagccgcagcaaaagccagagcctcttcgtccgtgctgaaacctatcaatacccgcaaccagtatgaggcagacagtgataacctcagtaccagaagcagtgccataagtgctgataccggacaccacaggtattgcgggaattcacagtacaggccctcttatccacccagcagagcaagtgcagatgacatcgagctgtacccccagacaccgagcagcttccagagcaactcacggactccaactcctctagccgagcaccatccctccaagcatttcaacccaatctaccagacatcagcaaacaggtctccattctcagcaaaagcaagcgtcagtgaagctcctatctctgaagtcaccaatgcagggagagggaggtcctaccccccaccacaagcggacagatcctcccggtcatctgtttactgggatcaggaagctggcaggttcgtgtctgcgcaggcaaaccagggatccagctctcgctctggccatcctgaccttctatacaccgggcagtctatattctttggtggacctctgatcgcagaccctgcagcaagaagcttcagagatcctggtggttcgagccaaaggtctgccgggcctcggccgcaccagctcccggtgttcgatcccagtaacccccagaaagatcagctgtccaggttaccgtga

SEQ ID NO: 310 - protein, 615 aa, Sorghum bicolor
  misc_feature: Ceres ANNOT ID no. 6007228
  misc_feature (141)..(203): Pfam Id: zf-DHHC Pfam Desc: DHHC zinc finger domain
  misc_feature (1)..(615): NCBI GI: 38344276 NCBI Desc: osjnba0013k16.7 [oryza sativa (japonica cultivar-group)]
  misc_feature (1)..(594): NCBI GI: 92875106 NCBI Desc: zinc finger, dhhc-type [medicago truncatula]
  misc_feature (164)..(589): NCBI GI: 52077070 NCBI Desc: dhhc-type zinc finger domain-containing protein -like [oryza sativa (japonica cultivar-group)]
  misc_feature (96)..(553): NCBI GI: 15233295 NCBI Desc: zinc finger (dhhc type) family protein [arabidopsis thaliana]
  misc_feature (3)..(512): NCBI GI: 42563074 NCBI Desc: zinc finger (dhhc type) family protein [arabidopsis thaliana]
MARRHGWQLPAHTLQVVAITVYFLLCIAFYAFFSPFLGKDLYEYIAVGIYSFLALSVLILYVRCTAIDPADPGILISMDGTLFYKSEAPGDTQEEAGKPGLRNGDSEDIQKHKSCFGRFCFCCAIFTTGDCREEDEANHEEDYGEEALFCTLCNAEVRTHSKHCRSCDKCVDGFDHHCRWLNNCVGRKNYITFLCLMAVSLAWLAVECGVGIAVFVRCFTDKTAIEDQIGEKLGYGLSRAPFATIVALATALSMLASVPLGELFFFHMILIRKGITTYEYVVAMRAQSEPPGPSVIDDQQSLASSPMSSTPTGFSGSSFARHYKGAWCTPPRIFIDQDEIIPHLEPGRVPSTIDPDTADPMERTKTHPKRPVRISAWKLAKLDSNEAMKAAAKARASSSVLKPINTRNQYEADSDNLSTRSSAISADTGHHRYCGNSQYRPSYPPSRASADDIELYPQTPSSFQSNSRTPTPLAEHHPSKHFNPIYQTSANRSPFSAKASVSEAPISEVTNAGRGRSYPPPQADRSSRSSVYWDQEAGRFVSAQANQGSSSRSGHPDLLYTGQSIFFGGPLIADPAARSFRDPGGSSQRSAGPRPHQLPVFDPSNPQKDQLSRLP

SEQ ID NO: 311 - DNA, 1848 bp, Sorghum bicolor; identical to SEQ ID NO: 309
  misc_feature: Ceres ANNOT ID no. 6007232
  misc_feature: Encodes the peptide sequence at SEQ ID NO 312

SEQ ID NO: 312 - protein, 615 aa, Sorghum bicolor; identical to SEQ ID NO: 310
  misc_feature: Ceres ANNOT ID no. 6007232
  misc_feature (141)..(203): Pfam Id: zf-DHHC Pfam Desc: DHHC zinc finger domain
  misc_feature (1)..(615): NCBI GI: 38344276 NCBI Desc: osjnba0013k16.7 [oryza sativa (japonica cultivar-group)]
  misc_feature (1)..(594): NCBI GI: 92875106 NCBI Desc: zinc finger, dhhc-type [medicago truncatula]
  misc_feature (164)..(589): NCBI GI: 52077070 NCBI Desc: dhhc-type zinc finger domain-containing protein -like [oryza sativa (japonica cultivar-group)]
  misc_feature (96)..(553): NCBI GI: 15233295 NCBI Desc: zinc finger (dhhc type) family protein [arabidopsis thaliana]
  misc_feature (3)..(512): NCBI GI: 42563074 NCBI Desc: zinc finger (dhhc type) family protein [arabidopsis thaliana]

SEQ ID NO: 313 - DNA, 1182 bp, Sorghum bicolor
  misc_feature: Ceres ANNOT ID no. 6007241
  misc_feature: Encodes the peptide sequence at SEQ ID NO 314
atgtggccgtggctggagaggattgcgtccgcgtgctgggaccgggtccggaggtacgggcttacgaggaagggtgaggacgacggcggggacggcggcgagggcgacgccggcgccgtcgacgagctgctgtggtcgcgggacctcgcgcggcacgcggcgggcgagttctccttcgccgtcgtgcaggccaacgacgtgctggaggatcaaagccaggtggagacggccgccgccgccaccttcgtcggcgtctacgacggccacgggggcgccgaggcgtcccgcttcatctctaaccacctttctgcgcacatcgtccgtcttgcacaggaacatggaaccatgtctgaggatgttgttcgaaaggccttttctgctacagaggaaggcttcctgtcacttgtgcgcaggacgcatttgataaaacctgctatggctactattggatcttgctgtctggttggtatcatatggagagggacactctacctggccaatcttggtgattctcgggcggttgtgggttgtttgaatgggtcaaacaggattgttgctgagcagttaacaagagaccataatgctagcatggaagagattaggcaggagcttaggactcttcatcctgatgattcgcaaatcgttgttcttaagaatggtgtttggcgcataaaaggcatcatacaggtttcaaggtctataggtgatgcatacttgaagaagcgagaattcgctgctgatccatccacagctcgtttccacctctcggaacctctacgccggcctgttctgacgtcagagccatctgtatgttcaagagttcttagttcacaagaccgttttttgatctttgcatcggatggattatgggagcacctctcaaaccagcaagctgttgaaatggtccacaataatccacgagaaggtattgcaaggagattagtacaagcagctctaaaagaagctgcaagaaagagggaaatgaggtatggtgatattaagaagctcgataaaggagtccggcgctacatccacgatgacataacagttgttgttgtcttcgtcgatcatgaactgcgatcggaagattccgcctcaacctctgttcctgaactctcagttcgtgggtttattgatgcaggggggcgctccagcttttcagggatgaatgacattacttga

SEQ ID NO: 314 - protein, 393 aa, Sorghum bicolor
  misc_feature: Ceres ANNOT ID no. 6007241
  misc_feature (57)..(327): Pfam Id: PP2C Pfam Desc: Protein phosphatase 2C
  misc_feature (1)..(340): NCBI GI: 115460136 NCBI Desc: os04g0584300 [oryza sativa (japonica cultivar-group)]
  misc_feature (1)..(387): NCBI GI: 21536936 NCBI Desc: protein phosphatase 2c-like [arabidopsis thaliana]
  misc_feature (8)..(387): NCBI GI: 9759303 NCBI Desc: protein phosphatase 2c-like [arabidopsis thaliana]
  misc_feature (32)..(376): NCBI GI: 20340237 NCBI Desc: protein phosphatase 2c-like protein [thellungiella halophila]
  misc_feature (38)..(376): NCBI GI: 10177123 NCBI Desc: protein phosphatase 2c-like protein [arabidopsis thaliana]
  misc_feature: Abnormal phyllotaxy, leaf number higher than wild-type
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: The sequence is a functional homolog of SEQ ID NO. 386 in the 11/188,298 US application
  misc_feature: The sequence is a functional homolog of SEQ ID NO. 448 in the 11/188,298 US application
  misc_feature: The sequence is a functional homolog of SEQ ID NO. 406 in the 11/188,298 US application
MWPWLERIASACWDRVRRYGLTRKGEDDGGDGGEGDAGAVDELLWSRDLARHAAGEFSFAVVQANDVLEDQSQVETAAAATFVGVYDGHGGAEASRFISNHLSAHIVRLAQEHGTMSEDVVRKAFSATEEGFLSLVRRTHLIKPAMATIGSCCLVGIIWRGTLYLANLGDSRAVVGCLNGSNRIVAEQLTRDHNASMEEIRQELRTLHPDDSQIVVLKNGVWRIKGIIQVSRSIGDAYLKKREFAADPSTARFHLSEPLRRPVLTSEPSVCSRVLSSQDRFLIFASDGLWEHLSNQQAVEMVHNNPREGIARRLVQAALKEAARKREMRYGDIKKLDKGVRRYIHDDITVVVVFVDHELRSEDSASTSVPELSVRGFIDAGGRSSFSGMNDIT

SEQ ID NO: 315 - DNA, 375 bp, Sorghum bicolor
  misc_feature: Ceres ANNOT ID no. 6007261
  misc_feature: Encodes the peptide sequence at SEQ ID NO 316
atggcggacatgcagattgtcctggccgggaggaagatcgaggcgcagtatgtggagatgaaggtgccgctctactcctacggctgcgagaagaagatcaagaaggcgctgtcacatctcaaaggtatacattcggttcaggtagactaccaccagcagaaggtgacggtgtgggggatctgcaaccgcgacgacgtgctcgccgccgtccggaagaagcgccgagacgcgcggttctggaacggcgacgaactgggcctaggcgagcatgtgccgccgacacccggagaagctcccaagcagtacctggctgccttcaccgcgtacaggttgaggaagtcgtggaagaagcttttcccgctgatccgcctctga

SEQ ID NO: 316 - protein, 124 aa, Sorghum bicolor
  misc_feature: Ceres ANNOT ID no. 6007261
  misc_feature (18)..(79): Pfam Id: HMA Pfam Desc: Heavy-metal-associated domain
  misc_feature (1)..(84): NCBI GI: 18417024 NCBI Desc: copper-binding protein-related [arabidopsis thaliana]
  misc_feature (13)..(86): NCBI GI: 15221451 NCBI Desc: copper-binding family protein [arabidopsis thaliana]
  misc_feature (13)..(86): NCBI GI: 8927670 NCBI Desc: contains similarity to a copper homeostasis factor (ccm) mrna from arabidopsis thaliana gbu88711 and contains a heavy-metal-associated pf00403 domain
  misc_feature (8)..(80): NCBI GI: 92899055 NCBI Desc: heavy metal transport/detoxification protein [medicago truncatula]
  misc_feature (20)..(80): NCBI GI: 57900370 NCBI Desc: copper-binding protein-like [oryza sativa (japonica cultivar-group)]
MADMQIVLAGRKIEAQYVEMKVPLYSYGCEKKIKKALSHLKGIHSVQVDYHQQKVTVWGICNRDDVLAAVRKKRRDARFWNGDELGLGEHVPPTPGEAPKQYLAAFTAYRLRKSWKKLFPLIRL

SEQ ID NO: 317 - DNA, 1224 bp, Sorghum bicolor
  misc_feature: Ceres ANNOT ID no. 6007270
  misc_feature: Encodes the peptide sequence at SEQ ID NO 318
atggagttcgcgagctcttccagtaggttttccaaagaggaggacgaggaggaggaaggggaggaagaggacgaggaggcgtccccgcgcgagatccccttcatgacagcggcggctgcgacggccgacaccggacccgccgccgcctcctcgtcctcgccttccgcggcgggggcctcggcgtccgcgtcgggttcggctgctgccctccgctccggcgacggcgccggggcgtccggtagcggcggcggcggcggcgggagcgacgacgtggaggtgatcgagaaggagcacatgttcgacaaggtggtgacgcccagcgacgtggggaagctcaaccggctggtgatcccgaagcagcacgcggagaagtacttcccgctggacgcggcggccaacgagaagggcctcctgctcagcttcgaggaccgcgccggcaagctctggcgcttccgctactcctactggaacagcagccagagagaagcgcctcgacgccgggacaccgtctccttctgccgcggcgccggggaggccgcgagggaccgcctcttcatcgactggaagcgacgcgccgactcccgcgacccgcaccggatgccacgactcccgctcccgatggcgcccgtcgcgtcgccctacggccttgggccctggggcggcggcgcgggcggtttcttcatgccgcccgcgccgcccgccacactctacgagcaccaccgcttccgccaggcccttgacttccgcaacatcaacgccgccgccgcgccggccaggcagctcctcttcttcggctcacaaggcatgcccccgcgcgcgtccatgccgctacagcagcagcagccgcagccgcagccgtcgcttccgcccccgcccccgcctctgcacagcattatgatggtgcaacccggcagccccgcggtcacgcacggcttgcccatggttctcgactcggtgccgctcgtcaacagcccaacggcagccgcgaagcgagtccgcctgtttggggtcaacctcgacaacccgcaacaaggcagcagtgccgagtcaagccaagacgccaacgcattgtcgctgaggatgccgggatggcaacggccggggccattgaggttcttcgaatcgcctcaacgcggcgccgccgagtcatctgcagcctcgtcgccgtcgtcatcatcgtcctccaagagagaagcgcattcgtcattggatctcgatctgtga

SEQ ID NO: 318 - protein, 407 aa, Sorghum bicolor
  misc_feature: Ceres ANNOT ID no. 6007270
  misc_feature (99)..(206): Pfam Id: B3 Pfam Desc: B3 DNA binding domain
  misc_feature (1)..(407): NCBI GI: 50251902 NCBI Desc: rav-like b3 domain dna binding protein-like [oryza sativa (japonica cultivar-group)]
  misc_feature (15)..(233): NCBI GI: 32492293 NCBI Desc: osjnba0088a01.1 [oryza sativa (japonica cultivar-group)]
  misc_feature (15)..(182): NCBI GI: 116311012 NCBI Desc: h0303a11-b0406h05.5 [oryza sativa (indica cultivar-group)]
  misc_feature (94)..(198): NCBI GI: 21618252 NCBI Desc: rav-like protein [arabidopsis thaliana]
  misc_feature (95)..(215): NCBI GI: 62701878 NCBI Desc: similar to probable rav2-like dna binding protein [imported] - arabidopsis thaliana [oryza sativa (japonica cultivar-group)]
  misc_feature: Abnormal phyllotaxy, leaf number higher than wild-type
  misc_feature: The plant flowers significantly late compared to wild-type.
  misc_feature: The plant is abnormally small.
  misc_feature: The sequence is a functional homolog of SEQ ID NO 1176 in the 10/374,780US patent application
  misc_feature: The sequence is a functional homolog of SEQ ID NO 1177 in the 10/374,780US patent application
  misc_feature: The sequence is a functional homolog of SEQ ID NO 1178 in the 10/374,780US patent application
  misc_feature: The sequence is a functional homolog of SEQ ID NO 1179 in the 10/374,780US patent application
  misc_feature: The sequence is a functional homolog of SEQ ID NO 1180 in the 10/374,780US patent application
  misc_feature: The sequence is a functional homolog of SEQ ID NO 1181 in the 10/374,780US patent application
  misc_feature: The sequence is a functional homolog of SEQ ID NO 1372 in the 10/412,699US patent application
  misc_feature: The sequence is a functional homolog of SEQ ID NO 1373 in the 10/412,699US patent application
  misc_feature: The sequence is a functional homolog of SEQ ID NO 1374 in the 10/412,699US patent application
  misc_feature: The sequence is a functional homolog of SEQ ID NO 14 in the 10/838,616US patent application
  misc_feature: The sequence is a functional homolog of SEQ ID NO 20 in the 10/838,616US patent application
  misc_feature: The sequence is a functional homolog of SEQ ID NO 24 in the 10/225,066US patent application
  misc_feature: The sequence is a functional homolog of SEQ ID NO 244 in the 10/225,066US patent application
  misc_feature: The sequence is a functional homolog of SEQ ID NO 2498 in the 10/374,780US patent application
  misc_feature: The sequence is a functional homolog of SEQ ID NO 30 in the 10/838,616US patent application
  misc_feature: The sequence is a functional homolog of SEQ ID NO 32 in the 10/838,616US patent application
  misc_feature: The sequence is a functional homolog of SEQ ID NO 34 in the 10/838,616US patent application
  misc_feature: The sequence is a functional homolog of SEQ ID NO 36 in the 10/838,616US patent application
  misc_feature: The sequence is a functional homolog of SEQ ID NO 36 in the 11/375,241US patent application
  misc_feature: The sequence is a functional homolog of SEQ ID NO 42 in the 10/838,616US patent application
  misc_feature: The sequence is a functional homolog of SEQ ID NO 44 in the 10/838,616US patent application
  misc_feature: The sequence is a functional homolog of SEQ ID NO 440 in the 10/374,780US patent application
  misc_feature: The sequence is a functional homolog of SEQ ID NO 46 in the 10/838,616US patent application
  misc_feature: The sequence is a functional homolog of SEQ ID NO 52 in the 10/838,616US patent application
  misc_feature: The sequence is a functional homolog of SEQ ID NO 53 in the 10/838,616US patent application
  misc_feature: The sequence is a functional homolog of SEQ ID NO 732 in the 11/435,388US patent application
  misc_feature: The sequence is a functional homolog of SEQ ID NO 734 in the 11/435,388US patent application
  misc_feature: The sequence is a functional homolog of SEQ ID NO 736 in the 11/435,388US patent application
  misc_feature: The sequence is a functional homolog of SEQ ID NO 738 in the 11/435,388US patent application
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12891
  misc_feature: The sequence is a functional homolog of SEQ ID NO 1372 in the 20040045049 US patent application
  misc_feature: The sequence is a functional homolog of SEQ ID NO 1373 in the 20040045049 US patent application
  misc_feature: The sequence is a functional homolog of SEQ ID NO 1374 in the 20040045049 US patent application
  misc_feature: The sequence is a functional homolog of SEQ ID NO 24 in the 20050160493 US patent application
  misc_feature: The sequence is a functional homolog of SEQ ID NO 244 in the 20050160493 US patent application
  misc_feature: The sequence is a functional homolog of SEQ ID NO 20 in the 20060008874 US patent application
  misc_feature: The sequence is a functional homolog of SEQ ID NO 34 in the 20060008874 US patent application
  misc_feature: The sequence is a functional homolog of SEQ ID NO 36 in the 20060008874 US patent application
  misc_feature: The sequence is a functional homolog of SEQ ID NO 42 in the 20060008874 US patent application
  misc_feature: The sequence is a functional homolog of SEQ ID NO 44 in the 20060008874 US patent application
  misc_feature: The sequence is a functional homolog of SEQ ID NO 46 in the 20060008874 US patent application
  misc_feature: The sequence is a functional homolog of SEQ ID NO 1180 in the 20060162006 US patent application
  misc_feature: The sequence is a functional homolog of SEQ ID NO 1181 in the 20060162006 US patent application
  misc_feature: The sequence is a functional homolog of SEQ ID NO 1181 in the 10/374,780 US patent application
MEFASSSSRFSKEEDEEEEGEEEDEEASPREIPFMTAAAATADTGPAAASSSSPSAAGASASASGSAAALRSGDGAGASGSGGGGGGSDDVEVIEKEHMFDKVVTPSDVGKLNRLVIPKQHAEKYFPLDAAANEKGLLLSFEDRAGKLWRFRYSYWNSSQREAPRRRDTVSFCRGAGEAARDRLFIDWKRRADSRDPHRMPRLPLPMAPVASPYGLGPWGGGAGGFFMPPAPPATLYEHHRFRQALDFRNINAAAAPARQLLFFGSQGMPPRASMPLQQQQPQPQPSLPPPPPPLHSIMMVQPGSPAVTHGLPMVLDSVPLVNSPTAAAKRVRLFGVNLDNPQQGSSAESSQDANALSLRMPGWQRPGPLRFFESPQRGAAESSAASSPSSSSSSKREAHSSLDLDL

SEQ ID NO: 319 - DNA, 594 bp, Sorghum bicolor
  misc_feature: Ceres ANNOT ID no. 6007280
  misc_feature: Encodes the peptide sequence at SEQ ID NO 320
atgtcgccgatgagcaaccctagcttcgatcacagctacgagctccctctgcggcgaaacctcctgcttctgctcgacctcctcggccgcctccgcttcatcgccgaggtgctcctggaccgcctcggcgtcgcgtcgtggcagggtgaggtgcatttgcccggacagctttggggttggggcggagagcatgccagcgatgccactttggaacacttccttgaggcgaggttgtgggagaccgggacgcggtcgccgctcacgacaacgcggtacaggcggcggcgggttgcgcttgcgcagccggcggacggcaaactggccgcagaaggcgacgccgagggcgcggcggccgtttgcgcgatttgcgtggcggggctggaatcgggggatctcgagacggtcgtggagctgtgcagctgctcgcacgcgttccacgacgcgtgcatcgatgcttgggtccgcagtggtgacgacgacgcggccacctgcccgctgtgccgcgcgccatgttgcccacggcgtgggacgacgacgggcggagagcagagtttgtctcgcgtactgaaaggggtctgtgtctctgtcccttaa

SEQ ID NO: 320 - protein, 197 aa, Sorghum bicolor
  misc_feature: Ceres ANNOT ID no. 6007280
  misc_feature (120)..(167): Pfam Id: zf-C3HC4 Pfam Desc: Zinc finger, C3HC4 type (RING finger)
  misc_feature (98)..(169): NCBI GI: 20160754 NCBI Desc: p0503c12.20 [oryza sativa (japonica cultivar-group)]
  misc_feature (111)..(175): NCBI GI: 115435246 NCBI Desc: os01g0213000 [oryza sativa (japonica cultivar-group)]
  misc_feature (108)..(178): NCBI GI: 50252104 NCBI Desc: zinc finger-like [oryza sativa (japonica cultivar-group)]
  misc_feature (106)..(173): NCBI GI: 32488512 NCBI Desc: osjnba0011j08.19 [oryza sativa (japonica cultivar-group)]
  misc_feature (108)..(168): NCBI GI: 53792029 NCBI Desc: el5-like [oryza sativa (japonica cultivar-group)]
  misc_feature: Useful for making plants with modulated nitrogen use efficiency
  misc_feature: Functional homolog of the protein sequence given in SEQ ID NO 13079
MSPMSNPSFDHSYELPLRRNLLLLLDLLGRLRFIAEVLLDRLGVASWQGEVHLPGQLWGWGGEHASDATLEHFLEARLWETGTRSPLTTTRYRRRRVALAQPADGKLAAEGDAEGAAAVCAICVAGLESGDLETVVELCSCSHAFHDACIDAWVRSGDDDAATCPLCRAPCCPRRGTTTGGEQSLSRVLKGVCVSVP

SEQ ID NO: 321 - DNA, 480 bp, Sorghum bicolor
  misc_feature: Ceres ANNOT ID no. 6007288
  misc_feature: Encodes the peptide sequence at SEQ ID NO 322
atggcgtacggaggcgccgcccgcggtcgcctcgccgaggagcgcaaggcgtggcgcaagaggcacccccacggcttcgtggccaagccggcgacgctgccggatggctccgtcaacctgatgctctggaactgcgtcgtccccggcaaggaaggcactgattgggaaggtggatatttcccacttactctccattttactgaaaattacccaagtaaccctccaacctgcaagtttccacgaaggtttttccatgtcaatgtctatgattccggggatgtatgcctgtcaatacttggtgatgcatgggcgccttctatcacagtgccgcaaatccttataggcatccaggagctgctggataacccaaatccagcctctcctgcacaggattttgcttatgatgtctttgcaaagaatatgccagaatacaagagacgtgttcgtgagcaagccaagaggtatccttcactcgtgtag

SEQ ID NO: 322 - protein, 159 aa, Sorghum bicolor
  misc_feature: Ceres ANNOT ID no. 6007288
  misc_feature (10)..(152): Pfam Id: UQ_con Pfam Desc: Ubiquitin-conjugating enzyme
  misc_feature (4)..(159): NCBI GI: 37719049 NCBI Desc: sumo e2 conjugating enzyme sce1 [nicotiana benthamiana]
  misc_feature (5)..(158): NCBI GI: 60652997 NCBI Desc: ubiquitin-conjugating enzyme e2i [synthetic construct]
  misc_feature (5)..(157): NCBI GI: 109158012 NCBI Desc: chain a, crystal structure of human rangap1-ubc9-d127s
  misc_feature (5)..(157): NCBI GI: 109158010 NCBI Desc: chain a, crystal structure of human rangap1-ubc9-d127a
  misc_feature (5)..(157): NCBI GI: 62858413 NCBI Desc: ube2i [xenopus tropicalis]
  misc_feature: The sequence is a functional homolog of SEQ ID NO. 431 in the 11/188,298 US application
MAYGGAARGRLAEERKAWRKRHPHGFVAKPATLPDGSVNLMLWNCVVPGKEGTDWEGGYFPLTLHFTENYPSNPPTCKFPRRFFHVNVYDSGDVCLSILGDAWAPSITVPQILIGIQELLDNPNPASPAQDFAYDVFAKNMPEYKRRVREQAKRYPSLV

SEQ ID NO: 323 - DNA, 1893 bp, Sorghum bicolor
  misc_feature: Ceres ANNOT ID no. 6007292
  misc_feature: Encodes the peptide sequence at SEQ ID NO 324
atggagccaggcgcgccgtggcgcgatccgcgccaggggtacgcctacggggtcggatcggcgatgcagatgcagctgcagcagcgggccgacgcggccgccggtggaggagtgctcaagaggagcctcggcgagctggagaggtggcagcaccaccagcagcagcaggtggcggcgcagcaggagctgtacctgcgcaccgtcaggcagcgcacggcggcggcggtcgatatcgccgccttgctgggagggaccccggctcggcctctggttctccccgggtccagcttcggagggggcctggcgtcgccttcgtccacgctgtcctcgctcaccaccgcgtccagggcggcggtgccgctgatgcagccgcagctgcagcgccaggtgccgctcatgacgtcctcaccgcagacgcaggccttcgggttgtcgagggcgccgccgctcccccagccggcgtcctcgagcgagctgttcattttgcaggagctcgagaagcagctgctggacgacgacgacgacgacgacgagccgttcagctccatcgcggccgcggcgatgagcggcaccggttccgcggtcaccaactccgagtgggaggagacgatacagcagctcagctccatcgcggccgcgccgtcgcccgggctccctgcagcggcgaccccaaataacaacatcaacaacaacaataacgtggggatgacgaggtcaccttcaaactcttcctcctccacggcgtcttcatcagcgtcctgctcgccgccggcgtcgaggcagctattgtctgaagccgccgtcgctatcgcggacggccaccatgacgcggcggccacccatctggccgccctgaagcgcgcggccaaccagcacggcgacgcggaacagcgcctgattgccatgatggtggacgcgctgtcctcccgcattggccgggccgcctccgccccagctcaacacctcgccgagctctgcagcggcgaccagcgcgccgggtcccaactcctccaggacatctcaccatgcttccgcgtcgccctccacgccgccagcgtcgccatcgtcgaagcggtgggcgaccaccgcgccatccacgtcgtcgacttcgacgtcagcctcgcgcagcacgcggctctcatccagtacctcgctgagcgacgcgtgcagggcaggtccctgaaggtcaccgccgtcaccgacccgagctcaccgttctcgcaggctcaaacggcgtcgctaaccaccatcgcggagccgctgaagaagctcgcggagcgagctggcgtggagtaccgctttaacgtggtcagctgcagagcagcagacctggacgcgtcgaggctgtgctgcgagcccggggaggcggtggcagtcaacctcgccttcgcgctctcccacgtgcccgacgagagcgtctctccggccaacccccgcgacgagctgctccgccgcgtgcgcgcgctggggccacaggtggtgaccctcgtcgagcaggagctgaacaccaacacggccccgctggcggcgcgcttcacggacgcgtgcgcgcactacggcgccatcctggagtcgctggacgcgacgctagggcgggagactagtgcggagaaggccagggccgccgaggcggccctgtggaagaaggcggcgaacgcggtcggccgggatggccccgaccgactggagcggtgcgaggtcttcggcaagtggcgcgccaggttcggcatggcgggcttccgcccggtgtcgctcggctcgggcattgcggaacagctggtcggcgcccgcgtcggcctgctgccgcccgcgttcgcagtcaaggcggagaacggcgtgctccggctctgttggaaggggcgcgtggtgaccgtcgcctccgcgtggcgctag

SEQ ID NO: 324 - protein, 630 aa, Sorghum bicolor
  misc_feature: Ceres ANNOT ID no. 6007292
  misc_feature (234)..(538): Pfam Id: GRAS Pfam Desc: GRAS family transcription factor
  misc_feature (223)..(630): NCBI GI: 89474476 NCBI Desc: gras10 [solanum lycopersicum]
  misc_feature (229)..(630): NCBI GI: 10177034 NCBI Desc: scarecrow transcriptional regulator-like [arabidopsis thaliana]
  misc_feature (229)..(630): NCBI GI: 4580523 NCBI Desc: scarecrow-like 8 [arabidopsis thaliana]
  misc_feature (233)..(630): NCBI GI: 20161431 NCBI Desc: scarecrow-like protein [oryza sativa (japonica cultivar-group)]
  misc_feature (233)..(630): NCBI GI: 146147357 NCBI Desc: scarecrow [aeluropus littoralis]
MEPGAPWRDPRQGYAYGVGSAMQMQLQQRADAAAGGGVLKRSLGELERWQHHQQQQVAAQQELYLRTVRQRTAAAVDIAALLGGTPARPLVLPGSSFGGGLASPSSTLSSLTTASRAAVPLMQPQLQRQVPLMTSSPQTQAFGLSRAPPLPQPASSSELFILQELEKQLLDDDDDDDEPFSSIAAAAMSGTGSAVTNSEWEETIQQLSSIAAAPSPGLPAAATPNNNINNNNNVGMTRSPSNSSSSTASSSASCSPPASRQLLSEAAVAIADGHHDAAATHLAALKRAANQHGDAEQRLIAMMVDALSSRIGRAASAPAQHLAELCSGDQRAGSQLLQDISPCFRVALHAASVAIVEAVGDHRAIHVVDFDVSLAQHAALIQYLAERRVQGRSLKVTAVTDPSSPFSQAQTASLTTIAEPLKKLAERAGVEYRFNVVSCRAADLDASRLCCEPGEAVAVNLAFALSHVPDESVSPANPRDELLRRVRALGPQVVTLVEQELNTNTAPLAARFTDACAHYGAILESLDATLGRETSAEKARAAEAALWKKAANAVGRDGPDRLERCEVFGKWRARFGMAGFRPVSLGSGIAEQLVGARVGLLPPAFAVKAENGVLRLCWKGRVVTVASAWR

SEQ ID NO: 325 - DNA, 669 bp, Sorghum bicolor
  misc_feature: Ceres ANNOT ID no. 6007297
  misc_feature: Encodes the peptide sequence at SEQ ID NO 326
atgggtttcccggtgggttactcggagctggtgctcccgaagcagctgctccacctcctcctgctcctggggtacatccgccgcttcctcctctgggcgttcgacgccgtggggctcggcgacctgctggatctcggggacgaccaccaccaggcgctgctgcagcaggaccaccaccacggcgacgcgcaggggcgggaccaccacggcgcgctggcgctgccgcatcaggcggcggcgatgctgctgcagcagcaccgacggccggagttccgggcggtgccggcgatggtcatcgaggaggtcctccccgtggtgcggttcgacgagctggaggaggcgcgcgtcggcggggactgcgccgtttgcctcagcggcatcggaggccgcgacgaggtgcgccggctcagcaactgccgccacgtcttccaccgcgcctgcctggaccgctggatggagcacgaccagcgcacctgcccgctctgccgcgcgccgctcatccccgacgagatggccggcgcgctctgggccgccgccgcgggcgtccccgacgcctccgacttcgacttctcctacttcggcgcgacgccgctgacgacgcccgtgccctccccgacgctgctgcggccgcacgagctgctgctcaccggcctgggcggataccagtga

SEQ ID NO: 326 - protein, 222 aa, Sorghum bicolor
  misc_feature: Ceres ANNOT ID no. 6007297
  misc_feature (120)..(162): Pfam Id: zf-C3HC4 Pfam Desc: Zinc finger, C3HC4 type (RING finger)
  misc_feature (1)..(222): NCBI GI: 32488512 NCBI Desc: osjnba0011j08.19 [oryza sativa (japonica cultivar-group)]
  misc_feature (96)..(193): NCBI GI: 87162911 NCBI Desc: zinc finger, ring-type; ringv [medicago truncatula]
  misc_feature (1)..(171): NCBI GI: 21554155 NCBI Desc: ring zinc finger protein-like [arabidopsis thaliana]
  misc_feature (96)..(171): NCBI GI: 72536735 NCBI Desc: at1g63840 [arabidopsis thaliana]
  misc_feature (96)..(170): NCBI GI: 21593210 NCBI Desc: ring-h2 finger protein rha1b [arabidopsis thaliana]
  misc_feature: The sequence is a functional homolog of SEQ ID NO 1311 in the 11/479,226US patent application
  misc_feature: The sequence is a functional homolog of SEQ ID NO 180 in the 10/666,642US patent application
  misc_feature: The sequence is a functional homolog of SEQ ID NO 184 in the 10/374,780US patent application
  misc_feature: The sequence is a functional homolog of SEQ ID NO 270 in the 10/666,642US patent application
  misc_feature: The sequence is a functional homolog of SEQ ID NO 614 in the 10/412,699US patent application
  misc_feature: The sequence is a functional homolog of SEQ ID NO 62 in the 10/225,068US patent application
  misc_feature: The sequence is a functional homolog of SEQ ID NO 874 in the 11/435,388US patent application
  misc_feature: Useful for making plants with modulated growth and phenotype characteristics
  misc_feature: Useful for making plants with modulated nitrogen use efficiency
  misc_feature: Useful for making plants with modulated nitrogen use efficiency
  misc_feature: Functional homolog of the protein sequence given in SEQ ID NO 13079
  misc_feature: Functional homolog of the protein sequence given in SEQ ID NO 13260
  misc_feature: The sequence is a functional homolog of SEQ ID NO 614 in the 20040045049 US patent application
  misc_feature: The sequence is a functional homolog of SEQ ID NO 874 in the 20060272060 US patent application
  misc_feature: The sequence is a functional homolog of SEQ ID NO 180 in the 20070033671 US patent application
  misc_feature: The sequence is a functional homolog of SEQ ID NO 270 in the 10/666,642 US patent application
  misc_feature: The sequence is a functional homolog of SEQ ID NO 874 in the 11/435,388 US patent application
  misc_feature: Useful for making plants with altered alkaloid content
  misc_feature: Functional homolog of the protein sequence given in SEQ ID NO 13826
  misc_feature: The sequence is a functional homolog of SEQ ID NO. 329 in the 11/188,298 US application
  misc_feature: The sequence is a functional homolog of SEQ ID NO. 350 in the 11/188,298 US application
  misc_feature: The sequence is a functional homolog of SEQ ID NO. 271 in the 11/188,298 US application
MGFPVGYSELVLPKQLLHLLLLLGYIRRFLLWAFDAVGLGDLLDLGDDHHQALLQQDHHHGDAQGRDHHGALALPHQAAAMLLQQHRRPEFRAVPAMVIEEVLPVVRFDELEEARVGGDCAVCLSGIGGRDEVRRLSNCRHVFHRACLDRWMEHDQRTCPLCRAPLIPDEMAGALWAAAAGVPDASDFDFSYFGATPLTTPVPSPTLLRPHELLLTGLGGYQ

SEQ ID NO: 327 - DNA, 2880 bp, Sorghum bicolor
  misc_feature: Ceres ANNOT ID no. 6007303
  misc_feature: Encodes the peptide sequence at SEQ ID NO 328
atggcgggcaatgacaactggatcaacagctacctcgacgccatcctagacgccggaaaggctgccatcggcggcgaccggccctccctcctcctgcgcgagcgcggccatttctcccccgcgcgctacttcgtcgaggaggtcatcaccggctacgacgagaccgacctctacaagacatggctacgcgcgaacgccatgcggagcccgcaggagaggaacacgcggctcgagaacatgacgtggaggatctggaaccttgcaaggaagaagaaggagttcgagaaagaagaagcttgtcgtttgtcaaaacgccagccagaaactgagaaaacacgagctgatgctactgcagatatgtctgaagatctctttgaaggtgaaaagggagaagatgctggtgatccatctgttgcatatggggacagcaccacagggagctcacctaagacaagttcaattgacaagctatacatagtattgatcagtctacatggtctggtccgtggtgagaatatggagcttggccgagattcagatacgggtggccaggtcaaatatgtggttgaacttgctaaagcactaagttcatctcctggagtttaccgggttgatctgctaacaagacaaatattagcaccaaattttgatcgtagttatggtgaacctgcagaattattggtttcaacaagtggtaaaaattctaaacaagaaaaaggagaaaatagtggtgcgtatataattcggctaccgtttggtccaaaagataagtatctagctaaagaacatctatggcctttcattcaagaatttgttgatggtgcactcagccatattgtgaggatgtcaaaagccataggtgaagaaactggccgcgtgcatccagtatggcctgctgtgattcatgggcattatgccagtgcaggaattgcagctgcgttactttctggagcacttaaccttcctatggcattcacaggacattttcttgggaaagataaattggaagggcttctcaaacaagggagacaaactagagaacagataaatatgacatacaaaataatgtgccgaattgaggcagaggagctatctcttgacgcatctgagattgtcattgcaagcactaggcaagaaatagaagagcagtggaacttgtatgatggttttgaggttatacttgcaaggaagctccgagcaagagttaaacgtggtgctaattgttatggccgttttatgcctcgtatggttataattcctcctggagttgaatttggtcacattattcacgattttgatatggatggtgaagaagagaatccatccccagcatctgaggatccacctatttggtctcagataatgcgcttctttacaaatcctaggaagcctatgattctagctgttgctcgcccttatcccgagaagaatattactacgcttgtaaaagcatttggtgaatgtcggccactaagggagcttgcaaaccttacattgataatgggtaaccgtgaagctatatctaagatgcacaatatgagtgctgctgtcttgacatcagtgcttacattgattgatgaatatgacttgtatggtcaagtggcataccccaagcatcataagcactcggaagttcctgacatttatcgtttagctgcaagaacaaagggggcttttgtaaatgtagcttacttcgaacaatttggagttactctgatagaggctgctatgaatggtttgcctataattgcgacaaaaaatggagcccctgttgaaattaatcaggtcctgaataatggtctccttgttgatccgcacgatcagaatgccattgcggatgcactatataaacttctttctgacaaacaactttggtcaaggtgcagagagaatggactgacaaatattcaccgattctcgtggcctgaacattgcaagaattacctgtcaaggatattaactcttggcccaaggtctcctgctattggtaacagagaggagcggagtaatacacctatttcaggaaggaggcaaatcattgttatctctgtagactctgttaacaaggaagatctagtcaggataatcagaaatgctattgaggtcatacatacacaaaacatgtcaagttcaactggttttgtgctgtcaacttcgctgacaatatcagagataaattcactgctactatctggtggcatgcttcccactgattttgatgctttcatctgcaatagtgggagtaacatttactatccttcatattccggtgaaacaccaaacaactccaagattacatttgcattagatcaaaatcaccagtcacatatcgagtatcgttggggaggagaaggactaaggaaatatcttgtgaagtgggccacttcagtggtagaaagaaagggaagaacagagaggcaaattatttttgaagatccagaacactcttcagcctattgtcttgcatttagagtggttaatcccaatcatgaattgaggaagttgatgagaatccaatctctccgttgcaatgcattgtataaccacagcgctaccagattatctgtagtccctatccacgcatcaagatctcaggctctaaggtacttgtgtatacgttgggggatagaggtgccaaatgttgcagtccttgtgggtgaaagcggcgattcagattacgaggaactgctggggggtctccataggaccattatcctgaagggcgagttcaacatccccgcaaacaggatccacacggtgaggagataccctttgcaggatgttgtcgccctcgacagctcaaacatcatcggtgtcgagggctacaccacggatgacctgaagtctgccctgcagcagatgggtatactcacacaataa

SEQ ID NO: 328 - protein, 959 aa, Sorghum bicolor
  misc_feature: Ceres ANNOT ID no. 6007303
  misc_feature (452)..(635): Pfam Id: Glycos_transf_1 Pfam Desc: Glycosyl transferases group 1
  misc_feature (676)..(912): Pfam Id: S6PP Pfam Desc: Sucrose-6F-phosphate phosphohydrolase
  misc_feature (1)..(959): NCBI GI: 1854378 NCBI Desc: sucrose-phosphate synthase [saccharum officinarum]
  misc_feature (1)..(959): NCBI GI: 33330168 NCBI Desc: sucrose-phosphate synthase 9 [triticum aestivum]
  misc_feature (1)..(685): NCBI GI: 23268299 NCBI Desc: sucrose phosphate synthase [oncidium cv. 'goldiana']
  misc_feature (1)..(685): NCBI GI: 3915023 NCBI Desc: sucrose-phosphate synthase 1 (udp-glucose-fructose-phosphate glucosyltransferase 1)
  misc_feature (26)..(660): NCBI GI: 38305300 NCBI Desc: sucrose-phosphate synthase [bambusa oldhamii]
  misc_feature (1)..(685): SWISSPROT Homolog: EC 2.4.1.14 Sucrose-phosphate synthase 1
  misc_feature: Useful for making plants with altered cell wall content and/or composition
  misc_feature: Functional homolog of the protein sequence encoded by LOCUS at5g20280
  misc_feature: Useful for making plants with altered cell wall content and/or composition
  misc_feature: Useful for making plants with modulated biomass
  misc_feature: Useful for making plants with modulated carbohydrate content
  misc_feature: Functional homolog of the protein sequence given in SEQ ID NO 13827
  misc_feature: Useful for making plants with altered carbohydrate content
  misc_feature: Functional homolog of the protein sequence given in SEQ ID NO 13828
MAGNDNWINSYLDAILDAGKAAIGGDRPSLLLRERGHFSPARYFVEEVITGYDETDLYKTWLRANAMRSPQERNTRLENMTWRIWNLARKKKEFEKEEACRLSKRQPETEKTRADATADMSEDLFEGEKGEDAGDPSVAYGDSTTGSSPKTSSIDKLYIVLISLHGLVRGENMELGRDSDTGGQVKYVVELAKALSSSPGVYRVDLLTRQILAPNFDRSYGEPAELLVSTSGKNSKQEKGENSGAYIIRLPFGPKDKYLAKEHLWPFIQEFVDGALSHIVRMSKAIGEETGRVHPVWPAVIHGHYASAGIAAALLSGALNLPMAFTGHFLGKDKLEGLLKQGRQTREQINMTYKIMCRIEAEELSLDASEIVIASTRQEIEEQWNLYDGFEVILARKLRARVKRGANCYGRFMPRMVIIPPGVEFGHIIHDFDMDGEEENPSPASEDPPIWSQIMRFFTNPRKPMILAVARPYPEKNITTLVKAFGECRPLRELANLTLIMGNREAISKMHNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKQLWSRCRENGLTNIHRFSWPEHCKNYLSRILTLGPRSPAIGNREERSNTPISGRRQIIVISVDSVNKEDLVRIIRNAIEVIHTQNMSSSTGFVLSTSLTISEINSLLLSGGMLPTDFDAFICNSGSNIYYPSYSGETPNNSKITFALDQNHQSHIEYRWGGEGLRKYLVKWATSVVERKGRTERQIIFEDPEHSSAYCLAFRVVNPNHELRKLMRIQSLRCNALYNHSATRLSVVPIHASRSQALRYLCIRWGIEVPNVAVLVGESGDSDYEELLGGLHRTIILKGEFNIPANRIHTVRRYPLQDVVALDSSNIIGVEGYTTDDLKSALQQMGILTQ

SEQ ID NO: 329 - DNA, 2301 bp, Sorghum bicolor
  misc_feature: Ceres ANNOT ID no. 6007305
  misc_feature: Encodes the peptide sequence at SEQ ID NO 330
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
atggctgcggcggcgatcctgccggagctggcgacgcaggtgctcatcccggtcgcggcggccgtgggcatcgcgttcgcggtggtgcagtgggtgctggtgtccaaggtgcggctcacccccgagcgccgtgcggacggcggagccgccaagagcgggcccagcgactacctcatcgaggaggaggaggggctcaacgaccacaacgtcgtcgtcaagtgcgccgagatccagaacgccatctctgaaggagctacatctttccttttcactgagtacaagtatgttggattattcatgggcatctttgcaatccttatattcctcttccttgggtccgtcgagggattcagcacgaagagtcaaccttgccactatagcaagggcaaaacttgcaagcctgcccttgctaatgccatcttcagtactatagcttttgtgcttggtgccgtcacctcactggtttctggatttcttggaatgaagattgcaacttatgcgaatgcccggacaactttagaggccagaaagggtgttgggaaggcatttattactgccttccgatctggtgcagttatgggctttctgcttgctgccagtggtcttttggttctttacattgctatcaatttgtttggaatttattacggtgatgactgggaaggtctttttgaggctattactggttatggccttggtggttcttctatggctcttttcggccgcgttggtggtggtatttataccaaggctgctgatgttggtgctgaccttgtgggtaaggtagaaagaaacattcctgaggacgatccaagaaacccagctgtcattgctgacaatgttggtgataatgttggagatattgctggaatgggatcagatctcttcggctcatatgctgaatcgtcatgtgctgctcttgttgtggcctcaatctcgtcttttggaatcaaccatgaatttactccgatggtgtacccccttcttgtcagctctgttggtattatagcatgtctcgtaacaacgctgtttgcaactgatttcttcgagataaaggctgtgagtgaaatagagcctgctctcaagaaacaacttataatatctactgttgtgatgaccattggcattgcgctcatcagttggcttggtcttccatacaccttcaccatttttaactttggagaacagaagacagtgcaaagctggcaattattcttgtgtgtggcggttggtctctgggctggcctagtcattggatttgttaccgagtactacacaagcaatgcctacagccctgtacaagatgttgctgattcctgcagaactggagctgccactaatgtcatttttgggcttgctttgggttacaaatcagtcattatcccaatttttgctattgcgtttagtatcttcctcagcttcagccttgctgccatgtatggtgttgctgtggctgctcttggaatgctgagtaccattgccacaggccttgccattgatgcctatggccctatcagtgataatgctggaggaatagctgaaatggctgggatgagccataggattcgtgagagaaccgatgctctagattctgcaggaaacaccactgctgcaattggaaagggctttgccattggctccgcagccttggtgtcccttgcactcttcggtgcctttgtaagccgggctgctatctccactgttgatgttctgactcctaaagtattcattgggcttattgtcggtgctatgctcccatactggttctcggcaatgaccatgaagagtgtaggcagtgctgcactcaaaatggtggaggaagtccgccggcagttcaacaccatccctgggctcatggagggcaccacaaagcctgactatgcaacttgtgtcaagatctcaacggatgcatccatcaaggagatgatccccccaggtgctcttgttatgctcacaccactgatcgttgggattttgtttggggttgagaccctctctggagtccttgctggtgcccttgtctctggtgttcagattgccatttctgcatccaacactggtggtgcctgggacaatgccaagaagtacattgaggctggagcttcagagcatgccaggacccttggcccaaaaggttctgaccctcacaaggcagctgtcattggtgacaccattggagatcctctcaaggacacgtctggcccctccctcaacatcctcatcaagcttatggcggttgaatcccttgtctttgcccccttcttcgccgcccatggtggcattctcttcaaatggctctaa

SEQ ID NO: 330 - protein, 766 aa, Sorghum bicolor
  misc_feature: Ceres ANNOT ID no. 6007305
  misc_feature (9)..(752): Pfam Id: H_PPase Pfam Desc: Inorganic H+ pyrophosphatase
  misc_feature (1)..(766): NCBI GI: 57161868 NCBI Desc: vacuolar h+-translocating inorganic pyrophosphatase [zea mays]
  misc_feature (1)..(766): NCBI GI: 66350968 NCBI Desc: vacuolar h+-translocating inorganic pyrophosphatase [zea mays]
  misc_feature (1)..(764): NCBI GI: 38488590 NCBI Desc: vacuolar proton pyrophosphatase [oryza sativa (japonica cultivar-group)]
  misc_feature (1)..(765): NCBI GI: 51535512 NCBI Desc: inorganic diphosphatase, h+-translocating, vacuolar membrane [oryza sativa (japonica cultivar-group)]
  misc_feature (4)..(765): NCBI GI: 1747294 NCBI Desc: vacuolar h+-pyrophosphatase [oryza sativa (japonica cultivar-group)]
  misc_feature (4)..(764): SWISSPROT Homolog: EC 3.6.1.1 Pyrophosphate-energized vacuolar membrane proton pump
  misc_feature: Useful for making plants with modulated water use efficiency
  misc_feature: Functional homolog of the protein sequence given in SEQ ID NO 13830
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
MAAAAILPELATQVLIPVAAAVGIAFAVVQWVLVSKVRLTPERRADGGAAKSGPSDYLIEEEEGLNDHNVVVKCAEIQNAISEGATSFLFTEYKYVGLFMGIFAILIFLFLGSVEGFSTKSQPCHYSKGKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLVTTLFATDFFEIKAVSEIEPALKKQLIISTVVMTIGIALISWLGLPYTFTIFNFGEQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDSAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFAAHGGILFKWL

SEQ ID NO: 331 - DNA, 570 bp, Sorghum bicolor
  misc_feature: Ceres ANNOT ID no. 6007308
  misc_feature: Encodes the peptide sequence at SEQ ID NO 332
atgatcatggcaatgtggaagccagcatggttagaggcccttaacacacagaagttcttcgtagcatgctctctccatgagcacgccaagaagaacgagaagaacatctgctgccttgactgttgcaccagcatctgcccacactgtgtgggagcacaccgtgtacaccggctcctgcaggtgcggcgatacgtctaccatgatgttgtccggctggaggacctggagaagcttgttgattgctccagtgttcaggtagaatatatactacggcagaagaaaaatttgtcagcatacttgcgcccatgcaagacgttgcagcttggccctgacttcttcattcctcatgatgctgatgatgacacaactcactcaacccttgttgatgttgatgagcccatgggatcatcggactctgagaatttgagtgcgccatgcacaaattttgttcggaaaaaacggagtggaccatatatttgtgcacggtctgcaaacagagtgtctgatgaagacatggccacaaatatgagcagaaggaaaggggttcctcatagatcgcctttgtgctaa

SEQ ID NO: 332 - protein, 189 aa, Sorghum bicolor
  misc_feature: Ceres ANNOT ID no. 6007308
  misc_feature (23)..(166): Pfam Id: PLATZ Pfam Desc: PLATZ transcription factor
  misc_feature (1)..(85): NCBI GI: 145336287 NCBI Desc: zinc ion binding [arabidopsis thaliana]
  misc_feature (1)..(85): NCBI GI: 9755373 NCBI Desc: f17f8.4 [arabidopsis thaliana]
  misc_feature (1)..(102): NCBI GI: 16117799 NCBI Desc: zinc-binding protein [pisum sativum]
  misc_feature (6)..(102): NCBI GI: 115460222 NCBI Desc: os04g0591100 [oryza sativa (japonica cultivar-group)]
  misc_feature (8)..(102): NCBI GI: 22136542 NCBI Desc: at1g21000/f9h16_1 [arabidopsis thaliana]
MIMAMWKPAWLEALNTQKFFVACSLHEHAKKNEKNICCLDCCTSICPHCVGAHRVHRLLQVRRYVYHDVVRLEDLEKLVDCSSVQVEYILRQKKNLSAYLRPCKTLQLGPDFFIPHDADDDTTHSTLVDVDEPMGSSDSENLSAPCTNFVRKKRSGPYICARSANRVSDEDMATNMSRRKGVPHRSPLC

SEQ ID NO: 333 - DNA, 1452 bp, Sorghum bicolor
  misc_feature: Ceres ANNOT ID no. 6007309
  misc_feature: Encodes the peptide sequence at SEQ ID NO 334
atggcgaccggtggcaagcccgctgctcctcagccacctcccgccgcgccctcctcctctgaccgcgcgctggagtcagtccacttctcctcgggaaaccctcgcatcgaggagacccgaggcgtcgtcgtcctccaccccgacccgcccgccgccgcctcctggtctcatctcccggtggggaggaagccgcgggtgtgcgtgctcgccgtgcccaatcacatgacctacgccgacttctgccgtttctgcggtgccttcgtcccccacacgctcgagatgcgcatcgtcagaactgatggagcagaggaccagtacagtgttcttataaattttgacactcagagctccacagacagcttctataagcacttcaatgggaagcagttctcttcgctggagggggatgtttgccaagtccgttttgtggaagatgtgcactacactcaattgattgagcatgcacatacctcggttacaaacttggctgagcaacctacgtgcccagtatgtcttgaacgacttgaccaagatcctggaggtattctcacaacaatctgcaaccattctttccactgttcttgcatatcaaaatggacagactcctcatgcccggtctgcagatattgtcagcagcaaccagagaaatccatgtgttctatttgcggaactttggagaatctttggatatgtctaatctgtggccatgttggctgtggaaggtacaaaggtggacatgctattgaacactggaaggaaacacaacattgctattcacttgagttagagacacagaaagtttgggactatgctggggacaactatgtccatcggcttattcagtcaaaaacagatggaaagctagttgagtacaattgccatgatgatcacacagcagagagcacgtgttcactatgcagtggtgatgccgcaatgagtgaagctctactaaacagtaaatttgaagctattgttgaagagtacaatgatcttgttacatttcaacttgaaaagcaaagaaattactatgagtcacttctactagaagtcaaagaggaaactgagagagaaatttctgctgctactgagaaagccatgagcataaaactccaaaagttggaagcaaagtttgaaaagttcagggaagagaaaagatttcttgatgaagttaatggcaatcttgtcaagaatcaggagatgtggattgaaacgatacgaaaagcacaagcaagggagcaagctgcccttagattaaaagatgagaagattgagaaacttcaagaagagctaagaggtttgatagcccatttcgagtgccaaagtgccattgcacaagctcaagattcgttctcaagtgatataccaggggacatgattcttccggtagcatcagaatcatcctcgagcggcggtgaccctgttggtggcactagaaacgggaagcagaattga

SEQ ID NO: 334 - protein, 483 aa, Sorghum bicolor
  misc_feature: Ceres ANNOT ID no. 6007309
  misc_feature (51)..(161): Pfam Id: BRAP2 Pfam Desc: BRCA1-associated protein 2
  misc_feature (219)..(290): Pfam Id: zf-UBP Pfam Desc: Zn-finger in ubiquitin-hydrolases and other protein
  misc_feature (168)..(207): Pfam Id: zf-C3HC4 Pfam Desc: Zinc finger, C3HC4 type (RING finger)
  misc_feature (1)..(325): NCBI GI: 49387526 NCBI Desc: brap2-like protein [oryza sativa (japonica cultivar-group)]
  misc_feature (18)..(339): NCBI GI: 42569332 NCBI Desc: zinc finger (c3hc4-type ring finger) family protein [arabidopsis thaliana]
  misc_feature (47)..(470): NCBI GI: 38345493 NCBI Desc: osjnba0010d21.6 [oryza sativa (japonica cultivar-group)]
  misc_feature (19)..(469): NCBI GI: 42569859 NCBI Desc: zinc finger (ubiquitin-hydrolase) domain-containing protein [arabidopsis thaliana]
  misc_feature (15)..(481): NCBI GI: 62087336 NCBI Desc: brca1 associated protein variant [homo sapiens]
  misc_feature: The sequence is a functional homolog of SEQ ID NO. 350 in the 11/188,298 US application
  misc_feature: The sequence is a functional homolog of SEQ ID NO. 424 in the 11/188,298 US application
  misc_feature: The sequence is a functional homolog of SEQ ID NO. 271 in the 11/188,298 US application
MATGGKPAAPQPPPAAPSSSDRALESVHFSSGNPRIEETRGVVVLHPDPPAAASWSHLPVGRKPRVCVLAVPNHMTYADFCRFCGAFVPHTLEMRIVRTDGAEDQYSVLINFDTQSSTDSFYKHFNGKQFSSLEGDVCQVRFVEDVHYTQLIEHAHTSVTNLAEQPTCPVCLERLDQDPGGILTTICNHSFHCSCISKWTDSSCPVCRYCQQQPEKSMCSICGTLENLWICLICGHVGCGRYKGGHAIEHWKETQHCYSLELETQKVWDYAGDNYVHRLIQSKTDGKLVEYNCHDDHTAESTCSLCSGDAAMSEALLNSKFEAIVEEYNDLVTFQLEKQRNYYESLLLEVKEETEREISAATEKAMSIKLQKLEAKFEKFREEKRFLDEVNGNLVKNQEMWIETIRKAQAREQAALRLKDEKIEKLQEELRGLIAHFECQSAIAQAQDSFSSDIPGDMILPVASESSSSGGDPVGGTRNGKQN

SEQ ID NO: 335 - DNA, 1896 bp, Sorghum bicolor
  misc_feature: Ceres ANNOT ID no. 6007323
  misc_feature: Encodes the peptide sequence at SEQ ID NO 336
  misc_feature: Down-regulated in root tissues in response to aminocyclopropane carboxylic treatment
atgaccgtcgaggacgtgaagctgcaggcggcgaaggcgaacggcggcggccatggggccaaggaccagttccccgtcggcatgcgcgtgctcgccgtcgacgacgatcccacctgcctcaagctcctcgagaagctcttgcaacactgccagtaccatgtgacaacaactggacaggcagccacggccctaaagctgctgagggagaagaaggaccagtttgaccttgtgatcagcgatgtccacatgccggacatggacggcttcaagctcctcgagcttgtgggcctcgagatggacctcccggtcattatgctgtctgcaaatggggagacacaaacagtcatgaagggtattacccatggagcatgtgactacctgctcaagccagtgcggattgagcagttgaggactatatggcagcatgtggttagaaggaggagttgtgatgccaagaacaatggtaatgataacgatgattccggtaagaagttgcaggtggtgagtgctgaaggtgacaatggtggtggtaatcgcaacaagagaacttcccgcaggggtagggatgataatggagatgacggtgatgattctgatgagaacagtaatgagaatggagactcatcaacccagaagaagccaagggtcgtgtggtctgttgaattacaccgaaagtttgtggctgctgtcaaccagcttggcattgacaaggctgttccaaagaaaatattggatctcatgaatgtcgagaacatcacaagggagaatgttgcaagtcatctgcagaagtatcggctgtatctgaaaagactcagtgcagatgcaagcaggcaggctaacctaactgctgcatttggaggaagaaaccctgcttatgtcaacatgggactagatgccttcaggcaatacaatgcatatgggagataccggccagttccaaccactaaccattcacagccaaacaacctccttgcaaggatgaactctcctgcatttggtatgcatggtttgctgccttcgcagccgcttcagattggacacacccagaacaatatgagcacttccgtaggcaatgtcggggggatgaacaacggcaacctgatcaggggtgcgcatatgccactgcaggatactagcaaatgctttcctactggcccttctggtaattcatttgcgaacatatcaaacagcatacaattggttacgacaaataacttgccattacagtctcttgagccaagcaaccaacaacaccttggtcggctgcagtcttctgcagacccattcaactcatttgttggtgagtctccccagtttccagatcttggaagatgcaacactacctggccaactgcggtctcatcctccaacgttcaggagcttggtcagaaggacagaattgtgaatgggcccaagcttgagcctctctcaagctttacagaagcatccagtcagattcccttgctgggaaatgaaatgcagagccaagtagcatcactagccagcaacggtcttccaatgccgttcactcaggaagcggcgcccttcgcatatggaagcagcacgaactcaagagagatgctgaataacaaccttgcacttagtaattcaggcatcaactcttcattgccgaaccttcgcatagacggttctgttgttccgaggcagacactggacggtggtaattcaggtggagtcccccctctgcaagatggcaggattgatcatcaagctgttagtagtcatctaagctataacaacgaactcatgatggggacaagtaggctgcaaaggggactcagtggtggtctggatgacattgtcgtggacatgtttaggccggaccgcgcagacgatggcgtccccttcattgatggggactgggaactggtctag

SEQ ID NO: 336 - protein, 631 aa, Sorghum bicolor
  misc_feature: Ceres ANNOT ID no. 6007323
  misc_feature (28)..(141): Pfam Id: Response_reg Pfam Desc: Response regulator receiver domain
  misc_feature (215)..(265): Pfam Id: Myb_DNA-binding Pfam Desc: Myb-like DNA-binding domain
  misc_feature (1)..(631): NCBI GI: 14189890 NCBI Desc: response regulator 9 [zea mays]
  misc_feature (1)..(437): NCBI GI: 109631194 NCBI Desc: srr391 [striga asiatica]
  misc_feature (20)..(456): NCBI GI: 30682677 NCBI Desc: two-component responsive regulator family protein / response regulator family protein [arabidopsis thaliana]
  misc_feature (19)..(387): NCBI GI: 50400641 NCBI Desc: two-component response regulator arr18
  misc_feature (28)..(387): NCBI GI: 145359387 NCBI Desc: arr18 (arabidopsis response regulator 18); transcription factor/ two-component response regulator [arabidopsis thaliana]
  misc_feature: The sequence is a functional homolog of SEQ ID NO 1232 in the 10/666,642US patent application
  misc_feature: The sequence is a functional homolog of SEQ ID NO 1233 in the 10/666,642US patent application
  misc_feature: The sequence is a functional homolog of SEQ ID NO 1410 in the 10/666,642US patent application
  misc_feature: The sequence is a functional homolog of SEQ ID NO 172 in the 10/666,642US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 2510 in the 10/374,780US patent application
  misc_feature: The sequence is a functional homolog of SEQ ID NO 36 in the 10/225,068US patent application
  misc_feature: The sequence is a functional homolog of SEQ ID NO 436 in the 10/374,780US patent application
  misc_feature: The sequence is a functional homolog of SEQ ID NO 476 in the 10/412,699US patent application
  misc_feature: The sequence is a functional homolog of SEQ ID NO 578 in the 10/666,642US patent application
  misc_feature: The sequence is a functional homolog of SEQ ID NO 58 in the 10/666,642US patent application
  misc_feature: The sequence is a functional homolog of SEQ ID NO 580 in the 10/666,642US patent application
  misc_feature: The sequence is a functional homolog of SEQ ID NO 686 in the 10/412,699US patent application
  misc_feature: The sequence is a functional homolog of SEQ ID NO 698 in the 10/225,066US patent application
  misc_feature: The sequence is a functional homolog of SEQ ID NO 932 in the 10/666,642US patent application
  misc_feature: The sequence is a functional homolog of SEQ ID NO 933 in the 10/666,642US patent application
  misc_feature: The sequence is a functional homolog of SEQ ID NO 934 in the 10/666,642US patent application
  misc_feature: The sequence is a functional homolog of SEQ ID NO 935 in the 10/666,642US patent application
  misc_feature: The sequence is a functional homolog of SEQ ID NO 936 in the 10/666,642US patent application
  misc_feature: The sequence is a functional homolog of SEQ ID NO 937 in the 10/666,642US patent application
  misc_feature: The sequence is a functional homolog of SEQ ID NO 976 in the 10/225,066US patent application
  misc_feature: Useful for making plants with modulated growth and phenotype characteristics
  misc_feature: The sequence is a functional homolog of SEQ ID NO 476 in the 20040045049 US patent application
  misc_feature: The sequence is a functional homolog of SEQ ID NO 686 in the 20040045049 US patent application
  misc_feature: The sequence is a functional homolog of SEQ ID NO 36 in the 20050120408 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1232 in the 20070033671 US patent application
  misc_feature: The sequence is a functional homolog of SEQ ID NO 1233 in the 20070033671 US patent application
  misc_feature: The sequence is a functional homolog of SEQ ID NO 578 in the 20070033671 US patent application
  misc_feature: The sequence is a functional homolog of SEQ ID NO 58 in the 20070033671 US patent application
  misc_feature: The sequence is a functional homolog of SEQ ID NO 580 in the 20070033671 US patent application
  misc_feature: The sequence is a functional homolog of SEQ ID NO 932 in the 20070033671 US patent application
  misc_feature: The sequence is a functional homolog of SEQ ID NO 933 in the 20070033671 US patent application
  misc_feature: The sequence is a functional homolog of SEQ ID NO 934 in the 20070033671 US patent application
  misc_feature: The sequence is a functional homolog of SEQ ID NO 935 in the 20070033671 US patent application
  misc_feature: The sequence is a functional homolog of SEQ ID NO 936 in the 20070033671 US patent application
  misc_feature: The sequence is a functional homolog of SEQ ID NO 937 in the 20070033671 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: Down-regulated in root tissues in response to aminocyclopropane carboxylic treatment
  misc_feature: The sequence is a functional homolog of SEQ ID NO. 378 in the 11/188,298 US application
MTVEDVKLQAAKANGGGHGAKDQFPVGMRVLAVDDDPTCLKLLEKLLQHCQYHVTTTGQAATALKLLREKKDQFDLVISDVHMPDMDGFKLLELVGLEMDLPVIMLSANGETQTVMKGITHGACDYLLKPVRIEQLRTIWQHVVRRRSCDAKNNGNDNDDSGKKLQVVSAEGDNGGGNRNKRTSRRGRDDNGDDGDDSDENSNENGDSSTQKKPRVVWSVELHRKFVAAVNQLGIDKAVPKKILDLMNVENITRENVASHLQKYRLYLKRLSADASRQANLTAAFGGRNPAYVNMGLDAFRQYNAYGRYRPVPTTNHSQPNNLLARMNSPAFGMHGLLPSQPLQIGHTQNNMSTSVGNVGGMNNGNLIRGAHMPLQDTSKCFPTGPSGNSFANISNSIQLVTTNNLPLQSLEPSNQQHLGRLQSSADPFNSFVGESPQFPDLGRCNTTWPTAVSSSNVQELGQKDRIVNGPKLEPLSSFTEASSQIPLLGNEMQSQVASLASNGLPMPFTQEAAPFAYGSSTNSREMLNNNLALSNSGINSSLPNLRIDGSVVPRQTLDGGNSGGVPPLQDGRIDHQAVSSHLSYNNELMMGTSRLQRGLSGGLDDIVVDMFRPDRADDGVPFIDGDWELV

SEQ ID NO: 337 - DNA, 942 bp, Sorghum bicolor
  misc_feature: Ceres ANNOT ID no. 6007328
  misc_feature: Encodes the peptide sequence at SEQ ID NO 338
atgtacttcgaaggctatggcttccgtggaagtactttcgagcagacttaccgctgctatcctgcgtccttcattgacaagccacaacttgaggctggtgacaaaattataatgccaccatcagctcttgatcgtcttgcatctctgcatattgaataccctatgctatttgaagtccacaatgcagcagcagaacgaacttcacattgtggtgttctggagttcattgcggaagaaggcatgatctacatgccatattggatgatgcaaaatcttcttctgcaagagggagatatggtgttcataaaaaatgccaacctccccaagggcacatatgtgaagttgcagcctcatacaacagactttctagatatttcaaaccccaaagcaatcttggagaaaactttgcggaacttttcttgtctaactacaggtgacagcattatggtagcgtataataacaagaagtactacattgatatagtggagacaaagccctccaatgctataagtattattgagaccgactgtgaggttgactttgctccaccacttgactacaaagaacccgagccagtaaaacctgctgttcctgcaagcacagagcctactaccgaggctccagctgaagaagaaccaaagttcatccccttcactggttcaggaaggcgcctggatgggaagccttccaaagataaagatgtgcaggcctcatcccctgcaaagcgacaagctaatgcaactaatggtgtgcagccctcaacagccaccacctcacagggcagttcatcacgtaagaccacaggaaaacttgtctttggctctggctctggtggaagccgcactgaaaaggcacctgaaaaggaagcaaaggaggagccaaagaaagaagacccaaaattcacagcattcacaggaaagaaatactcattgaagggctga

SEQ ID NO: 338 - protein, 313 aa, Sorghum bicolor
  misc_feature: Ceres ANNOT ID no. 6007328
  misc_feature (7)..(184): Pfam Id: UFD1 Pfam Desc: Ubiquitin fusion degradation protein UFD1
  misc_feature (1)..(313): NCBI GI: 46452265 NCBI Desc: ubiquitin fusion degradation protein [triticum aestivum]
  misc_feature (1)..(313): NCBI GI: 144923598 NCBI Desc: ubiquitin fusion degradation protein ufd1 [medicago truncatula]
  misc_feature (1)..(313): NCBI GI: 78191476 NCBI Desc: ubiquitin fusion-degradation protein-like [solanum tuberosum]
  misc_feature (1)..(312): NCBI GI: 38345534 NCBI Desc: osjnba0020j04.9 [oryza sativa (japonica cultivar-group)]
  misc_feature (1)..(313): NCBI GI: 145329208 NCBI Desc: ubiquitin fusion degradation ufd1 family protein [arabidopsis thaliana]
MYFEGYGFRGSTFEQTYRCYPASFIDKPQLEAGDKIIMPPSALDRLASLHIEYPMLFEVHNAAAERTSHCGVLEFIAEEGMIYMPYWMMQNLLLQEGDMVFIKNANLPKGTYVKLQPHTTDFLDISNPKAILEKTLRNFSCLTTGDSIMVAYNNKKYYIDIVETKPSNAISIIETDCEVDFAPPLDYKEPEPVKPAVPASTEPTTEAPAEEEPKFIPFTGSGRRLDGKPSKDKDVQASSPAKRQANATNGVQPSTATTSQGSSSRKTTGKLVFGSGSGGSRTEKAPEKEAKEEPKKEDPKFTAFTGKKYSLKG

SEQ ID NO: 339 - DNA, 948 bp, Sorghum bicolor
  misc_feature: Ceres ANNOT ID no. 6007350
  misc_feature: Encodes the peptide sequence at SEQ ID NO 340
atgacgacggcgacgacgactaagccggcggcggaacgcagcgggcggcgctacgcgctgctgctggcgctctgggactcggagtacgccaaggaggtgtacggcgggtactacaccgtcttcgtctccgcgttcggcgacggcgccagcggtggcaccgacgagaggtgggactccttccgcgtgatcgccggcgagttcccggcgccggaggacctggcgtcgtacgacggcttcgtggtgagcggcagcccgcacgacgcgcacggcgacgagccgtggatccggcgcctctgcgcgctcgtccagaccgtccacgccatgaggaagcgtgtgctcggcgtctgcttcgggcaccaggtcctgtgccgagcgctgggcggaagggtcggcagggcacggaacggctgggacgtcggggtgaggaaggtgacgtttgcgccggacctcctggagggccgcctcgagttcctcatcggggatctcgtcgccgatgagcttccggcccagagcgccggcctcatcgaggttcaccaggacgaggtgtgggagatcccgccggcggcgacggtgctggcctactcggagaagacgcgcgtggaggtgttcgcggtcggggagcacgcgctgggcatccagggacacccggagtacaccgtcgacatcctccacaacctcatcgaccgcctcaccggccagaaggccatccggaggagcgtcggcgaggaggcacggcggacggtcgcggagaccggcgggccggaccgcgcgttctggacggcgctctgcaagggttttctccggggcggaggagatcgtacgcagcctgctctgccggcgatgcgggagacgacggcggcgccggaggtgaccagctgcgccgtcgctggctgcggcttcaccagcgcaggcgcagctgcaatgatccagttggctcgcagcaactag

SEQ ID NO: 340 - protein, 315 aa, Sorghum bicolor
  misc_feature: Ceres ANNOT ID no. 6007350
  misc_feature (13)..(268): NCBI GI: 50725903 NCBI Desc: glutamine synthetase-like protein [oryza sativa (japonica cultivar-group)]
  misc_feature (16)..(269): NCBI GI: 23505821 NCBI Desc: at4g30550/f17i23_110 [arabidopsis thaliana]
  misc_feature (16)..(269): NCBI GI: 14009290 NCBI Desc: defense-related protein [brassica carinata]
  misc_feature (16)..(268): NCBI GI: 21593315 NCBI Desc: defense-related protein [arabidopsis thaliana]
  misc_feature (16)..(269): NCBI GI: 144922952 NCBI Desc: glutamine amidotransferase class-i [medicago truncatula]
MTTATTTKPAAERSGRRYALLLALWDSEYAKEVYGGYYTVFVSAFGDGASGGTDERWDSFRVIAGEFPAPEDLASYDGFVVSGSPHDAHGDEPWIRRLCALVQTVHAMRKRVLGVCFGHQVLCRALGGRVGRARNGWDVGVRKVTFAPDLLEGRLEFLIGDLVADELPAQSAGLIEVHQDEVWEIPPAATVLAYSEKTRVEVFAVGEHALGIQGHPEYTVDILHNLIDRLTGQKAIRRSVGEEARRTVAETGGPDRAFWTALCKGFLRGGGDRTQPALPAMRETTAAPEVTSCAVAGCGFTSAGAAAMIQLARSN

SEQ ID NO: 341 - DNA, 1893 bp, Sorghum bicolor
  misc_feature: Ceres ANNOT ID no. 6007357
  misc_feature: Encodes the peptide sequence at SEQ ID NO 342
atggctgctcccctctcttcctggccatggacaagcctcggcgattacaagtacgcgctgctggggcctctggcgtggaaggtggtgcaagaatggcgggagcagggccaaggggcgctgccgctggtgctgggctcgtggtggctgcacctcctcttgctgttcgtggtgcgggggctcacctaccagttctggttcacctacggcaacatgctcttcttcacccgccgccgccgagtcgtcgccgacggcgtcgacttccggcagatcgacgccgagtgggactgggacaactttctcgtgctgcaaacgctgattggggccacggtggtcaacagcccactgctcccgggcctgcggcagctctgcctgtgggacgcccgtgggtgggccgtcgccctgctgctgcatgtgggcttctcagagccggtcttctacctggcccaccgggccctccaccgggacccgctcttcgcccggcaccacgccgcgcaccactcctcgggagtcacccagtcgttgacagccgggttcgggacgccgctggaggccctgctgctgacgctggtgatgggggtcccactggcaggggccttcttggtcggggccgggtccataggcctggtctacgtgcacgccctcgccttcgactacctgcgcgccatggggtacagcaacgtcgaggtcgtgtcgcccagggtgtttgaagcgttcccgctgctcagatacatcctctacacaccttcgtacctgagcctgcaccaccgcgagcgtcgcggcaacttctgcctgttcatgccggcgctggactggctgggcgggacgctggactcgcgcgcgtggccgctgcagcgcgccgcctacgacggcgcggcgggcggcggcgcgctgggcacgccggggttcgtgttcctggcgcacgtggtggacatcatgtcgtcgatgcacgtgccgttcacgctccggtcgctgggcgccaccccgttcgccaaccacttctacctgctcccgttctggccgctggccttcttcttcatgctcctcatgtggtgctgctccaagaccttcgtcgtcagcttctactgcctccgcggccagctccaccagacctggtccgtgcctcgctacggcttccagtacttcctgccggcggcgaagaagggcatcaacaagcagatcgagctggccatccttcgggccgacaggatgggcgtcaaggtgctcagcctcgccgcgctaaacaagaacgaggcgttgaacggaggcggcaccctgttcgtgaacaagcacccggacctgcgtgtgagggtggtgcacggcaacacgctgacggcggccgtgatcctgaacgagatccccagcaacgtcaaggaggtgttcatgaccggcgccacctccaagctcggcagggccatcgcactctacctctgcaggaagaagatcagagtcctgatgttcacgatgtcgtcggagaggttcgtgaagatccagagggaggcgccgccggagttccagcagtacctcgtgcaggtgaccaaataccaggccgcacagaactgcaagacgtggatcgtgggcaagtggctgtcgccgcgcgagcagcggtgggcgccgtcggggacgcacttccaccagttcgtggtgccgcccatcatcggcttccggcgagactgcacctacggcaagctcgccgccatgaggctccccaaggacgtgcagggcctgggctcctgcgagtacacgatggagcgcggggtggtgcacgcgtgccacgccggcggcgtcgtgcacttcctcgaaggatgggaccaccacgaggtgggcgccatcgacgtcgaccggatcgacgtcgtctggaacgccgcgctcaagcacggcctcgcgccggtgtga

SEQ ID NO: 342 - protein, 630 aa, Sorghum bicolor
  misc_feature: Ceres ANNOT ID no. 6007357
  misc_feature (134)..(256): Pfam Id: FA_hydroxylase Pfam Desc: Fatty acid hydroxylase
  misc_feature (2)..(629): NCBI GI: 40950054 NCBI Desc: gl1 protein [zea mays]
  misc_feature (2)..(629): NCBI GI: 40794503 NCBI Desc: glossy1 protein [zea mays]
  misc_feature (70)..(629): NCBI GI: 2213643 NCBI Desc: glossy1 homolog [oryza sativa]
  misc_feature (71)..(630): NCBI GI: 9758349 NCBI Desc: lipid transfer protein; glossy1 homolog [arabidopsis thaliana]
  misc_feature (46)..(556): NCBI GI: 498038 NCBI Desc: lipid transfer protein
  misc_feature: Useful for making plants with modulated nitrogen use efficiency
  misc_feature: Useful for making plants with modulated nitrogen use efficiency
  misc_feature: Functional homolog of the protein sequence given in SEQ ID NO 13049
  misc_feature: Useful for making plants with modulated nitrogen use efficiency
  misc_feature: Functional homolog of the protein sequence given in SEQ ID NO 13049
MAAPLSSWPWTSLGDYKYALLGPLAWKVVQEWREQGQGALPLVLGSWWLHLLLLFVVRGLTYQFWFTYGNMLFFTRRRRVVADGVDFRQIDAEWDWDNFLVLQTLIGATVVNSPLLPGLRQLCLWDARGWAVALLLHVGFSEPVFYLAHRALHRDPLFARHHAAHHSSGVTQSLTAGFGTPLEALLLTLVMGVPLAGAFLVGAGSIGLVYVHALAFDYLRAMGYSNVEVVSPRVFEAFPLLRYILYTPSYLSLHHRERRGNFCLFMPALDWLGGTLDSRAWPLQRAAYDGAAGGGALGTPGFVFLAHVVDIMSSMHVPFTLRSLGATPFANHFYLLPFWPLAFFFMLLMWCCSKTFVVSFYCLRGQLHQTWSVPRYGFQYFLPAAKKGINKQIELAILRADRMGVKVLSLAALNKNEALNGGGTLFVNKHPDLRVRVVHGNTLTAAVILNEIPSNVKEVFMTGATSKLGRAIALYLCRKKIRVLMFTMSSERFVKIQREAPPEFQQYLVQVTKYQAAQNCKTWIVGKWLSPREQRWAPSGTHFHQFVVPPIIGFRRDCTYGKLAAMRLPKDVQGLGSCEYTMERGVVHACHAGGVVHFLEGWDHHEVGAIDVDRIDVVWNAALKHGLAPV

SEQ ID NO: 343 - DNA, 1668 bp, Sorghum bicolor
  misc_feature: Ceres ANNOT ID no. 6007379
  misc_feature: Encodes the peptide sequence at SEQ ID NO 344
atgggttccgtggacacggcggtcgcggtgccggtgccagtgccggagccggaggcagaggagaaggcggcggtggtgttccgttccaagcttcccgacatcgagatcaacaacagccagtcgctgcagacctactgcttcgggaagatgagcgaggtggcggaccgcgcctgcctcatcgacgggcagacgggggcgtcgtacacgtacgcggaggtggagtctctgtcccgtcgcgccgcgtcggggctccgcgccatgggcgtgggcaagggcgacgtggtgatgaacctgctccgcaactgccccgagttcgccttcaccttcctcggcgcggcgcggctgggcgccgccaccaccacggccaacccgttctacaccccgcacgagatccaccgccaggcggaggcggcgggcgccaaggtcatcgtcaccgaggcctgcgccgtggagaaggtgcgcgagttcgcggcggggaggggcgtccccgtcgtcaccgtcgacggccgcttcgacggctgcgtggagttcgccgaggtgatcgcggccgaggagctcgacgccgacgccgacgtccaccccgacgacgtcgtcgcgctgccttactcctccggcaccaccggtctccccaagggcgtcatgctcacccaccgcagcctcatcaccagcgtcgcgcagcaggtggatggcgagaacccgaacctgtacttcagcaaggacgacgtggtgctctgcctgctgccgctgttccacatctactcgctcaactcggtgctgctggcggggctgcgcgcggggtccaccatcgtgatcatgcgcaagttcgacctgggcgcgctggtggacctggtgcgcaagcacggcatcaccatcgcgcccttcgtgccgcccatcgtggtggagatcgccaagagcccgcgcgtgaccgccgacgacctggcctccatccgcatggtcatgtccggcgccgcgcccatggggaaggagctccaggacgccttcatgaccaagatccccaacgccgtgctcgggcaagggtacgggatgacggaggcagggcccgtgctggcgatgtgcctggcgttcgccaaggagccgttccaggtcaagtccgggtcgtgcggcaccgtggtgcggaacgcggagctgaaagtcgtcgaccccgacaccggcgccgccctcggccggaaccagcccggcgagatctgcatccgcggcgagcagatcatgaaaggttacctgaacgaccttgagtcgacaaagaacaccatcgacaaggacggctggctgcacaccggcgacatcggctatgtcgacgacgacgacgagatcttcatcgtcgacaggctcaaggagatcatcaagtacaaggggttccaggtgccgccggccgagctcgaggcgctcctcatcacgcacccggagatcaaggacgccgccgtcgtgtcaatgaaggatgatcttgctggtgaaatcccggtcgccttcatcgtgcggaccgaaggctctgaagtcaccgaggatgagatcaagcaatttgtcgccaaggaggtggttttctacaagaagatccacaaggttttcttcactgaatccatccccaagaacccgtccggcaagatcctaaggaaggacttgagagccaggctcgccgccggtgttcactga

SEQ ID NO: 344 - protein, 555 aa, Sorghum bicolor
  misc_feature: Ceres ANNOT ID no. 6007379
  misc_feature (69)..(481): Pfam Id: AMP-binding Pfam Desc: AMP-binding enzyme
  misc_feature (1)..(555): NCBI GI: 45549453 NCBI Desc: 4-coumarate coenzyme a ligase [zea mays]
  misc_feature (14)..(554): NCBI GI: 7188339 NCBI Desc: 4-coumarate--coa ligase 4cl3 [lolium perenne]
  misc_feature (23)..(554): NCBI GI: 7188337 NCBI Desc: 4-coumarate--coa ligase 4cl2 [lolium perenne]
  misc_feature (19)..(555): NCBI GI: 73665529 NCBI Desc: 4-coumarate:coenzyme a ligase [eucalyptus camaldulensis]
  misc_feature (16)..(554): NCBI GI: 9651915 NCBI Desc: 4-coumarate:coa ligase 2 [rubus idaeus]
  misc_feature (16)..(554): SWISSPROT Homolog: EC 6.2.1.12 4-coumarate--CoA ligase 1
  misc_feature: Useful for making plants with altered cell wall content and/or composition
  misc_feature: Useful for making plants with altered lignin content
  misc_feature: GREAT-hit functional homolog of the protein sequence given in SEQ ID NO 13358
  misc_feature: GREAT-hit functional homolog of the protein sequence encoded by LOCUS at1g51680
  misc_feature: GREAT-hit functional homolog of the protein sequence encoded by LOCUS at3g21240
  misc_feature: Useful for making plants with altered carbohydrate content
  misc_feature: Functional homolog of the protein sequence given in SEQ ID NO 13695
  misc_feature: Useful for making plants with altered lignin content
  misc_feature: Functional homolog of the protein sequence given in SEQ ID NO 13358
  misc_feature: Useful for making plants with altered cell wall content and/or composition
  misc_feature: Functional homolog of the protein sequence given in SEQ ID NO 13696
MGSVDTAVAVPVPVPEPEAEEKAAVVFRSKLPDIEINNSQSLQTYCFGKMSEVADRACLIDGQTGASYTYAEVESLSRRAASGLRAMGVGKGDVVMNLLRNCPEFAFTFLGAARLGAATTTANPFYTPHEIHRQAEAAGAKVIVTEACAVEKVREFAAGRGVPVVTVDGRFDGCVEFAEVIAAEELDADADVHPDDVVALPYSSGTTGLPKGVMLTHRSLITSVAQQVDGENPNLYFSKDDVVLCLLPLFHIYSLNSVLLAGLRAGSTIVIMRKFDLGALVDLVRKHGITIAPFVPPIVVEIAKSPRVTADDLASIRMVMSGAAPMGKELQDAFMTKIPNAVLGQGYGMTEAGPVLAMCLAFAKEPFQVKSGSCGTVVRNAELKVVDPDTGAALGRNQPGEICIRGEQIMKGYLNDLESTKNTIDKDGWLHTGDIGYVDDDDEIFIVDRLKEIIKYKGFQVPPAELEALLITHPEIKDAAVVSMKDDLAGEIPVAFIVRTEGSEVTEDEIKQFVAKEVVFYKKIHKVFFTESIPKNPSGKILRKDLRARLAAGVH

SEQ ID NO: 345 - DNA, 261 bp, Sorghum bicolor
  misc_feature: Ceres ANNOT ID no. 6007380
  misc_feature: Encodes the peptide sequence at SEQ ID NO 346
atggcgactgtgccagttaacccaaaacctttcctgaacaacctgacagggaagtttgtaattgtcaaactcaagtggggtatggagtacaaaggttatcttgcttcggtggactcctatatgaacctccagcttgccaacactgaggagtacattgatgggcaattctctggaaacctgggagagattctgatcaggtgcaacaacgttttgtatctccgaggcgttccagaggatgcagagatacaggatgcagaatga

SEQ ID NO: 346 - protein, 86 aa, Sorghum bicolor
  misc_feature: Ceres ANNOT ID no. 6007380
  misc_feature (10)..(75): Pfam Id: LSM Pfam Desc: LSM domain
  misc_feature (1)..(85): NCBI GI: 92873803 NCBI Desc: like-sm ribonucleoprotein-related, core [medicago truncatula]
  misc_feature (3)..(81): NCBI GI: 48145619 NCBI Desc: snrpf [homo sapiens]
  misc_feature (3)..(81): NCBI GI: 4507131 NCBI Desc: small nuclear ribonucleoprotein polypeptide f [homo sapiens]
  misc_feature (3)..(81): NCBI GI: 33417283 NCBI Desc: snrpf-prov protein [xenopus laevis]
  misc_feature (3)..(81): NCBI GI: 49900002 NCBI Desc: mgc89662 protein [xenopus tropicalis]
MATVPVNPKPFLNNLTGKFVIVKLKWGMEYKGYLASVDSYMNLQLANTEEYIDGQFSGNLGEILIRCNNVLYLRGVPEDAEIQDAE

SEQ ID NO: 347 - DNA, 951 bp, Sorghum bicolor
  misc_feature: Ceres ANNOT ID no. 6007385
  misc_feature: Encodes the peptide sequence at SEQ ID NO 348
atgtcaggggcgaaggcatccgtggagcgcgtgaaggaccgcgccaccggcctcgacaagttcgtgctccgcgaggcccggggcagctccgtcgaggtatatttatatggaggccaagtgacattttggaaaaataacttcggtcaacaactgctttttgttagtgacaaggctacttttaaaccaccaaaagcaattcgtggtggcatccaaatttgcttccctcaactaggtaaccatggagttcttgaacagcatggatttgcaaggaaccgattttggagtgtcgatgaaagtccaccttcttttccagttgctacttccaattgtcatattgacttgatactcaagtcatctcaagaggatttgaagatctggccacatagttatgaatttcgtctgagagttgctctgagtccaaggggagatcttattcttacatctcgaataaaaaatatcagctctgatagcaagccattccaatttacatttgcataccacacctacttttcggtgtctgacatcagtgaagtgagggttgaaggtttggagaccttggactatcttgaaaacttgcaatctaagaatcgttgtactgaacaaggagatgcagttgtatttgagtctgaagtggacaaggtatatttgagtgctccaccaaagattgtgatcattgaccacgagaagaaaagaacatttgttttgaggaaagagggacttcctgatgttgttgtttggaacccttgggacaagaaggccaaagcaatgacagatttcggggatgaggagtacaagaacatgctatgcgtggggcctgcagctattgagaagccaattactttaaagccaggtgaagagtggataggaaagcaggagatttgtgctgtaccatccagttatagcagcggacaattggatcctgaactgattcgtcgaatgcacacaatataa

SEQ ID NO: 348 - protein, 316 aa, Sorghum bicolor
  misc_feature: Ceres ANNOT ID no. 6007385
  misc_feature (19)..(294): Pfam Id: Aldose_epim Pfam Desc: Aldose 1-epimerase
  misc_feature (7)..(310): NCBI GI: 38344152 NCBI Desc: osjnba0041a02.19 [oryza sativa (japonica cultivar-group)]
  misc_feature (7)..(310): NCBI GI: 116309662 NCBI Desc: osigba0118p15.1 [oryza sativa (indica cultivar-group)]
  misc_feature (1)..(316): NCBI GI: 50252049 NCBI Desc: apospory-associated protein c-like [oryza sativa (japonica cultivar-group)]
  misc_feature (17)..(310): NCBI GI: 124360080 NCBI Desc: galactose mutarotase-like [medicago truncatula]
  misc_feature (9)..(307): NCBI GI: 549984 NCBI Desc: possible apospory-associated protein
MSGAKASVERVKDRATGLDKFVLREARGSSVEVYLYGGQVTFWKNNFGQQLLFVSDKATFKPPKAIRGGIQICFPQLGNHGVLEQHGFARNRFWSVDESPPSFPVATSNCHIDLILKSSQEDLKIWPHSYEFRLRVALSPRGDLILTSRIKNISSDSKPFQFTFAYHTYFSVSDISEVRVEGLETLDYLENLQSKNRCTEQGDAVVFESEVDKVYLSAPPKIVIIDHEKKRTFVLRKEGLPDVVVWNPWDKKAKAMTDFGDEEYKNMLCVGPAAIEKPITLKPGEEWIGKQEICAVPSSYSSGQLDPELIRRMHTI

SEQ ID NO: 349 - DNA, 1332 bp, Sorghum bicolor
  misc_feature: Ceres ANNOT ID no. 6007386
  misc_feature: Encodes the peptide sequence at SEQ ID NO 350
atgtcagcttctactgctgcaattcctactgcgaatacaaatggaaaccatgcattaagtacggactcacattctagccaagatgctaggcggcgaacagctggtattacaagaagaaaagccttgcctccgattcttgcaaaaattcctagcaatgatctgagtcatactatccgcggagaatcagttcttgacaagtcaaaacattcttctgaagcaagaaaagatgcggttgcttcagcagctgctgtacgccaaaagaaaagccctactaaacaagaaaaagctaagtgggtaactgccttaagtgtgctcgtgaagctgtgtcttcttatttcagctactgcttggatggggcaggtgttctggagatggcaaagtggtgaattatcattaacactggatatggagagcaggctatccaaggtggaaggatttaagaagactgccaagatgcttcagctacagttggatgttttggataagaagctaggaaatgagattgacaaagcaaaaagggatatcactaagcaatttgaggataagggtagcaagatagaaaaaaaaatgaagactttggaagacaaaactgacaagttggataaatcactggctgagcttagtgacatgggattcctttccaaaaatgagtttgaggagattttgagccagttgaagaaaaagaagggattcggtggtacagacgatgaaataagcttggatgatataaggctatatgccaaagaggtagttgagatggagatagcaaggcattccgcagatggccttggtatggtggattatgcattgggatcagggggtgctaaagtggtaagtcactcagagcctttcatgaatggcaagaactatttacctggtcgcagcattgtgcacacaacagctcaaaagatgctggagccaagttttgggcagccaggagagtgttttgcactgaaaggaagtagtgggtttgtgaaggtgaagctaagaacaggaataattcctgaggcggtcactctagaacatgttgacaagagtgtggcctatgatagatcaagtgctccaaaggatttccaggtccgtggatggtaccaaggatcacatgatgattcagaaaagcattcaaatgtgatggctgctttaggagagttctcttatgaccttgacaaaagcaatgctcagaccttccaactagagagaaccgctgattcacgggttgtcaacatggttcagcttgacttctcctcaaaccatgggaacttggaacttacatgcatctatcgcttcagggtgcatggcagagagcctggctcactcaacactggagcctga

SEQ ID NO: 350 - protein, 443 aa, Sorghum bicolor
  misc_feature: Ceres ANNOT ID no. 6007386
  misc_feature (295)..(435): Pfam Id: Sad1_UNC Pfam Desc: Sad1 / UNC-like C-terminal
  misc_feature (72)..(436): NCBI GI: 50953786 NCBI Desc: sun2 [mus musculus]
  misc_feature (129)..(436): NCBI GI: 50510577 NCBI Desc: mkiaa0668 protein [mus musculus]
  misc_feature (250)..(436): NCBI GI: 39644968 NCBI Desc: unc84b protein [homo sapiens]
  misc_feature (202)..(436): NCBI GI: 6538749 NCBI Desc: sad1 unc-84 domain protein 2 [homo sapiens]
  misc_feature (202)..(436): NCBI GI: 46812698 NCBI Desc: unc84b protein [homo sapiens]
MSASTAAIPTANTNGNHALSTDSHSSQDARRRTAGITRRKALPPILAKIPSNDLSHTIRGESVLDKSKHSSEARKDAVASAAAVRQKKSPTKQEKAKWVTALSVLVKLCLLISATAWMGQVFWRWQSGELSLTLDMESRLSKVEGFKKTAKMLQLQLDVLDKKLGNEIDKAKRDITKQFEDKGSKIEKKMKTLEDKTDKLDKSLAELSDMGFLSKNEFEEILSQLKKKKGFGGTDDEISLDDIRLYAKEVVEMEIARHSADGLGMVDYALGSGGAKVVSHSEPFMNGKNYLPGRSIVHTTAQKMLEPSFGQPGECFALKGSSGFVKVKLRTGIIPEAVTLEHVDKSVAYDRSSAPKDFQVRGWYQGSHDDSEKHSNVMAALGEFSYDLDKSNAQTFQLERTADSRVVNMVQLDFSSNHGNLELTCIYRFRVHGREPGSLNTGA

SEQ ID NO: 351 - DNA, 1866 bp, Sorghum bicolor
  misc_feature: Ceres ANNOT ID no. 6007410
  misc_feature: Encodes the peptide sequence at SEQ ID NO 352
atggcgtacggcgaccgcgtcaccaccttcgaggactccgagaaggagagcgagtacggctatgtccgcaaggtctctggacctgtggtcgtggctgatggaatgggtggtgctgccatgtatgaacttgttcgtgtcggacatgataacctcattggggaaattatccgtcttgagggcgattcagctacaatccaagtttatgaggaaacagctggactgatggttaatgatcctgttttgagaacaagaaaacctctttcagttgaattaggacctggaattcttggaaacatctttgatggtatccagcgccctctaaaaaccattgctattaagtcaggagatgtgtatattcctcgtggtgtttcagttcctgcccttgacaaagatgtactgtgggaatttcagccaaagaagctaggtgttggagatgtcatcacgggtggagatctatacgctactgtttttgagaacacattgatgcagcaccacgttgctcttccgccaggttctatggggaaagtaagttacatcgcaccagctggtcagtacagcctgcaggacacagtgctagaattggaatttcagggcataaaaaagaaatttaccatgcttcagacatggcctgtgcgttcaccaaggcctgttgcgtcaaagcttgctgcagatacacctcttctaacagggcagcgtgtactggatgcgctattcccctcagttcttggaggcacttgtgctattccaggagcgtttggttgtggtaaaactgtcatcagtcaggcactttccaagtactccaattccgaagctgtggtttatgttgggtgtggtgaaagaggaaatgagatggctgaggttctcatggacttcccccagttgacgatgacattgcctgatggccgtgaggagtcagtcatgaagagaacaacactggtggctaacacatcaaacatgcctgtcgctgctcgtgaagcctccatttatacaggaattacaattgctgagtatttccgtgatatgggctacaacgtcagtatgatggctgactccacatcccgatgggctgaggcattgcgtgagatctcagggcgtttggctgaaatgcctgctgatagtggttacccagcttatttggctgcacgtttggcatccttttatgaacgtgctggtaaggtaaaatgcctgggaagtccagacaggactggcagtgtcacaattgttggagccgtctctcctcctggtggtgatttttcagaccctgttacctcagcaaccctcagtattgttcaggtcttctggggtttagataaaaagcttgctcaaaggaagcatttcccatctgtgaattggctcatttcctattcaaaatactccaaggcccttgagtccttctatgagaagtttgatccagatttcattgatattaggacaaaagcacgtgaggtgttgcagagggaggacgatctaaatgaaattgtgcagcttgttggtaaagatgcgctggcagaatctgacaagattacgctggagacagcaaagcttctgagagaagattatttggcacaaaatgcatttaccccatacgataagttctgtccattctacaaatctgtttggatgatgcgcaacattattcacttcaacacattggcaaatcaggctgtggagcgggcagctggtactgacggacaaaagataacatacagtgtcataaagcatcgcttgggtgatctattttatcggctagtatctcaaaagtttgaggatcctgccgaaggcgaagaagctttggttgccaaatttaagaaactgtatgatgaccttaccaatgggttccgcaatctagaagatgaggcacggtga

SEQ ID NO: 352 - protein, 621 aa, Sorghum bicolor
  misc_feature: Ceres ANNOT ID no. 6007410
  misc_feature (229)..(456): Pfam Id: ATP-synt_ab Pfam Desc: ATP synthase alpha/beta family, nucleotide-binding domain
  misc_feature (474)..(618): Pfam Id: ATP-synt_ab_C Pfam Desc: ATP synthase alpha/beta chain, C terminal domain
  misc_feature (22)..(84): Pfam Id: ATP-synt_ab_N Pfam Desc: ATP synthase alpha/beta family, beta-barrel domain
  misc_feature (3)..(621): NCBI GI: 137460 NCBI Desc: vacuolar atp synthase catalytic subunit a (v-atpase a subunit) (vacuolar proton pump alpha subunit) (v-atpase 69 kda subunit)
  misc_feature (3)..(621): NCBI GI: 401322 NCBI Desc: vacuolar atp synthase catalytic subunit a (v-atpase a subunit) (vacuolar proton pump alpha subunit) (v-atpase 69 kda subunit)
  misc_feature (3)..(621): NCBI GI: 3169287 NCBI Desc: vacuolar h+-atpase catalytic subunit [gossypium hirsutum]
  misc_feature (1)..(621): NCBI GI: 11527563 NCBI Desc: vacuolar proton-atpase [hordeum vulgare subsp. vulgare]
  misc_feature (1)..(621): NCBI GI: 90025017 NCBI Desc: vacuolar proton-atpase subunit a [triticum aestivum]
  misc_feature (3)..(621): SWISSPROT Homolog: EC 3.6.3.14 Vacuolar ATP synthase catalytic subunit A
  misc_feature (18)..(560): SWISSPROT Homolog: EC 3.6.3.15 V-type sodium ATP synthase subunit A
MAYGDRVTTFEDSEKESEYGYVRKVSGPVVVADGMGGAAMYELVRVGHDNLIGEIIRLEGDSATIQVYEETAGLMVNDPVLRTRKPLSVELGPGILGNIFDGIQRPLKTIAIKSGDVYIPRGVSVPALDKDVLWEFQPKKLGVGDVITGGDLYATVFENTLMQHHVALPPGSMGKVSYIAPAGQYSLQDTVLELEFQGIKKKFTMLQTWPVRSPRPVASKLAADTPLLTGQRVLDALFPSVLGGTCAIPGAFGCGKTVISQALSKYSNSEAVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGSPDRTGSVTIVGAVSPPGGDFSDPVTSATLSIVQVFWGLDKKLAQRKHFPSVNWLISYSKYSKALESFYEKFDPDFIDIRTKAREVLQREDDLNEIVQLVGKDALAESDKITLETAKLLREDYLAQNAFTPYDKFCPFYKSVWMMRNIIHFNTLANQAVERAAGTDGQKITYSVIKHRLGDLFYRLVSQKFEDPAEGEEALVAKFKKLYDDLTNGFRNLEDEAR

SEQ ID NO: 353 - DNA, 963 bp, Sorghum bicolor
  misc_feature: Ceres ANNOT ID no. 6007413
  misc_feature: Encodes the peptide sequence at SEQ ID NO 354
atgaagaagtgcccatcggagctggagctggaggccttcctccgcggccgggaggacgccacggcggcggcggcggcggcggtggccgagcagaagcctgtgcacgacgtcgctgcgctggcgccgttcggcgcaggtggcgtgttcccccccagcgatctgtccgccttcagcttcgctgactcgaacaccctcaatggaagcattcataatcacctatggtcccataaccacaacgtgaggcatcctgcagtctccacgacaatcgagtcgcaatcgtcaatctgtgcagcagcaagtccaacatcagctaccaacctatatctgaaagagagccaaactttgggtggcacaagtggttcagactccgatagtgaatcgctgttggatatcgagggtggtccatgcgaacaaagcacaaacccacaggacgtgaagagaatgcgacggatggtgtcgaaccgtgagtctgctcgacggtcgaggaagaggaagcaagcccacctagctgatcttgagacacaggttgaccagctgcgaggcgagaatgcatcgctctttaagcagctgacagacgccaaccagcaattcacaaccgcagtcacggacaacaggatcttgaaatcagatgtggaggccctcagagtcaaggtgaagctggcggaggacatggtggcccgtggcgcgctgtcgtgcgggctgggcagcctggggctgtcgccggtgctgaacccgcggcaggcgtgccgtggccccgacgtgctgtccggcctggacttccccggcgacgacgcgtgcttcacggggctgtccgcgacggagcagctccagaactcgccgctgcagagcatcgccagcctcgagagcctggagaaccggatggctagcgaggtgacgagctgcggcggccccggcgtcgacgtctggccgtgggatcactccaacggcgggctttccaagtga

SEQ ID NO: 354 - protein, 320 aa, Sorghum bicolor
  misc_feature: Ceres ANNOT ID no. 6007413
  misc_feature (142)..(202): Pfam Id: bZIP_1 Pfam Desc: bZIP transcription factor
  misc_feature (142)..(196): Pfam Id: bZIP_2 Pfam Desc: Basic region leucine zipper
  misc_feature (1)..(277): NCBI GI: 556409 NCBI Desc: transcriptional activator protein
  misc_feature (1)..(277): NCBI GI: 115444547 NCBI Desc: os02g0175100 [oryza sativa (japonica cultivar-group)]
  misc_feature (47)..(277): NCBI GI: 13365772 NCBI Desc: risbz4 [oryza sativa]
  misc_feature (47)..(277): NCBI GI: 50251200 NCBI Desc: risbz4 [oryza sativa (japonica cultivar-group)]
  misc_feature (102)..(277): NCBI GI: 3287219 NCBI Desc: rita-2 protein [oryza sativa (japonica cultivar-group)]
  misc_feature: The sequence is a functional homolog of SEQ ID NO 1112 in the 11/479,226US patent application
  misc_feature: The sequence is a functional homolog of SEQ ID NO 1762 in the 10/374,780US patent application
  misc_feature: The sequence is a functional homolog of SEQ ID NO 910 in the 10/374,780US patent application
  misc_feature: The sequence is a functional homolog of SEQ ID NO 911 in the 10/374,780US patent application
  misc_feature: Useful for making plants with modulated growth and phenotype characteristics
  misc_feature: The sequence is a functional homolog of SEQ ID NO 1762 in the 20060162006 US patent application
  misc_feature: The sequence is a functional homolog of SEQ ID NO 910 in the 20060162006 US patent application
  misc_feature: The sequence is a functional homolog of SEQ ID NO 911 in the 20060162006 US patent application
  misc_feature: The sequence is a functional homolog of SEQ ID NO 1112 in the 20070022495 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MKKCPSELELEAFLRGREDATAAAAAAVAEQKPVHDVAALAPFGAGGVFPPSDLSAFSFADSNTLNGSIHNHLWSHNHNVRHPAVSTTIESQSSICAAASPTSATNLYLKESQTLGGTSGSDSDSESLLDIEGGPCEQSTNPQDVKRMRRMVSNRESARRSRKRKQAHLADLETQVDQLRGENASLFKQLTDANQQFTTAVTDNRILKSDVEALRVKVKLAEDMVARGALSCGLGSLGLSPVLNPRQACRGPDVLSGLDFPGDDACFTGLSATEQLQNSPLQSIASLESLENRMASEVTSCGGPGVDVWPWDHSNGGLSK

SEQ ID NO: 355 - DNA, 1521 bp, Sorghum bicolor
  misc_feature: Ceres ANNOT ID no. 6007414
  misc_feature: Encodes the peptide sequence at SEQ ID NO 356
atggttcatagtcctgtagcattcctaagaaagctccaaacttcctcttcatctttagccaccgagttgatttcttttagcaaatatgcacaaaagtccatgaaatactcttggcagttcatctgtcaaaataatccactcttcatccaagtcacttattttaccttgatttcatttgctggatatgcagctcttaagatcatcaagccacgagatgaacaagatactctgaaagacatagacttattgtttacttctgtatctgcatcaactgtctcaagcatggctactgttgaaatggaggatttctcaagcgctcagctctgcatattgactattttaatgctgattggtggagaggtattcacttcaatgcttgatctttatttcatgcgggctacatctattacaaaagggtcttccaacagaaagggctactcagtttatgttgataacgaatctattacttctgcaatgtctgttcccaacaatacccaggacaccattgtaacaatgccactgtctgaactccacttggaagaaaaaaaacaagttgaacccaagataattgaatctttaggtcatgcactgctggtctatcttctagtgtcaaatttaggcagctccctggttatctacctttacctaatatctgtaccagatgcacaaggagttctgaagagaaagggtattggatttgtcattttctctgtatttacagccgtctcctcagtggcaaattgtggcttcactccagtaaacgagaacatgatcatctttcagaagagatccattctcctattgctaattattcctcagatactagccggaaatacattatttgccccatgcttgagattcctggtgtggtcacttaagaaggtaactggacaagaagattatcgtttcattcttcagcacccagagaccattgggtataagcatcttatgagtagcaaggagtgtgtttatttgatgtcaactgttttcagcttcataattacacaaaccatactattttgctctctagaatggagctcagaggctttacgggcaatgaacagctatgagaagataattggtgctctcttccagtctactaatgcaaggcatgctggcgaatacatagttgacctgtcaagcctttcttccgcaatcctagttttgtacactgtgatgatgtatctccctggtgagacttcacttttacccagagatggtgagcagcactctagagctgaaataaaacacaaaaggaaaagactattagagaactggatcttctcccagctgtcttatttagctatctttgtaatgctaatttgcattactgagagggaagcattgatcacagatccgctcaatttcaatgtattcaacatattgtttgaagttgtcagttgcaagaggctactgaatcatgatgtctactgcaaggatgcttcgtatggatttgttggaaatggagtgaggcttaaagcgttcaatatgaaaggaggaagagcttggaggcttagatag

SEQ ID NO: 356 - protein, 506 aa, Sorghum bicolor
  misc_feature: Ceres ANNOT ID no. 6007414
  misc_feature (181)..(506): Pfam Id: TrkH Pfam Desc: Cation transport protein
  misc_feature (1)..(501): NCBI GI: 75123002 NCBI Desc: probable cation transporter hkt6 (oshkt6)
  misc_feature (8)..(487): NCBI GI: 116309741 NCBI Desc: osigba0113i13.11 [oryza sativa (indica cultivar-group)]
  misc_feature (5)..(487): NCBI GI: 84029308 NCBI Desc: cation transporter hkt4 (oshkt4)
  misc_feature (38)..(487): NCBI GI: 29424041 NCBI Desc: high affinity potassium transporter 2 [mesembryanthemum crystallinum]
  misc_feature (40)..(467): NCBI GI: 110083907 NCBI Desc: hkt1 [suaeda salsa]
MVHSPVAFLRKLQTSSSSLATELISFSKYAQKSMKYSWQFICQNNPLFIQVTYFTLISFAGYAALKIIKPRDEQDTLKDIDLLFTSVSASTVSSMATVEMEDFSSAQLCILTILMLIGGEVFTSMLDLYFMRATSITKGSSNRKGYSVYVDNESITSAMSVPNNTQDTIVTMPLSELHLEEKKQVEPKIIESLGHALLVYLLVSNLGSSLVIYLYLISVPDAQGVLKRKGIGFVIFSVFTAVSSVANCGFTPVNENMIIFQKRSILLLLIIPQILAGNTLFAPCLRFLVWSLKKVTGQEDYRFILQHPETIGYKHLMSSKECVYLMSTVFSFIITQTILFCSLEWSSEALRAMNSYEKIIGALFQSTNARHAGEYIVDLSSLSSAILVLYTVMMYLPGETSLLPRDGEQHSRAEIKHKRKRLLENWIFSQLSYLAIFVMLICITEREALITDPLNFNVFNILFEVVSCKRLLNHDVYCKDASYGFVGNGVRLKAFNMKGGRAWRLR

SEQ ID NO: 357 - DNA, 594 bp, Sorghum bicolor
  misc_feature: Ceres ANNOT ID no. 6007420
  misc_feature: Encodes the peptide sequence at SEQ ID NO 358
atggaggagcagttcatcctccgcttgccgccatccgtggcggagcggatcgagcgcctcatgaatgaatccgccgctgcctcctccaaccccgacgaggcctccctggacctctccttctcagaggatggaagaaatggtacatttatgatcggtaatgagagctttcctgcatctctcttggatctacctgctgtggtggagtcgtacaaaacatatgatgattctgtactaattaaaactgctgatattggtcagatgattatggtaagggaagaaaatgatcctcctccagaaggagttgaatacaagcatgggcttactcctccaatgagggatgcacgcaggcgacgtttccgcagagaaccagacttgaatgcagagctggttaaccaagttgagaagcatcttatcaatatcatgcatggagtatctgtcaatcagaacgccagtgtgataggaggtgaagaaggtggtgatcgtaagaaacctccagtagctcgtgcagccaagcagcctggtgttcaagagcccgccgcaaacggaggggaagcagaacctgagaggagcgacactgatgagtcagagaactga

SEQ ID NO: 358 - protein, 197 aa, Sorghum bicolor
  misc_feature: Ceres ANNOT ID no. 6007420
  misc_feature (1)..(152): Pfam Id: TAFII55_N Pfam Desc: TAFII55 protein conserved region
  misc_feature (3)..(197): NCBI GI: 140059085 NCBI Desc: tafii55 protein conserved region [medicago truncatula]
  misc_feature (1)..(151): NCBI GI: 79319993 NCBI Desc: transcription factor [arabidopsis thaliana]
  misc_feature (31)..(126): NCBI GI: 55296876 NCBI Desc: tata-binding protein-associated factor tafii55-like [oryza sativa (japonica cultivar-group)]
  misc_feature (1)..(99): NCBI GI: 17921978 NCBI Desc: taf7-like rna polymerase ii, tata box binding protein (tbp)-associated factor [mus musculus]
  misc_feature (1)..(99): NCBI GI: 123122983 NCBI Desc: taf7-like rna polymerase ii, tata box binding protein (tbp)-associated factor [mus musculus]
MEEQFILRLPPSVAERIERLMNESAAASSNPDEASLDLSFSEDGRNGTFMIGNESFPASLLDLPAVVESYKTYDDSVLIKTADIGQMIMVREENDPPPEGVEYKHGLTPPMRDARRRRFRREPDLNAELVNQVEKHLINIMHGVSVNQNASVIGGEEGGDRKKPPVARAAKQPGVQEPAANGGEAEPERSDTDESEN

SEQ ID NO: 359 - DNA, 843 bp, Sorghum bicolor
  misc_feature: Ceres ANNOT ID no. 6007421
  misc_feature: Encodes the peptide sequence at SEQ ID NO 360
atgttggagctgcggctggtgcaggcggcctccctcaagaatgtcctggaggcgctcagcgtcctcgacctgtccagtgaggtcaacttcgaattctccggcacgggctttgagctccaggccatggacaccagcggcgccgcgctcgtcgcgctcctcctccgtgccgatgccttcaatcactacctctgcgaccgcgacctctccatgggcctgaacctcgccgacatggccaatgttttccgctgcgccaacaacgacgacatcctcaccatcaaggtggatggctgccccgacaccgttatgttcgtgttcgagtcgcccaaggttggtgagatttcgtattttgatttgcatttcgtggacatcaaccgcatgccctgcgaaatcccggaaatcccggaatccgagtaccaggccatagtccgcatgccctctgccaagtttatgcgtatctgcaagaagctcagcagcgtcggggacagagaggacagggacactgttgccagtatctcagtggataaggagcgtgtcgacttcttcacttcgggaaaagctgggacctcaacaattttttgcactgttggcaagccaaaagaacctacccttatagaagaacctacccttatagagatgaaagaaaaggtttccctgagctttgacctaaggtacgtgaactccttctccaagatgtgtacccagtctgatcaacaagtgactatcagtctttcacccgagctacccgtgctgttcgagtacaagatcacagagatgggccgcatcagatattacgtggcgccaaggatcaaattgcagaatgaggtagatgggatgcagaactaa

SEQ ID NO: 360 - protein, 280 aa, Sorghum bicolor
  misc_feature: Ceres ANNOT ID no. 6007421
  misc_feature (1)..(125): Pfam Id: PCNA_N Pfam Desc: Proliferating cell nuclear antigen, N-terminal domain
  misc_feature (132)..(268): Pfam Id: PCNA_C Pfam Desc: Proliferating cell nuclear antigen, C-terminal domain
  misc_feature (1)..(275): NCBI GI: 732990 NCBI Desc: proliferative cell nuclear antigen [zea mays]
  misc_feature (1)..(275): NCBI GI: 4099508 NCBI Desc: proliferating cell nuclear antigen [zea mays]
  misc_feature (1)..(275): NCBI GI: 129697 NCBI Desc: proliferating cell nuclear antigen (pcna) (cyclin)
  misc_feature (1)..(274): NCBI GI: 3366661 NCBI Desc: proliferating cell nuclear antigen [nicotiana tabacum]
  misc_feature (1)..(274): NCBI GI: 25005275 NCBI Desc: proliferating cell nuclear antigen [lycopersicon esculentum]
MLELRLVQAASLKNVLEALSVLDLSSEVNFEFSGTGFELQAMDTSGAALVALLLRADAFNHYLCDRDLSMGLNLADMANVFRCANNDDILTIKVDGCPDTVMFVFESPKVGEISYFDLHFVDINRMPCEIPEIPESEYQAIVRMPSAKFMRICKKLSSVGDREDRDTVASISVDKERVDFFTSGKAGTSTIFCTVGKPKEPTLIEEPTLIEMKEKVSLSFDLRYVNSFSKMCTQSDQQVTISLSPELPVLFEYKITEMGRIRYYVAPRIKLQNEVDGMQN

SEQ ID NO: 361 - DNA, 1110 bp, Sorghum bicolor
  misc_feature: Ceres ANNOT ID no. 6007431
  misc_feature: Encodes the peptide sequence at SEQ ID NO 362
atgttcccttccaagaaggccactagtagcgccgctgccgctgccgctgccgccgtgagctcaaatgataggcaggcgatgtgcgtgcagcagggcgactcggggtcgggcctcgtcctcaccaccgaccccaagccccgcctccgctggaccgtcgagctccatgagcgcttcgtcgacgccgtcacgcagctcggtggccccgacaaggcgactccaaagaccatcatgagggtcatgggagtgaaggggcttaccctttaccacctcaagagccatcttcagaaattcaggttagggaagcagccgcacaaggagttcaacgagcactcagttaaggatgctgccgcagcaatggagatgcaacgaaacgctgcctcttcttcaggcatgatgggaagaagcatgaacgaccgcagtgtgcacatgaatgaggctatcaggatgcaaatggaagtccagagaaggctacatgagcaactagaggtgcaaaggcacctccagatgaggatcgaagcccaggggaagtacatgcagtccatcctggagaaagcctaccagaccatcgccgccggcgacgtcgctgcgtgcccggcggcagggtacaaatccctactaggtaaccaccaccaggcgatgctggacgtctgctccctcaaggacatgggcccgtccatgggcttcccttcgctgcaagacctgcacatgtacggcggaggcggccacctggacctgcagcagcagatggagcggccgatggaggccttcttcgccagctgcgacattgggtcgctggccaagaaaaggcccatcagcccttacgccgacggcaagagcccgatgatgtggtgcgacgacgaggacggcaagggcatcgtcgaccagctccagatggcgccgtcgatgatggacgccgccggcatcgacgtcatggactccatcgccgacgtgtatggcgacgccaagcccatgatgtccggcgactccacggggagcaagggcggctttgacgtcaagctcgagaggccgtcaccgcggcggccgcacatgggcggcagcccgtcggtgatcggcggaggccagcagacaaggaacctgtcctacgggtaa

SEQ ID NO: 362 - protein, 369 aa, Sorghum bicolor
  misc_feature: Ceres ANNOT ID no. 6007431
  misc_feature (47)..(98): Pfam Id: Myb_DNA-binding Pfam Desc: Myb-like DNA-binding domain
  misc_feature (1)..(369): NCBI GI: 115444531 NCBI Desc: os02g0174000 [oryza sativa (japonica cultivar-group)]
  misc_feature (27)..(369): NCBI GI: 49388972 NCBI Desc: myb family transcription factor-like [oryza sativa (japonica cultivar-group)]
  misc_feature (15)..(369): NCBI GI: 115469404 NCBI Desc: os06g0664800 [oryza sativa (japonica cultivar-group)]
  misc_feature (21)..(369): NCBI GI: 4835766 NCBI Desc: contains similarity to gbab017693 transfactor (werbp-1) from nicotiana tabacum. ests gbh39299, gbt41875, gbh38232 and gbn38325 come from this gene. [arabidopsis thaliana]
  misc_feature (21)..(369): NCBI GI: 30699418 NCBI Desc: myb family transcription factor-related [arabidopsis thaliana]
  misc_feature: The sequence is a functional homolog of SEQ ID NO 10 in the 10/225,066US patent application
  misc_feature: The sequence is a functional homolog of SEQ ID NO 1016 in the 10/225,066US patent application
  misc_feature: The sequence is a functional homolog of SEQ ID NO 106 in the 10/225,066US patent application
  misc_feature: The sequence is a functional homolog of SEQ ID NO 1062 in the 10/225,066US patent application
  misc_feature: The sequence is a functional homolog of SEQ ID NO 1097 in the 11/479,226US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 136 in the 11/375,241US patent application
  misc_feature: The sequence is a functional homolog of SEQ ID NO 1589 in the 11/479,226US patent application
  misc_feature: The sequence is a functional homolog of SEQ ID NO 1857 in the 10/374,780US patent application
  misc_feature: The sequence is a functional homolog of SEQ ID NO 1873 in the 11/479,226US patent application
  misc_feature: The sequence is a functional homolog of SEQ ID NO 1990 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 2240 in the 10/374,780US patent application
  misc_feature: The sequence is a functional homolog of SEQ ID NO 2340 in the 10/374,780US patent application
  misc_feature: The sequence is a functional homolog of SEQ ID NO 2402 in the 10/374,780US patent application
  misc_feature: The sequence is a functional homolog of SEQ ID NO 2788 in the 10/374,780US patent application
  misc_feature: The sequence is a functional homolog of SEQ ID NO 304 in the 10/374,780US patent application
  misc_feature: The sequence is a functional homolog of SEQ ID NO 548 in the 10/225,066US patent application
  misc_feature: The sequence is a functional homolog of SEQ ID NO 580 in the 11/435,388US patent application
  misc_feature: The sequence is a functional homolog of SEQ ID NO 620 in the 11/479,226US patent application
  misc_feature: The sequence is a functional homolog of SEQ ID NO 718 in the 10/225,066US patent application
  misc_feature: The sequence is a functional homolog of SEQ ID NO 76 in the 10/412,699US patent application
  misc_feature: The sequence is a functional homolog of SEQ ID NO 762 in the 10/412,699US patent application
  misc_feature: The sequence is a functional homolog of SEQ ID NO 838 in the 10/225,066US patent application
  misc_feature: The sequence is a functional homolog of SEQ ID NO 933 in the 10/666,642US patent application
  misc_feature: Useful for making plants with altered alkaloid content
  misc_feature: Useful for making plants with altered terpenoid content
  misc_feature: Useful for making plants with modulated growth and phenotype characteristics
  misc_feature: Functional homolog of the protein sequence given in SEQ ID NO 13070
  misc_feature: The sequence is a functional homolog of SEQ ID NO 76 in the 20040045049 US patent application
  misc_feature: The sequence is a functional homolog of SEQ ID NO 762 in the 20040045049 US patent application
  misc_feature: The sequence is a functional homolog of SEQ ID NO 10 in the 20050160493 US patent application
  misc_feature: The sequence is a functional homolog of SEQ ID NO 106 in the 20050160493 US patent application
  misc_feature: The sequence is a functional homolog of SEQ ID NO 1062 in the 20050160493 US patent application
  misc_feature: The sequence is a functional homolog of SEQ ID NO 548 in the 20050160493 US patent application
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1990 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 933 in the 20070033671 US patent application
  misc_feature: Useful for making plants with altered alkaloid content
  misc_feature: Useful for making plants with altered lignin content
  misc_feature: Functional homolog of the protein sequence given in SEQ ID NO 13089
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MFPSKKATSSAAAAAAAAVSSNDRQAMCVQQGDSGSGLVLTTDPKPRLRWTVELHERFVDAVTQLGGPDKATPKTIMRVMGVKGLTLYHLKSHLQKFRLGKQPHKEFNEHSVKDAAAAMEMQRNAASSSGMMGRSMNDRSVHMNEAIRMQMEVQRRLHEQLEVQRHLQMRIEAQGKYMQSILEKAYQTIAAGDVAACPAAGYKSLLGNHHQAMLDVCSLKDMGPSMGFPSLQDLHMYGGGGHLDLQQQMERPMEAFFASCDIGSLAKKRPISPYADGKSPMMWCDDEDGKGIVDQLQMAPSMMDAAGIDVMDSIADVYGDAKPMMSGDSTGSKGGFDVKLERPSPRRPHMGGSPSVIGGGQQTRNLSYG

SEQ ID NO: 363 - DNA, 1383 bp, Sorghum bicolor
  misc_feature: Ceres ANNOT ID no. 6007434
  misc_feature: Encodes the peptide sequence at SEQ ID NO 364
atgctgcgccttcgcgcttgcggcggcacggcgccggcgtcggtgcccgcgctcgtcagggcccgcctcgccaggcgagcctcctccgcagcctccgccgctgccaccgtcgcctccgcttcctcctcttcgtccgccctggaagagctcgccgccgagcgcagaggtttggcaaaggtcattttaaagaaggggaagacccaaatattccgagatggaagcccaatggtgtacagcggtgctgttgataggataattggtcgacctcctccgaaatctggcgatgttgttctggtagctgatgggacagagaaacctattggatggggcctctacaactctgtgtctatgttttgtgttcggttgatgcagctagaagaagatgcaataagagatcccacatgtgcacttaatatggaaagactgcttgaagcaaggatttcatctgctgttgatttgcggcgcagtttgggtctcccttcagctgacacaaatgcttatcgcctcatcaacagtgaaggggaccgattgtctggtctaatagtggacatctttgctgatgttgctgtcattgcttcatctgctgcttgggttgagaaatataggcaagaaatacaatttcttgttagcaaagttaacggcatcagccatataaagtggaggccatcggcagatattttgaaagaagaaggattggatatatcagagcataaggagcctgcttcaccatgctcaactgttaaggtcatggagaatggcattgtctacttagtctcattagagggtcagaagacagggttttatgcagatcaacgggaaaaccgctctttcatatctttactttcaaaggaccaaagggtccttgacctttgctgctacagtggtggctttgctcttaacgcagctaagggtggtgctgataatgtcattggcattgattcatcaggattggcactagaccttgccaatgagaatattgttctcaatgagctaaaccatggaaaaatctcatttgtaaaaggagatgcaactacattcatgaaaggagctatctcagaaaatgagctgtgggatttggtaatccttgaccctccaaagttggcgccgcgaaagaaggtgctacaaagtgcatccggtatgtatagaagcttgaacgcgcttgcaatgcaagtggtgaagccaggggggttactcatgacatgctcttgttctggagctatgacccaaagtggcatgttcctgaaaaccattcagggtgctgcatcaatggctggccgtaaggttacggtcttacgtcaagctggggcagcctgtgatcaccccatcgaccctgcataccctgagggccagtatctcagcaattacttgctgcgcgtggcatga

SEQ ID NO: 364 - protein, 460 aa, Sorghum bicolor
  misc_feature: Ceres ANNOT ID no. 6007434
  misc_feature (117)..(459): NCBI GI: 49388970 NCBI Desc: sam-dependent methyltransferase-like [oryza sativa (japonica cultivar-group)]
  misc_feature (58)..(457): NCBI GI: 52841423 NCBI Desc: sam-dependent methyltransferase [legionella pneumophila subsp. pneumophila str. philadelphia 1]
  misc_feature (3)..(459): NCBI GI: 118720520 NCBI Desc: pua domain containing protein [burkholderia multivorans atcc 17616]
  misc_feature (60)..(459): NCBI GI: 83748652 NCBI Desc: methyltransferase [ralstonia solanacearum uw551]
  misc_feature (60)..(460): NCBI GI: 118028324 NCBI Desc: pua [burkholderia phymatum stm815]
MLRLRACGGTAPASVPALVRARLARRASSAASAAATVASASSSSSALEELAAERRGLAKVILKKGKTQIFRDGSPMVYSGAVDRIIGRPPPKSGDVVLVADGTEKPIGWGLYNSVSMFCVRLMQLEEDAIRDPTCALNMERLLEARISSAVDLRRSLGLPSADTNAYRLINSEGDRLSGLIVDIFADVAVIASSAAWVEKYRQEIQFLVSKVNGISHIKWRPSADILKEEGLDISEHKEPASPCSTVKVMENGIVYLVSLEGQKTGFYADQRENRSFISLLSKDQRVLDLCCYSGGFALNAAKGGADNVIGIDSSGLALDLANENIVLNELNHGKISFVKGDATTFMKGAISENELWDLVILDPPKLAPRKKVLQSASGMYRSLNALAMQVVKPGGLLMTCSCSGAMTQSGMFLKTIQGAASMAGRKVTVLRQAGAACDHPIDPAYPEGQYLSNYLLRVA

SEQ ID NO: 365 - DNA, 801 bp, Sorghum bicolor
  misc_feature: Ceres ANNOT ID no. 6007435
  misc_feature: Encodes the peptide sequence at SEQ ID NO 366
atgtcgtcgctgctgtcgaggctgcggctggtgaccgtggacgtgacgggcaccctgatcgcctacaggggccagctgggcgactactactgcatggcggccaagtccgccgggatgccgtgcccggactacgcgcgcgtgcacgagggcttcaagctcgcctacgccgacatgagcaggagacacccctgcttcggccacgccgccgccatgcccaccgccgactggtggtggaagacgtgcgtcagggactccttcgtcagggccggctacgactacgacgacgagacgttcgagaggatattccggcggatctactccacgttcggctccgccgcgccgtacgcggtgttcccggacgcgcagcgcttcctcaggtggctccggaaggagggcctcgtcgtcggcatcgtcagcaacgccgagcaccggtacagggacgtcgtcctgccggcgctggggctcaaccaggggtcggagtgggacttcggggtgttctcgggcgtcgtcggcgtggagaagcccgacccgaggatctacgaggcggcgctggagcaggcggctgccgtgaccgggggcgtggcgcccggggaggcgctccacatcggcgacagcctgcgcaaggactacgcccccgcgcggagcctagggatgcacgcgctgctgctggaccggttccggaccgccgaggcggagcgctggcggaggtccggcgtgcccgtgctcccggacctcgtcgccgcgcaggagtggctcgcctcgccggggggagccgcggatcagcctgtcacggccaggtga

SEQ ID NO: 366 - protein, 266 aa, Sorghum bicolor
  misc_feature: Ceres ANNOT ID no. 6007435
  misc_feature (8)..(226): Pfam Id: Hydrolase Pfam Desc: haloacid dehalogenase-like hydrolase
  misc_feature (3)..(254): NCBI GI: 106879171 NCBI Desc: at5g44730 [arabidopsis thaliana]
  misc_feature (3)..(88): NCBI GI: 115444523 NCBI Desc: os02g0173600 [oryza sativa (japonica cultivar-group)]
  misc_feature (7)..(225): NCBI GI: 86605887 NCBI Desc: haloacid dehalogenase, ia family protein [cyanobacteria bacterium yellowstone a-prime]
  misc_feature (7)..(225): NCBI GI: 86609760 NCBI Desc: haloacid dehalogenase, ia family protein [cyanobacteria bacterium yellowstone b-prime]
  misc_feature (7)..(223): NCBI GI: 119607781 NCBI Desc: haloacid dehalogenase-like hydrolase domain containing 3, isoform cra_a [homo sapiens]
MSSLLSRLRLVTVDVTGTLIAYRGQLGDYYCMAAKSAGMPCPDYARVHEGFKLAYADMSRRHPCFGHAAAMPTADWWWKTCVRDSFVRAGYDYDDETFERIFRRIYSTFGSAAPYAVFPDAQRFLRWLRKEGLVVGIVSNAEHRYRDVVLPALGLNQGSEWDFGVFSGVVGVEKPDPRIYEAALEQAAAVTGGVAPGEALHIGDSLRKDYAPARSLGMHALLLDRFRTAEAERWRRSGVPVLPDLVAAQEWLASPGGAADQPVTAR

SEQ ID NO: 367 - DNA, 900 bp, Sorghum bicolor
  misc_feature: Ceres ANNOT ID no. 6007441
  misc_feature: Encodes the peptide sequence at SEQ ID NO 368
atggcggaggcggcgacgggggcggtgcgggtggagagggtgcgggggaggtcggcgctgacccgctgcttcgccaggtacccgctcaagctcatcgccccgtccaaggtggggccctcctcctgcgacgcggtctggctctacgccctcacctacggcggcggcatcgtctccggggacaccgtatcgtgcacggttagcgtcggcgacgggtgcacggtggcgatcaccacgcaggcctccaccaaggtgtacaaggctgtgggttcaaaatgttctgaacagttgctagaggccagagttggggaagatgccctgcttgctgttattccagaccctgtaacctgcttctcaactgctcggtaccaccaaaagcaagtttttcatgtctctgccaattcaaacttagtagttgtagattggtttacaagtggccgttatgagagtggagaaaaatgggattttagcttctacaaaagtgtgaaccatattttcttgggagatcagcctctctttattgactcgactttgttggaacaaggctcgacttatagcattgttgaacggatgcaggagtacaatgtgattgcgatggttgtgttactggggccaaagctgaggcacatacaagacaagatgcaagacgaagtgaagaagctgatgtctgggcagctgcgcccgcccacatccggcggtagcctctacaccatgagatcacaacttccccagcacccacaaaggcctcaacttgtcgcctcttgcagcccgttcggccgcacgggaacaggcatggttgctcgggtagccgcagtgaacacagagctcgcgtacagcttcttgagacaccgtctagccgagctggagccgttcctaggcgctcccccttatgccgcatcatga

SEQ ID NO: 368 - protein, 299 aa, Sorghum bicolor
  misc_feature: Ceres ANNOT ID no. 6007441
  misc_feature (46)..(266): Pfam Id: UreD Pfam Desc: UreD urease accessory protein
  misc_feature (7)..(296): NCBI GI: 24286395 NCBI Desc: urease accessory protein ured [glycine max]
  misc_feature (84)..(175): NCBI GI: 115444511 NCBI Desc: os02g0173000 [oryza sativa (japonica cultivar-group)]
  misc_feature (4)..(217): NCBI GI: 121536312 NCBI Desc: urease accessory protein ured [anaeromyxobacter sp. fw109-5]
  misc_feature (29)..(241): NCBI GI: 115374521 NCBI Desc: urease accessory protein ured [stigmatella aurantiaca dw4/3-1]
  misc_feature (3)..(291): NCBI GI: 2104425 NCBI Desc: spac3a12.09c [schizosaccharomyces pombe]
MAEAATGAVRVERVRGRSALTRCFARYPLKLIAPSKVGPSSCDAVWLYALTYGGGIVSGDTVSCTVSVGDGCTVAITTQASTKVYKAVGSKCSEQLLEARVGEDALLAVIPDPVTCFSTARYHQKQVFHVSANSNLVVVDWFTSGRYESGEKWDFSFYKSVNHIFLGDQPLFIDSTLLEQGSTYSIVERMQEYNVIAMVVLLGPKLRHIQDKMQDEVKKLMSGQLRPPTSGGSLYTMRSQLPQHPQRPQLVASCSPFGRTGTGMVARVAAVNTELAYSFLRHRLAELEPFLGAPPYAAS

SEQ ID NO: 369 - DNA, 2994 bp, Sorghum bicolor
  misc_feature: Ceres ANNOT ID no. 6007445
  misc_feature: Encodes the peptide sequence at SEQ ID NO 370
atggcccacctccagctcacggcgctcgccggcggcgccgacgacgagatggaggaggtcgcgttgctgggctcctacgacgaggaggccggggtggggccggagggggaggaccaggcggaggccggcatgcggcgggtgcaggtgcgcgtcaccggcatgacgtgctccgcgtgcacgggcgccgtcgaggccgcgctctccgcccgccgaggcgtgcgccgcgccgccgtgtcgctgctccagaaccgcgcccacgtcgtcttcgaccccgcactcgccaaggacgatgacattgtagaagcaatagaagatgctgggttcgaagcggaaattcttcctgactctactgtttctcagccaaaatcacagaagactttgtcaggacaatttaggatagggggaatgacttgtgctgcatgcgtgaactcggttgaggggatcttaaaaaaattgccaggtgtaaaaagagcagttgttgcattagcgacctcattgggtgaagttgaatatgatccttctgccattagcaaagatgaaattgttcaggccatcgaggatgctggttttgatgctgcgctgttgcaaagtagtgagcaagacaaagccttattaactgtcacagggttgcattttgagggagatgtagatgtattgcatgatatactgaagaaaatggaagggttgcgtcagtttggtgtagattttgcgaaatcagaagttgacattgtatttgaccctgaagtagttggtttgagacagattgtagataccatcgagatggaaagcaacaatagactgaaagctcatgtacagaatccatacatacgagctgcttcaaatgatgcacaggaggcaaataagacgcttcaccttcttcgctttagtttattcctaagtattcctgtatttttcatccgcatggtatgccctcacatacctctgattagttcattcctactcatgcactttgggccatttcgtattggagatctgttgaagtggattctggtgaccatggtacagtttgttgttggcaaacgattctatgttgcagcttatagggccctaagacatggctctacaaatatggatgtcttagttgttattggcactactgcttcatatgtctactctgtttgtgcacttctttatggggcattcactggatttcatcctccaatatattttgagacgagtgcaatgataattacatttgtgctatttgggaagtatcttgaggtgcttgcgaaaggaaagacatcagatgctatcaagaagcttgtagagcttgctcctgctacagctcttctacttctgaaggacaaagagggaaaatattcaggagagaaggagattgacgcatcgttagtacaacctggtgatgccttaaaagtgcttcctggttcaaaggttcctgcagacggtatcgtcatttggggtacaagtcatgtcaatgagagtatggtaaccggtgaatctgtaccaatctccaaggaagtatccagtctagtaattggaggcacaatgaacttgcatggtattcttcatatacaagcgactaaagtaggatctgggacagttctgagccagataatttctcttgttgaaactgcccagatgtctaaggcccctattcagaagtttgctgattatgtagctagcattttcgttcctattgtcatcaccctgtccttcttgacatttcttgcatggtttctatgtggatggttgggagcatatccaaactcatggtctgctgaaagtagcaattgctttgttttctccctcatgttctccatatctgttgtggtgattgcttgtccatgtgctcttggtctggcaacaccaactgctgttatggtagcaactggagttggggctagtcatggagtacttgtaaagggcggagatgccctggagagagctcagaatgtgaaatatgttattttcgacaagaccggaacactgacccaaggaaaggctactgtaacaacagcaaagattttttcaggaatggatctgggggactttctcacattggtagcatctgctgaggcaagcagtgagcatccacttgcaaaagctatcttggattatacatttcatttccatttctttggcaaacttacctcagcaaaagacaacattaatagaagaaaagaagagatactttctcagtggcttctggaagttgcggacttttctgccttgcctggcaaagggattcaatgttggatcaatgggaagaaaattttggtagggaatcgtgcattgataactgaaaatggggtaaacattccagaagaagctgaatgtttcttggtagacatggagctgaatgcaaaaactggtattctcgtagcatatgatggagacttcattggcttgattgggataactgatcccttgaaaagggaggctgctgtggttatacaaggtctaaaaaagatgggtgttcatccagttatggtcactggggacaactggaggactgcacgagcagttgcaaaggaggttggcattgacgacgtgagagccgaggttatgccagccggaaaagccaatgtaatccgctctctgcaaaaggatggcagtgttgtcgcaatggtcggagatggcatcaacgactcgcctgccctggccgccgctgatgttggtatggctatcggtgcaggcactgacattgctattgaggcggctgactatgtgctcgtccggaacaacctggaggatgtgatcacagctattgacctctcaaggaagacattcagcaggatccggtggaactacttctttgccatggcgtacaacgtgatcgccatccccgtggctgctggcgcgctgtttcccttcaccggggtccagatgccgccttggctggctggcgcgtgcatggcattctcgtccgtcagcgtggtgtgttcgtcgctgctgctgaggaggtataggaaaccgaggctcaccaccgtgcttcagataacagtggaatag

SEQ ID NO: 370 - protein, 997 aa, Sorghum bicolor
  misc_feature: Ceres ANNOT ID no. 6007445
  misc_feature (402)..(642): Pfam Id: E1-E2_ATPase Pfam Desc: E1-E2 ATPase
  misc_feature (48)..(112): Pfam Id: HMA Pfam Desc: Heavy-metal-associated domain
  misc_feature (130)..(194): Pfam Id: HMA Pfam Desc: Heavy-metal-associated domain
  misc_feature (646)..(894): Pfam Id: Hydrolase Pfam Desc: haloacid dehalogenase-like hydrolase
  misc_feature (11)..(997): NCBI GI: 115444507 NCBI Desc: os02g0172600 [oryza sativa (japonica cultivar-group)]
  misc_feature (4)..(997): NCBI GI: 140043928 NCBI Desc: copper ion-binding; heavy metal translocating p-type atpase [medicago truncatula]
  misc_feature (4)..(997): NCBI GI: 14194135 NCBI Desc: at5g44790/k23l20_14 [arabidopsis thaliana]
  misc_feature (4)..(997): NCBI GI: 6850337 NCBI Desc: atp dependent copper transporter (ran1) [arabidopsis thaliana]
  misc_feature (4)..(997): NCBI GI: 15636781 NCBI Desc: copper-transporting p-type atpase [brassica napus]
  misc_feature (4)..(997): SWISSPROT Homolog: EC 3.6.3.4 Copper-transporting ATPase RAN1
MAHLQLTALAGGADDEMEEVALLGSYDEEAGVGPEGEDQAEAGMRRVQVRVTGMTCSACTGAVEAALSARRGVRRAAVSLLQNRAHVVFDPALAKDDDIVEAIEDAGFEAEILPDSTVSQPKSQKTLSGQFRIGGMTCAACVNSVEGILKKLPGVKRAVVALATSLGEVEYDPSAISKDEIVQAIEDAGFDAALLQSSEQDKALLTVTGLHFEGDVDVLHDILKKMEGLRQFGVDFAKSEVDIVFDPEVVGLRQIVDTIEMESNNRLKAHVQNPYIRAASNDAQEANKTLHLLRFSLFLSIPVFFIRMVCPHIPLISSFLLMHFGPFRIGDLLKWILVTMVQFVVGKRFYVAAYRALRHGSTNMDVLVVIGTTASYVYSVCALLYGAFTGFHPPIYFETSAMIITFVLFGKYLEVLAKGKTSDAIKKLVELAPATALLLLKDKEGKYSGEKEIDASLVQPGDALKVLPGSKVPADGIVIWGTSHVNESMVTGESVPISKEVSSLVIGGTMNLHGILHIQATKVGSGTVLSQIISLVETAQMSKAPIQKFADYVASIFVPIVITLSFLTFLAWFLCGWLGAYPNSWSAESSNCFVFSLMFSISVVVIACPCALGLATPTAVMVATGVGASHGVLVKGGDALERAQNVKYVIFDKTGTLTQGKATVTTAKIFSGMDLGDFLTLVASAEASSEHPLAKAILDYTFHFHFFGKLTSAKDNINRRKEEILSQWLLEVADFSALPGKGIQCWINGKKILVGNRALITENGVNIPEEAECFLVDMELNAKTGILVAYDGDFIGLIGITDPLKREAAVVIQGLKKMGVHPVMVTGDNWRTARAVAKEVGIDDVRAEVMPAGKANVIRSLQKDGSVVAMVGDGINDSPALAAADVGMAIGAGTDIAIEAADYVLVRNNLEDVITAIDLSRKTFSRIRWNYFFAMAYNVIAIPVAAGALFPFTGVQMPPWLAGACMAFSSVSVVCSSLLLRRYRKPRLTTVLQITVE

SEQ ID NO: 371 - DNA, 1596 bp, Sorghum bicolor
  misc_feature: Ceres ANNOT ID no. 6007450
  misc_feature: Encodes the peptide sequence at SEQ ID NO 372
atgtccagcgccgccgtcgacctccgcctgggccagcgcgtgcacgccgccggcgaccctcgccgcgtaggcacggtgcgctacctgggccccgtagagggccacgccggagactgggtaggcgtcgactgggacgatggcgccggcggccggcacgacggctcgctcgccggccgccgatactttgtcgccgcgggagagtgctcggcctccttcgcgcgccccaccgcgctcagcggagggatctcgctcccggacgcgctccgcctacgctaccgcgttcaggacttcaccaaggaggagcaggatgagatgtatgtcttctcgacaagccagaagcgtgtctcggttgaatttgttggcacagacaaagttcagcagaagctcaacaacttcaatgagttgaccagtgcatccgtttcgtacatgggagtgagctcaattggagcgccaaatgaactaaagagtttggttccaaatctcagacttcttgacttaactggaaatctattctcacagtggcaagatatatcatctctttgtcaagcactggcatccctggaagttcttaatttgacaaacaataccatggagagtgatgttgtagaaactccaatgctcgagaatatcagaattcttgttctcaacaactgtggtgtaacatgggaactggttgaaaagattaaaatttccctttcatgtatcagtgaactccacctgatgtcaaacaggctcaatatgatcatgaccccagatggaaagtttgtacaaggtttcaatacactgtggctcctaaatttagaagataatcacattgattcatgggatgaaattgtgaaactttcttacttaagaagtttggaacaactccatttgaacaaaaacaggttaaagcatgtgaagtatccatctaatctttcaccagatggacctcttgatgatacagctgctgtgccatttgaaaatttgcaagttcttttgttaggatctaatgacatagacgacttctcttcagtggattcacttaacctgttcccaagtttaagggatgtcaggctttctgataatcctatagctgatcctgccaagggtggtgctcctcgttttgtgcttgttgctcgacttgggaaagttggaatactaaatggcagtgagataagcccacgtgaacggagggaatctgaaatacgatatgtccgccttgttatgggaaaaatagaatcaaatgacctagaagagatcaaacggctgcatcctagatttgctgaactgaagtcctttcatggtattgaagatgagaagccaacttcaagcacatcggggccacaaaagatggcttctggtgttacattgaaatgtgtgggggcatcaatgggtgaaaagcaaccactgacaaagaaactgcctcctacaacaactgtagggaagttgaaatctttgtgcgaaagcttctttaaactgaaggacataaacgtgagactgtttgtcgaagaagagcgatgccctctaccacaacttctggaggaggacacggcctctctgatggagcttggaattggctcgggcacaaccattgttgtggacgaagagagctag

SEQ ID NO: 372 - protein, 531 aa, Sorghum bicolor
  misc_feature: Ceres ANNOT ID no. 6007450
  misc_feature (10)..(79): Pfam Id: CAP_GLY Pfam Desc: CAP-Gly domain
  misc_feature (1)..(527): NCBI GI: 110331779 NCBI Desc: beta-tubulin cofactor e [bos taurus]
  misc_feature (10)..(527): NCBI GI: 61371210 NCBI Desc: tubulin-specific chaperone e [synthetic construct]
  misc_feature (10)..(527): NCBI GI: 30583011 NCBI Desc: tubulin-specific chaperone e [homo sapiens]
  misc_feature (10)..(527): NCBI GI: 60654793 NCBI Desc: tubulin-specific chaperone e [synthetic construct]
  misc_feature (10)..(527): NCBI GI: 118442828 NCBI Desc: beta-tubulin cofactor e [homo sapiens]
MSSAAVDLRLGQRVHAAGDPRRVGTVRYLGPVEGHAGDWVGVDWDDGAGGRHDGSLAGRRYFVAAGECSASFARPTALSGGISLPDALRLRYRVQDFTKEEQDEMYVFSTSQKRVSVEFVGTDKVQQKLNNFNELTSASVSYMGVSSIGAPNELKSLVPNLRLLDLTGNLFSQWQDISSLCQALASLEVLNLTNNTMESDVVETPMLENIRILVLNNCGVTWELVEKIKISLSCISELHLMSNRLNMIMTPDGKFVQGFNTLWLLNLEDNHIDSWDEIVKLSYLRSLEQLHLNKNRLKHVKYPSNLSPDGPLDDTAAVPFENLQVLLLGSNDIDDFSSVDSLNLFPSLRDVRLSDNPIADPAKGGAPRFVLVARLGKVGILNGSEISPRERRESEIRYVRLVMGKIESNDLEEIKRLHPRFAELKSFHGIEDEKPTSSTSGPQKMASGVTLKCVGASMGEKQPLTKKLPPTTTVGKLKSLCESFFKLKDINVRLFVEEERCPLPQLLEEDTASLMELGIGSGTTIVVDEES

SEQ ID NO: 373 - DNA, 768 bp, Sorghum bicolor
  misc_feature: Ceres ANNOT ID no. 6007451
  misc_feature: Encodes the peptide sequence at SEQ ID NO 374
atgccatcacggcaaccgccctcgccgtcttctttgcctccggctccggcaccgggcacggcggcggtccaggccctcgccggcgccgcgagctgcctccccgcggaccagtcctgcttcacggtctcggcggtctccgtcggtgcgcctagctactactcctcgcgtcacgacgctgccgccgccattgtcggcacacacgcctgctgcaacacagcctcctacatcaccgtcctcggcatcagcttcggctccctcctcgtcatcctgctcatcctgtgcgccatccggtggtacctcgtccggcggtccgcgagccgggacgacgctgccgcccagcaggctaccgccgccgcggcggcggaaccggcggaaaagaaacagcccaagggactggatgctgacgccatcgccgcgctgccggagttcatgtatcggcggaaggaggacgccgccgacgggaaggaggagcgggagcttgagtgtgctgtatgcctgggcgcaatggcggacggcgacgcggcgcggcggctgccgtcatgcatgcacgtcttccaccggggctgcgtcgacgtgtggctaagggagcgctcgacatgcccggtctgccgcgccgaggtggacgtcgtcgtcagatcgtccggcgagggctgtgacgggaaggacgaccaagaaggcggcccgtcaagggcgtccacgtcgatggcgtggacagcacaggaagagctgatagacgaaggggagagggacctggaggcgcagctgtag

SEQ ID NO: 374 - protein, 255 aa, Sorghum bicolor
  misc_feature: Ceres ANNOT ID no. 6007451
  misc_feature (162)..(203): Pfam Id: zf-C3HC4 Pfam Desc: Zinc finger, C3HC4 type (RING finger)
  misc_feature (51)..(216): NCBI GI: 47497733 NCBI Desc: ring-h2 zinc finger protein-like [oryza sativa (japonica cultivar-group)]
  misc_feature (43)..(205): NCBI GI: 115445315 NCBI Desc: os02g0249300 [oryza sativa (japonica cultivar-group)]
  misc_feature (73)..(208): NCBI GI: 20160754 NCBI Desc: p0503c12.20 [oryza sativa (japonica cultivar-group)]
  misc_feature (33)..(208): NCBI GI: 115435244 NCBI Desc: os01g0212700 [oryza sativa (japonica cultivar-group)]
  misc_feature (71)..(208): NCBI GI: 56201670 NCBI Desc: ring-h2 zinc finger protein-like [oryza sativa (japonica cultivar-group)]
  misc_feature: The sequence is a functional homolog of SEQ ID NO 1541 in the 11/479,226US patent application
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13258
  misc_feature: The sequence is a functional homolog of SEQ ID NO 1541 in the 20070022495 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
MPSRQPPSPSSLPPAPAPGTAAVQALAGAASCLPADQSCFTVSAVSVGAPSYYSSRHDAAAAIVGTHACCNTASYITVLGISFGSLLVILLILCAIRWYLVRRSASRDDAAAQQATAAAAAEPAEKKQPKGLDADAIAALPEFMYRRKEDAADGKEERELECAVCLGAMADGDAARRLPSCMHVFHRGCVDVWLRERSTCPVCRAEVDVVVRSSGEGCDGKDDQEGGPSRASTSMAWTAQEELIDEGERDLEAQL

SEQ ID NO: 375 - DNA, 1257 bp, Sorghum bicolor
  misc_feature: Ceres ANNOT ID no. 6007460
  misc_feature: Encodes the peptide sequence at SEQ ID NO 376
atggctataagcttcaaatactgggacgattgcttagatccagaggacatgagattaatgtggcaggatcctattgtaagtaaagagtggactgatgctggggaagagcaaggacagaaagttcacctatcacgggaccctgacggtgaggcatatctcacacaaactgaaatgatggcagtggcggcaattactgttcatagacatttcaaatctcagctagacccgtatatgataggcgcactcgctgaaattgcaagcggaaggagactctttgtagatacctatgatcgcaagactaaagaaaccaaggttggcataatgcaggtggcacctgaagttgctcaatggcttggaagggaactaggttacaagagttatgacattgaagataatactaatttgctgtactggcctcttgtcaatgtctactttggtgctgcttatgcaaaatggctcttctcttgtgatgacaaacaaagaactgaagagtttgttgttagagcatataaaggtggcaaaaagaaggctgctcacaaatcaacttcccccatcttccagcgttatctttatgtgaaagagaacttgttgtctatgagacaaccagaaatttgccacgagcttactcctgacctagaagatttgtcaagcgcagaagcacagttgatatattgggattccaaggtatcagaggctgatatggatgcaatgtggaaacatccggatgtatataaggagtggataaaatctggtgagaggcgtggaaatgtacgattctcccatgatgaaaagaagaggccttacctttctcgcgtggaggtgaaggctgttgccgaaataatcatatcacgccatttgagcacaagaggagtaaaaccagaagctcttgcagcacttgcagaggtctgcagtatgcgctttgttcatggagtaagtacccggactggattgatgggaatagactaccctactgcttcatggctttccagggattgtcgctacagggcatatacagtgatctctgtagatgatctctacaatccttttgcatcaatgtactttggtgcatcttacttggcatggttgtctcaatacgaaggaagggagcaaagctacgaattcattgtccaagcttatcttgggggaccagagaatgttagtcttcaggagactgggcctttttggaaccaattccttgagtcattaacacagtatcaagatccaaagaaggaccataatagctgctgtattttgtga

SEQ ID NO: 376 - protein, 418 aa, Sorghum bicolor
  misc_feature: Ceres ANNOT ID no. 6007460
  misc_feature (1)..(412): NCBI GI: 4966349 NCBI Desc: contains a pf01464 transglycosylase slt domain. [arabidopsis thaliana]
  misc_feature (74)..(173): NCBI GI: 76795789 NCBI Desc: slt [thermoanaerobacter ethanolicus atcc 33223]
  misc_feature (74)..(173): NCBI GI: 114843859 NCBI Desc: lytic transglycosylase, catalytic [thermoanaerobacter ethanolicus x514]
MAISFKYWDDCLDPEDMRLMWQDPIVSKEWTDAGEEQGQKVHLSRDPDGEAYLTQTEMMAVAAITVHRHFKSQLDPYMIGALAEIASGRRLFVDTYDRKTKETKVGIMQVAPEVAQWLGRELGYKSYDIEDNTNLLYWPLVNVYFGAAYAKWLFSCDDKQRTEEFVVRAYKGGKKKAAHKSTSPIFQRYLYVKENLLSMRQPEICHELTPDLEDLSSAEAQLIYWDSKVSEADMDAMWKHPDVYKEWIKSGERRGNVRFSHDEKKRPYLSRVEVKAVAEIIISRHLSTRGVKPEALAALAEVCSMRFVHGVSTRTGLMGIDYPTASWLSRDCRYRAYTVISVDDLYNPFASMYFGASYLAWLSQYEGREQSYEFIVQAYLGGPENVSLQETGPFWNQFLESLTQYQDPKKDHNSCCIL

SEQ ID NO: 377 - DNA, 780 bp, Sorghum bicolor
  misc_feature: Ceres ANNOT ID no. 6007463
  misc_feature: Encodes the peptide sequence at SEQ ID NO 378
atgggacgcgggaagatcgagatcaagcggatcgagaactcgacgaaccggcaggtgaccttctccaagcgccggggcgggctgctcaagaaggccaacgagctcgccgtgctgtgcgacgcgcgcgtcggcgtcgtcatcttctccagcaccggcaagatgttcgagtactgcagccctgcctgcagcctgagggagcttattgagcagtatcagcatgctaccaacaaccactttgaggagataaaccatgatcagcaaatattactggagatgacacggatgaagaacgagatggacaagctggagactggcatcaggaggtacactggcgacgacctctcctcactcaccctcgacgacgtcagcgacctcgagcagcagctcgagtactctgtctccaaagtccgtgcaagaaagcatcagctcctgaatcaacagcttgacaacctgcgtcgcaaggaacaaatcttggaagatcagaacaccttcctgtaccgcatgatcaacgagaaccagcaggcgacattgaccggcgaggtgaagctgggggagatgacggcgccgctggcgatgctgccaccgccggcggcgttcacgcactccacctactacggcggggagtcatcgtcgggcggcacggcactgcagctgatgtcggcggcgccgcagctgcagcacgccgacctcgggttccggctacagccgacgcagcccaacctgcaggacccggcggcggcgtgcggcggcctccatggccacggcctgcagctgtggtaa

SEQ ID NO: 378 - protein, 259 aa, Sorghum bicolor
  misc_feature: Ceres ANNOT ID no. 6007463
  misc_feature (9)..(59): Pfam Id: SRF-TF Pfam Desc: SRF-type transcription factor (DNA-binding and dimerisationdomain)
  misc_feature (71)..(171): Pfam Id: K-box Pfam Desc: K-box region
  misc_feature (1)..(259): NCBI GI: 75290460 NCBI Desc: mads-box transcription factor 29 (osmads29)
  misc_feature (1)..(258): NCBI GI: 66473798 NCBI Desc: fst [oryza sativa (japonica cultivar-group)]
  misc_feature (1)..(167): NCBI GI: 95982323 NCBI Desc: mads-box transcription factor taagl35 [triticum aestivum]
  misc_feature (1)..(175): NCBI GI: 62122359 NCBI Desc: mads-box transcription factor gbmads10 [ginkgo biloba]
  misc_feature (1)..(173): NCBI GI: 62122347 NCBI Desc: mads-box transcription factor gbmads4 [ginkgo biloba]
  misc_feature: Abnormal phyllotaxy, leaf number higher than wild-type
  misc_feature: The plant flowers significantly earllier than wild-type.
  misc_feature: The sequence is a functional homolog of SEQ ID NO 14 in the 10/374,780US patent application
  misc_feature: The sequence is a functional homolog of SEQ ID NO 328 in the 10/225,066US patent application
  misc_feature: The sequence is a functional homolog of SEQ ID NO 34 in the 10/286,264US patent application
  misc_feature: The sequence is a functional homolog of SEQ ID NO 468 in the 11/435,388US patent application
  misc_feature: The sequence is a functional homolog of SEQ ID NO 68 in the 10/412,699US patent application
  misc_feature: The sequence is a functional homolog of SEQ ID NO 729 in the 10/666,642US patent application
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12958
  misc_feature: The sequence is a functional homolog of SEQ ID NO 34 in the 20030093837 US patent application
  misc_feature: The sequence is a functional homolog of SEQ ID NO 729 in the 20070033671 US patent application
  misc_feature: The sequence is a functional homolog of SEQ ID NO 729 in the 10/666,642 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1701 in the 10/412,699 US patent application
  misc_feature: Useful for making plants with modulated flowering time
  misc_feature: Functional homolog of the protein sequence given in SEQ ID NO 13660
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 518 in the 11/188,298 US application
  misc_feature: The sequence is a functional homolog of SEQ ID NO. 359 in the 11/188,298 US application
  misc_feature: The sequence is a functional homolog of SEQ ID NO. 273 in the 11/188,298 US application
  misc_feature: The sequence is a functional homolog of SEQ ID NO. 361 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGKIEIKRIENSTNRQVTFSKRRGGLLKKANELAVLCDARVGVVIFSSTGKMFEYCSPACSLRELIEQYQHATNNHFEEINHDQQILLEMTRMKNEMDKLETGIRRYTGDDLSSLTLDDVSDLEQQLEYSVSKVRARKHQLLNQQLDNLRRKEQILEDQNTFLYRMINENQQATLTGEVKLGEMTAPLAMLPPPAAFTHSTYYGGESSSGGTALQLMSAAPQLQHADLGFRLQPTQPNLQDPAAACGGLHGHGLQLW

SEQ ID NO: 379 - DNA, 1095 bp, Sorghum bicolor
  misc_feature: Ceres ANNOT ID no. 6007469
  misc_feature: Encodes the peptide sequence at SEQ ID NO 380
atggcacggtatcttctcgcccccacctcctccacgacctcctctgctgcgcctgccctcctccccaaggatgccgccaagaaatcgccgacgtcacggcccctccgcctccgtgcgcttggctccaggaccagcaaggcgcggcccatcatggcggtggcgtcggagcaggccgcgccggccgccaggtaccccaaggtggccgcccctaccaccggcccgatcccggccgccgagctgctcggagtcatcgaggccgctgcaaaagctggcgccgatgttataatggaagctgttaataagccacgcaatatccaatataaaggtgttgcagacctggtgacagacacagacaagttgagtgaatcagtcattttggaagttgtcaccaagaacttcaaagaccacctcatacttggggaggaaggcggccttattggagattcccagtcagagtatctctggtgcattgaccctttagatggaacaacaaactttgcacatggttaccccagcttttctgtgtccattggtgttctcttccgtgggaagcctgctgcttctactgtggtggaattttgtggtgggcctatgtgctggagcacccgtacaatttctgcatctgctggtggaggagcttattgtaatgggcaaaagattcatgtcagtcagacaaacaaggtggaacaatctcttctcgtcacaggttttggatatgaacatgatgatgcctggacgaccaatataaatttgttcaaggaatttactgacattagcaggggagtgcgaaggctggggtctgccgctgctgacatgtcccacgttggacttggtattacagaagcttactgggaataccgacttaagccatgggatatggctgctggcgtcctgatagttgaagaagctggtggggtggtaactcgcatggatggtggagagtttacagtctttgatcgttctgttcttgtttccaatggacttgttcatggacagcttttggatcggattggccctcctactgaagatcttaagaagaaaggaattgatttctctttgtggttcaagcctgacaactacgtaactgacttttga

SEQ ID NO: 380 - protein, 364 aa, Sorghum bicolor
  misc_feature: Ceres ANNOT ID no. 6007469
  misc_feature (76)..(346): Pfam Id: Inositol_P Pfam Desc: Inositol monophosphatase family
  misc_feature (52)..(363): NCBI GI: 18397837 NCBI Desc: inositol monophosphatase family protein [arabidopsis thaliana]
  misc_feature (117)..(363): NCBI GI: 4512616 NCBI Desc: contains similarity to gi1653332 extragenic suppressor (suhb) from synechocystis sp. gbd90912 and is a member of the inositol monophophatase family pf00459. est gbaa597395 comes from
  misc_feature (117)..(363): NCBI GI: 4512616 (continued) this gene. [arabidopsis thaliana]
  misc_feature (40)..(362): NCBI GI: 58760232 NCBI Desc: inositol monophosphatase [chlamydomonas incerta]
  misc_feature (79)..(334): NCBI GI: 91220268 NCBI Desc: inositol-1-monophosphatase [psychroflexus torquis atcc 700755]
  misc_feature (37)..(342): NCBI GI: 77920033 NCBI Desc: inositol-1-monophosphatase [pelobacter carbinolicus dsm 2380]
MARYLLAPTSSTTSSAAPALLPKDAAKKSPTSRPLRLRALGSRTSKARPIMAVASEQAAPAARYPKVAAPTTGPIPAAELLGVIEAAAKAGADVIMEAVNKPRNIQYKGVADLVTDTDKLSESVILEVVTKNFKDHLILGEEGGLIGDSQSEYLWCIDPLDGTTNFAHGYPSFSVSIGVLFRGKPAASTVVEFCGGPMCWSTRTISASAGGGAYCNGQKIHVSQTNKVEQSLLVTGFGYEHDDAWTTNINLFKEFTDISRGVRRLGSAAADMSHVGLGITEAYWEYRLKPWDMAAGVLIVEEAGGVVTRMDGGEFTVFDRSVLVSNGLVHGQLLDRIGPPTEDLKKKGIDFSLWFKPDNYVTDF

SEQ ID NO: 381 - DNA, 1023 bp, Sorghum bicolor
  misc_feature: Ceres ANNOT ID no. 6007479
  misc_feature: Encodes the peptide sequence at SEQ ID NO 382
atggtgtcgctgcgatgcgccaccgcgcgccactccctcctcggcccgccgacctgcctcgcgcgcccgcggcggcgggcgtgccccgtcgccgtggaggccgtctcgcaggccaaggacagtgatcttgctcttgcacaagcccgtgaaactcgagataaactgaaagctgcacactctgaattagctgaggagggggctgttgagatcatcattataaagaccacaggagacatgatcttggacaaaccccttgcagatattggtggcaagggtttattcaccaaggagatagatgatgcgatcttgcagggaaggattgatattgctgttcactctatgaaagatgtcccaacatatctacctgaaggaacaatactaccatgtaacctcccgcgagaagatgctagagacgcatttatatgtttgactgcaaattcacttgcggagcttccttctggttgtgtcgtcggaagtgcttccctgaggagacaatctcagattctctgcaggtatccgtcactcaaggttgttaacttaagaggaaatgttcagacacggttaacgaaactcaagaacggagatgtccatgctacgctgttggcactggctggactaaagcggctaaatatggtggaaaatgtaacatctatattatccatggaagaaatgcttccagccgttgcccaaggtgccattggaatagcttgcagaagcaatgacaacaaaatgatggagtacctctcctcgttgaaccatgaagataccagatcagctgttgcatgcgaaagagaattcttgacagttcttgatggtaactgccgaactccaattgcggcctatgctcatcgtgataaggatgggagttgctcattccgaggtctattggcttcaccagatggatctaaagtatatgagacaacaagaattggaccgtactctttcgacgatatggttgagatggggaaagatgctggtcatgagctgaaggcaaaggctgggcctggcttctatgattgctag

SEQ ID NO: 382 - protein, 340 aa, Sorghum bicolor
  misc_feature: Ceres ANNOT ID no. 6007479
  misc_feature (40)..(249): Pfam Id: Porphobil_deam Pfam Desc: Porphobilinogen deaminase, dipyromethane cofactor bindingdomain
  misc_feature (257)..(333): Pfam Id: Porphobil_deamC Pfam Desc: Porphobilinogen deaminase, C-terminal domain
  misc_feature (39)..(339): NCBI GI: 19849543 NCBI Desc: porphobilinogen deaminase [triticum aestivum]
  misc_feature (39)..(339): NCBI GI: 92891983 NCBI Desc: porphobilinogen deaminase [medicago truncatula]
  misc_feature (39)..(339): NCBI GI: 313724 NCBI Desc: hydroxymethylbilane synthase [pisum sativum]
  misc_feature (26)..(338): NCBI GI: 21592624 NCBI Desc: hydroxymethylbilane synthase [arabidopsis thaliana]
  misc_feature (39)..(339): NCBI GI: 46201306 NCBI Desc: cog0181: porphobilinogen deaminase [magnetospirillum magnetotacticum ms-1]
  misc_feature (39)..(339): SWISSPROT Homolog: EC 2.5.1.61 Porphobilinogen deaminase, chloroplast precursor
MVSLRCATARHSLLGPPTCLARPRRRACPVAVEAVSQAKDSDLALAQARETRDKLKAAHSELAEEGAVEIIIIKTTGDMILDKPLADIGGKGLFTKEIDDAILQGRIDIAVHSMKDVPTYLPEGTILPCNLPREDARDAFICLTANSLAELPSGCVVGSASLRRQSQILCRYPSLKVVNLRGNVQTRLTKLKNGDVHATLLALAGLKRLNMVENVTSILSMEEMLPAVAQGAIGIACRSNDNKMMEYLSSLNHEDTRSAVACEREFLTVLDGNCRTPIAAYAHRDKDGSCSFRGLLASPDGSKVYETTRIGPYSFDDMVEMGKDAGHELKAKAGPGFYDC

SEQ ID NO: 383 - DNA, 1071 bp, Sorghum bicolor
  misc_feature: Ceres ANNOT ID no. 6007480
  misc_feature: Encodes the peptide sequence at SEQ ID NO 384
atggtctccctgcgatgcaccaccgcgcaccactccctgctcggctcgccgacctgcctcgtgcgcccgaggcggcgggcgtgccccgtggtgcgcgctgccgtggcagtggaggccggcgcggaggccaaggtctccctcatccggattgggacgcgtggaagtcctcttgctcttgcacaagcccatgaaactcgagaaaaactgaaagccgcacactctgagttagctgaggagggggctattgagatcgtcatcataaagaccacaggagacatgatcttggacaaacctcttgcagatattggaggcaagggtttattcaccaaggaaatagatgatgcgctcttgcagggaaggattgatatcgctgttcactctatgaaagatgttccaacatatctacctgaaggcacaatattgccctgtaacctcccacgagaagatgtcagagatgcattcatatgcttgactgcaaattcgcttgcggagcttcctgctggcagtgttgttggaagtgcttccctgcggagacaatctcagattctctacagatatccatcactgaaagtagttaacttcagaggaaatgttcagacacggctaaggaaactgaaggaaggagatgtctctgctacgttgttggcactggctggattaaggcggctgaatatggcagaaaatgcaacagctgtactatcagtggaagaaatgcttccagcagttgcccaaggtgctattggaatagcttgccgaagcaacgatgacaaaatgatggagtatctatcctcgttgaaccatgaagataccagattagctgttgcatgtgaaagagaattcttggcagttcttgatggtaactgccgaactccgattgcagcctatgcttaccgtgataaggatgggaattgctcattccggggtctgttggcttccccagacggatctaaagtatttgagacaacaagaagtggaccatactcttttgacgacatggttgagttgggcaaagatgctggtcatgagctgaaggcaaaggctgggcctggcttctttgatagcttgcaatga

SEQ ID NO: 384 - protein, 356 aa, Sorghum bicolor
  misc_feature: Ceres ANNOT ID no. 6007480
  misc_feature (47)..(263): Pfam Id: Porphobil_deam Pfam Desc: Porphobilinogen deaminase, dipyromethane cofactor bindingdomain
  misc_feature (271)..(347): Pfam Id: Porphobil_deamC Pfam Desc: Porphobilinogen deaminase, C-terminal domain
  misc_feature (49)..(356): NCBI GI: 19849543 NCBI Desc: porphobilinogen deaminase [triticum aestivum]
  misc_feature (31)..(354): NCBI GI: 92891983 NCBI Desc: porphobilinogen deaminase [medicago truncatula]
  misc_feature (31)..(354): NCBI GI: 313724 NCBI Desc: hydroxymethylbilane synthase [pisum sativum]
  misc_feature (22)..(352): NCBI GI: 21592624 NCBI Desc: hydroxymethylbilane synthase [arabidopsis thaliana]
  misc_feature (43)..(356): NCBI GI: 46201306 NCBI Desc: cog0181: porphobilinogen deaminase [magnetospirillum magnetotacticum ms-1]
  misc_feature (31)..(354): SWISSPROT Homolog: EC 2.5.1.61 Porphobilinogen deaminase, chloroplast precursor
MVSLRCTTAHHSLLGSPTCLVRPRRRACPVVRAAVAVEAGAEAKVSLIRIGTRGSPLALAQAHETREKLKAAHSELAEEGAIEIVIIKTTGDMILDKPLADIGGKGLFTKEIDDALLQGRIDIAVHSMKDVPTYLPEGTILPCNLPREDVRDAFICLTANSLAELPAGSVVGSASLRRQSQILYRYPSLKVVNFRGNVQTRLRKLKEGDVSATLLALAGLRRLNMAENATAVLSVEEMLPAVAQGAIGIACRSNDDKMMEYLSSLNHEDTRLAVACEREFLAVLDGNCRTPIAAYAYRDKDGNCSFRGLLASPDGSKVFETTRSGPYSFDDMVELGKDAGHELKAKAGPGFFDSLQ

SEQ ID NO: 385 - DNA, 684 bp, Sorghum bicolor
  misc_feature: Ceres ANNOT ID no. 6007483
  misc_feature: Encodes the peptide sequence at SEQ ID NO 386
atgactgaacaccaggaatgtgttagcaagagctcttcctcaagtattagcagcagcactcaggagagtgaggaggaactgaccattggtactcttataactgaagcaacaaacacaacaaacagtgcaaagagtcttggaaggcgcctttcgcacttagattcgatcccgcacactccgcgtgttaatgggaaaattccagattttaataatgcgacaattgatcatgaatcattattagaaagattgggcacttatggcttagctgaataccaaatagaaggagatgggaattgccagttccgagctctggcagaccagatattccgcaatcctgattatcacaaacatgtgaggaaggcggtagtgaagcagctgaaggaattcaagaaacactatgaaggttatgtgccaatggaatataaggtttacttgaagaaaatgaaaagatccggggaatggggagatcatgtgaccttacaggcagctgcagacaggtttgctgctaaaatatgtctgttgacgtcgtttagagacacatgcctagttgagatagtccccagagatgccactccaacaagagagctttggctaagtttctggtgtgaagtacactacaattcattgtatgcagttgaagatcttccgacacggaaaactaaaaagaagcattggctgttctag

SEQ ID NO: 386 - protein, 227 aa, Sorghum bicolor
  misc_feature: Ceres ANNOT ID no. 6007483
  misc_feature (94)..(206): Pfam Id: OTU Pfam Desc: OTU-like cysteine protease
  misc_feature (1)..(227): NCBI GI: 52075842 NCBI Desc: otu-like cysteine protease-like [oryza sativa (japonica cultivar-group)]
  misc_feature (9)..(227): NCBI GI: 18403314 NCBI Desc: otu-like cysteine protease family protein [arabidopsis thaliana]
  misc_feature (9)..(227): NCBI GI: 42572513 NCBI Desc: otu-like cysteine protease family protein [arabidopsis thaliana]
  misc_feature (9)..(214): NCBI GI: 115458186 NCBI Desc: os04g0402300 [oryza sativa (japonica cultivar-group)]
  misc_feature (46)..(225): NCBI GI: 140068577 NCBI Desc: calcium-binding ef-hand; ovarian tumour, otubain [medicago truncatula]
MTEHQECVSKSSSSSISSSTQESEEELTIGTLITEATNTTNSAKSLGRRLSHLDSIPHTPRVNGKIPDFNNATIDHESLLERLGTYGLAEYQIEGDGNCQFRALADQIFRNPDYHKHVRKAVVKQLKEFKKHYEGYVPMEYKVYLKKMKRSGEWGDHVTLQAAADRFAAKICLLTSFRDTCLVEIVPRDATPTRELWLSFWCEVHYNSLYAVEDLPTRKTKKKHWLF

SEQ ID NO: 387 - DNA, 3660 bp, Sorghum bicolor
  misc_feature: Ceres ANNOT ID no. 6007492
  misc_feature: Encodes the peptide sequence at SEQ ID NO 388
atggcaaatttaaacataaccaacatcttggagaagatgacagggaaagataaagactacagatatatggcaacatcagatctactcagtgagttgaataaagaaagcttcaaagctgatcaagaccttgagccgaagttaacaattactgttcttcaacaactcgaggatgcttcaggagatgtttctggtttagctgttaaatgcttggctccactcgtcaaaaaggttggtgaggacagggttgtggagatgaccaataaactttgtgataaattgatcaatggaaaggaccagcatcgggatacagctagtatagccctgaagacaatcattgcagaagttacaacaccatcacttgctgaaaagattttgctctctcttgccccacaactcatcaagggtgtcaataccgcaaaaggtgctgaaattaaatgcgaatgtcttgatatattggcggatgtgcttcatagatttggcaacttgatcacaaaagatcatgagtatatgctcactgcacttttatcccaattgggttccaaccaagcaagcgtcagaaagaagtctatttcttgcattgcatcacttgctccaagtttatcagatgatttgttagcgaaggcaactttgcaagttgtccagttgctgaaaaatagaggtgcaaaatctgaaattacccgaacaaatatccagatgattggttctctaagtcgttctgtggggtaccggtttgggccacaccttgcagaaactgttccgctgcttataagctattgtacaagtgcatctgaaaatgatgaagagcttcgtgaatacagcttgcaggctcttgagagctttatgctcaggtgcccaagggatatatccccatattgtgagggcattctgaaccttgctttggaatatgtgagctatgatcctaatttcactgatagcatggatgaggatactgatgaggaagggcaggaagaggatgatgacgatgagagtgcaaatgagtacacagatgatgaggatgcaagctggaaagtccgcagagcatcagcgaagtgcctatctgcaattatagtgtcacgtcctgaaatgttgtcaaagatgtatctagaggcttgtccaaagttaattgaacgctttcgggaaagagaggagaatgtaaagatggatatcttcaacaccttcattgagctgttacgccaaacttgtaatgtaacgaaaggacaaggcgacatcgatgagtccagtcctcgatggttgctgaagcaagaggtaccaaaagttgtcaagtctatcaataggcagttacgtgaaaaatcaatcaagacaaaggttggggcattttcagtactgaaggagcttgtggttgtattaccagactgtcttgctgatcattttggatcacttgttcctgggattgagaaggctttgaatgacaagtcttctacctccaacctgaagattgaagcccttgtatttacaaggcttgttatggcttcacattcgccatctgtgtttcatccatacatcaaggcactttctgcccctatactatctgctatcggagatagatattataaagtcactgctgaggctttgcgggtgtgtggagagctagtccgtgtccttcgcccaaatcttgagacaagctcagtcgatttcaggccatacagtggtccaatctataatgctatactgggacgtttggctaatcaagatcaggatcaggaggtaaaagaatgcgccatatcttgcatgagtctggtggtctctacgtttggtgatggtcttcaaagagaattaccagcatgccttcccatactcgtcgataggatgggtaatgaaattacaagacttacagctgtcaaggcattttcagttattgcgaattcacctcttcgtattgatctctcgtgtgtcctggatcatgttgtttctgagctcacagctttccttcgtaaggccaacagagctcttaggcaggcaacattgggaactctaaattctttggttgtcacatatggtggtcagattggctcttcttcatatgagacgataatagcagaactttcaaccctcataagtgacatggatttgcatatgaccgctcttgcattggaactttgttgcacaattatggttgacagaaaatccattaaaaatgttggtttagctgtgagaaataaggttttacctcaggcccttgttttgatcaggagtgccctcttgcaagggcaggcactacaggctcttcagagattttttgcgtcacttgttcaatctgcaaatactagctttgatgctttgttggattcccttatttctgctgcgaagccatcacagtccggtagtcttgccaagcaagcactgtcttctattgctaagtgtgttgctgttctatgcttagcagctggtgaccagaagtgtgcatctacaattgaaatgcttaaaggcattttgaaagatgacagcactactaactctgctaaacaacatatggccttgttatgtctgggagaaattgggaggaggaaggacctcagcaatcatgttcaaattgagaacattgtcattgaatcatttcaatcaccttttgaggagattaagtctgcagcatcctatgcacttggaaacattgctgttggcaacctctccaagtatttaccatttattttggatcagattgacaatcaacagaagaagcaatatctgttgctccattcacttaaagaggtaatcgtgcggcaatctgttgatcatgctggccagagtgagctccaggattcaaacattgagaagatattggcattgctcttcaatcactgtgaaagtgaggaggagggagttcggaatgttgttgcagagtgtttaggaaaaattgctttaattgaaccaaaaaaattagtccctgctttgaaggtacgcacatctagcccagcagcaaatacaagagctacagttgccattgctataaagtattcaattgttgaacgacctgagaaaatagatgaaatcatgtactctgagatatctactttcctgatgttgattaaagacagcgataggcatgtgagaagagcagcggttctggctttgagcacagcagcacacaacaagccaaatttgataaaaggtcttcttccagagttattacctcttctatatgaccaaactgttattaagcaagagttgatcaggacagttgatcttgggcctttcaagcatgttgtagatgatggtcttgaacttaggaaagctgcatttgaatgtgtggacactttattggacagttgtcttgatcaagtgaatccatcatccttcattgtacctttcctcttgtctggcttaggtgatcattatgatgtaaaaatgccttgccatttgattctctcaaagctagcagacaagtgcccttcagccgttcttgctgttttggactccatagttgaaccgattgagaaaactataagtcacaaaccgaagggcgatgcagtgaagcaggaggttgatcggaatgaagacatgattcgtagcgctcttaggtccatttcttctttaagccgcataagtggcagcgactacagtatacggttcaagaatctgatgaacaagataacgaccactcctgcacttgcggagaagtacaactcggtgcgcagtgaataa

SEQ ID NO: 388 - protein, 1219 aa, Sorghum bicolor
  misc_feature: Ceres ANNOT ID no. 6007492
  misc_feature (1039)..(1206): Pfam Id: TIP120 Pfam Desc: TATA-binding protein interacting (TIP20)
  misc_feature (2)..(1219): NCBI GI: 71891685 NCBI Desc: kiaa0829 protein [homo sapiens]
  misc_feature (2)..(1219): NCBI GI: 29792160 NCBI Desc: tip120 protein [homo sapiens]
  misc_feature (2)..(1219): NCBI GI: 67460489 NCBI Desc: cullin-associated nedd8-dissociated protein 1 (cullin-associated and neddylation-dissociated protein 1) (p120 cand1)
  misc_feature (2)..(1219): NCBI GI: 37360114 NCBI Desc: mkiaa0829 protein [mus musculus]
  misc_feature (2)..(1219): NCBI GI: 16758920 NCBI Desc: tbp-interacting protein 120a [rattus norvegicus]
MANLNITNILEKMTGKDKDYRYMATSDLLSELNKESFKADQDLEPKLTITVLQQLEDASGDVSGLAVKCLAPLVKKVGEDRVVEMTNKLCDKLINGKDQHRDTASIALKTIIAEVTTPSLAEKILLSLAPQLIKGVNTAKGAEIKCECLDILADVLHRFGNLITKDHEYMLTALLSQLGSNQASVRKKSISCIASLAPSLSDDLLAKATLQVVQLLKNRGAKSEITRTNIQMIGSLSRSVGYRFGPHLAETVPLLISYCTSASENDEELREYSLQALESFMLRCPRDISPYCEGILNLALEYVSYDPNFTDSMDEDTDEEGQEEDDDDESANEYTDDEDASWKVRRASAKCLSAIIVSRPEMLSKMYLEACPKLIERFREREENVKMDIFNTFIELLRQTCNVTKGQGDIDESSPRWLLKQEVPKVVKSINRQLREKSIKTKVGAFSVLKELVVVLPDCLADHFGSLVPGIEKALNDKSSTSNLKIEALVFTRLVMASHSPSVFHPYIKALSAPILSAIGDRYYKVTAEALRVCGELVRVLRPNLETSSVDFRPYSGPIYNAILGRLANQDQDQEVKECAISCMSLVVSTFGDGLQRELPACLPILVDRMGNEITRLTAVKAFSVIANSPLRIDLSCVLDHVVSELTAFLRKANRALRQATLGTLNSLVVTYGGQIGSSSYETIIAELSTLISDMDLHMTALALELCCTIMVDRKSIKNVGLAVRNKVLPQALVLIRSALLQGQALQALQRFFASLVQSANTSFDALLDSLISAAKPSQSGSLAKQALSSIAKCVAVLCLAAGDQKCASTIEMLKGILKDDSTTNSAKQHMALLCLGEIGRRKDLSNHVQIENIVIESFQSPFEEIKSAASYALGNIAVGNLSKYLPFILDQIDNQQKKQYLLLHSLKEVIVRQSVDHAGQSELQDSNIEKILALLFNHCESEEEGVRNVVAECLGKIALIEPKKLVPALKVRTSSPAANTRATVAIAIKYSIVERPEKIDEIMYSEISTFLMLIKDSDRHVRRAAVLALSTAAHNKPNLIKGLLPELLPLLYDQTVIKQELIRTVDLGPFKHVVDDGLELRKAAFECVDTLLDSCLDQVNPSSFIVPFLLSGLGDHYDVKMPCHLILSKLADKCPSAVLAVLDSIVEPIEKTISHKPKGDAVKQEVDRNEDMIRSALRSISSLSRISGSDYSIRFKNLMNKITTTPALAEKYNSVRSE

SEQ ID NO: 389 - DNA, 1119 bp, Sorghum bicolor
  misc_feature: Ceres ANNOT ID no. 6007500
  misc_feature: Encodes the peptide sequence at SEQ ID NO 390
atgcggttccccgtgcgcctcccgccgccatcaacgaccgcggccgcggccgctgccaccgtcggggccgttctcgccgccgtcgcgctccgccgctacctgtctgcttcccgccaccgcccacccgcccgcgtgtccatgtccgcggccgccggagccacagccaccacgctcgtggcgtacggcaagtcagcgcaggagcaggagctgctggcctccgcggccggttccgtcgccctaggggagggagagcaggccggtgaggtctccgtcgcgcttgcctacgatggcgcgggctttgacgccgccgtgtacatgagcgcgctccgggcgcgccggtttgggaggtggatgctctggacgcccaggattggttccacgcaggatcttatcgcgcggaactttgcaaagctcccggtgggcgttgtgtgcgttgccgacgtgcagttcaaagggagaggccgttcaaagaatgtgtgggaatcgccaccaggctgtctcatgttctctttcacatcacagatgcaggatgcacggaagttgccccttatgcaatatgttgtttgtctttctataactcaagctatccaggagctatgccgtgccaagggactaccagaacttgatgtgaggataaaatggcctaatgatctctatctgaaaggattaaaaattggtggcattctatgtacctcatcttatgaatccaaagtctacaatatttgtactggtgttggtttaaatattgacaatgagaaacctaccacatgcttgaatgctgcacttcaagaagcaaatcctacatcacccgtattgaatcgagaagacatactggcatacttcttcaataaattcgaaaatcttttcgagatcttcttggatcatggatttcaggttcttgaggagcaatactataactcatggcttcatagtggccagagagttgttgtacaagatgcacatgaaagcaattcaggcagtgtcgtcaccatccaggggttaacaccaactgggtacttatacgctatcggtgaggataacaaaagctatgagttgcacccagatggcaacagctttgatttcttcactggattggtgaggagaaagatggaagcttag

SEQ ID NO: 390 - protein, 372 aa, Sorghum bicolor
  misc_feature: Ceres ANNOT ID no. 6007500
  misc_feature (120)..(221): Pfam Id: BPL_LipA_LipB Pfam Desc: Biotin/lipoate A/B protein ligase family
  misc_feature (1)..(371): NCBI GI: 115444447 NCBI Desc: os02g0167000 [oryza sativa (japonica cultivar-group)]
  misc_feature (39)..(370): NCBI GI: 20197509 NCBI Desc: biotin holocarboxylase synthetase [arabidopsis thaliana]
  misc_feature (40)..(370): NCBI GI: 19698365 NCBI Desc: holocarboxylase synthetase 1 [arabidopsis thaliana]
  misc_feature (57)..(370): NCBI GI: 30693409 NCBI Desc: holocarboxylase synthetase 2 (hcs2.d) [arabidopsis thaliana]
  misc_feature (57)..(370): NCBI GI: 19698367 NCBI Desc: holocarboxylase synthetase hcs2.a [arabidopsis thaliana]
MRFPVRLPPPSTTAAAAAATVGAVLAAVALRRYLSASRHRPPARVSMSAAAGATATTLVAYGKSAQEQELLASAAGSVALGEGEQAGEVSVALAYDGAGFDAAVYMSALRARRFGRWMLWTPRIGSTQDLIARNFAKLPVGVVCVADVQFKGRGRSKNVWESPPGCLMFSFTSQMQDARKLPLMQYVVCLSITQAIQELCRAKGLPELDVRIKWPNDLYLKGLKIGGILCTSSYESKVYNICTGVGLNIDNEKPTTCLNAALQEANPTSPVLNREDILAYFFNKFENLFEIFLDHGFQVLEEQYYNSWLHSGQRVVVQDAHESNSGSVVTIQGLTPTGYLYAIGEDNKSYELHPDGNSFDFFTGLVRRKMEA

SEQ ID NO: 391 - DNA, 627 bp, Sorghum bicolor
  misc_feature: Ceres ANNOT ID no. 6007518
  misc_feature: Encodes the peptide sequence at SEQ ID NO 392
atggaaggtgtcgttgtcaggagggtcatcccttcggataacagttgcctcttcaatgctgtgggctacgtgatggagcacagcagaaataaggcttctgagctcagacaggtaatagcagcaacagttgctagtgatcccgagaaatacaacgaagcatttcttggcaaaccaaatgaagcctattgtgcttggattttggatcctgaaaagtggggaggggccattgaactttctattctatctgaatattacgggcgtgaaattgcggcatatgacattcagaccacccgctgtgatctctatggtcaggagaagaattatagtgaaagggccatgctcatttatgatggattgcattacgatgctcttgctatgtctccagctgaaggagcaccagaagaatttgaccagacaatcttccctgtcaatcataaccgttccattggtccagcagaaggccttgccctcaacttagtgaaggaggcgcaaaggaagaggagctatactgacaccgcaaacttcactctgcgctgtggggtgtgccagatcggcgtcatcggtcaaaaggaggccgtcgaacatgcgcaagccactggccatgtcaacttccaagaatacaaatga

SEQ ID NO: 392 - protein, 208 aa, Sorghum bicolor
  misc_feature: Ceres ANNOT ID no. 6007518
  misc_feature (11)..(121): Pfam Id: OTU Pfam Desc: OTU-like cysteine protease
  misc_feature (3)..(206): NCBI GI: 55245851 NCBI Desc: ensangp00000015110 [anopheles gambiae str. pest]
  misc_feature (4)..(206): NCBI GI: 55665023 NCBI Desc: novel protein [homo sapiens]
  misc_feature (3)..(206): NCBI GI: 24658155 NCBI Desc: cg4603-pa [drosophila melanogaster]
  misc_feature (3)..(206): NCBI GI: 17861926 NCBI Desc: gm14814p [drosophila melanogaster]
  misc_feature (4)..(206): NCBI GI: 47169474 NCBI Desc: tpa: hiv-induced protein-7-like protease [rattus norvegicus]
MEGVVVRRVIPSDNSCLFNAVGYVMEHSRNKASELRQVIAATVASDPEKYNEAFLGKPNEAYCAWILDPEKWGGAIELSILSEYYGREIAAYDIQTTRCDLYGQEKNYSERAMLIYDGLHYDALAMSPAEGAPEEFDQTIFPVNHNRSIGPAEGLALNLVKEAQRKRSYTDTANFTLRCGVCQIGVIGQKEAVEHAQATGHVNFQEYK

SEQ ID NO: 393 - DNA, 1455 bp, Sorghum bicolor
  misc_feature: Ceres ANNOT ID no. 6007520
  misc_feature: Encodes the peptide sequence at SEQ ID NO 394
atgtcaccgccacggccttcccctcccatcccggcgtgggcggcggccaactccctcttccgccgccaccgctgcctgcgtccactcctcctccccgccacctccctccgcgaccacctccccgttctgtcccactgcctcgtctcgggccttgcccgcaaccccttcgtggcgtcccgcctgctcctcgcatcctccagcctctccctccctttctccctcgccctcctcgcctatctcccggcctcctcgctctctccgttctccttcaactcgctcatccgcgcatccccgccgcgcctcgcggtccgcctgtttgaccaaatgcgcagccgaggcgtccccacggacccctacaccttgccgctcttgatcagcgcctgttcccgcagcagtcctacactgtgccagtctctgcatgggcagggcttccgtcttggctacaactgccacctcttcacccagacggcgctgatgaatgcttacctcgcgtgcgggtcggtggtcactgctcgcagggtgttcgaggaaatgccggtgaaggacgtggttgcgtggaccagcatggtgtctggttatgtagactccaggatgtacttggaagctgttgaggtgtttaacgagatgagaggtgctgatgatcttgtgtggcctaatgaggccacggtggtgtcgcttgcctctgcctgtgccggtctgggctcgatggagcatgcaaagggtctgcattcatatgtggagaagactggattagagggcgagttaattgtcaggaatgcattggttgacatgtatgggaagtgtggtagcattgaatctgcacgaagattgttttgtttgatgcgtgagaaggacttgcattcatggacagcaatgatttcagggctctcttgtcatggacatggtgaagaagcagttgaattgttcttcagcatgcgggaggaaggagtattaccagattcaactactttcattgtggttctttctgcctgtagccatgctggactggtagaagaggggatacgtatcttcaatttcatggagagtgagcacaatgtccccagggacatcaagcactatggttgcatggtggatcttttcagcagagcagggcttgttcaccgtgcttatgaattcattagcatgatgccttttgaaccgaacttggagattcttggggcactgctgagtgcatgcagtatcaataatgaactggagattggggagctcgtgctcaataagattgagtccatctgctcctacagaggaggtgctagtgtgcttctgtcaaatatatatgctaaccaaaatctgtggcatgaagtggatacccttagaaggaagataaggactgaagcaattgtcaggaagccacctggtcacagtttgtgtcatgggcagccaacgggctgcctgggccgacgggctgatagttcggcccagttatctttataa

SEQ ID NO: 394 - protein, 484 aa, Sorghum bicolor
  misc_feature: Ceres ANNOT ID no. 6007520
  misc_feature (184)..(218): Pfam Id: PPR Pfam Desc: PPR repeat
  misc_feature (287)..(321): Pfam Id: PPR Pfam Desc: PPR repeat
  misc_feature (85)..(463): NCBI GI: 145333528 NCBI Desc: binding [arabidopsis thaliana]
  misc_feature (7)..(460): NCBI GI: 42407498 NCBI Desc: pentatricopeptide (ppr) repeat-containing protein-like [oryza sativa (japonica cultivar-group)]
  misc_feature (102)..(458): NCBI GI: 140042117 NCBI Desc: tetratricopeptide-like helical [medicago truncatula]
  misc_feature (42)..(463): NCBI GI: 92872667 NCBI Desc: tetratricopeptide-like helical [medicago truncatula]
  misc_feature (135)..(463): NCBI GI: 145333540 NCBI Desc: binding [arabidopsis thaliana]
MSPPRPSPPIPAWAAANSLFRRHRCLRPLLLPATSLRDHLPVLSHCLVSGLARNPFVASRLLLASSSLSLPFSLALLAYLPASSLSPFSFNSLIRASPPRLAVRLFDQMRSRGVPTDPYTLPLLISACSRSSPTLCQSLHGQGFRLGYNCHLFTQTALMNAYLACGSVVTARRVFEEMPVKDVVAWTSMVSGYVDSRMYLEAVEVFNEMRGADDLVWPNEATVVSLASACAGLGSMEHAKGLHSYVEKTGLEGELIVRNALVDMYGKCGSIESARRLFCLMREKDLHSWTAMISGLSCHGHGEEAVELFFSMREEGVLPDSTTFIVVLSACSHAGLVEEGIRIFNFMESEHNVPRDIKHYGCMVDLFSRAGLVHRAYEFISMMPFEPNLEILGALLSACSINNELEIGELVLNKIESICSYRGGASVLLSNIYANQNLWHEVDTLRRKIRTEAIVRKPPGHSLCHGQPTGCLGRRADSSAQLSL

SEQ ID NO: 395 - DNA, 1209 bp, Sorghum bicolor
  misc_feature: Ceres ANNOT ID no. 6007523
  misc_feature: Encodes the peptide sequence at SEQ ID NO 396
atgagctggagacgaggcggaggaggtgatggaggaggggtgtcgaggaggtgggccgtcctgctctgcgtcggcagcttctgcctcggcctgctcttcaccaacagaatgtggacactgcctgaggcaagtgagattgctaggccaaatgcaaatgtagaggaaggcaacgtgccagttgctggggagtgtggttctaaaaaggtccaagaaaagcaagattacagagatattttacaagtccaagatagccatcatgatgtacaaacactagataagacgatagcaagcttagagacagagctctcagctgcaagatcactgcaagaatccctgctgaacggctcccctgttgctgaagagtttaaagtttccgaatcaattgggaggcgaaagtatcttatggtgatagggatcaataccgcgtttagcagtcgcaagaggagagattccatacgttacacctggatgccccaaggtgaaaagaggaaaaagcttgaagaagagaaggggatcattattcggttcgtcattggccacagtgctatatcaggtggaattgttgatagagcaattgaagcagaggacaggaaacatggggatttcatgaggatagatcatgttgaaggatatcttgcattgtcaggcaaaaccaagacctactttgctacagctgtttcactatgggatgctgacttttatgttaaggttgacgatgatgtgcatgtgaacatagcaacacttggacagattttgtcaaaacaagcattgaagccgagggtatatattggatgcatgaaatctggacctgtcctatctgaaaagggcgtgagatattatgaacctgagcactggaaatttggggaatcaggaaacaagtattttcggcatgctactggtcaattatatgctatttcaaaagatttggcaacctacatatctataaacaagcatatcctgcacaagtatataaatgaggatgtttcattaggatcttggttcattgggttagatgttgagcatattgatgatcggagactttgttgtggtactccgcctgattgcgaatggaaagctcaggcggggaacatttgcgccgcgtcattcgattggagatgcagcggcatatgcaactccgaggggaggatctgggaagtccacaacaagtgcgccgaaggcgagaaggcgctgtggaacgccactttctag

SEQ ID NO: 396 - protein, 402 aa, Sorghum bicolor
  misc_feature: Ceres ANNOT ID no. 6007523
  misc_feature (147)..(345): Pfam Id: Galactosyl_T Pfam Desc: Galactosyltransferase
  misc_feature (14)..(402): NCBI GI: 21360399 NCBI Desc: at1g05170/yup8h12_22 [arabidopsis thaliana]
  misc_feature (14)..(402): NCBI GI: 145323746 NCBI Desc: galactosyltransferase family protein [arabidopsis thaliana]
  misc_feature (14)..(402): NCBI GI: 21553519 NCBI Desc: avr9 elicitor response-like protein [arabidopsis thaliana]
  misc_feature (14)..(402): NCBI GI: 7269547 NCBI Desc: avr9 elicitor response like protein [arabidopsis thaliana]
  misc_feature (14)..(402): NCBI GI: 4138265 NCBI Desc: avr9 elicitor response protein [nicotiana tabacum]
  misc_feature: Useful for making plants with altered carbohydrate content
  misc_feature: Functional homolog of the protein sequence given in SEQ ID NO 13851
MSWRRGGGGDGGGVSRRWAVLLCVGSFCLGLLFTNRMWTLPEASEIARPNANVEEGNVPVAGECGSKKVQEKQDYRDILQVQDSHHDVQTLDKTIASLETELSAARSLQESLLNGSPVAEEFKVSESIGRRKYLMVIGINTAFSSRKRRDSIRYTWMPQGEKRKKLEEEKGIIIRFVIGHSAISGGIVDRAIEAEDRKHGDFMRIDHVEGYLALSGKTKTYFATAVSLWDADFYVKVDDDVHVNIATLGQILSKQALKPRVYIGCMKSGPVLSEKGVRYYEPEHWKFGESGNKYFRHATGQLYAISKDLATYISINKHILHKYINEDVSLGSWFIGLDVEHIDDRRLCCGTPPDCEWKAQAGNICAASFDWRCSGICNSEGRIWEVHNKCAEGEKALWNATF

SEQ ID NO: 397 - DNA, 1761 bp, Sorghum bicolor
  misc_feature: Ceres ANNOT ID no. 6007549
  misc_feature: Encodes the peptide sequence at SEQ ID NO 398
atgtcaccggcggcgaggcgcctcctgctcgccggagccgcccgtcgccgccgcttctccacggacgcagcggcgtcggacccgtcccggccgtcgcagcagctgcccaaggataagcggtgggacgcggtggtgatcggcggcggccacaacggcctcgtcgcggccgcctacctcgcccgcgcgggccgctccgtcgccgtgctggagcgccggggcatcctgggtggcgctgcggtctcagagtcggaccttgtccccggatttcgcttctcccgctgcagttacctcctcagcctcctccgccccgccatcctccgtgacctggagctggagaggcacggactgaagctgctgccacggagcccttcgtcgttcacgccatgccttgacggcagatacctgcttcttggtccggatgcggagctaaacttctcagagatcagcaagttctctaggaaggatgcagaggcatacccaagatacgaggagaagctggagaagttctgcaagctcatggactttgtcatagactcggctccacccgagctgaggcaggaggtccacttctctatggttgacaggatgaagcatagggtcgagaagtcagcattctggggccacctttttcggcatgtgatgcagcaggggcagacgaacatggtggaattctttgacctccttctttctccggcatcgaaaatcttgaacacctggtttgagagtgaggttttgaaggcgactcttgcaactgacgccgtgataggagctatggctggtgtgcacactccaggttctggatatgttctcctacaccatgtcatgggggagactggtggtcaacgtggtgtttgggcgtatgtcgaaggtggtatgggttcagtgtcatcggctataagcaaagcagctcttgaagcaggagtgcagattgtaacaaatgccgaggtttcccaagtaatggttaataatagtggaagggtaaaaggggtagctttggctgatggaacagtggtgcactcgccagttgttctctcaaatgccactccatacaaaacatttgtggacctagtaccttctactgttcttccaaaggacttcctctgtgcaattaaggcagcagattacagctctgcaacaacaaagattaatgtagctgtcgacaagctgccacagttccagtgttgcaaagacatcaaccctgaaggtggtccagagcacatgggcaccatacacattgggtccgaaagcatggaggaaattgaccttgcatacagggaagcagcaggcggcatctcatccaaaagacctgttatagaaatgacaattccttctgtcttggataagaccatctctccaccaggtcagcatgttattaatctttttgttcagtacacaccctacaaactttcagaaggcagttggcaggattctaatgtcagaaaagcctttgttgagcgatgcttttctttgattgatgaatatgcaccgggctttagctcatcggtggtaggctatgatatgctgactccacctgatcttgaaagagagtttggtctaacagggggcaacattttccacggtgcaatgggcttagattctcttttcctcatgaggcccgccaagggatggtcagattacagaactcctgtgaaggggctgtacctctgcgggagtggcgcacacccaggtggtggggtgatgggtgcgccaggacgcaacgctgccaccattgttttggaggacctgatgaaggggaaatag

SEQ ID NO: 398 - protein, 586 aa, Sorghum bicolor
  misc_feature: Ceres ANNOT ID no. 6007549
  misc_feature (42)..(571): Pfam Id: DAO Pfam Desc: FAD dependent oxidoreductase
  misc_feature (52)..(579): Pfam Id: Amino_oxidase Pfam Desc: Flavin containing amine oxidoreductase
  misc_feature (30)..(584): NCBI GI: 18423042 NCBI Desc: amine oxidase-related [arabidopsis thaliana]
  misc_feature (30)..(584): NCBI GI: 29028742 NCBI Desc: at5g49550/k6m13_10 [arabidopsis thaliana]
  misc_feature (30)..(577): NCBI GI: 10177621 NCBI Desc: phytoene dehydrogenase-like [arabidopsis thaliana]
  misc_feature (41)..(582): NCBI GI: 14249308 NCBI Desc: chromosome 10 open reading frame 33 [homo sapiens]
  misc_feature (41)..(582): NCBI GI: 123993485 NCBI Desc: chromosome 10 open reading frame 33 [synthetic construct]
MSPAARRLLLAGAARRRRFSTDAAASDPSRPSQQLPKDKRWDAVVIGGGHNGLVAAAYLARAGRSVAVLERRGILGGAAVSESDLVPGFRFSRCSYLLSLLRPAILRDLELERHGLKLLPRSPSSFTPCLDGRYLLLGPDAELNFSEISKFSRKDAEAYPRYEEKLEKFCKLMDFVIDSAPPELRQEVHFSMVDRMKHRVEKSAFWGHLFRHVMQQGQTNMVEFFDLLLSPASKILNTWFESEVLKATLATDAVIGAMAGVHTPGSGYVLLHHVMGETGGQRGVWAYVEGGMGSVSSAISKAALEAGVQIVTNAEVSQVMVNNSGRVKGVALADGTVVHSPVVLSNATPYKTFVDLVPSTVLPKDFLCAIKAADYSSATTKINVAVDKLPQFQCCKDINPEGGPEHMGTIHIGSESMEEIDLAYREAAGGISSKRPVIEMTIPSVLDKTISPPGQHVINLFVQYTPYKLSEGSWQDSNVRKAFVERCFSLIDEYAPGFSSSVVGYDMLTPPDLEREFGLTGGNIFHGAMGLDSLFLMRPAKGWSDYRTPVKGLYLCGSGAHPGGGVMGAPGRNAATIVLEDLMKGK

SEQ ID NO: 399 - DNA, 1089 bp, Sorghum bicolor
  misc_feature: Ceres ANNOT ID no. 6007550
  misc_feature: Encodes the peptide sequence at SEQ ID NO 400
atggagggaggcgggagcgcggcgaaagggccggtggtggtgacgggggcgtcgggcttcgtcggctcctggctcgtcatgaagctcctccaggccggctacaccgtccgggcgaccgtgcgcgatcccgcgaacgctgccaagacgaagccattgctggaccttcccggagcaacggagcgcctgtccatatggaaagccgacctggcggaggaaggcagcttcgacgacgccatcaggggctgcaccggcgtcttccacgtcgccacgcccttggacttcgagtcccaagaccccgagaacgaggtgatcaagccggcggtggaaggggtgatcagcatcttgcgagcctgcaaggaggccgccgccgccggcggcggcaccgtgcgccgcgtcgtcttcacttcctccgccgggacgtgcagcgtcgaggagcggcagaggcccgtctacggcgacgacgactggagcgacgtcgatttctgccgtcgcgccaagatgaccgggtggatgtacttcgtgtccaagaccctggcggagaaggcggcgctggcgtacgcggcggagcacggcgtggacctcgtcagcatcatcccgacgctcgtcgtcggccctttcgtcagctccggcatgccgcccagcctcgtcaccgcgctggcgctcgtcacggggaacgaggcacactactcgatcctgaagcaggtgcagttcgtccacctcgacgacctctgcgacgccgagatcttcctcttcgagcacccggccgccgccgccggacgctacgtctgctcctcgcacgatgccaccatccacggcctcgccgccatgctcagggataggtaccccgagtacgacatcccgcagaggttccctgggatcgaggacgacctccagccagtgcgcttctcgtccaagaagctcctagaccatgggttcactttcaagtacacggcaatggaggacatgttcgacgcagccatccggacgtgccgggagaagggcctcatccccctcgccactgccggaggcggaggggacgactctgcctcagtgcgcgcacctggcgagacggatgtgacgattgtttga

SEQ ID NO: 400 - protein, 362 aa, Sorghum bicolor
  misc_feature: Ceres ANNOT ID no. 6007550
  misc_feature (12)..(264): Pfam Id: Epimerase Pfam Desc: NAD dependent epimerase/dehydratase family
  misc_feature (14)..(231): Pfam Id: NAD_binding_4 Pfam Desc: Male sterility protein
  misc_feature (13)..(292): Pfam Id: 3Beta_HSD Pfam Desc: 3-beta hydroxysteroid dehydrogenase/isomerase family
  misc_feature (10)..(151): Pfam Id: adh_short Pfam Desc: short chain dehydrogenase
  misc_feature (4)..(360): NCBI GI: 3287294 NCBI Desc: dihydroflavonol4-reductase [zea mays]
  misc_feature (4)..(360): NCBI GI: 3287298 NCBI Desc: dihydroflavonol4-reductase [zea mays]
  misc_feature (4)..(344): NCBI GI: 2735842 NCBI Desc: nadph-dependent reductase a1-a [sorghum bicolor]
  misc_feature (1)..(361): NCBI GI: 78172239 NCBI Desc: nadph-dependent reductase [zea mays]
  misc_feature (1)..(361): NCBI GI: 20385155 NCBI Desc: nadph-dependent reductase [zea mays]
  misc_feature (1)..(361): SWISSPROT Homolog: EC 1.1.1.219 Dihydroflavonol-4-reductase
MEGGGSAAKGPVVVTGASGFVGSWLVMKLLQAGYTVRATVRDPANAAKTKPLLDLPGATERLSIWKADLAEEGSFDDAIRGCTGVFHVATPLDFESQDPENEVIKPAVEGVISILRACKEAAAAGGGTVRRVVFTSSAGTCSVEERQRPVYGDDDWSDVDFCRRAKMTGWMYFVSKTLAEKAALAYAAEHGVDLVSIIPTLVVGPFVSSGMPPSLVTALALVTGNEAHYSILKQVQFVHLDDLCDAEIFLFEHPAAAAGRYVCSSHDATIHGLAAMLRDRYPEYDIPQRFPGIEDDLQPVRFSSKKLLDHGFTFKYTAMEDMFDAAIRTCREKGLIPLATAGGGGDDSASVRAPGETDVTIV

SEQ ID NO: 401 - DNA, 1371 bp, Sorghum bicolor
  misc_feature: Ceres ANNOT ID no. 6007553
  misc_feature: Encodes the peptide sequence at SEQ ID NO 402
atgcgcgatcgatcggttgagcgcgaactcccgagccgcgagcgcggggatcggccgccgcccgggatgctgggcccgccgcgccgcgggccggcgtacaagacgaagctgtgcgcgctgtggcagcgcggcggctgttcccgcgacacctgcagcttcgcgcacggccacgccgagctgcgccggttccccggctcccgcacctcgttcccgccccgcgccgggagaagagattatagaggtggtgacttcagagataggtttgataggaggcgctcgcctcataggaggcactcccctgacagagattccagggggcatcgttcccttcatgaccgaagaccaaattcccaagaaagggaatctagctattcacggtctcccagtaggaagagtgaaaggaggcatgagaagaagcctgatgatggagaaactaattcatctaggagtttgagtgtctctgacaataacgatgatagaaaaaaggagacactcttaagtggtgatgataaagaggatcatgaaatacagctgaaacaaataagacaggatatggagcttttgcgcgatgataaatctcacttggagataattttggatcagaagaatgctgaagtgcgcaagatttctagcagagtaaatgatcttgatctgcagctaaggaaggagaaagaggaatgccacaggatgacatcaaaaatgaaaaagttcatcaaagcccatactcgctttttgaaagcacaggaagaattgaaaaggtcacaagctcgttttgagagacttggtgatttgcttgcttcagatattctgaagcgcggtgctaatgaagaagtttccagtatcaatgttgatgaagatccaaatggtccttatgaaaggagcccaaatgctgctacagctaagaagagatcaatactatactcaacaagtgaagaagcgaaagctgtgaagaaaagaagagaacgagactctgacacaactaggccagataaatataggtcagaagctactattgcagaatttgaaaaaccaatcaagggaactgagccaacaaaatctttatatttgaagaagaaactgtgggaagatgaaaaggataagataggcaattttgtttcctcagccaacactgacaaggtcaaagaatctccagtcaaacatgttttgccctccactggtatggctgctcatgcagtggatgatctgtttgaagctgttgaactggaggatagacatgatccaataaacgcatcaatagaaaatgatgctgatgacgaaactaggtcgcctgttatgcccccacaaccaccaccagtggttaattcttacgagcagtatgaggctgatgatgaggaagtcgacgtggactaa

SEQ ID NO: 402 - protein, 456 aa, Sorghum bicolor
  misc_feature: Ceres ANNOT ID no. 6007553
  misc_feature (33)..(57): Pfam Id: zf-CCCH Pfam Desc: Zinc finger C-x8-C-x5-C-x3-H type (and similar)
  misc_feature (171)..(456): NCBI GI: 42733472 NCBI Desc: bri1-kd interacting protein 105 [oryza sativa (japonica cultivar-group)]
  misc_feature (23)..(75): NCBI GI: 115469568 NCBI Desc: os06g0682800 [oryza sativa (japonica cultivar-group)]
  misc_feature (90)..(415): NCBI GI: 89303210 NCBI Desc: inositol monophosphatase family protein [tetrahymena thermophila sb210]
  misc_feature (101)..(446): NCBI GI: 24641414 NCBI Desc: cg32662-pa [drosophila melanogaster]
  misc_feature (65)..(163): NCBI GI: 431953 NCBI Desc: nucleic acid binding protein [homo sapiens]
MRDRSVERELPSRERGDRPPPGMLGPPRRGPAYKTKLCALWQRGGCSRDTCSFAHGHAELRRFPGSRTSFPPRAGRRDYRGGDFRDRFDRRRSPHRRHSPDRDSRGHRSLHDRRPNSQERESSYSRSPSRKSERRHEKKPDDGETNSSRSLSVSDNNDDRKKETLLSGDDKEDHEIQLKQIRQDMELLRDDKSHLEIILDQKNAEVRKISSRVNDLDLQLRKEKEECHRMTSKMKKFIKAHTRFLKAQEELKRSQARFERLGDLLASDILKRGANEEVSSINVDEDPNGPYERSPNAATAKKRSILYSTSEEAKAVKKRRERDSDTTRPDKYRSEATIAEFEKPIKGTEPTKSLYLKKKLWEDEKDKIGNFVSSANTDKVKESPVKHVLPSTGMAAHAVDDLFEAVELEDRHDPINASIENDADDETRSPVMPPQPPPVVNSYEQYEADDEEVDVD

SEQ ID NO: 403 - DNA, 1566 bp, Sorghum bicolor
  misc_feature: Ceres ANNOT ID no. 6007559
  misc_feature: Encodes the peptide sequence at SEQ ID NO 404
atggcgggagccgtgatcgtgcaccaccacacgaggtacaagacgtaccccggcgaggtcaccggcatcgtcttcttctcctgcctcatcgcctccttcgccggatgcatcttcggctatgacatcggcctcacctccgggttgacgtcgtcggagccatacatggtcaagttcttcccgtccatctacgaggagatgaagaagcaggtggtcgtcaaccagtactgcaagttcgacagccagatgctgacgctgttctgctcctccctcttcctctccgcgacggtgtgcgccttcttcgccggcccaatgacccgttccttcggacgcaagtggaccctgttctccgccgcgtccgcgtacgtggccggcgcttgcatcggcggcgtgtccgtgaacttccccatgctgctcaccggccggattctcgtcggcgccggcgtcggcatctccattcaagcggctccgctgtacatctcggagatggcgccggcgcagcagcgcgggatgctcaacatcctgttccagctgatgatcacgattgggatcctgacggcgaacatgaccaactacctggggtccaaggtcccgggcggctggggctggcgcatcgccgtggcgttcggcgccatcccggccgccgtgatcgcgctgggcgcgctggcgatcccggacaccccgacgtcgctgatcgagcgcggcgacacggcgacggcgcgcaagacgctgctccagatccgcggcgtcggcgacgtccgcgaggagttcgacgacctgtcgacggcgagcgaggacgccaaggccgtggagtgcccgtggcgggagctcttcttcggcggcaagtacaagccgcagctgacgttcgcgctgctcatccctttcttccagcagctcaccggcatcaacgtcatcatgttctacgcgccggtgctcttcaagaccgtcgggttcaagcagaacgccaccctcgtgtcctccgtcatcaccggcctcgtcaacgtcttctccaccttcgtctccaccgtcaccgccgacaaggtcggccgccgcgcgctcttcctccaaggcggcacccagatgatcatctcacagatccttgtggggacgttcatcgggctgcagttcggcatgagcgggacgggggacatctcggagcagtacgccatgtgcatcgtgctgttcgtgtgcgtgtacgtggccggcttcgcgtggtcgtggggtcccatggggtggctgatccccagcgagatctacccgctggccgtccggaacgcggcgatgagcatcacggtggccgtcaacatgttcttcacggccttcatcgggcagatcttcctcacgctgctctgccacctccgcttcggcctcttctacttcttcggcgcctgggtgctgctcatgacgctcttcatcgccatgctgctcccggagaccaagaacgtgcccatcgaggagatggcccacgtctggaagaagcactggttctggcgcaagttcgtcatcgacaccagcaatgacgcccgcagcgccgagatgaggaagaggatagcactagagatgagctga

SEQ ID NO: 404 - protein, 521 aa, Sorghum bicolor
  misc_feature: Ceres ANNOT ID no. 6007559
  misc_feature (27)..(490): Pfam Id: Sugar_tr Pfam Desc: Sugar (and other) transporter
  misc_feature (45)..(442): Pfam Id: MFS_1 Pfam Desc: Major Facilitator Superfamily
  misc_feature (1)..(502): NCBI GI: 33694268 NCBI Desc: monosaccharide transporter 6 [oryza sativa (japonica cultivar-group)]
  misc_feature (1)..(502): NCBI GI: 50953794 NCBI Desc: monosaccharide transport protein 1 [zea mays]
  misc_feature (1)..(502): NCBI GI: 11991114 NCBI Desc: monosaccharide transporter 3 [oryza sativa]
  misc_feature (14)..(504): NCBI GI: 4138724 NCBI Desc: hexose transporter [vitis vinifera]
  misc_feature (14)..(512): NCBI GI: 116294315 NCBI Desc: monosaccharide transporter 2 [olea europaea]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MAGAVIVHHHTRYKTYPGEVTGIVFFSCLIASFAGCIFGYDIGLTSGLTSSEPYMVKFFPSIYEEMKKQVVVNQYCKFDSQMLTLFCSSLFLSATVCAFFAGPMTRSFGRKWTLFSAASAYVAGACIGGVSVNFPMLLTGRILVGAGVGISIQAAPLYISEMAPAQQRGMLNILFQLMITIGILTANMTNYLGSKVPGGWGWRIAVAFGAIPAAVIALGALAIPDTPTSLIERGDTATARKTLLQIRGVGDVREEFDDLSTASEDAKAVECPWRELFFGGKYKPQLTFALLIPFFQQLTGINVIMFYAPVLFKTVGFKQNATLVSSVITGLVNVFSTFVSTVTADKVGRRALFLQGGTQMIISQILVGTFIGLQFGMSGTGDISEQYAMCIVLFVCVYVAGFAWSWGPMGWLIPSEIYPLAVRNAAMSITVAVNMFFTAFIGQIFLTLLCHLRFGLFYFFGAWVLLMTLFIAMLLPETKNVPIEEMAHVWKKHWFWRKFVIDTSNDARSAEMRKRIALEMS

SEQ ID NO: 405 - DNA, 3324 bp, Sorghum bicolor
  misc_feature: Ceres ANNOT ID no. 6007560
  misc_feature: Encodes the peptide sequence at SEQ ID NO 406
atgagctcaggcgggcgcggcggcaagcggcggggccccccgccccccgctccctccggggcggcggtgaagagggctaaccccagccccggcatgccgcagcctcctcctcccgcggcggcggcggcggaggaggacatgatggacgaagacgtgttcctggatgagtccatcctggcggaggacgaggcggcgctgctgatgctccagcgtgacgaggccctcgcgtcccgcctcgcgcggtggaagcgccccgcactccccgccgacctcgccgccgggtgctcccgcaccgtcgcttttcagcagttggaaatagattatgttattgatgagagccacaaagaattgctccccaactcatctggttcagcagccatactcaggatttttggtgttaccagagaaggtcacagcatatgctgtcaggtgcatggatttgagccatatttctatattggctgtccttcagggatgggtcctgatgatatatcacactttcaccaaacactagaggggaggatgaaggagtcaaatagaagcagcaatgttccaaggttcgtgaagagagttgaacttgtgcagaagcagacaattatgcattaccaaacgcagcaatctcagcctttcctcaagatagtagtcgctttgcctaccatggttgctagctgtcgtggtatcctggaaaggggaataatgattgaaggccttggctcaaagagtttcctgacatatgaaagcaacattctttttgcccttcgtttcatgattgattgcaatattgttggtggcaactggattgaacttcctgctgggaaatacaggaaagcagcccgtgtgatgtcctattgtcagctagagctagattgcctatactcagatctggtaagtcatgctgctgaaggagaatattctaagatggccccgtttcgcatattaagttttgatattgaatgtgctggtcgcaaaggtcatttcccagaaccaactcatgatcctgttattcaggttgagctcattattcatatagctaacttggttacacatcaaggagaaggtcaaccttttgtacagaatgtcatgactcttaaatcatgctctcccattgtgggagtcgatgttatgtcatttgatgcagagagagatattctacttgcatggaggaatttcatacgtgaagtggatcctgatatcataattggatacaatatttgcaaatttgacatgccctatcttattgagagggctgaggttctcaagatagcggagtttccaatacttggccgaatcagaaatagtcgtgttcgtgtccgtgatacgaccttttcctcgagacaatatggtgtgcgtgaaagtaaggatgttactattgaaggaagagtgcaatttgatctcctgcaggctatgcaacgggattacaagctgagttcttattcattaaactctgtatcggcacacttccttggggaacaaaaagaagatgttcatcattcaattatatctgatcttcaaaatggaaacccagagacacgaaggcggctggcagtctattgcttgaaggatgcttatcttcctcaaagactgttggacaaattgttgtatatctacaattatgtggaaatggcgagggtcactggtgttcccatttcatttttactttcaaggggacaaagtattaaggtcctctcacaactactcaggaaagcaaaacagaaaaaccttgttataccaaatataaagggtcaagggtccgggcaagatacctttgagggtgcaactgttttggaggcaagggctggattttatgagaagcccattgcaactttggacttcgcttctttgtatccatccatcatgatggcatataacctctgctactgtactttggtgccccctgaggacgctcgtaaactcaacttacctccagaaagcatcaataaaaccccatctggtgaaatatttgtgaaaccagaactacagaagggtatacttcctgagatccttgaagaattattagcagctcggaaaagggcaaaagcagatttaaaggaagcgaaggacccactcgaaagggctgttcttgatggtcgtcagcttgcactgaaaataagtgcaaattcagtttatggtttcactggagcaactgttggtcagttaccttgcttagagatttcttcaagcgtgaccagctatggacgacagatgattgaacatacaaaaaagcttgttgaagataaattcacaacagtaggaggttatgagcataatgcagaggtaatttacggggacactgattctgtgatggtacagttcggtgtttctacggttgaagatgcaatgaagttaggaagagaagctgcagattatattagtggaacctttaccaagcccatcaaactggagtttgagaaggtctattttccttaccttctaatcagcaagaagagatatgctggtttgtactggacaaatcctgagaaatttgacaaaatggatgcaaaaggtattgaaactgtgagaagggacaactgtttactggtaaagaacctggttactgagtgtcttcataaaatactggtggaccgtgatgttcctggtgcagtccaatatgtcaagaacaccatatctgatctattaatgaatcgtgtcgacttgtctcttcttgtcataacaaagggtttgacaaaaacgggagaagattacgcggtaaaagctgctcatgtggagctggctgagaggatgcgaaagagagatccagctactgcacctactgttggtgaccgtgttccttatgttataattaaagcagcaaaaggggcaaaggcatatgagaaatcagaagatcctatttatgttttggacaataatatacccattgatcctcaatactaccttgagaaccaaatcagcaagccacttttgaggatctttgagccaattctgaagaatgccagcaaagagttgcttcatggaagccacaccagatctgtttcaatctcaactccttcaaatagcgggataatgaaatttgcaaagaaacaattaacttgccttgggtgcaaagctgttatcagtggtgccagtcagacactttgctcacattgcaagggaagagaagcagagttatactgcaaaacagtagcaaatgtttctgacctggagatgctctttgggaggctatggacgcaatgccaggagtgccaaggatctctgcaccaggacgttctctgcacaagtcgggattgtccgattttctatcggcgaaggaaggcacagaaggatatggcggaagctaggctgcagcttgaccggtgggacttctga

SEQ ID NO: 406 - protein, 1107 aa, Sorghum bicolor
  misc_feature: Ceres ANNOT ID no. 6007560
  misc_feature (556)..(1014): Pfam Id: DNA_pol_B Pfam Desc: DNA polymerase family B
  misc_feature (133)..(483): Pfam Id: DNA_pol_B_exo Pfam Desc: DNA polymerase family B, exonuclease domain
  misc_feature (1)..(1107): NCBI GI: 62734232 NCBI Desc: dna polymerase delta catalytic subunit (ec 2.7.7.7). [oryza sativa (japonica cultivar-group)]
  misc_feature (1)..(1107): NCBI GI: 13124219 NCBI Desc: dna polymerase delta catalytic subunit
  misc_feature (9)..(1107): NCBI GI: 76262800 NCBI Desc: dna-directed dna polymerase delta catalytic subunit [arabidopsis thaliana]
  misc_feature (44)..(1044): NCBI GI: 2895198 NCBI Desc: dna polymerase delta [glycine max]
  misc_feature (21)..(1106): NCBI GI: 81157941 NCBI Desc: dna polymerase delta subunit [chlorella pyrenoidosa]
  misc_feature (1)..(1107): SWISSPROT Homolog: EC 2.7.7.7 DNA polymerase delta catalytic subunit
MSSGGRGGKRRGPPPPAPSGAAVKRANPSPGMPQPPPPAAAAAEEDMMDEDVFLDESILAEDEAALLMLQRDEALASRLARWKRPALPADLAAGCSRTVAFQQLEIDYVIDESHKELLPNSSGSAAILRIFGVTREGHSICCQVHGFEPYFYIGCPSGMGPDDISHFHQTLEGRMKESNRSSNVPRFVKRVELVQKQTIMHYQTQQSQPFLKIVVALPTMVASCRGILERGIMIEGLGSKSFLTYESNILFALRFMIDCNIVGGNWIELPAGKYRKAARVMSYCQLELDCLYSDLVSHAAEGEYSKMAPFRILSFDIECAGRKGHFPEPTHDPVIQVELIIHIANLVTHQGEGQPFVQNVMTLKSCSPIVGVDVMSFDAERDILLAWRNFIREVDPDIIIGYNICKFDMPYLIERAEVLKIAEFPILGRIRNSRVRVRDTTFSSRQYGVRESKDVTIEGRVQFDLLQAMQRDYKLSSYSLNSVSAHFLGEQKEDVHHSIISDLQNGNPETRRRLAVYCLKDAYLPQRLLDKLLYIYNYVEMARVTGVPISFLLSRGQSIKVLSQLLRKAKQKNLVIPNIKGQGSGQDTFEGATVLEARAGFYEKPIATLDFASLYPSIMMAYNLCYCTLVPPEDARKLNLPPESINKTPSGEIFVKPELQKGILPEILEELLAARKRAKADLKEAKDPLERAVLDGRQLALKISANSVYGFTGATVGQLPCLEISSSVTSYGRQMIEHTKKLVEDKFTTVGGYEHNAEVIYGDTDSVMVQFGVSTVEDAMKLGREAADYISGTFTKPIKLEFEKVYFPYLLISKKRYAGLYWTNPEKFDKMDAKGIETVRRDNCLLVKNLVTECLHKILVDRDVPGAVQYVKNTISDLLMNRVDLSLLVITKGLTKTGEDYAVKAAHVELAERMRKRDPATAPTVGDRVPYVIIKAAKGAKAYEKSEDPIYVLDNNIPIDPQYYLENQISKPLLRIFEPILKNASKELLHGSHTRSVSISTPSNSGIMKFAKKQLTCLGCKAVISGASQTLCSHCKGREAELYCKTVANVSDLEMLFGRLWTQCQECQGSLHQDVLCTSRDCPIFYRRRKAQKDMAEARLQLDRWDF

SEQ ID NO: 407 - DNA, 1506 bp, Sorghum bicolor
  misc_feature: Ceres ANNOT ID no. 6007561
  misc_feature: Encodes the peptide sequence at SEQ ID NO 408
atggcggggcacggcgagaagcggcgccggacgggaggggcccacgaggaggagccggaggaggaggaccgcatctcggaccttcccgacgtactgcgcctgcagattctcagcctgctgccgctcaaatcggccatccgcaccggcgcgctctcctcgcggtggcgccgcctctgggcgtaccgctggccggagccgtcctcggttaccatccgcctcccgcccggcggcggcgcggcgggggcgggggcggtggcggctgcggcggcgcgcgcggaggcgctcgcggggatcgaccgccgcgggcgccgccgcgtcgacggcttctccctctccttccatggcgggcagctcacgcaggcggacctcaaccgctgcgtccactacgccgcggcgtgcgaggccgaggacctgcacctccgcgtcgacggcggcgcgggcgccggccggggctcccgcggtggcacgcgccgccccgggatgctctccgtgcagttccccgtggggagcccgctgctcgcgcgcctgtcggtgcgcgggctcaacctcacggccgtcaacaacgccatggtcgtcacgctcgaggtgatccacctccactccgtcttcctcaccgacgccgcgctgcgccggatggtcgccgcctgcccccgcctccgggagctcgacctccgttactgccgccgcctgcgccgcgtcgacttcagcaacgtcggggtgcccaacctcaggagcttcaccgtcgtcgactgctcccgcaccaccgagctgcgggtcccggtcgcgctccgcctccggtccttccgcttcagcggcgccttcctctccagcaacatcctctctggcgccaagggctctcttgagcatctctacctctgctctggcgggccagagaccggccttcccacaaccaacttgctgtacgcagttcctcgcctatcgaacctcactgtcctcaccctctgcagcattgccctccagtatgtttcttccacagccaaggctgtaacggagagcaacctgcatagtctgagggagctccatttgctcatgttcgggatggccaactccaaccttgctgacatctatagcttcctcaagacctgcccgtgtcctcagttggagcgcctctttgtgcagctcccgacaaataccggtgatgcattcacggagaatttcttgaaggtggcggaggaggacccaccaaaaggtggattagaaaacctttgcttagccaagatgacaaatttcaaggggcaccgtaatgagatgcaactagtaggatttctgcttagaaagtctagtagtctgaagaaactatttctgattgctcctaaggaggatcaccctcaaggactccgcaagattcagtcagatatgctgcctgatcttctaaaaaaagaaatattgcatctggaaagagcttcagcaaatacccagatatttttcagtgagcctgatgctcagacccagccattgcattcggaggtctttgtcaggttttag

SEQ ID NO: 408 - protein, 501 aa, Sorghum bicolor
  misc_feature: Ceres ANNOT ID no. 6007561
  misc_feature (23)..(70): Pfam Id: F-box Pfam Desc: F-box domain
  misc_feature (4)..(76): NCBI GI: 51536004 NCBI Desc: f-box protein-like protein [oryza sativa (japonica cultivar-group)]
  misc_feature (193)..(349): NCBI GI: 116309161 NCBI Desc: osigba0135a16.3 [oryza sativa (indica cultivar-group)]
  misc_feature (22)..(61): NCBI GI: 15239560 NCBI Desc: f-box family protein [arabidopsis thaliana]
  misc_feature (158)..(448): NCBI GI: 87162656 NCBI Desc: cyclin-like f-box; fbd [medicago truncatula]
  misc_feature (22)..(138): NCBI GI: 53793451 NCBI Desc: ribosomal rna apurinic site specific lyase-like [oryza sativa (japonica cultivar-group)]
MAGHGEKRRRTGGAHEEEPEEEDRISDLPDVLRLQILSLLPLKSAIRTGALSSRWRRLWAYRWPEPSSVTIRLPPGGGAAGAGAVAAAAARAEALAGIDRRGRRRVDGFSLSFHGGQLTQADLNRCVHYAAACEAEDLHLRVDGGAGAGRGSRGGTRRPGMLSVQFPVGSPLLARLSVRGLNLTAVNNAMVVTLEVIHLHSVFLTDAALRRMVAACPRLRELDLRYCRRLRRVDFSNVGVPNLRSFTVVDCSRTTELRVPVALRLRSFRFSGAFLSSNILSGAKGSLEHLYLCSGGPETGLPTTNLLYAVPRLSNLTVLTLCSIALQYVSSTAKAVTESNLHSLRELHLLMFGMANSNLADIYSFLKTCPCPQLERLFVQLPTNTGDAFTENFLKVAEEDPPKGGLENLCLAKMTNFKGHRNEMQLVGFLLRKSSSLKKLFLIAPKEDHPQGLRKIQSDMLPDLLKKEILHLERASANTQIFFSEPDAQTQPLHSEVFVRF

SEQ ID NO: 409 - DNA, 198 bp, Sorghum bicolor
  misc_feature: Ceres ANNOT ID no. 6007567
  misc_feature: Encodes the peptide sequence at SEQ ID NO 410
atgtcaggcggcgggaagcagggcggcaagcagaagcccctcaaggcccccaaggcacccaagaaggagtacactgatctggagaaccagaggaagaagaaggaggaggagaaggccctcaaggagctgagggcaaaggcggcgcagaagggcccgctcggaggcgctggcctcaagaagagcagcggcaagaaatga

SEQ ID NO: 410 - protein, 65 aa, Sorghum bicolor
  misc_feature: Ceres ANNOT ID no. 6007567
  misc_feature (4)..(65): Pfam Id: TMA7 Pfam Desc: Translation machinery associated TMA7
  misc_feature (5)..(65): NCBI GI: 24638908 NCBI Desc: cg13364-pa [drosophila melanogaster]
MSGGGKQGGKQKPLKAPKAPKKEYTDLENQRKKKEEEKALKELRAKAAQKGPLGGAGLKKSSGKK

SEQ ID NO: 411 - DNA, 693 bp, Sorghum bicolor
  misc_feature: Ceres ANNOT ID no. 6007581
  misc_feature: Encodes the peptide sequence at SEQ ID NO 412
atgctgcggctctcccgcttcctcccctccgcctccaggagaggttttgatctaaaagaatctcttttgagtggttcactgacattccaacaagctgtttcaacttcagcagcaaatattgatgataacttgtctagcaaaaagtatgcaagctatactgtgttcaagggaaaggctgcactttctatacaacctatactgccaagtttcagcaaattagaatccggtggatctcgagtgagcagaaatggatcaatcatgttgaccttctttcctgctgttggaccaaggaagtatgactttacaaagaaacagctctttgctctgtcaccaaccgaggttggaagcttgataagtcttgggcctgctgaatcctgtgaatttttccatgacccatccatgaaatcaagtaatgaaggaatggtgaaaaaatcgctgtcgatcactccacttggcagtgacagtggatactttgttaatataactgttgtgaacagcgtggagaagactaatgatcgtctttcagtccctatcacaaaagctgagtttgctgtgatgcgcacaactctgagttttgcattgccgcacatcatgggttgggatcaggctttaaccaatcaccacccatctcctccagctatcagcaagcccagggtagagcgtccacacccggattctgaatgggaaaggtga

SEQ ID NO: 412 - protein, 230 aa, Sorghum bicolor
  misc_feature: Ceres ANNOT ID no. 6007581
  misc_feature (53)..(191): Pfam Id: Whirly Pfam Desc: Whirly transcription factor
  misc_feature (47)..(230): NCBI GI: 9651810 NCBI Desc: dna-binding protein p24 [solanum tuberosum]
  misc_feature (47)..(223): NCBI GI: 21730639 NCBI Desc: chain c, structure of the plant transcriptional regulator pbf-2
  misc_feature (47)..(209): NCBI GI: 21730640 NCBI Desc: chain d, structure of the plant transcriptional regulator pbf-2
  misc_feature (47)..(209): NCBI GI: 21730638 NCBI Desc: chain b, structure of the plant transcriptional regulator pbf-2
  misc_feature (47)..(209): NCBI GI: 21730637 NCBI Desc: chain a, structure of the plant transcriptional regulator pbf-2
MLRLSRFLPSASRRGFDLKESLLSGSLTFQQAVSTSAANIDDNLSSKKYASYTVFKGKAALSIQPILPSFSKLESGGSRVSRNGSIMLTFFPAVGPRKYDFTKKQLFALSPTEVGSLISLGPAESCEFFHDPSMKSSNEGMVKKSLSITPLGSDSGYFVNITVVNSVEKTNDRLSVPITKAEFAVMRTTLSFALPHIMGWDQALTNHHPSPPAISKPRVERPHPDSEWER

SEQ ID NO: 413 - DNA, 1038 bp, Sorghum bicolor
  misc_feature: Ceres ANNOT ID no. 6007582
  misc_feature: Encodes the peptide sequence at SEQ ID NO 414
atgggctccctcccggtgccagcctcggcggaatgcgccccgcaggggcgcgccacggtgtcggcgtcggacctggcgccgctcttctccgcgcagcgccggcacctggaccacttcttcgacagcctcgacatgtcgcaggcggcggcgttcgcgcaggcgctgatcgacgcgccgggcgccgtcttcttcacgggcgtcggcaagtcgggcatcgtggcgtgcaagatcgcgcagacgctggcgtcgctgggcttcgcgagggcggggttcctggcccccgtcgacgcgctccacggcgacatcggcgcgctcttccccggggacgtcctcgtgctcatctccaagtccggagcctccgacgagctgctcgcgctcgcgccctgcgcgcgcgccaagggcgcctacctcatctcgctcacctccgcggcctcgggggctgaatgcccgctcgccgcggcctgcgacctcaacgtccacctgccgctgcagggagaggtgtgccccttcggcctcgcgcccgtcacctccaccgccatccagatggtgtttggggacaccgtcatcgccgccatcatggaggcaaggcgactctccagggaccagtacgcctccaaccatcccgctggcaagatcggcaagaccctcatcttcaaggttaaggatgttatgaagaaacagaatgaacttcctctgtgcaaggagggagatatgataatggagcaactcactgagctcaccagtaaaggttgtggttgtttgcttgtggttgatgaagagcatcatttgattgggaccttcactgatggtgatctccggcggacattgaaggcaagcgggccagctatcttcagtctcacagttggagagatgtgcaacaggaatccaagaacaataactgcggaggcaatggcagttgaagccatggagaagatggagtcacctccttcacctgtacagttcttgcctgttatcaacgataacaacatcgtgtgtgggatcatcacattgcatggattggtctctgccggattgtag

SEQ ID NO: 414 - protein, 345 aa, Sorghum bicolor
  misc_feature: Ceres ANNOT ID no. 6007582
  misc_feature (224)..(345): Pfam Id: CBS Pfam Desc: CBS domain pair
  misc_feature (54)..(191): Pfam Id: SIS Pfam Desc: SIS domain
  misc_feature (1)..(345): NCBI GI: 7258373 NCBI Desc: sugar-phosphate isomerase-like protein [arabidopsis thaliana]
  misc_feature (20)..(345): NCBI GI: 33236388 NCBI Desc: kpsf [chlamydophila pneumoniae tw-183]
  misc_feature (20)..(345): NCBI GI: 15618437 NCBI Desc: gutq/kpsf family sugar-p isomerase [chlamydophila pneumoniae cwl029]
  misc_feature (20)..(345): NCBI GI: 16752515 NCBI Desc: carbohydrate isomerase, kpsf/gutq family [chlamydophila pneumoniae ar39]
  misc_feature (20)..(345): NCBI GI: 15836057 NCBI Desc: gutq/kpsf family sugar-p isomerase [chlamydophila pneumoniae j138]
MGSLPVPASAECAPQGRATVSASDLAPLFSAQRRHLDHFFDSLDMSQAAAFAQALIDAPGAVFFTGVGKSGIVACKIAQTLASLGFARAGFLAPVDALHGDIGALFPGDVLVLISKSGASDELLALAPCARAKGAYLISLTSAASGAECPLAAACDLNVHLPLQGEVCPFGLAPVTSTAIQMVFGDTVIAAIMEARRLSRDQYASNHPAGKIGKTLIFKVKDVMKKQNELPLCKEGDMIMEQLTELTSKGCGCLLVVDEEHHLIGTFTDGDLRRTLKASGPAIFSLTVGEMCNRNPRTITAEAMAVEAMEKMESPPSPVQFLPVINDNNIVCGIITLHGLVSAGL

SEQ ID NO: 415 - DNA, 1683 bp, Sorghum bicolor
  misc_feature: Ceres ANNOT ID no. 6007583
  misc_feature: Encodes the peptide sequence at SEQ ID NO 416
atggcgtcgatgatgcaaccgcagatcatcctgctcaaggagggcacggacacgtcgcaggggcgcgcgcaggtggtgagcaacatcaacgcgtgcacggcggtgggcgacaccgtgcggaccacgctggggccccgggggatggacaagctcatccacgacgacaagggcggagtcaccatctccaacgacggcgcaaccatcatgcgcctcctcgacatcgtgcaccccgccgccaagatccttgtcgacatcgccaagtcacaggactccgaggttggtgatgggacaactactgtggtgcttctagctgcagaattcttaaaggaagcaaaaccttatattgaggatggggtgcacccccacagtctaattcgcagctatagaactgcaggcaatatggcaatccaaagggttaaagagctagcagttagcatagaaggaaaaagccttgaagagaagaaaacattgctagccaagtgtgctgctacaacactctcttcaaaacttataggcggtgaaaaagaattctttgcttctatggttgtggatgctgtccttgccattggcaatgatgacaggcttaatcttatcgggattaagaaggttcctggaggtaccatgagagattcttttctggtgaatggtgttgcgttcaagaagacattttcgtatgctggatttgagcaacaaccaaagaagttcctgaacccgaagattcttttgttaaacattgaactagaattgaaatctgagaaggaaaatgcagagatcaggttatctgaccctctgcaataccaatcaattgttgatgctgaatggaacattatttatgataaactggataaatgtgtgaaaagtggagcaaagatagttctgtctcggctagctattggtgatcttgcaacacagtatttcgcagatcgagacattttctgcgccggccgtgtcactgaagaagatttgcaacgtgttgctgcagcaactggtggaactgttcaaacttctgtaaataatgtcatcgatgaggtacttggttcctgtgaggtattcgaggaaaagcaagtaggtaatgaaaggttcaacatatttagtggctgcccttctggtcagacagcaactattgtgctccgtggtggtgcagaccagttcattgaggaagctgaacggagtctccatgatgccatcatgattgtgaggagagcacttaagaactcaacagttgtgccgggtggcggtgctattgatatggaaataagcaagtatctcaggcagcatgcacggacaattgctgggaagtctcagttctttgtaaattcgtttgctaaagccctcgaggtcattcctcgtcaactttgtgataatgctggatttgatgctactgacgttctcaataagctcaggcagaaacatgcatctggtgaaggtgctaattatggtgtagacatcaacactggcggaattgctgattcctttgctaactttgtgtgggaacctgctgttgtaaagatcaatgctataaatgctgcaactgaagcatcctgccttattcttagcgttgacgaaacagtgaaaaacccaaagtccgaaagcgcacaaggtgaggcagcagctggcgcaatggctggtcgtggtggtggggcaatgcgtggacgtggtggcaggggcatgcgcaggcgatga

SEQ ID NO: 416 - protein, 560 aa, Sorghum bicolor
  misc_feature: Ceres ANNOT ID no. 6007583
  misc_feature (35)..(528): Pfam Id: Cpn60_TCP1 Pfam Desc: TCP-1/cpn60 chaperonin family
  misc_feature (1)..(547): NCBI GI: 45829538 NCBI Desc: loc407957 protein [xenopus tropicalis]
  misc_feature (1)..(547): NCBI GI: 27769226 NCBI Desc: similar to chaperonin subunit 7 (eta) [xenopus laevis]
  misc_feature (4)..(547): NCBI GI: 50418287 NCBI Desc: cct7-prov protein [xenopus laevis]
  misc_feature (1)..(547): NCBI GI: 28277344 NCBI Desc: cct7-prov protein [xenopus laevis]
  misc_feature (4)..(552): NCBI GI: 27545245 NCBI Desc: chaperonin containing tcp1, subunit 7 (eta) [danio rerio]
MASMMQPQIILLKEGTDTSQGRAQVVSNINACTAVGDTVRTTLGPRGMDKLIHDDKGGVTISNDGATIMRLLDIVHPAAKILVDIAKSQDSEVGDGTTTVVLLAAEFLKEAKPYIEDGVHPHSLIRSYRTAGNMAIQRVKELAVSIEGKSLEEKKTLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNVIDEVLGSCEVFEEKQVGNERFNIFSGCPSGQTATIVLRGGADQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGIADSFANFVWEPAVVKINAINAATEASCLILSVDETVKNPKSESAQGEAAAGAMAGRGGGAMRGRGGRGMRRR

SEQ ID NO: 417 - DNA, 1644 bp, Sorghum bicolor
  misc_feature: Ceres ANNOT ID no. 6007584
  misc_feature: Encodes the peptide sequence at SEQ ID NO 418
atggagatcgcgcgagcggctgctggcgtggcctgctccaaggagcaccagaggatctacgccgagtggttcgccctcgcagacccagatggcgatggccgcgtcacgggcgccgatgccaccagcttcttcggaatgtccgcgctctcacgcgccgatctcaagcaggtatgggcgatcgcggattccaagcggcaggggtacctcggattcgccgagttcgtcacagcaatgcagctcgtgtctctggcccaagcagggaacgagatcacagaggacagtctgaaacgtgaagacctgagcaccttggatccgcctgtgatggaaggtgtcgatggactactggctagatccaaggctgttgtgaagagaattcacccagatgacaatggcaccgctcaggtccaagcaccttccatgtatcactggtttggttcaaaagcagcacagaaggtgcagatgcctctgactgctgttacctctgtaattgatggcttgaaaagactatatgttgaaaaactgaagccattggaagtcgcttacagatacaatgattttgcttccccattattgacaaacagtgattttgatgcaaagccaatggttatgctcttgggtcagtattcaacagggaaaacaacattcattaagcatctgctgaagacaagctacccaggagctcacgtcggaccagagccaaccactgatagattcgtagttgtcatgtcaggatctgatggaaggaccattccaggcaatactattgctgttcaagccgacatgccattcactggtcttacaacatttgggggagcatttctgtcaaagtttgaatgctctcagatgccacatccgcttctagagcatatcacctttgtggacactcctggtgtcctctctggggaaaagcaacggacgcaacgtagctatgatttcactggtgtaacctcatggtttgctgctaagtgtgaccttattcttcttctgtttgaccctcacaagcttgatataagtgatgagttcaaacgtgtcatttcatccttacgtggtcatgatgacaaaatacgcgtagtgttgaacaaggctgaccaagtggacacacagcagcttatgagagtatacggtgcattgatgtggtctcttgggaaagtgctaaatactcctgaggttgtgcgtgtgtatatcgggtccttcaacgataagccagtgaatgattcagctgttggaccaattggaaaagacttgtttgagagggagcaagatgacctactgtgtgacctgaaagacattcctaagaaagcttgtgatcgacgggtcaatgagtttgttaagcgtgctcgagctgccaagatccatgcttacataattggccatctgaagaaggagatgcctgcaatgatgggaaaagctaaggctcagcagcgactcatagacaacttaggggaggagtttgccaaggtgcagagggaataccatctccccgccggagacttccccgacgtggagcacttcaaacaggtgctgggtgggtacagcatcgacaagttcgagaagctgaagcccaagatggtgcaggcggtggacgacatgcttgctcacgacatcccggagctcctcaagaacttcaggaacccgtacgagtga

SEQ ID NO: 418 - protein, 547 aa, Sorghum bicolor
  misc_feature: Ceres ANNOT ID no. 6007584
  misc_feature (202)..(362): Pfam Id: Dynamin_N Pfam Desc: Dynamin family
  misc_feature (200)..(363): Pfam Id: MMR_HSR1 Pfam Desc: GTPase of unknown function
  misc_feature (1)..(547): NCBI GI: 42566321 NCBI Desc: calcium-binding ef hand family protein [arabidopsis thaliana]
  misc_feature (1)..(547): NCBI GI: 42572841 NCBI Desc: calcium-binding ef hand family protein [arabidopsis thaliana]
  misc_feature (13)..(547): NCBI GI: 92878920 NCBI Desc: eps15 homology (eh); actin-binding, actinin-type [medicago truncatula]
  misc_feature (13)..(547): NCBI GI: 92884328 NCBI Desc: eps15 homology (eh); dynamin; actin-binding, actinin-type [medicago truncatula]
  misc_feature (14)..(547): NCBI GI: 38345297 NCBI Desc: osjnba0043a12.19 [oryza sativa (japonica cultivar-group)]
MEIARAAAGVACSKEHQRIYAEWFALADPDGDGRVTGADATSFFGMSALSRADLKQVWAIADSKRQGYLGFAEFVTAMQLVSLAQAGNEITEDSLKREDLSTLDPPVMEGVDGLLARSKAVVKRIHPDDNGTAQVQAPSMYHWFGSKAAQKVQMPLTAVTSVIDGLKRLYVEKLKPLEVAYRYNDFASPLLTNSDFDAKPMVMLLGQYSTGKTTFIKHLLKTSYPGAHVGPEPTTDRFVVVMSGSDGRTIPGNTIAVQADMPFTGLTTFGGAFLSKFECSQMPHPLLEHITFVDTPGVLSGEKQRTQRSYDFTGVTSWFAAKCDLILLLFDPHKLDISDEFKRVISSLRGHDDKIRVVLNKADQVDTQQLMRVYGALMWSLGKVLNTPEVVRVYIGSFNDKPVNDSAVGPIGKDLFEREQDDLLCDLKDIPKKACDRRVNEFVKRARAAKIHAYIIGHLKKEMPAMMGKAKAQQRLIDNLGEEFAKVQREYHLPAGDFPDVEHFKQVLGGYSIDKFEKLKPKMVQAVDDMLAHDIPELLKNFRNPYE

SEQ ID NO: 419 - DNA, 2022 bp, Sorghum bicolor
  misc_feature: Ceres ANNOT ID no. 6007591
  misc_feature: Encodes the peptide sequence at SEQ ID NO 420
atggccaccggcgccaccgcctcccgcctcgccgtcctcgcaccgcggccgttggcccccgcgccgggacgccggcgacatgcccctgctcccggttgcggtccttcccgtccgcgcggtctccacgccgcgcctcgcggccgcgtcctctgcctcgcggcacccgcgcccgctgctccttccaccaccgacgccggccaggaccgcctccggaaggtgcccatttcgaatatcaggaacttctgcatcatcgcgcacatcgaccacggcaagtccacgctggcggataagctgctagagctcactggcacggtgcagaagagagagatgaaggagcagtttctggataacatggacctggagagggagagagggatcactatcaaattgcaggcagctcggatgcgctatgtcatgaataatgagccttactgcctgaatttgattgatacaccagggcatgttgatttctcatatgaggtttcccgctctcttgctgcctgtgagggcgcacttcttgttgttgatgcttctcagggcgttgaagctcagacattagcgaatgtatatcttgcgttggaaaacaatcttgaaatcataccggttctaaataaaatagatcttcctggtgctgaacctgaccgtgtcgcacaggaaattgaagagataattgggttggactgcagtgacgcaattcggtgttcagcaaaggaaggcataggcatcactgaaatactagatgcccttgtgaccaaaatccccccaccgaaagatacggcaaaagatcctctcagggctcttatatttgacagctattatgatccatacagaggtgtaattgtgtacttccgtgttattgacggcagtataaagaaaggggacaagatctgttttatggccaatggaaaggaatatgttgctgatgaaattggagtactatccccaaatcagatgcaagttgacgaactatatgctggcgaggttggttatctctccgcttctataagatcagtagcagatgccagggttggtgatacaattactcattattcaaagaaagcagatcatgctttaccaggatattctcaagccactccaatggttttttgtggcttgttccctatagatgctgatcagtttgaggagctgcgggaagctctggaaaaacttcagctaaatgatgctgccctaaagtttgaaccagaatcttctagtgccatggggtttggcttcagatgtggtttccttggtcttctccatatggaaattgttcaggaaaggcttgagagggaatacaacttgaacttaataattactgcaccaagtgtggtataccgtgtgaactgtgtagatggtgaaaccgttgaatgttcaaatccatccttgcttccggagcccgggaagcggaggtctatagaagaaccatatgtgaagattgaaatgcttacaccgaaggattatattggttcaataatggatctggctcaagatagaagaggtgaattcaaggaaatgaacttcatcacagaaagcagggccaaacttatttatgagctaccactagccgagatggttggcgatttctttgatcaactgaaatcacgaagtaaaggatatgctagcatggaatattcacttatcgggtacagagaaagtcaactagtaaagctagatatacaaatcaacggggatcctgttgaggcgttgtcaacaattgtacacagagataaggcatatgctgttggcagggcacttactcaaaaactcaaggaactcatacctcggcaaatgtttaaagttcctattcaagcatgtattggcacaaaggtcattgcgagcgaagccctgtctgccatcaggaaggatgtcctatcaaaatgctatggtggtgatataacaaggaaaaagaagttgctgaagaaacaggctgaaggaaagaaaaggatgaaggcaataggaagggttgatgttcctcaagaagcattcatggccgtgttgaaactggagaaggaggtgctatga

SEQ ID NO: 420 - protein, 673 aa, Sorghum bicolor
  misc_feature: Ceres ANNOT ID no. 6007591
  misc_feature (76)..(255): Pfam Id: GTP_EFTU Pfam Desc: Elongation factor Tu GTP binding domain
  misc_feature (561)..(669): Pfam Id: LepA_C Pfam Desc: GTP-binding protein LepA C-terminus
  misc_feature (471)..(560): Pfam Id: EFG_C Pfam Desc: Elongation factor G C-terminus
  misc_feature (278)..(348): Pfam Id: GTP_EFTU_D2 Pfam Desc: Elongation factor Tu domain 2
  misc_feature (65)..(673): NCBI GI: 9759359 NCBI Desc: gtp-binding protein lepa homolog [arabidopsis thaliana]
  misc_feature (65)..(673): NCBI GI: 22136082 NCBI Desc: gtp-binding protein lepa-like protein [arabidopsis thaliana]
  misc_feature (73)..(671): NCBI GI: 67925685 NCBI Desc: small gtp-binding protein domain:gtp-binding protein lepa [crocosphaera watsonii wh 8501]
  misc_feature (73)..(671): NCBI GI: 81299290 NCBI Desc: gtp-binding protein lepa [synechococcus elongatus pcc 7942]
  misc_feature (73)..(671): NCBI GI: 16332331 NCBI Desc: lepa gene product [synechocystis sp. pcc 6803]
MATGATASRLAVLAPRPLAPAPGRRRHAPAPGCGPSRPRGLHAAPRGRVLCLAAPAPAAPSTTDAGQDRLRKVPISNIRNFCIIAHIDHGKSTLADKLLELTGTVQKREMKEQFLDNMDLERERGITIKLQAARMRYVMNNEPYCLNLIDTPGHVDFSYEVSRSLAACEGALLVVDASQGVEAQTLANVYLALENNLEIIPVLNKIDLPGAEPDRVAQEIEEIIGLDCSDAIRCSAKEGIGITEILDALVTKIPPPKDTAKDPLRALIFDSYYDPYRGVIVYFRVIDGSIKKGDKICFMANGKEYVADEIGVLSPNQMQVDELYAGEVGYLSASIRSVADARVGDTITHYSKKADHALPGYSQATPMVFCGLFPIDADQFEELREALEKLQLNDAALKFEPESSSAMGFGFRCGFLGLLHMEIVQERLEREYNLNLIITAPSVVYRVNCVDGETVECSNPSLLPEPGKRRSIEEPYVKIEMLTPKDYIGSIMDLAQDRRGEFKEMNFITESRAKLIYELPLAEMVGDFFDQLKSRSKGYASMEYSLIGYRESQLVKLDIQINGDPVEALSTIVHRDKAYAVGRALTQKLKELIPRQMFKVPIQACIGTKVIASEALSAIRKDVLSKCYGGDITRKKKLLKKQAEGKKRMKAIGRVDVPQEAFMAVLKLEKEVL

SEQ ID NO: 421 - DNA, 699 bp, Sorghum bicolor
  misc_feature: Ceres ANNOT ID no. 6007607
  misc_feature: Encodes the peptide sequence at SEQ ID NO 422
atggtgtcgctgaagctgcaaaagcgccttgccgcgagtgttctaaagtgtggaaaaggcaaagtgtggcttgatccaaatgaagttagtgagatctccatggcgaactcccgccagaacatccggaagttggttaaggatgggtttatcatcaagaagcctcagaagatccactctagatcccgtgcaagaagggcacatgaggccaagcagaaggggcgccactcaggatatggaaagcgtaggggaaccagggaggctaggctccccaccaaggttctgtggatgaggaggatgcgtgtgcttaggcgcctgctccgcaagtatcgtgaggccaagaagattgacaagcacatgtatcatgatatgtacatgaaggtcaaaggtaactcgttcaagaacaagagggtacttatggagagtatccacaagtccaaggccgagaaggccagagagaagacactttctgatcagtttgaggctaagcgcgccaagagcaaggcaagccgtgaaaggaagattgctaggagggaggagaggttggcccagggcccaaaagatataactccaccagtctcagccacagcccaagccactggagttttgttgggacaggaatccccaaaaatgtttatttggatcagattatctcgggaaatgtggttatgttttatgaaaatttatcttattgttatgtga

SEQ ID NO: 422 - protein, 232 aa, Sorghum bicolor
  misc_feature: Ceres ANNOT ID no. 6007607
  misc_feature (2)..(149): Pfam Id: Ribosomal_L19e Pfam Desc: Ribosomal protein L19e
  misc_feature (1)..(206): NCBI GI: 32401377 NCBI Desc: ribosomal protein l19 [triticum aestivum]
  misc_feature (1)..(195): NCBI GI: 47026900 NCBI Desc: ribosomal protein l19 [hyacinthus orientalis]
  misc_feature (1)..(208): NCBI GI: 92878290 NCBI Desc: ribosomal protein l19e [medicago truncatula]
  misc_feature (1)..(198): NCBI GI: 40287526 NCBI Desc: 60s ribosomal protein l19 [capsicum annuum]
  misc_feature (1)..(198): NCBI GI: 83284003 NCBI Desc: 60s ribosomal protein l19-like protein [solanum tuberosum]
MVSLKLQKRLAASVLKCGKGKVWLDPNEVSEISMANSRQNIRKLVKDGFIIKKPQKIHSRSRARRAHEAKQKGRHSGYGKRRGTREARLPTKVLWMRRMRVLRRLLRKYREAKKIDKHMYHDMYMKVKGNSFKNKRVLMESIHKSKAEKAREKTLSDQFEAKRAKSKASRERKIARREERLAQGPKDITPPVSATAQATGVLLGQESPKMFIWIRLSREMWLCFMKIYLIVM

SEQ ID NO: 423 - DNA, 984 bp, Sorghum bicolor
  misc_feature: Ceres ANNOT ID no. 6007621
  misc_feature: Encodes the peptide sequence at SEQ ID NO 424
atgggcgacgccgcggagaggaggctggcccgcgtcgccgcccacctcgtcccgtcgtcgtcgttcccggttacgcacgccaccgtgcgtcccctcgcgccctctgccacggcagcgtcgtcgtcgtcctcgccggcgaaggacagctaccggcgcgtgcacggcgacgtgccgtcggagccaccggagtggcgcgccgccacggacgagtcggggaaggagttcgtcgacatcgtctacgagaaggccgtgggagagggcatcgccaagatcaccataaaccggccaaatcgaaggaacgcgttccgtccgctgaccgtgaaggagcttatgcgcgcattcaacgacgctagagatgatagctccattggagtcatcattcttacagggaaggcgttaagagattctgatggatatgttgacttcgatagcttcggccgcctcaacgttctagatctccaggtgcaaattcgccgtcttccaaagcctgttattgctatggttgctggttatgctgttggtggtgggcatgtcttgcatatggtgtgtgacataacaattgcagcagacaatgcgatatttgggcagacagggcccaaggttggaagctttgatgctggttacggatcttcaataatgtcccgattggttggaccgaagagggcccgtgagatgtggtttctgtcgcggttctatacagccgatgaagctgacaaaatgggacttgtgaacattgtggtgccacttgctcaactggagcaagaaactgtcaaatggtgcaggcagatcttaaggaacagccccatggccatccgagtgctcaaatctgcactcaacgctgctgatgatggccatgcaggtcttcaggagcttggcgggaatgccaccctgatattctacggcactgaggaggcaaaggaagggaagaatgcgtacatggagagacgacgcccagatttctccaaattcccacggaaaccttga

SEQ ID NO: 424 - protein, 327 aa, Sorghum bicolor
  misc_feature: Ceres ANNOT ID no. 6007621
  misc_feature (89)..(248): Pfam Id: ECH Pfam Desc: Enoyl-CoA hydratase/isomerase family
  misc_feature (74)..(327): NCBI GI: 119357883 NCBI Desc: naphthoate synthase [chlorobium phaeobacteroides dsm 266]
  misc_feature (71)..(327): NCBI GI: 68548715 NCBI Desc: naphthoate synthase [pelodictyon phaeoclathratiforme bu-1]
  misc_feature (74)..(327): NCBI GI: 67918349 NCBI Desc: naphthoate synthase [chlorobium limicola dsm 245]
  misc_feature (70)..(327): NCBI GI: 67938338 NCBI Desc: naphthoate synthase [chlorobium phaeobacteroides bs1]
  misc_feature (74)..(327): NCBI GI: 78189675 NCBI Desc: naphthoate synthase [chlorobium chlorochromatii cad3]
  misc_feature (56)..(327): SWISSPROT Homolog: EC 4.1.3.36 Naphthoate synthase
MGDAAERRLARVAAHLVPSSSFPVTHATVRPLAPSATAASSSSSPAKDSYRRVHGDVPSEPPEWRAATDESGKEFVDIVYEKAVGEGIAKITINRPNRRNAFRPLTVKELMRAFNDARDDSSIGVIILTGKALRDSDGYVDFDSFGRLNVLDLQVQIRRLPKPVIAMVAGYAVGGGHVLHMVCDITIAADNAIFGQTGPKVGSFDAGYGSSIMSRLVGPKRAREMWFLSRFYTADEADKMGLVNIVVPLAQLEQETVKWCRQILRNSPMAIRVLKSALNAADDGHAGLQELGGNATLIFYGTEEAKEGKNAYMERRRPDFSKFPRKP

SEQ ID NO: 425 - DNA, 1077 bp, Sorghum bicolor
  misc_feature: Ceres ANNOT ID no. 6007648
  misc_feature: Encodes the peptide sequence at SEQ ID NO 426
atggcggcggcgggggagaaggcgagggtggtgcttgttggcggcggccccgcgggctccctcttcgccaagaccatggagggccacgccgacgtcgtcctcctcgatccgaaagagtacctggagatcccctggtctgagctgcgttcgatggtggaaccatcttttgctgagagatcattaatctatcacaaagattacctcaacgacacaaccatcgtgacatcttctgcagtcaatatcaccgaagacgctgtcctgactgctgatggtcaatctcttccatatgattatcttgtcatagcgactggccatgctttgacttctcctgccagcagagctgagaggttaaaagaattccagagagataatgggaagatagagtcatcagaatctgtcctgataattggaggtggtccaactggtgttgaactagctgcagagattgcggtagactacccggggaagaaggtgacccttatccatagaggaccacgtctactcgaattcatgggagaaaaggcttcaaagaagtgccttgattggctgacttcaaagaaagtagacgtgcttcttcagcaatctgttgacttgggctcattatcagacacggagaaggtgtacaagacatcaggcggagaaacagtaagagctgattgccactttgtgtgcattggaaagccactgagttcgtcgtggctacatgataccatcctaaaggaatctttggatagcaaggggagagtaatggtggaaaatgatttaagagtgaagggttataataacattttcgcgattggtgacatcacggatattcctgaaatcaaacaagggtataacgcccagaagcatgccctgctagtggcgaagaacctgaagttattgatcaagggtttgcctaacagcaaactgtcaacttacagcaccggttacccgctggcactcgtctctcttggaaggaaggaagggctggctcaaattccctttctgacgatctgcgggtgcttgccaggcaagatcaaatccggcgatcttttcatcggcaagacgaggaagcagattggcctgagtggttga

SEQ ID NO: 426 - protein, 358 aa, Sorghum bicolor
  misc_feature: Ceres ANNOT ID no. 6007648
  misc_feature (132)..(226): Pfam Id: Pyr_redox Pfam Desc: Pyridine nucleotide-disulphide oxidoreductase
  misc_feature (9)..(274): Pfam Id: Pyr_redox_2 Pfam Desc: Pyridine nucleotide-disulphide oxidoreductase
  misc_feature (36)..(357): NCBI GI: 115444243 NCBI Desc: os02g0150300 [oryza sativa (japonica cultivar-group)]
  misc_feature (38)..(357): NCBI GI: 34581771 NCBI Desc: pyridine nucleotide-disulphide oxidoreductase [cucumis sativus]
  misc_feature (51)..(357): NCBI GI: 42573445 NCBI Desc: pyridine nucleotide-disulphide oxidoreductase family protein [arabidopsis thaliana]
  misc_feature (8)..(355): NCBI GI: 133909654 NCBI Desc: fad-dependent pyridine nucleotide-disulphide oxidoreductase [saccharopolyspora erythraea nrrl 2338]
  misc_feature (10)..(353): NCBI GI: 123992832 NCBI Desc: apoptosis-inducing factor (aif)-like mitochondrion-associated inducer of death [synthetic construct]
MAAAGEKARVVLVGGGPAGSLFAKTMEGHADVVLLDPKEYLEIPWSELRSMVEPSFAERSLIYHKDYLNDTTIVTSSAVNITEDAVLTADGQSLPYDYLVIATGHALTSPASRAERLKEFQRDNGKIESSESVLIIGGGPTGVELAAEIAVDYPGKKVTLIHRGPRLLEFMGEKASKKCLDWLTSKKVDVLLQQSVDLGSLSDTEKVYKTSGGETVRADCHFVCIGKPLSSSWLHDTILKESLDSKGRVMVENDLRVKGYNNIFAIGDITDIPEIKQGYNAQKHALLVAKNLKLLIKGLPNSKLSTYSTGYPLALVSLGRKEGLAQIPFLTICGCLPGKIKSGDLFIGKTRKQIGLSG

SEQ ID NO: 427 - DNA, 390 bp, Sorghum bicolor
  misc_feature: Ceres ANNOT ID no. 6007661
  misc_feature: Encodes the peptide sequence at SEQ ID NO 428
atgtaccaaaaactagaccctggatttttcattcacaatatggttaaagaaaagattacagaacagttcagttgcttgactttctggtgcccctgtgtcacatttggccgcactgctgagatcgtggacagagcatgctgcatgaatggcacactgtattatctgcttgcaacaataggctgccaatggttgtatggttgtaccaagcgctcctcaatgcgcacacaatacaacttgcaagaatccccttgcttggactgctgcgtccacttctggtgtggcccttgtgcactctgccaggagtacagggagctggagaaacgcggcttcaacatggccaacggtatccctctccctcctgctgaaagaaaacataggggagaactttag

SEQ ID NO: 428 - protein, 129 aa, Sorghum bicolor
  misc_feature: Ceres ANNOT ID no. 6007661
  misc_feature (19)..(105): Pfam Id: PLAC8 Pfam Desc: PLAC8 family
  misc_feature (25)..(115): NCBI GI: 115458794 NCBI Desc: os04g0461600 [oryza sativa (japonica cultivar-group)]
  misc_feature (25)..(115): NCBI GI: 144924422 NCBI Desc: uncharacterized cys-rich domain [medicago truncatula]
  misc_feature (24)..(115): NCBI GI: 144924419 NCBI Desc: uncharacterized cys-rich domain [medicago truncatula]
  misc_feature (25)..(115): NCBI GI: 4105794 NCBI Desc: pgps/d12 [petunia x hybrida]
  misc_feature (25)..(115): NCBI GI: 140064276 NCBI Desc: uncharacterized cys-rich domain [medicago truncatula]
MYQKLDPGFFIHNMVKEKITEQFSCLTFWCPCVTFGRTAEIVDRACCMNGTLYYLLATIGCQWLYGCTKRSSMRTQYNLQESPCLDCCVHFWCGPCALCQEYRELEKRGFNMANGIPLPPAERKHRGEL

SEQ ID NO: 429 - DNA, 1347 bp, Sorghum bicolor
  misc_feature: Ceres ANNOT ID no. 6007662
  misc_feature: Encodes the peptide sequence at SEQ ID NO 430
atggcgctgcaaaacattggtgcttcaaacagggatgatgccttctacaggtacaagatgcccagaatgattaccaagatagaaggtcgtggtaatggtatcaagacaaatgttgtgaacatggttgacatagcaaaagcacttgccaggccagcttcctacacaaccaagtactttggatgtgagcttggtgcacagtccaaatttgatgagaagacagggatttccttggttaatggggctcatgatacttctaagctggctggtctccttgaagtattcatcaagaagtatgtccagtgttatgggtgtgggaatcctgagactgagattctcatctcaaagacccagatgatatcactgaaatgtgcagcctgtgggttcgtctcagatgttgacatgagggacaagctcacaaccttcatcctgaaaaacccaccagaacagaagaagggaggaaaagacaagaaggccatgaggagagctgagaaggaacgcctgaaggaaggtgaggctgctgatgaggagatgaagaaactgaagaaggatgcaaagaagaagggtgcatccaaggagcccactgccaagggttcaaagaagaaggctactgctgctggctctgatgaggaccactcaacctctccaactcgcagccgtgatggtgaccatgcagctgcagatgaggaagaggatgatgatgatgttcagtggcagactgacacttctatcgaggctgcgaagcagcgcatgcaggagcagctgagtgcagcaactgctgaaatggtgatgctgtccactgaggagactgagaagaagaagaaacaggcaacccatgctaatggttcagcaaaagaaatccctgttgaaaaacctgccgtcactaagcctagtccatatgaagaactggttggagacatcaaggctagcctaggaagtgctcctacccctacccagctcaaggctgtgcttgcctcctcaacccttcctccccaggatgtgatgaatgctctcctcgaggctctatttgatggtgtgggcaaggggtttgcgaaggaggttgtcaagaacaagaagtaccttgcagttgctgtgccagatgaggctgcccaggtcctgctggttcaggccattgaggcttttggtggcaagtgcaaccctgaggcgctgaaggaggtcccagttgtcctgaaagccctgtatgatggagatatcctggaggaggaaaccatcgtggactggtacaatgctgctgttgcagctggaaaggactcccaggttgtcaagaacgccaagccctttgttgagtggctccagagcgccgagtctgaggaagaggacgatgagtga

SEQ ID NO: 430 - protein, 448 aa, Sorghum bicolor
  misc_feature: Ceres ANNOT ID no. 6007662
  misc_feature (1)..(131): Pfam Id: eIF-5_eIF-2B Pfam Desc: Domain found in IF2B/IF5
  misc_feature (367)..(448): Pfam Id: W2 Pfam Desc: eIF4-gamma/eIF5/eIF2-epsilon
  misc_feature (1)..(448): NCBI GI: 4160402 NCBI Desc: eukaryotic translation initiation factor 5 [zea mays]
  misc_feature (1)..(448): NCBI GI: 1806575 NCBI Desc: eukaryotic initiation factor-5 [zea mays]
  misc_feature (1)..(445): NCBI GI: 126513560 NCBI Desc: translation initiation factor eif5 [triticum aestivum]
  misc_feature (63)..(447): NCBI GI: 42733476 NCBI Desc: bri1-kd interacting protein 107 [oryza sativa (japonica cultivar-group)]
  misc_feature (1)..(447): NCBI GI: 92897431 NCBI Desc: translation initiation factor if5; eif4-gamma/eif5/eif2-epsilon [medicago truncatula]
MALQNIGASNRDDAFYRYKMPRMITKIEGRGNGIKTNVVNMVDIAKALARPASYTTKYFGCELGAQSKFDEKTGISLVNGAHDTSKLAGLLEVFIKKYVQCYGCGNPETEILISKTQMISLKCAACGFVSDVDMRDKLTTFILKNPPEQKKGGKDKKAMRRAEKERLKEGEAADEEMKKLKKDAKKKGASKEPTAKGSKKKATAAGSDEDHSTSPTRSRDGDHAAADEEEDDDDVQWQTDTSIEAAKQRMQEQLSAATAEMVMLSTEETEKKKKQATHANGSAKEIPVEKPAVTKPSPYEELVGDIKASLGSAPTPTQLKAVLASSTLPPQDVMNALLEALFDGVGKGFAKEVVKNKKYLAVAVPDEAAQVLLVQAIEAFGGKCNPEALKEVPVVLKALYDGDILEEETIVDWYNAAVAAGKDSQVVKNAKPFVEWLQSAESEEEDDE

SEQ ID NO: 431 - DNA, 1182 bp, Sorghum bicolor
  misc_feature: Ceres ANNOT ID no. 6007667
  misc_feature: Encodes the peptide sequence at SEQ ID NO 432
atggaagctctaggagcgcgctcctccgtgctctcgtcgccggggaccgccggagacgcgtcgccgtccctgtccctgccgctccgcagagcctccgccgcgttccccgggctccgcaggagcccctccgctctcgccatctccacgcgctggctgcgcgctccaccccgaatcggcggccgcctgctcgccggggcaggggaagacgggtccctggaccctgccgatgacacgactgatcaggcgggagattttcaattactcgagagtaatgtaactctacgcggaagcaatgacatggataccactaaacatgatgatgctggcacttctggaagtggtgggactaacactggtggctctagggctggtctattcagaacacctatttcaggtggtgtgcacagtgcaaccgctgttcatgatttaccaccaccagctttggctgttcgcaacctcatggaacaggcaaggtttgctcatctgtgcactgtaatgtctcggatgcatcaccgccgtgaaggatacccatttggttctctagtagattttgcacctgatccatttggccacccaatcttctcattatccccactagccatccacacaagaaatttgttggcagacccaagatgcacccttgttgtacaggtacctggatggagtggactatcaaatgcacgagtaactatctttggtgatgtcattccgttgcccgttgaacaacaggaatgggctcatcagcagtatgtttcaaagcaccagcagtgggcatcccaacagtggggtaacttttattactacagaatgcacacaataagtgacatatatttcattggaggttttggtactgttgcttggatagatgtgaacgaatatgaggctctgcagcctgacaagattgcaatggatggaggggaacacaatctaaaggaactcaactcaatgttctcaaagcctctgagagaacttttatcaactgatgaaggagaggtagatgatgtagctgttatttcaatggatagcaaaggcattgatatccgtgttcgacatggtgcacagttcaacatccagaggatagcttttgaggtggatcacagcgtcgagacactggatgaagccacggaagcgcttaggaggatcatcagcaagtctaggtggcacacaagggctcaattatga

SEQ ID NO: 432 - protein, 393 aa, Sorghum bicolor
  misc_feature: Ceres ANNOT ID no. 6007667
  misc_feature (143)..(242): Pfam Id: Pyridox_oxidase Pfam Desc: Pyridoxamine 5'-phosphate oxidase
  misc_feature (142)..(386): NCBI GI: 116228192 NCBI Desc: pyridoxamine 5'-phosphate oxidase-related, fmn-binding [solibacter usitatus ellin6076]
  misc_feature (135)..(298): NCBI GI: 118700262 NCBI Desc: pyridoxamine 5'-phosphate oxidase-related, fmn-binding [burkholderia ambifaria mc40-6]
  misc_feature (121)..(304): NCBI GI: 115350250 NCBI Desc: pyridoxamine 5'-phosphate oxidase-related, fmn-binding [burkholderia cepacia ammd]
  misc_feature (146)..(354): NCBI GI: 118039454 NCBI Desc: pyridoxamine 5'-phosphate oxidase-related, fmn-binding [burkholderia phytofirmans psjn]
  misc_feature (161)..(304): NCBI GI: 78064860 NCBI Desc: pyridoxamine 5'-phosphate oxidase-related, fmn-binding [burkholderia sp. 383]
MEALGARSSVLSSPGTAGDASPSLSLPLRRASAAFPGLRRSPSALAISTRWLRAPPRIGGRLLAGAGEDGSLDPADDTTDQAGDFQLLESNVTLRGSNDMDTTKHDDAGTSGSGGTNTGGSRAGLFRTPISGGVHSATAVHDLPPPALAVRNLMEQARFAHLCTVMSRMHHRREGYPFGSLVDFAPDPFGHPIFSLSPLAIHTRNLLADPRCTLVVQVPGWSGLSNARVTIFGDVIPLPVEQQEWAHQQYVSKHQQWASQQWGNFYYYRMHTISDIYFIGGFGTVAWIDVNEYEALQPDKIAMDGGEHNLKELNSMFSKPLRELLSTDEGEVDDVAVISMDSKGIDIRVRHGAQFNIQRIAFEVDHSVETLDEATEALRRIISKSRWHTRAQL

SEQ ID NO: 433 - DNA, 1347 bp, Sorghum bicolor
  misc_feature: Ceres ANNOT ID no. 6007669
  misc_feature: Encodes the peptide sequence at SEQ ID NO 434
atggcagcaatctcgccgccgccgccgccgccgctccgtccgtggtgcgacctgctgccggagctgctaggccaggtcctcgtgcggctcccgttccccgccgaccgcgcgcgcttccgcgccgtctgccgcgggtggcactccgtcgccgcgctgcacgtgcgccagctcccgtggctggtcctgcgggacggctccttctgcaccgtcggcgccggcggggccttcttccaccggacggcgatgcccggcctgcccgacggcgtgaccgtcgtcgggtccgccgacggcggctggctcctcctcgaccgcaccgactgcgcgtaccgccgtggcgacgtcttcgcgctgcggtacaagacacccagacgcgacgtcaggcacgcgcactcgtacctcctgctcaaccccttctccggcgccggcgcgacgccgctgccgctcccggagctggacgccgtcgtcgggaccgtctccgaggtgttcgagatctacagggtggcgatgcggtcgtcgtcgacgcctgatgacctcatcgccgtcgtgaccagcagcggggattgcaatgtcatcctgtgccgtcccgggaaaggtacgtatgtgatgtgctaccgtcgtgtcttcgacgccgcgttcgttggggatcagtggctctatgggatcactagggatgaagaacttctcgccttccgcctcgcggaggacgacgatggcaagcctgtcgttaccaaagagaagcgcgtcatcaaggccacgtcgccattacctgaggcgcactattgggactggatggatgatgatgatgatgaagacgacgacgaggacgatgataacaacaactacagtgctgatgatggtggtggtggtgaggatgatgcaccaaaccaagaagaggaatataatagtaactacaatgttgatgccttggtgttggatggtacagagagatcatttgatactcaagtgccatatagaggtgatattattactaccacccgaatgttagtgaagtcgcgggacggcgagttgctcatggtgaggcgtcaggttttttcacctatacgctccgaaccttacattatgagtgtcaaggtcattaaagcggatgtcaacatgggtgagtggatctcagtcgggcttgccaaagatgaggccttctttcttagccgaggcttctgcaaatctactatagtgtttggagacatacaagcaggttccatatattttgatgatatcaatgatgtggttgacactagattatggactcgtagggcatttagattgccgtgggcgagaagactattcacatggatgacatggattttcccaccaaaaatggtggtctag

SEQ ID NO: 434 - protein, 448 aa, Sorghum bicolor
  misc_feature: Ceres ANNOT ID no. 6007669
  misc_feature (13)..(61): Pfam Id: F-box Pfam Desc: F-box domain
  misc_feature (11)..(230): NCBI GI: 115439105 NCBI Desc: os01g0673300 [oryza sativa (japonica cultivar-group)]
  misc_feature (2)..(118): NCBI GI: 115464541 NCBI Desc: os05g0484700 [oryza sativa (japonica cultivar-group)]
  misc_feature (15)..(75): NCBI GI: 115466420 NCBI Desc: os06g0148300 [oryza sativa (japonica cultivar-group)]
  misc_feature (15)..(52): NCBI GI: 115466422 NCBI Desc: os06g0148500 [oryza sativa (japonica cultivar-group)]
  misc_feature (229)..(280): NCBI GI: 134274473 NCBI Desc: truncated aut1 protein [trypanosoma brucei gambiense]
MAAISPPPPPPLRPWCDLLPELLGQVLVRLPFPADRARFRAVCRGWHSVAALHVRQLPWLVLRDGSFCTVGAGGAFFHRTAMPGLPDGVTVVGSADGGWLLLDRTDCAYRRGDVFALRYKTPRRDVRHAHSYLLLNPFSGAGATPLPLPELDAVVGTVSEVFEIYRVAMRSSSTPDDLIAVVTSSGDCNVILCRPGKGTYVMCYRRVFDAAFVGDQWLYGITRDEELLAFRLAEDDDGKPVVTKEKRVIKATSPLPEAHYWDWMDDDDDEDDDEDDDNNNYSADDGGGGEDDAPNQEEEYNSNYNVDALVLDGTERSFDTQVPYRGDIITTTRMLVKSRDGELLMVRRQVFSPIRSEPYIMSVKVIKADVNMGEWISVGLAKDEAFFLSRGFCKSTIVFGDIQAGSIYFDDINDVVDTRLWTRRAFRLPWARRLFTWMTWIFPPKMVV

SEQ ID NO: 435 - DNA, 1431 bp, Sorghum bicolor
  misc_feature: Ceres ANNOT ID no. 6007673
  misc_feature: Encodes the peptide sequence at SEQ ID NO 436
atgtcgtcttcctgcataccaaccggcctgcggctggacctggacatggtgaaggcggcggcgtcgccgggcgcgcactcgtcgccgctgcggccggtgcactcgtcgccgtcgtcgacgctgtcggaggcgtccaacgcctcgtcgtcggcgacgtcggtgtcgctgaaacgggcgcgcgcgccgcggaagcggccgaaccaggcgtacaacgaggccgccgcgctgctcgcgtccatccacccctccgtcttccccgtcaagaagagccccaagacggggccgccgcgcccgccgtcgcggcagctctccgggctcgcggcggcgttcgacgcctcctccgacctcctcccgccgctccccgtcctcgcggactccgcattcctgctccgggacatgcccgcgccgtcgccgtcgccgcagccgcagagcccgtctggcgccaagaactgctcgtcgccggcccccgtgagcagcgcgttccgggacttccgtgacccggcgccgtcgccggcgagccccgacacggtcgacgtcgacgagcttggcgagatcgacttcgacgacgacggcttcgacgccgaatccattctcgacgtcgacgaggccgctgccggcgccgcggccgagggcctcgacggcatcatgggtagcctcaccgtcgagagcaacaacaccgccaccacgtccgatgactccatcctgtccagctccggcatacacccttacctcaggagcctcatggtggtcggcctcgccggcaggttcgagctcggactcggcttccggcacggcgctcggcccaacctcaaccgcgcactgaaacggcgggacgacgacggcgcctggtggatgtggcctgcagtgccggtaaaggacttaacgattgcaccaccgacaccgccagcaccgccggcgtcgaacgccgcaatgccacaggccgccgccgcgccagagaagaagaaaagcaagaagaagaaggtggtgaaggtggagaagatcatggcgaagggaaaggaggagcttcccaacgcgaaatgcaaggaggaggaagctgacgcctctgtcgatgccgctaatggcgacggtgacgctgacagtgcgccgacgaaggcgccaaagaccgggttggggctgaagctggacgccgacgaggtgctcaaggcgtggtccgacaaagggtccatgtttgccgagggcagcgggccggagtcgccgacgtcggccgccgaagtgcgggctaagcttgcagacatcgacctgtttccagagaatggagctggtggtggcatcagggaagccagtgtgctgcggtacaaggagaagaggcgcacccggctcttctccaagaagatccggtaccaagtgcgcaagggaaggtttgttaggagcccatctcttcttcagcaagccctggaggaagagagctag

SEQ ID NO: 436 - protein, 476 aa, Sorghum bicolor
  misc_feature: Ceres ANNOT ID no. 6007673
  misc_feature (432)..(466): Pfam Id: CCT Pfam Desc: CCT motif
  misc_feature (348)..(467): NCBI GI: 140067271 NCBI Desc: cct [medicago truncatula]
  misc_feature (3)..(129): NCBI GI: 79331135 NCBI Desc: cia2 (chloroplast import apparatus 2) [arabidopsis thaliana]
  misc_feature (430)..(467): NCBI GI: 140045409 NCBI Desc: cct [medicago truncatula]
  misc_feature (1)..(96): NCBI GI: 92877480 NCBI Desc: at5g57180/mul3_13 [medicago truncatula]
  misc_feature (18)..(174): NCBI GI: 530876 NCBI Desc: amino acid feature: rod protein domain, aa 266 .. 468; amino acid feature: globular protein domain, aa 32 .. 265
  misc_feature: The sequence is a functional homolog of SEQ ID NO 1522 in the 10/374,780US patent application
  misc_feature: The sequence is a functional homolog of SEQ ID NO 1593 in the 10/412,699US patent application
  misc_feature: Useful for making plants with modulated growth and phenotype characteristics
  misc_feature: The sequence is a functional homolog of SEQ ID NO 1593 in the 20040045049 US patent application
  misc_feature: The sequence is a functional homolog of SEQ ID NO. 370 in the 11/188,298 US application
MSSSCIPTGLRLDLDMVKAAASPGAHSSPLRPVHSSPSSTLSEASNASSSATSVSLKRARAPRKRPNQAYNEAAALLASIHPSVFPVKKSPKTGPPRPPSRQLSGLAAAFDASSDLLPPLPVLADSAFLLRDMPAPSPSPQPQSPSGAKNCSSPAPVSSAFRDFRDPAPSPASPDTVDVDELGEIDFDDDGFDAESILDVDEAAAGAAAEGLDGIMGSLTVESNNTATTSDDSILSSSGIHPYLRSLMVVGLAGRFELGLGFRHGARPNLNRALKRRDDDGAWWMWPAVPVKDLTIAPPTPPAPPASNAAMPQAAAAPEKKKSKKKKVVKVEKIMAKGKEELPNAKCKEEEADASVDAANGDGDADSAPTKAPKTGLGLKLDADEVLKAWSDKGSMFAEGSGPESPTSAAEVRAKLADIDLFPENGAGGGIREASVLRYKEKRRTRLFSKKIRYQVRKGRFVRSPSLLQQALEEES

SEQ ID NO: 437 - DNA, 1269 bp, Sorghum bicolor
  misc_feature: Ceres ANNOT ID no. 6007684
  misc_feature: Encodes the peptide sequence at SEQ ID NO 438
atggggaagcacgagttcctgacgccgaaggcgatcgcgaaccggatcaaggcaaaggggctgcagaagctgcggtggtactgccagatgtgccagaagcagtgccgcgacgagaacgggttcaagtgccactgcatgtcggagtcgcaccagcggcagatgcaggtgttcggcatggcgcccgaccgcgtcgtcgagggcttctccgaggagttcctcgagtccttcctctccctcatccgccgcgcgcaccgccactcccgcgtcgccgccaccgtcgtctacaacgagtacatcgcggaccgtcaccacgtccacatgaactccacgcgctgggccacgctcaccgagttcgtcaagttccttgggcgcgaggggtactgcaaggtcgaggacacgcccaaggggtggttcatgacctacatcgaccgtgactcagagaaggccgtcaaggaccgcctcaagcgcaagaggatcaagtcagacatggctgaggacgagcgccaggagcgcatgatcgcccgccagattgagcgtgcacacaagtccttagccaaacccgatgatggtgatgctgccgagggcgagcctgagtccggcagtgaagaagagtattcaggctcagacgatgatggggaggagcgtgaggatggctcaaaagaggcaagcaaggcaacagggaagattgcaattgcgcttcagaaggctgtgccagggcccaaggttaatccttttgaggataagccgaaggtgaaatttggtttcgacgaggatgacacaggtaccggagagaaaaaggatgaggcggccaagaacaagggaaaggatgtgaaggcaacagaggcaaggaggtcagcattggatgacctgatgaaggaggaggagaaggccaaggagaggagcaataggaaggactactggctgtgccctgggattgtggtcaaggtgatgagcaagacattggcagagaagggatactacaagcagaaaggggtggtgaagaaagttatcgataaatatgttggggagattgagatgttggagagcaagcatgttctcagggttgaccaagatgagcttgagaccgtgatccctcagattggtggactggtgcggattgtgaatggggcttatcgggggtcaaatgccaggttgctctcagtggacactgcaaaattcagtgcaaaagtgcaggttgagaaaggcctctatgatgggaaggttcttagggctgtcgaatacgaggacatttgcaagatatcctcatga

SEQ ID NO: 438 - protein, 422 aa, Sorghum bicolor
  misc_feature: Ceres ANNOT ID no. 6007684
  misc_feature (367)..(400): Pfam Id: KOW Pfam Desc: KOW motif
  misc_feature (250)..(421): NCBI GI: 22327736 NCBI Desc: kin17 dna-binding protein-related [arabidopsis thaliana]
  misc_feature (1)..(250): NCBI GI: 49257754 NCBI Desc: mgc69184 protein [xenopus tropicalis]
  misc_feature (1)..(179): NCBI GI: 51258255 NCBI Desc: mgc81626 protein [xenopus laevis]
  misc_feature (8)..(183): NCBI GI: 23481294 NCBI Desc: drosophila melanogaster kin17 protein [plasmodium yoelii yoelii]
  misc_feature (1)..(257): NCBI GI: 55962358 NCBI Desc: novel protein similar to vertebrate kin, antigenic determinant of reca protein homolog (mouse) (kin) [danio rerio]
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKFLGREGYCKVEDTPKGWFMTYIDRDSEKAVKDRLKRKRIKSDMAEDERQERMIARQIERAHKSLAKPDDGDAAEGEPESGSEEEYSGSDDDGEEREDGSKEASKATGKIAIALQKAVPGPKVNPFEDKPKVKFGFDEDDTGTGEKKDEAAKNKGKDVKATEARRSALDDLMKEEEKAKERSNRKDYWLCPGIVVKVMSKTLAEKGYYKQKGVVKKVIDKYVGEIEMLESKHVLRVDQDELETVIPQIGGLVRIVNGAYRGSNARLLSVDTAKFSAKVQVEKGLYDGKVLRAVEYEDICKISS

SEQ ID NO: 439 - DNA, 375 bp, Sorghum bicolor
  misc_feature: Ceres ANNOT ID no. 6007694
  misc_feature: Encodes the peptide sequence at SEQ ID NO 440
atgggggagcaaggcaggtccagcagcaacaagatcagagacattgtgaggctgcaacaacttctgaagaagtggaagcggcttgcactctcgccaaaagccggcaagagcagcagcaaccatggtgttccaaagggtttctttgcggtgtgcgttggcatggagatgaagaggtttgtgatccccacggagtacctaggccactgggcatttgaggagctcctgaaggaggcagaggaggaatttggattccagcatgagggagctctgagaatcccctgtgatgtgaaggtgtttgagggcatcctcaggctggtgggcaggaaggaggcagtttgctacagtccttcacagcctgggatcttatgcagataa

SEQ ID NO: 440 - protein, 124 aa, Sorghum bicolor
  misc_feature: Ceres ANNOT ID no. 6007694
  misc_feature (12)..(107): Pfam Id: Auxin_inducible Pfam Desc: Auxin responsive protein
  misc_feature (1)..(122): NCBI GI: 45736190 NCBI Desc: auxin-induced protein-like [oryza sativa (japonica cultivar-group)]
  misc_feature (1)..(100): NCBI GI: 115444179 NCBI Desc: os02g0143400 [oryza sativa (japonica cultivar-group)]
  misc_feature (2)..(124): NCBI GI: 53792744 NCBI Desc: auxin-induced protein-like [oryza sativa (japonica cultivar-group)]
  misc_feature (2)..(124): NCBI GI: 115469776 NCBI Desc: os06g0701900 [oryza sativa (japonica cultivar-group)]
  misc_feature (41)..(104): NCBI GI: 79328260 NCBI Desc: calmodulin binding [arabidopsis thaliana]
  misc_feature: Useful for making plants with modulated cold sensitivity
  misc_feature: Useful for making plants with modulated cold sensitivity
  misc_feature: Functional homolog of the protein sequence given in SEQ ID NO 13354
  misc_feature: Functional homolog of the protein sequence encoded by LOCUS at2g24400
  misc_feature: The sequence is a functional homolog of SEQ ID NO. 402 in the 11/188,298 US application
  misc_feature: The sequence is a functional homolog of SEQ ID NO. 505 in the 11/188,298 US application
  misc_feature: The sequence is a functional homolog of SEQ ID NO. 443 in the 11/188,298 US application
MGEQGRSSSNKIRDIVRLQQLLKKWKRLALSPKAGKSSSNHGVPKGFFAVCVGMEMKRFVIPTEYLGHWAFEELLKEAEEEFGFQHEGALRIPCDVKVFEGILRLVGRKEAVCYSPSQPGILCR

SEQ ID NO: 441 - DNA, 2271 bp, Sorghum bicolor
  misc_feature: Ceres ANNOT ID no. 6007698
  misc_feature: Encodes the peptide sequence at SEQ ID NO 442
atgtggaggctgaaggtggcgcagggcgacgacggcccgtggctgcggtcgaccaacaactttgttggacgggcggtgtgggagttcgatcccgaccacggcacgccggaggagcgcgccgacgtggagaggctccgccgtgagttctcccaacaccgcttccagaggagggagtcttccgatctcctcatgcgcatgcagggcacaaagcagaacagatgtcaacgtgatctgccacgcatcaagcttgaggaggatgaccaagtcactgaagaaattgtattgagctctttgaggcgggctctggatcagttctcttcactgcaagcaagtgatgggcactggcctggtgatttcagcgggatcatgttcatcatgcctggtttgatatttgccttgtatgtcactggatcactgaatgctgtcatatcaccagaacatcggcatgagatatgccgctacatctacaaccaccagaacgaagatggtggatggagcacacttgtcctgggttcaagcaccatgtttggcacatgctcaaactacatcaccctgaggcttcttggcgaggagctatatggcaacaacgatgcgttggctaaagggcgggcttggattctatcccatggtggtgcaaccttcattccccagtggggaaagatatggctttcggtacttggagtgtttgattggtcaggaaataatccaattttccctgaactatggctcattcctcagtttcttccatttcatccagggaaattttggtgcttaacccgtatggtatatctgccaatggcttatctttatggcaagaaatttgtcggaccaattacaccaactatattagcactaagagaggagatatatgacactccgtacaacaagattgactggagcaacgctcgtaatgaatgcgcaaaggaggacctcatctgtccacgtacactgttgcagaatgttgtttggacttcactttacaggtgtgtggaaccagtgttgagcagttggcctgtcaacaagctgagggagagagctctaggaaacctcatggagcatatccattatgaagatgagaacacacaatacctatgcatatgttctgtgaacaaggctctaaacatgatctgctgttgggtagaagatccaaattcagatgcattcaagcatcaccttgcaagggtaccagatttcttgtggctttcagaagatggcatgaaggcacaggtatatgatggttgccagagctgggaaacatcattcataattcaagcattttgcggtacagatcttgtcaatgagtatggtccaactattcagagagcctatgagttcatgaaaaattcacaggttttgaggaaccaccctggtgaccaaagtaaatggcatcgccatagatcgaagggttcatggacactttcatctgcagacaatgggtgggctgtatctgacactacaggagaagcacttaaggctgtactgttagtggcaaagatctcaaacaaaaataaccttgctggggatccaatagaaaaacaaaggttgcatgataacaaagatggtaccttttctacatatgagtgcaaaagatcttcttcttggatagagattctaaatccttgtgagagttttccaaacatggttgtcgattacccttacccagaatgcacttcctcagtgctccaagctctgatacttttccaagaattgtatcctggttaccgcacaaaagagataaaaacatctatcagaaatgcagcaacgtttattgaaagaagtcaacaagaagatggttcatggttaggcacttggggtgtatgtttcacctatggggccttcttttcaatcaaaggtttagttgattatggaagaacgtatgagaacaactctttcatacggaaaggatgccattttttattgtcaaagcaactcaccactggtggatggggagaaaagcatgtctctaatgaaactcatgtttatgtaaatatcaaaggtgatcgtgctcacgctgtgaatactgcttgggcaatgttggctctaatttatgctggacagatggagcgagatccaacaccattacaccgtgctgcaaaagaattgataaatatgcagttggagacaggagagttcccacagcaagagcatgtcggatgcttcaattgttctcttttcttcaattaccccaactaccgcaacttgttccccatttgggctctcggtgagtatcatcgtggcatttgtggaaagaagagaaatgagtccaaatga

SEQ ID NO: 442 - protein, 756 aa, Sorghum bicolor
  misc_feature: Ceres ANNOT ID no. 6007698
  misc_feature (146)..(189): Pfam Id: Prenyltrans Pfam Desc: Prenyltransferase and squalene oxidase repeat
  misc_feature (581)..(623): Pfam Id: Prenyltrans Pfam Desc: Prenyltransferase and squalene oxidase repeat
  misc_feature (630)..(685): Pfam Id: Prenyltrans Pfam Desc: Prenyltransferase and squalene oxidase repeat
  misc_feature (1)..(752): NCBI GI: 115485919 NCBI Desc: os11g0562100 [oryza sativa (japonica cultivar-group)]
  misc_feature (1)..(751): NCBI GI: 47834395 NCBI Desc: beta-amyrin synthase [avena longiglumis]
  misc_feature (1)..(751): NCBI GI: 15866696 NCBI Desc: beta-amyrin synthase [avena strigosa]
  misc_feature (1)..(751): NCBI GI: 47834397 NCBI Desc: beta-amyrin synthase [avena prostrata]
  misc_feature (1)..(751): NCBI GI: 47834393 NCBI Desc: beta-amyrin synthase [avena longiglumis]
  misc_feature (1)..(743): SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO. 343 in the 11/188,298 US application
MWRLKVAQGDDGPWLRSTNNFVGRAVWEFDPDHGTPEERADVERLRREFSQHRFQRRESSDLLMRMQGTKQNRCQRDLPRIKLEEDDQVTEEIVLSSLRRALDQFSSLQASDGHWPGDFSGIMFIMPGLIFALYVTGSLNAVISPEHRHEICRYIYNHQNEDGGWSTLVLGSSTMFGTCSNYITLRLLGEELYGNNDALAKGRAWILSHGGATFIPQWGKIWLSVLGVFDWSGNNPIFPELWLIPQFLPFHPGKFWCLTRMVYLPMAYLYGKKFVGPITPTILALREEIYDTPYNKIDWSNARNECAKEDLICPRTLLQNVVWTSLYRCVEPVLSSWPVNKLRERALGNLMEHIHYEDENTQYLCICSVNKALNMICCWVEDPNSDAFKHHLARVPDFLWLSEDGMKAQVYDGCQSWETSFIIQAFCGTDLVNEYGPTIQRAYEFMKNSQVLRNHPGDQSKWHRHRSKGSWTLSSADNGWAVSDTTGEALKAVLLVAKISNKNNLAGDPIEKQRLHDNKDGTFSTYECKRSSSWIEILNPCESFPNMVVDYPYPECTSSVLQALILFQELYPGYRTKEIKTSIRNAATFIERSQQEDGSWLGTWGVCFTYGAFFSIKGLVDYGRTYENNSFIRKGCHFLLSKQLTTGGWGEKHVSNETHVYVNIKGDRAHAVNTAWAMLALIYAGQMERDPTPLHRAAKELINMQLETGEFPQQEHVGCFNCSLFFNYPNYRNLFPIWALGEYHRGICGKKRNESK

SEQ ID NO: 443 - DNA, 2982 bp, Sorghum bicolor
  misc_feature: Ceres ANNOT ID no. 6007710
  misc_feature: Encodes the peptide sequence at SEQ ID NO 444
atgagggttcgtgacggggacggcggcggcgaggtgaccgcgccgccgcagcacctcgtgttcgcctattacatcaccggccacggcttcgggcacgccacccgcgccctcgaggtggtgaggcacctggtcgccgcggggcacgacgtgcacgtggtcaccgccgcgcccgagttcgtcttcaccaccgagatcacttccccgagcctccacatccgcaaggtcctgctcgactgcggcgccgtccaggccgatgcactcaccgtcgaccgcctcgcctcactcgagaagtatcaccagacggctgtggtgccccgggagtccatcctcaggaccgaggcggagtggctcaactccatcaaggccgacctagtggtttcagatgttgtacccgtggcgtgtagggcagctgcagatgctggcattcgatccgtgtgcgtcacaaatttcagctgggactttatttatgcagagtatgttgtagcagctggacatcatcatcgctcaattgtgtggcagatagcagaggattactcccattgtgaattcttgctccgactccctggatactgccctatgcctgcttttcgtgatgtcattgatgttcctctggtggttagaagattacacagatctagatctgaggtgagaaaggaactaggaattgcagatgatgttaagttggtcattttcaactttggaggacagcctgcgggatgggaactgaagaaagagtggttgcctgatggttggctatgtttggtatgtggtgcatctgatactcaaaagcttcctccaaatttcattaagcttgcaaaggatgcctacacacctgatttgatggcagcatctgactgcatgcttggaaaaattggatatggcacagtgagtgaggctttggcttacaagttgccatttgtatttgttcgaagagattatttcaatgaagaaccatttttgaggaatatgcttgagcattatcaatgcggcattgagatgatacggagggatttacttactgggcattggaaaccttatctgcaacgtgctatcacacttcaaccttgctatgatggtcccataaatggtggcgaggtggctgcacatatcctccaagatactgctgttggaaagaagtatatttctggaaagttgagcggagcaagacggttgcgtgatgccattgtgcttggctatcaactacaaagggctcctgggagagatgtaggaattcctgactggtattctctctctgagaaagaaatcagtgtccgcccaacgcccacatctcatgatatgaatggaagtgcagagtcatcgttcgaggacttcgagatactccatggtgacatgcaaggcttaactgataccatgtcctttttgaagagtttatcagggcttgttggaaatgacttaagaagccctgagaagcaaactcgagagagggccgctgcttctgtgctctttgactgggaggaggaaatatatgttgcaagagctcctgggcgattagatgttatgggtggtattgcagattactctggaagtcttgtactgcagatgcccatccgagaggcgtgccatgttgctgttcagagaagcgaccctaccaaacagaagcaatggaagcatacacaggctagacaactagcaaatggaggagcagtaccagtgttacaaattgtgtcctttggttctgaattaagcaatcgtgcacctacgtttgacatggacctttctgattttatggatggtgacaaaccaatatcttatgataaagctaaagaatacttttctcgggacccatcacaaaaatgggctgcctatgttgctggaactatttttgtattgatgtctgagctaggagtgcgctttacggacagcatgagcattttggtttcttcatctgtccctgaaggcaaaggtgtctcctcttctgcatcagtggaggtagcttctatgtctgccatcgctgctgcctatggtttaaacattgctccaagggatcttgctttactctgtcaaaaggttgagaatcgtgttgttggagctccttgtggagtaatggaccaaatgacatctgcttgtggagaagctaacaaactcctagcaatggtttgccagcctgcagaagtgaaggagctggttagcattccaactcatatacgattttggggtcttgactctgggatacgtcatagtgtcggtgggactgattatgggtctgtaagagtaggcacttacatgggtcgcaagatgatcaagtgtgctgcatctgacctactttcagaattgttaccctcatgtacgtctatgcaatcaggcgactcaaatcctgatgaatatgaagagcatggtgtagaccttctgaaatctgaagcatcgatggagtatttatgcaacttaccaccacatagatatgaagctgtttatgcaaaagatattccagagacgataactggtgatgttttcctggagaagtatggagatcataatgatgcggtaacagaagttgaccgaaaacgatcttactgtgtcagggctcctaccagacatcccatatacgagaattccagagttgaggccttcaaagcattgttgacagcatccaaaacagacgagcaactttcagcccttggagagcttatgttccagtgccactacagctacaacgcttgcgggcttggttctgacggtacagacaggctagtgaatctagtacaagaaatccggcacaggaagaccttgcgaactggaggccccagtctattcggcgcaaagatcaccggtggagggtccggtggctcagtttgtgtgattgggaagaactgcctgaaaagcagtgaagagatacttgagatccagaagagatacaaagcagctaccgggtatcttccgattgttttcgagggctcgtctccaggcgcctgcaagtttgggtacctgaagattcgacgccgatccacgtcgccatctaactga

SEQ ID NO: 444 - protein, 993 aa, Sorghum bicolor
  misc_feature: Ceres ANNOT ID no. 6007710
  misc_feature (630)..(698): Pfam Id: GHMP_kinases_N Pfam Desc: GHMP kinases N terminal domain
  misc_feature (862)..(960): Pfam Id: GHMP_kinases_C Pfam Desc: GHMP kinases C terminal
  misc_feature (1)..(989): NCBI GI: 42409310 NCBI Desc: ghmp kinase-like protein [oryza sativa (japonica cultivar-group)]
  misc_feature (6)..(991): NCBI GI: 53792755 NCBI Desc: ghmp kinase-like [oryza sativa (japonica cultivar-group)]
  misc_feature (1)..(987): NCBI GI: 7268362 NCBI Desc: galactokinase like protein [arabidopsis thaliana]
  misc_feature (406)..(987): NCBI GI: 110739978 NCBI Desc: galactokinase like protein [arabidopsis thaliana]
  misc_feature (557)..(987): NCBI GI: 51849618 NCBI Desc: arabinose kinase-like protein [nannochloris bacillaris]
MRVRDGDGGGEVTAPPQHLVFAYYITGHGFGHATRALEVVRHLVAAGHDVHVVTAAPEFVFTTEITSPSLHIRKVLLDCGAVQADALTVDRLASLEKYHQTAVVPRESILRTEAEWLNSIKADLVVSDVVPVACRAAADAGIRSVCVTNFSWDFIYAEYVVAAGHHHRSIVWQIAEDYSHCEFLLRLPGYCPMPAFRDVIDVPLVVRRLHRSRSEVRKELGIADDVKLVIFNFGGQPAGWELKKEWLPDGWLCLVCGASDTQKLPPNFIKLAKDAYTPDLMAASDCMLGKIGYGTVSEALAYKLPFVFVRRDYFNEEPFLRNMLEHYQCGIEMIRRDLLTGHWKPYLQRAITLQPCYDGPINGGEVAAHILQDTAVGKKYISGKLSGARRLRDAIVLGYQLQRAPGRDVGIPDWYSLSEKEISVRPTPTSHDMNGSAESSFEDFEILHGDMQGLTDTMSFLKSLSGLVGNDLRSPEKQTRERAAASVLFDWEEEIYVARAPGRLDVMGGIADYSGSLVLQMPIREACHVAVQRSDPTKQKQWKHTQARQLANGGAVPVLQIVSFGSELSNRAPTFDMDLSDFMDGDKPISYDKAKEYFSRDPSQKWAAYVAGTIFVLMSELGVRFTDSMSILVSSSVPEGKGVSSSASVEVASMSAIAAAYGLNIAPRDLALLCQKVENRVVGAPCGVMDQMTSACGEANKLLAMVCQPAEVKELVSIPTHIRFWGLDSGIRHSVGGTDYGSVRVGTYMGRKMIKCAASDLLSELLPSCTSMQSGDSNPDEYEEHGVDLLKSEASMEYLCNLPPHRYEAVYAKDIPETITGDVFLEKYGDHNDAVTEVDRKRSYCVRAPTRHPIYENSRVEAFKALLTASKTDEQLSALGELMFQCHYSYNACGLGSDGTDRLVNLVQEIRHRKTLRTGGPSLFGAKITGGGSGGSVCVIGKNCLKSSEEILEIQKRYKAATGYLPIVFEGSSPGACKFGYLKIRRRSTSPSN

SEQ ID NO: 445 - DNA, 3432 bp, Sorghum bicolor
  misc_feature: Ceres ANNOT ID no. 6007711
  misc_feature: Encodes the peptide sequence at SEQ ID NO 446
atgaagcagtccccggcgagctctggtgtcgcgcccgcgcccgtcgctgcccccgcgcccgactccaccggcgcggcggcatgcgaaggggagcggaaggcgccggcgatcaacgccgacctgtggtacgcctgcgcgggcccgctcgtgtcgctgccgccggtgggcagcctcgtcgtctacttcccgcagggccacagcgagcaggttgcagcttctatgcaaaaggacattgatgcacatgtgccaagctacccaaatcttccctcaaagttgatatgtcttcttcacagtgttactttgcatgcggacccagacactgatgaggtgtatgcacagatgactcttcagccagtgaacacatatggaaaagaggctttgcagctatcggagcttgcactaaaacatgcaaggccacagatggagttcttctgtaagacacttactgcaagtgatacaagtacacatggaggcttctctgtgcctcgccgtgctgcagagaagatattacctccactggacttcagtatgcagcctccggctcaagagcttcaagccagagacatacatgacaacgtgtggacatttcgccatatatttcgaggtcagccgaaaagacatttactaaccactgggtggagtcttttcgtgggcggcaagagattatttgctggtgattctgtcatttttgttagggatgaaaggcagcaacttctactgggaataaggcgggctagccggcagccaactaatatatcttcttcagtactttcaagtgacagtatgcacataggggtgcttgctgcagcggcccatgctgctgctaacaatagcccatttaccatattttacaaccctagggctagccctactgagtttgttatcccatttgccaaataccagaaggcactgtatagtaaccaaatatctttaggaatgcgattccggatgatgtttgagactgaggaattagggatgagaaggtacatgggcacgataactgggataagtgacctagatcctgtaagatggaaaaactcccagtggcgaaacttacaggttggttgggatgagtctgcagcgggtgaaagacgaaacagagtttcaatgtgggagattgaaccaattgctgctcctttcttcatatgcccccagcctttctttggcgtaaagcgccctaggcaaatagatgatgagtcatcagagatggaaaaccttttcaagagggcaatgccttggcttggtgaggagatatgcataaaggatgctcagacccagaacaccacaatgcctggtctgagcttggttcaatggatgaacatgaacaggcagcagagctccacattagctaatacaggcatacagtcggagtatctgcgatctctaagtaaccctgccatgcaaaaccttggtgccgctgagcttgcaaggcagttatatgttcagaaccatctcctgcaacaaaacagtgtacagcttaatgcttccaagctccctcagcaaatgcaacctataaatgagcttgccaagggatcgttgtcttgtaatcaacttgacaccatcaccaatcatcaagaactgaagcaagaagttggcaaccagcagaggcaacagcagcacattaaccaaacaattcctttaagccaggctcaagccaatcttgtccaggcccaggtaattatccagactcagatgcagcagcagcagcaacaacaacaacaacaaccgtctccaactaggtgccagcagggaaccagtgagcaacagctgcttctttcacagcaacatcaggaccagaattttcaactgcagcaacagcagcagctattacttcaggaactgcagcggcagcagcagcagaatcagcagcagctaaacaagttgccaggtcaacttgtgaatctggctggtcaacaggctcaattgtctgaccaggaacttcagttgcagctattacagaaactacagcagcagtcacttatatcacagccagcagttacactctcacgattaccactaatgcaggaacagcagaagttacttttggacatgcagcagctatcgagttctcattcacttgcgcagcagcggatcatgcctcagcaagatagcaaagtttcactgcaagcatcacaggcgccaccaacaatgaagcaagaacagcagaagctttcacagaaacaagtcgcacttgcaaatgtgtcagatgttgcctttcaacagatctcatcaaccaacgttctgtccaaagccggaagccaactgatgattccaggtgctacacaatctgtactaactgaggaaatcccttcttgctcaacatcaccttctacagccaacaacggaaatcatttggcacacccaactattggcaggaacgagcattgcaaggtcaacatggagaaggtgcctcaatcgtctgctctgatgtcaattccaacatctagtgaagctgtaacaactccaataatgatgaaggaatcgtcgaagttgaaccataatctgaaggagaatgtaatcacctcaaagtcacccactgttgggactggacatgacaatcttttgaacattgtaccatcaacagaaaacctggaaacagcttcatcagcaacttcgttatggcctacccaaacagatggacttttgcatcaaggattccccacttctaacttgaaccagcaacaaatgttcaaagatgcacttgcagatgtggaaattcaagaagtggatccaactaacaatgctttctttgggatcaacaatgatggtccattgagctttcctatggaaacagaaggcttgttggtaagtgcacttaatcctgtgaagtgtcagactaatttgtcaactgatgttgagaacaattaccgaatacaaaaggatgcccaacaagagatctcaacctccatggtttcacagtcatttggtcagtctgatatagcttttaactcaattgattctgcaatcaacgatggtgccatgttgaacagaaattcttggccccctgcacctccaccacagagaatgcggacattcacaaaggtctacaagcgtggagctgtaggccggtccattgacataggtaggttctctggatatgaagaattgaagcatgctttggcccgcatgtttggtatagagggccaacttgaggaccgacagcgaataggctggaagttagtctacaaggatcatgaggatgacatcctacttctcggtgatgacccatgggaggagtttgtgaattgtgtgaagtgcattaggatcctatccccccaagaagtgcaacagatgagcttagacggtgatttggggaacaatgtcctctccaaccaggcttgcagcagctcagatggtgggaatgcctggaagcctcgctgtgaccagaaccctggtaacccttcgatcggcttctacgatcaatttgaatga

SEQ ID NO: 446 - protein, 1143 aa, Sorghum bicolor
  misc_feature: Ceres ANNOT ID no. 6007711
  misc_feature (270)..(353): Pfam Id: Auxin_resp Pfam Desc: Auxin response factor
  misc_feature (143)..(248): Pfam Id: B3 Pfam Desc: B3 DNA binding domain
  misc_feature (30)..(1143): NCBI GI: 19352045 NCBI Desc: auxin response factor 7a [oryza sativa]
  misc_feature (30)..(1143): NCBI GI: 115469786 NCBI Desc: os06g0702600 [oryza sativa (japonica cultivar-group)]
  misc_feature (24)..(1124): NCBI GI: 42409173 NCBI Desc: auxin response factor 7b [oryza sativa (japonica cultivar-group)]
  misc_feature (34)..(1124): NCBI GI: 19352047 NCBI Desc: auxin response factor 7b [oryza sativa]
  misc_feature (34)..(1124): NCBI GI: 115477344 NCBI Desc: os08g0520500 [oryza sativa (japonica cultivar-group)]
  misc_feature: The sequence is a functional homolog of SEQ ID NO 1001 in the 10/666,642US patent application
  misc_feature: The sequence is a functional homolog of SEQ ID NO 1003 in the 10/666,642US patent application
  misc_feature: The sequence is a functional homolog of SEQ ID NO 1004 in the 10/666,642US patent application
  misc_feature: The sequence is a functional homolog of SEQ ID NO 16 in the 10/412,699US patent application
  misc_feature: The sequence is a functional homolog of SEQ ID NO 1621 in the 10/374,780US patent application
  misc_feature: The sequence is a functional homolog of SEQ ID NO 1623 in the 10/374,780US patent application
  misc_feature: The sequence is a functional homolog of SEQ ID NO 1624 in the 10/374,780US patent application
  misc_feature: The sequence is a functional homolog of SEQ ID NO 1654 in the 10/412,699US patent application
  misc_feature: The sequence is a functional homolog of SEQ ID NO 1656 in the 10/412,699US patent application
  misc_feature: The sequence is a functional homolog of SEQ ID NO 1657 in the 10/412,699US patent application
  misc_feature: The sequence is a functional homolog of SEQ ID NO 202 in the 10/225,066US patent application
  misc_feature: The sequence is a functional homolog of SEQ ID NO 2342 in the 10/374,780US patent application
  misc_feature: The sequence is a functional homolog of SEQ ID NO 286 in the 10/412,699US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1654 in the 20040045049 US patent application
  misc_feature: The sequence is a functional homolog of SEQ ID NO 1656 in the 20040045049 US patent application
  misc_feature: The sequence is a functional homolog of SEQ ID NO 1657 in the 20040045049 US patent application
  misc_feature: The sequence is a functional homolog of SEQ ID NO 286 in the 20040045049 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 100 in the 10/666,642 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
MKQSPASSGVAPAPVAAPAPDSTGAAACEGERKAPAINADLWYACAGPLVSLPPVGSLVVYFPQGHSEQVAASMQKDIDAHVPSYPNLPSKLICLLHSVTLHADPDTDEVYAQMTLQPVNTYGKEALQLSELALKHARPQMEFFCKTLTASDTSTHGGFSVPRRAAEKILPPLDFSMQPPAQELQARDIHDNVWTFRHIFRGQPKRHLLTTGWSLFVGGKRLFAGDSVIFVRDERQQLLLGIRRASRQPTNISSSVLSSDSMHIGVLAAAAHAAANNSPFTIFYNPRASPTEFVIPFAKYQKALYSNQISLGMRFRMMFETEELGMRRYMGTITGISDLDPVRWKNSQWRNLQVGWDESAAGERRNRVSMWEIEPIAAPFFICPQPFFGVKRPRQIDDESSEMENLFKRAMPWLGEEICIKDAQTQNTTMPGLSLVQWMNMNRQQSSTLANTGIQSEYLRSLSNPAMQNLGAAELARQLYVQNHLLQQNSVQLNASKLPQQMQPINELAKGSLSCNQLDTITNHQELKQEVGNQQRQQQHINQTIPLSQAQANLVQAQVIIQTQMQQQQQQQQQQPSPTRCQQGTSEQQLLLSQQHQDQNFQLQQQQQLLLQELQRQQQQNQQQLNKLPGQLVNLAGQQAQLSDQELQLQLLQKLQQQSLISQPAVTLSRLPLMQEQQKLLLDMQQLSSSHSLAQQRIMPQQDSKVSLQASQAPPTMKQEQQKLSQKQVALANVSDVAFQQISSTNVLSKAGSQLMIPGATQSVLTEEIPSCSTSPSTANNGNHLAHPTIGRNEHCKVNMEKVPQSSALMSIPTSSEAVTTPIMMKESSKLNHNLKENVITSKSPTVGTGHDNLLNIVPSTENLETASSATSLWPTQTDGLLHQGFPTSNLNQQQMFKDALADVEIQEVDPTNNAFFGINNDGPLSFPMETEGLLVSALNPVKCQTNLSTDVENNYRIQKDAQQEISTSMVSQSFGQSDIAFNSIDSAINDGAMLNRNSWPPAPPPQRMRTFTKVYKRGAVGRSIDIGRFSGYEELKHALARMFGIEGQLEDRQRIGWKLVYKDHEDDILLLGDDPWEEFVNCVKCIRILSPQEVQQMSLDGDLGNNVLSNQACSSSDGGNAWKPRCDQNPGNPSIGFYDQFE

SEQ ID NO: 447 - DNA, 2292 bp, Sorghum bicolor
  misc_feature: Ceres ANNOT ID no. 6007715
  misc_feature: Encodes the peptide sequence at SEQ ID NO 448
  misc_feature: Down-regulated in shoot tissues in response to aminocyclopropane carboxylic treatment
atgtggaggctgaaggtggcgcggggcgggccatggctgcggtcgaccaacggcttcattggacgggcagtgtgggagttcgacccggaccttggcacgccggaggagcgcgccgaggtggacagggtccgccgggagttctccgaccgccgcttccacaggagggagtccgccgacctcctcatgcgcatgcagtgcgcaaagcagaagagatatcaacgtgatctgccgtgcctcaaacttgaggaggatgagaatgtcactgaagaaattgtagtgagctccttgaggcgggctctggatcagttctcttcgctgcaagcaagtgatggtcactggcctggtgatttcagtgggatcatgttcatcatgcctggtttgatatttgccttgtatgtcactggatcaatgaatgttgtcatatcaccggaacatcggcgtgagatatgccgctacatttacaaccaccagaacaaagatggtggatggagtacacttatccttggttcgagcaccatgtttggcacatgctcaaactacatcaccctgaggcttctcggcgaggagccatacggaaacaatggtgcattggctaaagggcgtgcttggattctatcccatggtggtgcaaccttgattccccagtggggaaagatatggctttcggtacttggagtgtttgattggtcaggaaataatccaattttccctgaactatggctcgctcctcagtttcttccatttcatccagggaaattttggtgcttaacccgcatggtatatctgccaatggcttatctttatggcaagaaatttgttggaccaattacaccaactatattggcactgagagaggagatctatgacactccatatggcgagattggttggagcgatgctgctaataaatgtgcaaaggaggacctcgtctgtccacgtacactgttgcaaaatgttttttggacttcactttacaggtgtgtggaaccagtattgagcagctgtcctgtcaacaagctgagagagagagctctgggaaacctcatggatcatatccattatgaagatgagaacacacagtacctatgcatatgttctgtgaacaaggctctaaacatggtctgctgttgggtagaagatccaaattcagatgcattcaagcgtcatcttgcaaggataccagatttcttgtggctttcagaagatggcatgaaggcacagatatatgatggctgccagagctgggagacatcattcataattcaagcattttgcgctacagatcttgtcaatgagtatgctccaactcttcagagagcctatgagtttatgaaaaattcacaggttctgaggaaccatcctggtgaccaaagttattggcatcgccatagatcgaagggctcatggacactttcatctgcagacaatggatgggctgtatctgacactacaggagaagcacttaaggctgtattgttgctgtcaaagatctcaaacaaaaacaaccttattggggatccaatagaaagagagaggctgcatgatgctattgattgccttctatcttttgtgaacaaagatggtaccttttctacatatgagtgcaaaagaacttcttcttggatagagattctaaatccttgtgagagttttccaaacatggttgtcgattacccttacccagaatgcacttcatcagtgctccaagctctgatactgttcaaagaattatatcctggttaccgcacagaagagatagaaacattggttagaaatgcagcaacatttattgagaacagacaacaagaagacggttcatggttaggtacttggggtgtatgtttcacctacggggccttcttttcaattaaaggtttagttgcttctggaagaacatataagaatagcctttccatacggaaagcatgccactttatattgtcgaagcaactcagtactggtggatggggagaaagccatgtctctaatgaaactcaggtttatgtaaatatcaaaggtgactgtgctcacgccgtgaatactgcttgggcaatgctcgctttaatttatgctggacagtttgaaagagatccaacaccattacatcgcgctgcaaaagaattgatcaatatgcagttggagacaggagagtttccacaacaagagcacgtaggatgcttcaactgctcccttttcttcaattacccaaactaccgcaacttgttccccatctgggctcttggtgagtatcatcgtggccttagtgcaaagaagagaaatgagtccatatga

SEQ ID NO: 448 - protein, 763 aa, Sorghum bicolor
  misc_feature: Ceres ANNOT ID no. 6007715
  misc_feature (144)..(187): Pfam Id: Prenyltrans Pfam Desc: Prenyltransferase and squalene oxidase repeat
  misc_feature (588)..(630): Pfam Id: Prenyltrans Pfam Desc: Prenyltransferase and squalene oxidase repeat
  misc_feature (637)..(692): Pfam Id: Prenyltrans Pfam Desc: Prenyltransferase and squalene oxidase repeat
  misc_feature (1)..(759): NCBI GI: 115485919 NCBI Desc: os11g0562100 [oryza sativa (japonica cultivar-group)]
  misc_feature (1)..(758): NCBI GI: 47834397 NCBI Desc: beta-amyrin synthase [avena prostrata]
  misc_feature (1)..(758): NCBI GI: 47834395 NCBI Desc: beta-amyrin synthase [avena longiglumis]
  misc_feature (1)..(758): NCBI GI: 15866696 NCBI Desc: beta-amyrin synthase [avena strigosa]
  misc_feature (1)..(758): NCBI GI: 47834393 NCBI Desc: beta-amyrin synthase [avena longiglumis]
  misc_feature (1)..(750): SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
  misc_feature: The sequence is a functional homolog of SEQ ID NO 4 in US patent 7135624
  misc_feature: Down-regulated in shoot tissues in response to aminocyclopropane carboxylic treatment
  misc_feature: The sequence is a functional homolog of SEQ ID NO. 343 in the 11/188,298 US application
MWRLKVARGGPWLRSTNGFIGRAVWEFDPDLGTPEERAEVDRVRREFSDRRFHRRESADLLMRMQCAKQKRYQRDLPCLKLEEDENVTEEIVVSSLRRALDQFSSLQASDGHWPGDFSGIMFIMPGLIFALYVTGSMNVVISPEHRREICRYIYNHQNKDGGWSTLILGSSTMFGTCSNYITLRLLGEEPYGNNGALAKGRAWILSHGGATLIPQWGKIWLSVLGVFDWSGNNPIFPELWLAPQFLPFHPGKFWCLTRMVYLPMAYLYGKKFVGPITPTILALREEIYDTPYGEIGWSDAANKCAKEDLVCPRTLLQNVFWTSLYRCVEPVLSSCPVNKLRERALGNLMDHIHYEDENTQYLCICSVNKALNMVCCWVEDPNSDAFKRHLARIPDFLWLSEDGMKAQIYDGCQSWETSFIIQAFCATDLVNEYAPTLQRAYEFMKNSQVLRNHPGDQSYWHRHRSKGSWTLSSADNGWAVSDTTGEALKAVLLLSKISNKNNLIGDPIERERLHDAIDCLLSFVNKDGTFSTYECKRTSSWIEILNPCESFPNMVVDYPYPECTSSVLQALILFKELYPGYRTEEIETLVRNAATFIENRQQEDGSWLGTWGVCFTYGAFFSIKGLVASGRTYKNSLSIRKACHFILSKQLSTGGWGESHVSNETQVYVNIKGDCAHAVNTAWAMLALIYAGQFERDPTPLHRAAKELINMQLETGEFPQQEHVGCFNCSLFFNYPNYRNLFPIWALGEYHRGLSAKKRNESI

SEQ ID NO: 449 - DNA, 2274 bp, Sorghum bicolor
  misc_feature: Ceres ANNOT ID no. 6007720
  misc_feature: Encodes the peptide sequence at SEQ ID NO 450
  misc_feature: Up-regulated in shoot tissues in response to methyl jasmonate treatment
  misc_feature: Up-regulated in root tissues in response to methyl jasmonate treatment
atgtggcgcctgcggatcacggaggggggcggggacccctggctccgcacgaagaacgcccacgtcggccgccaggtctgggagttcgacgccgccgccgaccccgaccccgccgtcgacgccgcgcgccgggccttcgtcgacaccaggcgccaactcaagcacagcgccgacctcctcatgcgcatccagtttgccaaagaaaatccgcttgagcttgaccttccagcgatcaagcttggtgagcatgaagatgttaccgaggaagccgtgtcgactaccttgaaaagggcaatcagccgtttttctactctccaggcacacgatggacactggcctggggattatggtggccctatgttccttatgccaggcttgatcataacattgtatgtgactggagcactaaacactgtcctgtcaccagaacaccagaaggagatccgccggtatctttataatcatcagaatgaagatggtggctggggattgcacattgagggtccaagcaccatgtttggctcagcactgacctacgttattttgagattgcttggagagggaccagatagtggagatggagccatggagaaaggtcgaaactggatattagaccatggtggagcaacatatataacatcatgggggaagttttggctctcggtactgggtgtatttgaatggtctggtaacaacccggtgccaccagaagtatggctactgccatatctcctcccatttcacccagggaggatgtggtgtcattgtcgaatggtgtatttgccaatgtgctacatttatgggaagaggtttgttggccgaatcacaccacttctgttggaattaaggaaggagcttttcaaagaaccttataacaagattgattgggacaaagcccgcaatctatgtgctaaggaagatctgtactacccacacccattcgttcaagatgtgttatgggccactctccataaattcgttgaaccagttatgatgcattggcctggcagcaaattgagggagaaagctctggaaacagtcatgcagcatgttcactatgaggatgagaacactcgttacatttgcattggtcctgtaaacaaggtattgaatatgcttgcttgctggattgaagatccaaactcagaggccttcaaacttcatatcccacgagtctatgattacttgtggcttgctgaagatggcatgaagatgcagggttataatggcagccaactttgggatacagcttttgcagttcaagccattgtggctaccaaccttattgaagagtttggtcccacccttaaactagcacacaactatatcaagaattcgcaggttcttgatgactgccctggtgatctggatgactggtaccgccacacatctaaaggtgcatggccattctcaactgctgatcatggttggcctatatctgattgcactgctgaaggactaaaggcttcattattgttatcaaagatctctcccaaaattgttggtgaaccggtggaagctaatagattttatgatgctgtcagttgtctaatgtcttatatgaatgataatggtggtttcgcgacatatgaactcacaagatcttatccctggctggagcttatcaatcctgctgagacctttggggatattgtgattgattacccgtatgttgaatgtacatcagcagcaattcaggccttgacatcattcaaaaaactataccctgggcaccgcaggaaagaggtggatagctgtatcagcaaagcttctaatttcattgagagtattcagaaaagtgatggttcatggtatggctcttgggctgtttgtttcacatacggcacttggtttggtgtgaagggactaattgctgctggtagaacatttgagaacagtcctgcaattagaaaggcatgcgactttctgttatcaaaagaacttccttcgggtggttggggagaaagctatttgtcctctcaagaccaggtttacaccaatctcaaaggcaacagacctcatgcagtgaacactagttgggccatgctggcactgattgatgcaggacaggctgagagagacccaacgcctctacaccgagcagcaaaggttttgatcaacttgcaatcagaggatggagaatttcctcagcaagagatcataggagtgttcaacaagaactgcatgatcagttactcccagtacaggaacaccttcccaatttgggctctgggtgagtaccggtgccgagtcttggcgtctggcaagcagtag

SEQ ID NO: 450 - protein, 757 aa, Sorghum bicolor
  misc_feature: Ceres ANNOT ID no. 6007720
  misc_feature (143)..(186): Pfam Id: Prenyltrans Pfam Desc: Prenyltransferase and squalene oxidase repeat
  misc_feature (585)..(627): Pfam Id: Prenyltrans Pfam Desc: Prenyltransferase and squalene oxidase repeat
  misc_feature (634)..(689): Pfam Id: Prenyltrans Pfam Desc: Prenyltransferase and squalene oxidase repeat
  misc_feature (1)..(756): NCBI GI: 15866702 NCBI Desc: cycloartenol synthase [avena strigosa]
  misc_feature (1)..(756): NCBI GI: 47834383 NCBI Desc: cycloartenol synthase [avena longiglumis]
  misc_feature (1)..(756): NCBI GI: 47834381 NCBI Desc: cycloartenol synthase [avena longiglumis]
  misc_feature (1)..(756): NCBI GI: 47834387 NCBI Desc: cycloartenol synthase [avena strigosa]
  misc_feature (1)..(756): NCBI GI: 47834385 NCBI Desc: cycloartenol synthase [avena prostrata]
  misc_feature (1)..(752): SWISSPROT Homolog: EC 5.4.99.8 Cycloartenol synthase
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO 15 in US patent 7186884
  misc_feature: Up-regulated in shoot tissues in response to methyl jasmonate treatment
  misc_feature: Up-regulated in root tissues in response to methyl jasmonate treatment
  misc_feature: The sequence is a functional homolog of SEQ ID NO. 343 in the 11/188,298 US application
MWRLRITEGGGDPWLRTKNAHVGRQVWEFDAAADPDPAVDAARRAFVDTRRQLKHSADLLMRIQFAKENPLELDLPAIKLGEHEDVTEEAVSTTLKRAISRFSTLQAHDGHWPGDYGGPMFLMPGLIITLYVTGALNTVLSPEHQKEIRRYLYNHQNEDGGWGLHIEGPSTMFGSALTYVILRLLGEGPDSGDGAMEKGRNWILDHGGATYITSWGKFWLSVLGVFEWSGNNPVPPEVWLLPYLLPFHPGRMWCHCRMVYLPMCYIYGKRFVGRITPLLLELRKELFKEPYNKIDWDKARNLCAKEDLYYPHPFVQDVLWATLHKFVEPVMMHWPGSKLREKALETVMQHVHYEDENTRYICIGPVNKVLNMLACWIEDPNSEAFKLHIPRVYDYLWLAEDGMKMQGYNGSQLWDTAFAVQAIVATNLIEEFGPTLKLAHNYIKNSQVLDDCPGDLDDWYRHTSKGAWPFSTADHGWPISDCTAEGLKASLLLSKISPKIVGEPVEANRFYDAVSCLMSYMNDNGGFATYELTRSYPWLELINPAETFGDIVIDYPYVECTSAAIQALTSFKKLYPGHRRKEVDSCISKASNFIESIQKSDGSWYGSWAVCFTYGTWFGVKGLIAAGRTFENSPAIRKACDFLLSKELPSGGWGESYLSSQDQVYTNLKGNRPHAVNTSWAMLALIDAGQAERDPTPLHRAAKVLINLQSEDGEFPQQEIIGVFNKNCMISYSQYRNTFPIWALGEYRCRVLASGKQ

SEQ ID NO: 451 - DNA, 2286 bp, Sorghum bicolor
  misc_feature: Ceres ANNOT ID no. 6007721
  misc_feature: Encodes the peptide sequence at SEQ ID NO 452
atgtggcgcctgcgggtcgcggaggacggcggcggcggggggggcgggctccgcacgaagaacggccacgtcggccgccaggtctgggagttcgacgccgccgccgaccccgaccccgccgtcgacgccgcgcggcaggccttcgtcgacaccaggcaccacctcaagcacagcgccgacctgctcatgcgcatccagttggccaaagaaaatcctcttcagctggaccttctggcgatgaaactagatgagcatgaagatgttaccgttgaagccgtgtccactaccttgaaaagggcactcaaccgtttttctactatccaggcacacgatgggcactggcctggggactatggtggtcctatgttcctcatgccaggcttggtcataacattgtatgtgactggagcactaaacattgtcctatcaccagaacaccagaaggagatccgtcgatatctttataaccatcagaatgaagatggcggttggggcatgcacattgagggtccgagcaccatgtttggctcagcactgagctatgttattttgagattgcttggagagggaccagatagcggagatggagccatggagaatggtcgaaactggatcttagatcatggtggagcaacatatatagcatcatgggggaagttttggctttcgatacttggtgtatttgaatggtctggtaacaacccggtcccaccagaactatggctactaccatatctcctgccatttcatccagggaggatgtggtgtcattgtcgaatgttgtatttgcctatgtgctacatttatgggaagaggtttgtcggccgaatcacaccacttgtgttggaattgagaaaggaaattttcaatgacccttacaacgagattgattgggacaaggtccgcaacatatgtgctaaggaagatctgtaccgtccgcacccatttgttcaagatgtcttatgggcatctctccataaatttgttgaaccagttatgatgcactggcctggttgcaaattgagggagaaagctctagaaattgtcatgcaacatgttcactatgaggatgagaacactcaatacatctgcattggtcctgtaaccaaggtattaaatatgcttgcttgctggattgaagatccaaactcagaggcattcaaactccacattccacgagtatatgattacttgtggcttgctgaagatggcatgaagatgcagggttataatggcagccaactttgggatacagctttcgcagttcaagccattgtggctactaaccttattaaagagtttggtcccacccttaaactagcacacagctacatcaagaattcgcaggttcttgacgactgtcctggtgatctgaatgactggtaccgccacacatctaaaggtgcatggccattctcaactgctgataatggttggactgtatctgattgcactgcagaaggattaaaggcttcattattgttatcaaagatttctcctgagattgttggtgaaccggtggaagctaataggttttacgatgctgtcagttgtctgatgtcttatatgaatgataatggtggcttcgcgacatatgaactcacgagatcttatgcctggctggagcttatcaatcctacggagacctttggggacattatgattgattacccgtatgttgaatgtacatcagcagcaattcaggccctgacatcattcagaaaactctaccctgggcatcgcaggaaagaggtggacaactgtatcagcaaagctgccaatttcattgaggatgttcagagaagcgacggttcatggtatggctcttgggctgtttgcttcacgtatggcacttggtttggtgtgaagggactaattgctgctggtagaacatttgagaacagtcctgcgatcagaaaggcatgcggctttctgttatcaaaagagcttcttccttccggtggttggggagaaagctatttatcatctcaagaccaggtttacaccaatctcaaaggcaaccgagctcatgcagtgaacactagttgggccatgctggcactgattgatgcaggacaggctgagagagatccaacacctctacaccgagcagcaaaggttttgatcaacttgcaatcagaggatggagaatttcctcagcaagagatcgtaggagtgttcaacaagaactgcatgatcagctactcccagtacaggaacatcttcccaatttgggctctgggtgcgtaccggtgccgggtcctcctggaagatggcaagcagtag

SEQ ID NO: 452 - protein, 761 aa, Sorghum bicolor
  misc_feature: Ceres ANNOT ID no. 6007721
  misc_feature (145)..(188): Pfam Id: Prenyltrans Pfam Desc: Prenyltransferase and squalene oxidase repeat
  misc_feature (587)..(629): Pfam Id: Prenyltrans Pfam Desc: Prenyltransferase and squalene oxidase repeat
  misc_feature (1)..(755): NCBI GI: 47834387 NCBI Desc: cycloartenol synthase [avena strigosa]
  misc_feature (1)..(755): NCBI GI: 15866702 NCBI Desc: cycloartenol synthase [avena strigosa]
  misc_feature (1)..(755): NCBI GI: 47834383 NCBI Desc: cycloartenol synthase [avena longiglumis]
  misc_feature (1)..(755): NCBI GI: 47834381 NCBI Desc: cycloartenol synthase [avena longiglumis]
  misc_feature (1)..(755): NCBI GI: 47834385 NCBI Desc: cycloartenol synthase [avena prostrata]
  misc_feature (1)..(760): SWISSPROT Homolog: EC 5.4.99.8 Cycloartenol synthase
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO 15 in US patent 7186884
  misc_feature: The sequence is a functional homolog of SEQ ID NO. 343 in the 11/188,298 US application
MWRLRVAEDGGGGGGGLRTKNGHVGRQVWEFDAAADPDPAVDAARQAFVDTRHHLKHSADLLMRIQLAKENPLQLDLLAMKLDEHEDVTVEAVSTTLKRALNRFSTIQAHDGHWPGDYGGPMFLMPGLVITLYVTGALNIVLSPEHQKEIRRYLYNHQNEDGGWGMHIEGPSTMFGSALSYVILRLLGEGPDSGDGAMENGRNWILDHGGATYIASWGKFWLSILGVFEWSGNNPVPPELWLLPYLLPFHPGRMWCHCRMLYLPMCYIYGKRFVGRITPLVLELRKEIFNDPYNEIDWDKVRNICAKEDLYRPHPFVQDVLWASLHKFVEPVMMHWPGCKLREKALEIVMQHVHYEDENTQYICIGPVTKVLNMLACWIEDPNSEAFKLHIPRVYDYLWLAEDGMKMQGYNGSQLWDTAFAVQAIVATNLIKEFGPTLKLAHSYIKNSQVLDDCPGDLNDWYRHTSKGAWPFSTADNGWTVSDCTAEGLKASLLLSKISPEIVGEPVEANRFYDAVSCLMSYMNDNGGFATYELTRSYAWLELINPTETFGDIMIDYPYVECTSAAIQALTSFRKLYPGHRRKEVDNCISKAANFIEDVQRSDGSWYGSWAVCFTYGTWFGVKGLIAAGRTFENSPAIRKACGFLLSKELLPSGGWGESYLSSQDQVYTNLKGNRAHAVNTSWAMLALIDAGQAERDPTPLHRAAKVLINLQSEDGEFPQQEIVGVFNKNCMISYSQYRNIFPIWALGAYRCRVLLEDGKQ

SEQ ID NO: 453 - DNA, 1953 bp, Sorghum bicolor
  misc_feature: Ceres ANNOT ID no. 6007728
  misc_feature: Encodes the peptide sequence at SEQ ID NO 454
atgccgctggggcagcgcccaggggacaagagcgactcccgctactgcggggtggaggtgctcgacttccccgccggcgagggcctccccgccgtcctcagccactccatctcctccggcttcgacttcatcctcgctcctctggttgacccgaactaccggccggcgcccggcgccgtcctgcccgtgtcggcgtcggacctcgtcctcggcccggcccagtggagcaaccacgtcgtcgggaagatcagcgagtggatcgatttggacgcggaggacgagcggctccgcctggactccgagctcacgctgaagcaggagatcgcgtgggcgtctcacgtctcgctgcaggcatgtgttcttcctgccccctggacatctttttgtggcaattatgccagagttgtgaatcaaattttgcaaggcctgaccaatatgcatttatggcttaggttgcctctggagaagtccgagcctatggatgacgatcttgataaaataaagaataacaaccacatgagtgaaatagtagactcgtgggaattatggaattcgttcagattgctatgtgaccatagtagccaactatgtgtggcacttgatatttcgagcacactgccatcaataaactcattagggcggtggtttggggagcctgtaaaggctgctattctgcaaaccaatgcttatcttacaaattcaaaaggatatccttgtttatcaaagcggcatcagaggctgctaactggattttttaaccattctgttcaggtgataatctctgggagatcaaatctcaatgttttcccagcatctggagtgctctcaggtgatgagagctgcattgaagattcccctgttcgacatgcattagctccgtacctggagtacattgcgtacctatatcagaagatggatccacttcctgagcaggaacgctttgagattaattacagggattttttgcagtctcctctccagcctctaatggataatttggaagctcagacttatgagacatttgagaaggatgttgtgaagtatactcagtatcgaagagcagttgctaaggccttggttgatagggttgcagatgatgcagtctccacaactaggactgttctgatggttgtgggagcaggccgaggacctctagtacgagcatcattgcaggccgctgaagaaactggtcgcaagttaaaagtatatgctgttgaaaaaaatcctaacgctgttattactcttcatagtttgatcaaattggagggttgggaaagcctggttactgtaatttctagtgacatgcggtgttgggatgcccctgaaaaggcagatattctggtcagtgaattgcttgggtcctttggtgacaatgaactatctcctgagtgtcttgatggtgctcagcgattcttgaagcctgatgggatttccattccttcatcatataccagcttcatccaaccaataacagcatcaaaactgcacaacgatattaaagcacacaaagatattgctcattttgaaacagcatatgttgtcaaactacaccgtatagcgacacttgcacctacacaacaggtttttactttcaaccatccaaatttctcaccaagtgctagcaaccaaaggtacaccaagttgcaatttgaaatgctaccagatatgggttcatgccttgtgcacggatttgctggctattttgactccgttctctataaggatgttcatcttggaatcgagccaaacaccgctacaccaaacatgtttagctggttccccatcttcttcccattgagaaagcccatctacgtgccccaagggtctcctatagaagtgcacttctggcgctgctgtgcccccacaaaggtgtggtacgagtgggctgtcactacgccgaccccgtcgccggtccacaacagcaatggccgctcgtactgggttggtctgtaa

SEQ ID NO: 454 - protein, 650 aa, Sorghum bicolor
  misc_feature: Ceres ANNOT ID no. 6007728
  misc_feature (175)..(632): Pfam Id: PRMT5 Pfam Desc: PRMT5 arginine-N-methyltransferase
  misc_feature (60)..(650): NCBI GI: 7270014 NCBI Desc: kinase binding protein-like [arabidopsis thaliana]
  misc_feature (1)..(650): NCBI GI: 30688918 NCBI Desc: skb1 methyltransferase family protein [arabidopsis thaliana]
  misc_feature (1)..(650): NCBI GI: 92871400 NCBI Desc: sam (and some other nucleotide) binding motif; skb1 methyltransferase [medicago truncatula]
  misc_feature (1)..(592): NCBI GI: 42573101 NCBI Desc: skb1 methyltransferase family protein [arabidopsis thaliana]
  misc_feature (294)..(650): NCBI GI: 82581643 NCBI Desc: protein arginine n-methyltransferase 5 (shk1 kinase-binding protein 1 homolog) (skb1 homolog)
  misc_feature (294)..(650): SWISSPROT Homolog: EC 2.1.1.125 Protein arginine N-methyltransferase 5
MPLGQRPGDKSDSRYCGVEVLDFPAGEGLPAVLSHSISSGFDFILAPLVDPNYRPAPGAVLPVSASDLVLGPAQWSNHVVGKISEWIDLDAEDERLRLDSELTLKQEIAWASHVSLQACVLPAPWTSFCGNYARVVNQILQGLTNMHLWLRLPLEKSEPMDDDLDKIKNNNHMSEIVDSWELWNSFRLLCDHSSQLCVALDISSTLPSINSLGRWFGEPVKAAILQTNAYLTNSKGYPCLSKRHQRLLTGFFNHSVQVIISGRSNLNVFPASGVLSGDESCIEDSPVRHALAPYLEYIAYLYQKMDPLPEQERFEINYRDFLQSPLQPLMDNLEAQTYETFEKDVVKYTQYRRAVAKALVDRVADDAVSTTRTVLMVVGAGRGPLVRASLQAAEETGRKLKVYAVEKNPNAVITLHSLIKLEGWESLVTVISSDMRCWDAPEKADILVSELLGSFGDNELSPECLDGAQRFLKPDGISIPSSYTSFIQPITASKLHNDIKAHKDIAHFETAYVVKLHRIATLAPTQQVFTFNHPNFSPSASNQRYTKLQFEMLPDMGSCLVHGFAGYFDSVLYKDVHLGIEPNTATPNMFSWFPIFFPLRKPIYVPQGSPIEVHFWRCCAPTKVWYEWAVTTPTPSPVHNSNGRSYWVGL

SEQ ID NO: 455 - DNA, 1110 bp, Sorghum bicolor
  misc_feature: Ceres ANNOT ID no. 6007733
  misc_feature: Encodes the peptide sequence at SEQ ID NO 456
atgaatacagattttcatatgactgaaggggaaggagaatggagctactccaaaaattctaggcgtcaagaaattttttttcttgagacgaggccaatgattgagaatgccataaaagaagtgtacacaactcttctccccaaaactatgatcattgctgacctaggatgctcttcagggccaaacacaatgctcttcatatctagtgtcataaacatcattgttgaaaaatgtaaatctactggagatgattgcatggaacttcaattcttcttgaatgaccttcccggtaatgactttaatgaactatttcggtcaattgagaagttcaaaaggccaaatacaacaggtgaaagggaacatctaccacctttatattatattatggggttaccagaatcctattacaaaaggctttttcctcgtgaaagtgtccatctattccactcttcatactgccttcactggcgctcccaggaacctgagggactagaggcatggagaaaaacttatctaaataaaaacaacatttacattacgaagaccacaacaccttttgtggtcaaacaattccaaaagttgttctacaaggacttctccctcttcctacagctgcgtcatgaagaacttgtgcatggagggcaaatggtccttatatttcttgggaggaagaatgaggatgtatataatggtgatctcaatcaactttttgcattggttgcaagatcgttacagtctcttgttttgaagggcattgtggagaaggaaaagctagaatctttcaatctaccaatctatgggccgtcggttggagaagtgaaggaactagtcatgcaaagtcatttattcaacatggatctaattaaacaatttgagatgaactgggacccttttgatgatttagaaggtgatgatgttgaggataatacccgcagtagcatgaatattgctaagttcatcatgtccgtactaaaatatttaattgttcaccattttggagaaaccatactcgatgcatggtttgccgagttcaagtgcctcgttggtgagcaccttgaaaaggagaagaccaagttcaccgtcatcgccatgtccttgaagaaagaataa

SEQ ID NO: 456 - protein, 369 aa, Sorghum bicolor
  misc_feature: Ceres ANNOT ID no. 6007733
  misc_feature (34)..(369): Pfam Id: Methyltransf_7 Pfam Desc: SAM dependent carboxyl methyltransferase
  misc_feature (1)..(365): NCBI GI: 115467342 NCBI Desc: os06g0242000 [oryza sativa (japonica cultivar-group)]
  misc_feature (7)..(368): NCBI GI: 45238343 NCBI Desc: carboxyl methyltransferase [crocus sativus]
  misc_feature (4)..(367): NCBI GI: 42528301 NCBI Desc: benzothiadiazole-induced s-adenosyl-l-methionine:salicylic acid carboxyl methyltransferase 1; bth-induced s-adenosyl-l-methionine:salicylic acid carboxyl
  misc_feature (4)..(367): NCBI GI: 42528301 (continued) methyltransferase 1 [oryza sativa (indica cultivar-group)]
  misc_feature (6)..(369): NCBI GI: 140048982 NCBI Desc: sam dependent carboxyl methyltransferase; four-helical cytokine [medicago truncatula]
  misc_feature (6)..(368): NCBI GI: 140067009 NCBI Desc: sam dependent carboxyl methyltransferase [medicago truncatula]
MNTDFHMTEGEGEWSYSKNSRRQEIFFLETRPMIENAIKEVYTTLLPKTMIIADLGCSSGPNTMLFISSVINIIVEKCKSTGDDCMELQFFLNDLPGNDFNELFRSIEKFKRPNTTGEREHLPPLYYIMGLPESYYKRLFPRESVHLFHSSYCLHWRSQEPEGLEAWRKTYLNKNNIYITKTTTPFVVKQFQKLFYKDFSLFLQLRHEELVHGGQMVLIFLGRKNEDVYNGDLNQLFALVARSLQSLVLKGIVEKEKLESFNLPIYGPSVGEVKELVMQSHLFNMDLIKQFEMNWDPFDDLEGDDVEDNTRSSMNIAKFIMSVLKYLIVHHFGETILDAWFAEFKCLVGEHLEKEKTKFTVIAMSLKKE

SEQ ID NO: 457 - DNA, 1092 bp, Sorghum bicolor
  misc_feature: Ceres ANNOT ID no. 6007734
  misc_feature: Encodes the peptide sequence at SEQ ID NO 458
atggctgatggggaaggagaatggagctactccaagaattctaggcgtccagaaatatattttcgtgagaccaagccagtggttgagaatgccataaaagaagtgtacacaactcttctccccaaaactatgatcattggcgacctagcatgcgctgcggggccaaacacattgctcttcatgtccagtgttataagcaccattgttgaacactgtaaatctagtagggatgattccgtggaacttcaattcttcttgaatgaccttcccggcaacgactttaacgaactatttcggttaattgagaagttcagaaggccaaatataacgggtgaaagggcacatctaccacctttttattatattcaagggttaccagaatcctattataacaggctttttccccgtgaaagtgtccacatattccactcttcatacggtcttcattggcgctcccaggaacttgagggactagagtcgtggagaaaaacttatctaaatgaagacaacatttacattacaaagaccacaacaccttttgtggtgaaacaattccagaagctgttctataaggacttctccctcttcctaaagttgcgtcacgaagaacttgtgcatggagggcaaatggttcttatatttaatgggagaaaggatgaggatgtatacaatggtgatcttaataaactttttgcattggttgcaatagcattaaagtctcttgttttgaagggccttgtggacaaggaaaagctacaatctttcaatctaccagtctacgggccatcagttggagaagtgaaagaactagtcatgcaaagccatttatttaacatgaatctaatcaaacaatttgagacgaactgggatccttttgatgattcagaaggtgatgatgttgaagataatgcctgcagtagcatgaacattgctaagtttataagacctgcactaaagtctttaattgttcgccatttcggagaaaccataattgacgcatggtttaccgagttcaagagccttgttgctgagcaccttgaaaaggagaagaccaagttcaccatcatcgtcatgtccttgaagaaagaataa

SEQ ID NO: 458 - protein, 363 aa, Sorghum bicolor
  misc_feature: Ceres ANNOT ID no. 6007734
  misc_feature (28)..(363): Pfam Id: Methyltransf_7 Pfam Desc: SAM dependent carboxyl methyltransferase
  misc_feature (1)..(359): NCBI GI: 115467342 NCBI Desc: os06g0242000 [oryza sativa (japonica cultivar-group)]
  misc_feature (1)..(362): NCBI GI: 45238343 NCBI Desc: carboxyl methyltransferase [crocus sativus]
  misc_feature (1)..(361): NCBI GI: 42528301 NCBI Desc: benzothiadiazole-induced s-adenosyl-l-methionine:salicylic acid carboxyl methyltransferase 1; bth-induced s-adenosyl-l-methionine:salicylic acid carboxyl
  misc_feature (1)..(361): NCBI GI: 42528301 (continued) methyltransferase 1 [oryza sativa (indica cultivar-group)]
  misc_feature (156)..(362): NCBI GI: 115467344 NCBI Desc: os06g0242700 [oryza sativa (japonica cultivar-group)]
  misc_feature (1)..(363): NCBI GI: 140048982 NCBI Desc: sam dependent carboxyl methyltransferase; four-helical cytokine [medicago truncatula]
MADGEGEWSYSKNSRRPEIYFRETKPVVENAIKEVYTTLLPKTMIIGDLACAAGPNTLLFMSSVISTIVEHCKSSRDDSVELQFFLNDLPGNDFNELFRLIEKFRRPNITGERAHLPPFYYIQGLPESYYNRLFPRESVHIFHSSYGLHWRSQELEGLESWRKTYLNEDNIYITKTTTPFVVKQFQKLFYKDFSLFLKLRHEELVHGGQMVLIFNGRKDEDVYNGDLNKLFALVAIALKSLVLKGLVDKEKLQSFNLPVYGPSVGEVKELVMQSHLFNMNLIKQFETNWDPFDDSEGDDVEDNACSSMNIAKFIRPALKSLIVRHFGETIIDAWFTEFKSLVAEHLEKEKTKFTIIVMSLKKE

SEQ ID NO: 459 - DNA, 1806 bp, Sorghum bicolor
  misc_feature: Ceres ANNOT ID no. 6007750
  misc_feature: Encodes the peptide sequence at SEQ ID NO 460
atgtcggcgccccactgcgcgtcctcctcctcctctgcattcctcagcctcccgcgcagcgacggcgggcggcgctacggcaactcatgccacttcgctgccaacgctaggctggcgacggtgtccgccacgctcgacaaggagaccgcggcggcgaagccccggaggtcccgccggcccaggaaggcgaccaagtccggctccacggcgctgctcgcccccgacgagcccacggaggccaagaacggtgtggccaccgaggcaccgaacggcggcctcggcggtaggggtatggtggcgctggacgatgtgatcgtgaacccggtggggctgggccgccggtcccggcaggtgttcgacgaggtgtggcgcaagttctcgcggctcggccagatgtccagcgcctcctccgccgcggtggcagagcaggacccagccatcctcttccgcggcggacccatgtgcgacttcaccgtgcccggcgcgcaggacaccaccgtcctcgtcgttggcgccaccagccgcattggccgcatagttgtccgcaagctcatgctccgcggatacaacgtcaaggcattagttaggaggaatgacccagaagtgatcgacatgcttccgaggtctgtggatattgtggttggagatgttggcgacccttcttcagttcaagctgctgtgtcaggttgcaacaaggtaatttactgtgcaaccgcgcggtccactatcacgggggacctcaacagggttgataaccaaggagtgaggaatgttaccaaggccttccaggattactacaatcagctggcccagtcaagggctggtaagagcagcaagagcaaactgttgattgctaaattcaaatctgccaaatctgtgaaaggatgggaggtgcggcagggatcatactttcaggatatctacccttctacttctagattcgaaggtggcaccgatgcgtcatttgaatttgcagaaagtggacaggctgttttctcagggtttgttttcacaaggggtgggtacgttgaaatctctaaacgactttcacttcctctaggttccaccctagacaggtatgatggcttgcttctttcggtgggtggaaatggaagatcatatgttatcattcttgagactggtccgctggctgacacctcacagagcaagaagtattttgcccggatgaacacaaaagttgggttttgtagggtaagagtgccgttttcatctttccggccagtaaacccacaggatcctccactggacccgtttcttgtccacacactaaccattaggtttgaaccaaagaagcagagacctggtgattcatctgaaggagctagtgaccaaagaaactttgagctcaaaatggagttcataaaagccttgccgagtggtcaagaaacagaaattgtactggtctcatgcacaggctcaggaattgaagctaataggagagaacaagtcctgaaagcaaagaaggctggagaagatgcattgaggagatctggccttggatatacaattgtacggccaggtccactgcaggaagaacctggcggtcagcgtgccttgatcttcgaccaagggaacaggatctctcagggcatcagctgcgccgatgtagcagacatctgcgtcaaagcgttgcacgattcgaccgcgaggaacaagagcttcgatgtgtgctatgagcatgtttcagagcaagggagcgagctatatgaacttgtggctcatctgccagacaaggccaacaactacctggcgccggcgctctcggtcctggagaagaacacctga

SEQ ID NO: 460 - protein, 601 aa, Sorghum bicolor
  misc_feature: Ceres ANNOT ID no. 6007750
  misc_feature (302)..(463): Pfam Id: CIA30 Pfam Desc: Complex I intermediate-associated protein 30 (CIA30)
  misc_feature (161)..(463): NCBI GI: 20339364 NCBI Desc: uos1 [pisum sativum]
  misc_feature (490)..(582): NCBI GI: 67922003 NCBI Desc: similar to nucleoside-diphosphate-sugar epimerases [crocosphaera watsonii wh 8501]
  misc_feature (169)..(258): NCBI GI: 86605827 NCBI Desc: 3-beta hydroxysteroid dehydrogenase/isomerase family protein [cyanobacteria bacterium yellowstone a-prime]
  misc_feature (169)..(258): NCBI GI: 75910514 NCBI Desc: 3-beta hydroxysteroid dehydrogenase/isomerase [anabaena variabilis atcc 29413]
  misc_feature (169)..(258): NCBI GI: 86608008 NCBI Desc: 3-beta hydroxysteroid dehydrogenase/isomerase family protein [cyanobacteria bacterium yellowstone b-prime]
MSAPHCASSSSSAFLSLPRSDGGRRYGNSCHFAANARLATVSATLDKETAAAKPRRSRRPRKATKSGSTALLAPDEPTEAKNGVATEAPNGGLGGRGMVALDDVIVNPVGLGRRSRQVFDEVWRKFSRLGQMSSASSAAVAEQDPAILFRGGPMCDFTVPGAQDTTVLVVGATSRIGRIVVRKLMLRGYNVKALVRRNDPEVIDMLPRSVDIVVGDVGDPSSVQAAVSGCNKVIYCATARSTITGDLNRVDNQGVRNVTKAFQDYYNQLAQSRAGKSSKSKLLIAKFKSAKSVKGWEVRQGSYFQDIYPSTSRFEGGTDASFEFAESGQAVFSGFVFTRGGYVEISKRLSLPLGSTLDRYDGLLLSVGGNGRSYVIILETGPLADTSQSKKYFARMNTKVGFCRVRVPFSSFRPVNPQDPPLDPFLVHTLTIRFEPKKQRPGDSSEGASDQRNFELKMEFIKALPSGQETEIVLVSCTGSGIEANRREQVLKAKKAGEDALRRSGLGYTIVRPGPLQEEPGGQRALIFDQGNRISQGISCADVADICVKALHDSTARNKSFDVCYEHVSEQGSELYELVAHLPDKANNYLAPALSVLEKNT

SEQ ID NO: 461 - DNA, 1338 bp, Sorghum bicolor
  misc_feature: Ceres ANNOT ID no. 6007751
  misc_feature: Encodes the peptide sequence at SEQ ID NO 462
atggcggtggcggcggcccgacgcctcttctccttccacctccacgcgcgccctctcgccgccggtgttgccgtcgcgacaccacaccgccgcggaaagcatgatgcggtctcgtgcaaggccacggggaaaaccaagcccaagcccaagcccaagtccaaggcgaaggcggtcaagggcggcgagcggcagcagaggcgggcgctggaggagcacctcaaacggcgcacccgttccgcggcttccttcgacgccgacctgtacggtcggcgcgcccacgagcaccacgtccccgtcttgcttggcgaggtcctcgccgccttccgccggccccgcccactccgttccttcgtcgactgcaccctcggcgccgcgggacactccctcgccatgatggaggcgcacccggagttggagctgtacattggcatggacgtcgacccatctgccctggagattggccgtgggcacattgagaccttccttgctggtagggaaagggaagcgaatggaagggaagaggatgtcttgcaggagactctgcgtgcctacactcatgtcaagaacttcaagtacatcaagcaagttctcggtagtgtggatgagagtctggcggttggctcttctggagttgatggtatcctcattgaccttggcatgtcatccatgcaggtgaatagatcaaataggggattcagtgtactccaggatggccctcttgatatgcgcatggaccctaaggcaactttaagagcagaggacattttgaattcttggccggagattgaacttgggcgtatcctgcgtgaatatggggaggaaagcaactggcaatcagttcagaagcaaattgttaaagcccgagctacgggcggtttgcactctactggggatcttgtcaaactaatccaaaggatgtgtagcatctcaagcgggcggcaaggctggattaagactgcaacaagagtgtttcaggccctcaggattgcagttaatgatgaactccgggttctagaagattcactccattcatgctttgactgcctagcgacaggtggccgtcttgctgtaatctcattccacagtctggaggacagaattgtgaagaagactttcttggagctcatccatgggggtgaagcagatgatgaagaagacgacaaagatgacctggcgctcactgacatcgtaaatgaagatgaaccatggtttggccagagagtgcaaggaaggaatggaactgtcctcacaaaaagaccaataaccccctcgcaagaggaggaaaaactaaatcagaggtgcagaagcgcaaagcttagagttattcagaagaactga

SEQ ID NO: 462 - protein, 445 aa, Sorghum bicolor
  misc_feature: Ceres ANNOT ID no. 6007751
  misc_feature (94)..(445): Pfam Id: Methyltransf_5 Pfam Desc: MraW methylase family
  misc_feature (197)..(378): NCBI GI: 27262272 NCBI Desc: methyltransferase [heliobacillus mobilis]
  misc_feature (206)..(369): NCBI GI: 46445945 NCBI Desc: probable s-adenosyl-methyltransferase [parachlamydia sp. uwe25]
  misc_feature (169)..(375): NCBI GI: 134298535 NCBI Desc: s-adenosyl-methyltransferase mraw [desulfotomaculum reducens mi-1]
  misc_feature (184)..(372): NCBI GI: 68565432 NCBI Desc: s-adenosyl-methyltransferase mraw
  misc_feature (206)..(378): NCBI GI: 121535927 NCBI Desc: s-adenosyl-methyltransferase mraw [thermosinus carboxydivorans nor1]
MAVAAARRLFSFHLHARPLAAGVAVATPHRRGKHDAVSCKATGKTKPKPKPKSKAKAVKGGERQQRRALEEHLKRRTRSAASFDADLYGRRAHEHHVPVLLGEVLAAFRRPRPLRSFVDCTLGAAGHSLAMMEAHPELELYIGMDVDPSALEIGRGHIETFLAGREREANGREEDVLQETLRAYTHVKNFKYIKQVLGSVDESLAVGSSGVDGILIDLGMSSMQVNRSNRGFSVLQDGPLDMRMDPKATLRAEDILNSWPEIELGRILREYGEESNWQSVQKQIVKARATGGLHSTGDLVKLIQRMCSISSGRQGWIKTATRVFQALRIAVNDELRVLEDSLHSCFDCLATGGRLAVISFHSLEDRIVKKTFLELIHGGEADDEEDDKDDLALTDIVNEDEPWFGQRVQGRNGTVLTKRPITPSQEEEKLNQRCRSAKLRVIQKN

SEQ ID NO: 463 - DNA, 5058 bp, Sorghum bicolor
  misc_feature: Ceres ANNOT ID no. 6007752
  misc_feature: Encodes the peptide sequence at SEQ ID NO 464
atgaatgtggggcaggctgcccacctgtctgggcagatgtccgggcagacagcgcagatgaatcaggttcccggcaccggtgtcggcgtcggcgttggtgttggtgttggtggcgctgatgggctgccgcagcaccagccaatgcaggagatggcagcgctctcgggaacggatcagcatttcgtcatgcttcggaccactatgcgtgaaaagatattcgaatatatagggaggaaacaatcatcagctgagtggcggaagcggttgccagaactggcaaagcggcttgaggagatcttgtacagaaaattcccaaacaagaatgactactacaatatgatgaagggaccagttgagccgcaattgcagtttgctattaagaccttgagcgctcagaaccaacacaatcaacaaaacccacaaatgacaagacaaatagcatcatcctctggctatggtactatgattcctacccctggtatgacgcaaggcaccagtgcaaattctaggattccttatgtcacggacaacaatgccctttcttcgtctggtggaggcatggttcctcagaatgctaacatgggtgtctcgatgcaaggtccaatgtctaatgggtaccagcatttaaataccaacattccacaaaattctaccacaaataacgtccaatctacaatgggttcagttggtgttcagcgacaactacctcatatgatcccaactccaggattcagtaatcaacagaatgtaccttcaaatcctgactattcaaatggaactggatatttcaacggtgagtcagctgtggcgccacatatgcagcaccagaagcaattttctagcaaccaaaatagcaatcaaattcagcatattgcgggccacaataattctggaatgcattcaagcatgttggacaactcatctgcatatggtttatcagatggacacatgaatggtggaataggagtgcatgggtcaaatatgcagctaacaaataggaatacagcaccggaagcatatatgaacatatccccttatggcaattcgcccaaacctttgcagcagcaattcaatcagcaccctcagcagagaataccgacatcagttgatatggctggttccggcagcttttatgctactggctctacccctttaaccacagcaaatagtcagagcatgaatgttgcaaatttgcagtctagatcaagaatgaatcagatgttggtttccaatcagttaaacattcagtctattcagcaacagccccagataaaaagtgaggttttggatcaaacagaaaaggtgaattttcagtcaccacagttgactcatgatcaactactacgccagcacccaatgccgcagcatcaggtgcaacctaattcccagtttgttcaaaatcagtatcatataaatcaacagcagccaaatccacagcatcagcaggctatgctaaggaacaattcctttaaacagtctcaaatggtttccacccattcaatgcaactaccagaacaggggactctgccacaaactgaactggtatcttcacaagctagtgatcctggtgaccttccaagcttccagggtcaataccagcaaagaaatgctcttgacaatgttaaaggagggcagatgcttggtcatctatctagctctcaaaattttcatccttctgcctcacatgtttctcagcaattgttgccctctaatccacatcttgatgacggttccaatgctgtaagctatgtgctgaaagggtcgcagacagagcaaatgctacgtcctcaatggcagcctcaaacaatggaaaaggctcctgtcactactaattcaacactcgaaaagcaaatacaggaagatttttgtcaaagcacaatggcacaagatggagcacaacaaccattttcatcagattggcgtctttctaatggcactgcaacttctattgatcctgcagtgccgaagcccgcagctgaacaggttactggaaatatccattacttccgtcagataaagtggttgctgttactgtttcatgcaaaaacatgcacatatcctgttggaagttgtaagttccatggttgtgttcaggtgcaggagcttttgaagcattttcagaactgtcaaaggaaagattgttcatacaggagctgcagtaagtcaaaaacgatgtctcaccattataaaacttgtgttgatgagcaatgtcctgtgtgcagcgttgtaaggaagtttttgcggcaatcaactgaacaggcatctaagcaaaaagctcttgagtctagaaaacttgctcaacaaaatgtgcctcagagaatcatgaacgggatagaaggtgatagaatggacgttgacccagtgtcagctgaagcatttgatgatcaaccatctgtcccaaaacgtttaaagatgcatcctccatcacccagtggcccagagaatgatatctctgtagtctccaatcatcatgtaaactcaggctttgcattgcaggaaacacagcctgagcagtttgagcacaataacaggacagcatatctgaaacgagaggtagatgcaaaggctgacatacgagctcctcaaaagcccataaaaaatagttatggtattgatggaaatgcgactacatcaaggcacaatgtgattcctggtgttcccactgagatgaactctcatatcaagcaagaaaacttgtcggttgacaaagagacaagtgaaaccgcccttgaggttaagaacgaaacaaatgatccaactgatgcgaccgtgtctaaatcaggaaaaccaaaaataaagggcgtttctatgactgaattattcactccagaacaaataagggaacatattgacagtctaaggctgtgggttggtcagagtaaggctaaagctgaaaagaatcaagctattggtcattctgagaatgagaactcttgccagctctgtagagtagaaaaacttacttttgaacctccaccaatatattgttctccttgtggagctcggataaagcgaaacgcaccatactacactgtgggtactggcgatacacgccattatttctgtatcccttgttacaatgagtctcgtggtgagactattgaggttgaaggccaaacatttccgaaggcaaagttagaaaagaaaagaaatgatgaggaaacggaagaatggtgggttcaatgtgacaaatgtgaatgctggcaacatcaaatttgtgctctatttaatggaagaaggaacgatggaggacaagctgaatatacttgccccaattgctatgttgaggaggtcaaacgcgggctgcgcaaacctttaccacagagtgctgttcttggggcaaaagatttgccgagaactgttcttagtgatcatatagaagatcggctatttaaacgacttaagcaggagaaacaggaccgtgcagctgctgctggcaaaaatattgatgagattcctggagcggaaggacttgtggtcagagttgtttcatcagtggataagaagctggaggttaaaccacgctttttggaaatttttcaagaagacaactaccctacagagttcccttacaagtccaaggctgttctcttgttccagaaaatagaaggtgtggaagtatgtctatttggaatgtatgttcaagaatttggtgcagaatgctctttcccgaaccagcgccgtgtttacttgtcgtacttggattctgttaagtatttcagacctgagattagaacagtatctggagaggccttgcgtacatttgtgtatcatgaaattctgataggatatcttgaatactgtaagctacggggattcacaagttgttacatatgggcttgcccacctttgaagggtgaagattacatcttatattgccatcctgagattcaaaagactccgaaatctgacaaactgcgtgagtggtacttatctatgcttcggaaggcttctaaggaggaaattgttgttgagctgacaaatctatatgaccatttcttcattactatgggggaatgcaaggctaaggtgactgcttctcgcttgccgtactttgatggagattattggccaggagctgcagaagatatgatcaatcaactccgacaagaagaagatgatcgcaaacttcagaaaaagagtaagacaaagaaaattattacaaaaagagctcttaaagctgctggccacactgatctcagtgggaatgcttccaaggatgctatgttgatgcaaaagcttggggaaactatatatcctatgaaggaagatttcattatggtccatttacagtattcatgtagtcactgttgtgttcttatggtgtctggaagacgttgggtttgtcatcaatgcagaagctttcacatctgtgacaagtgttatgatgcagaacaacaacttgaagacagggagaggcacccgagtaatagtagagacacacatatgcttcatccggttgatattgtcggggtgcccaaagataccaaagatagagatgacatcttagaaagtgagttttttgacaccaggcaggcattccttagtctttgccaaggaaatcattatcagtatgacacacttcgccgcgcaaagcattcgtcaatgatggtgttgtaccacctacacaatccaactgcaccagcatttgtcactacgtgcaatgtctgctgtcatgatattgaaactggtcaaggctggcggtgtgagatttgtccagattttgatctaagaaagatgcttgatcttctggtacatgcgtcgacatgccgctctggtagttgccagtatcctaactgccgaaaagtcaagggactattccgtcatgggatgcagtgcaaaacgcgtgcttcaggagggtgtgtcctttgcaagaaaatgtggtacatgcttcaactccatgcccgagcttgcaaagattcagattgcaatgtgccgcggtgcagagatctgaaggagcatcttagaaggttgcaacagcagtctgattccaggaggagggctgctgtaaatgaaatgatgaggcaaagagcggcggaagtcgccgcaaatgaatag

SEQ ID NO: 464 - protein, 1685 aa, Sorghum bicolor
  misc_feature: Ceres ANNOT ID no. 6007752
  misc_feature (663)..(742): Pfam Id: zf-TAZ Pfam Desc: TAZ zinc finger
  misc_feature (1573)..(1648): Pfam Id: zf-TAZ Pfam Desc: TAZ zinc finger
  misc_feature (1045)..(1096): Pfam Id: PHD Pfam Desc: PHD-finger
  misc_feature (11)..(1685): NCBI GI: 115444101 NCBI Desc: os02g0137500 [oryza sativa (japonica cultivar-group)]
  misc_feature (11)..(1685): NCBI GI: 122064234 NCBI Desc: probable histone acetyltransferase hac-like 1
  misc_feature (100)..(1652): NCBI GI: 140055482 NCBI Desc: zinc finger, taz-type; zinc finger, zz-type; transcriptional coactivation; zinc finger, fyve/phd-type [medicago truncatula]
  misc_feature (147)..(1652): NCBI GI: 42563332 NCBI Desc: p300/cbp acetyltransferase-related protein 2 (pcat2) [arabidopsis thaliana]
  misc_feature (147)..(1652): NCBI GI: 12597461 NCBI Desc: p300/cbp acetyltransferase-related protein 2 [arabidopsis thaliana]
  misc_feature (147)..(1652): SWISSPROT Homolog: EC 2.3.1.48 Histone acetyltransferase HAC1
MNVGQAAHLSGQMSGQTAQMNQVPGTGVGVGVGVGVGGADGLPQHQPMQEMAALSGTDQHFVMLRTTMREKIFEYIGRKQSSAEWRKRLPELAKRLEEILYRKFPNKNDYYNMMKGPVEPQLQFAIKTLSAQNQHNQQNPQMTRQIASSSGYGTMIPTPGMTQGTSANSRIPYVTDNNALSSSGGGMVPQNANMGVSMQGPMSNGYQHLNTNIPQNSTTNNVQSTMGSVGVQRQLPHMIPTPGFSNQQNVPSNPDYSNGTGYFNGESAVAPHMQHQKQFSSNQNSNQIQHIAGHNNSGMHSSMLDNSSAYGLSDGHMNGGIGVHGSNMQLTNRNTAPEAYMNISPYGNSPKPLQQQFNQHPQQRIPTSVDMAGSGSFYATGSTPLTTANSQSMNVANLQSRSRMNQMLVSNQLNIQSIQQQPQIKSEVLDQTEKVNFQSPQLTHDQLLRQHPMPQHQVQPNSQFVQNQYHINQQQPNPQHQQAMLRNNSFKQSQMVSTHSMQLPEQGTLPQTELVSSQASDPGDLPSFQGQYQQRNALDNVKGGQMLGHLSSSQNFHPSASHVSQQLLPSNPHLDDGSNAVSYVLKGSQTEQMLRPQWQPQTMEKAPVTTNSTLEKQIQEDFCQSTMAQDGAQQPFSSDWRLSNGTATSIDPAVPKPAAEQVTGNIHYFRQIKWLLLLFHAKTCTYPVGSCKFHGCVQVQELLKHFQNCQRKDCSYRSCSKSKTMSHHYKTCVDEQCPVCSVVRKFLRQSTEQASKQKALESRKLAQQNVPQRIMNGIEGDRMDVDPVSAEAFDDQPSVPKRLKMHPPSPSGPENDISVVSNHHVNSGFALQETQPEQFEHNNRTAYLKREVDAKADIRAPQKPIKNSYGIDGNATTSRHNVIPGVPTEMNSHIKQENLSVDKETSETALEVKNETNDPTDATVSKSGKPKIKGVSMTELFTPEQIREHIDSLRLWVGQSKAKAEKNQAIGHSENENSCQLCRVEKLTFEPPPIYCSPCGARIKRNAPYYTVGTGDTRHYFCIPCYNESRGETIEVEGQTFPKAKLEKKRNDEETEEWWVQCDKCECWQHQICALFNGRRNDGGQAEYTCPNCYVEEVKRGLRKPLPQSAVLGAKDLPRTVLSDHIEDRLFKRLKQEKQDRAAAAGKNIDEIPGAEGLVVRVVSSVDKKLEVKPRFLEIFQEDNYPTEFPYKSKAVLLFQKIEGVEVCLFGMYVQEFGAECSFPNQRRVYLSYLDSVKYFRPEIRTVSGEALRTFVYHEILIGYLEYCKLRGFTSCYIWACPPLKGEDYILYCHPEIQKTPKSDKLREWYLSMLRKASKEEIVVELTNLYDHFFITMGECKAKVTASRLPYFDGDYWPGAAEDMINQLRQEEDDRKLQKKSKTKKIITKRALKAAGHTDLSGNASKDAMLMQKLGETIYPMKEDFIMVHLQYSCSHCCVLMVSGRRWVCHQCRSFHICDKCYDAEQQLEDRERHPSNSRDTHMLHPVDIVGVPKDTKDRDDILESEFFDTRQAFLSLCQGNHYQYDTLRRAKHSSMMVLYHLHNPTAPAFVTTCNVCCHDIETGQGWRCEICPDFDLRKMLDLLVHASTCRSGSCQYPNCRKVKGLFRHGMQCKTRASGGCVLCKKMWYMLQLHARACKDSDCNVPRCRDLKEHLRRLQQQSDSRRRAAVNEMMRQRAAEVAANE

SEQ ID NO: 465 - DNA, 3699 bp, Sorghum bicolor
  misc_feature: Ceres ANNOT ID no. 6007758
  misc_feature: Encodes the peptide sequence at SEQ ID NO 466
atgtacctctacagcctgacgctgcagcgagcgacgggcgcggtgtgcgccgtcattggcagcttcagtgggcgggactcgaagaagtcggccgcctccggctccggctccggctccacgcaggagatcgccgtggcccggggcagcacgctcgacctcctccgcccggacccggagacgggccgcctccgcacgctcctctccgtcgacgtcttcggcgccatccgctcgctcgcgcagttccgcctcaccggcgccaacaaggactacctcgtcgtcggctccgactcgggccgcctcgtcatcctcgagtactcccccgaccgcaaccgcctcgacaaggtccaccaggagaccttcggcaagtcgggatgccgccgcatcgtccccggccagctcctcgccgtcgaccccaagggccgcgcgctctgtatcgccgcgctcgagaagcagaagctcgtctacgtactcaaccgcgacgccgccgcgcgcctcaccatctcgtccccgctcgaggcccacaagtccaatactctcaccttcgccctcgccgcgctcgactgcgggttcgacaaccccgtcttcgccgccatcgagctcgagtacgccgagtctgaccgcgaccccacgggacaggctgccaaccaggcgcagaagctcctcaccttctacgagcttgacctggggctcaaccatgtctcccgcaaggtctctgagcccattgataatggtgccaatcttctagtgactgtccctggtggcggtgacggtccgagtggggttctcgtgtgctgcgacaatttcgtgctgtaccggaaccagggtcacccagagattcgtgctgttattccacggcgtgctgacctccctgctgagcgtggcgtcctcattgttgctgccgccacacacaaacaaaagagtatgttcttcttcctgctacagactgagtatggtgacatcttcaaggttgaccttgatcataatggggatactgttagtgagctcaggatcaagtactttgacaccataccagtgacatcagctgtctgtgtgctgcgatcgggtttcctctttgctgcttctgagtttggcaaccatgcactttaccagttccgtgatattggcagagatgcggatgtcgagtcctcttctgcaacactgatggagacagaggagggattccagccagttttctttcagccaagggcactgaagaacctcatgcgcatagatgagattgagagcctcatgccagtcatggacatgcgtgtcgcgaatttatttgacgaggaaacaccccagttgttcactgcctgtggccgtggtccgcgctccacgctgcgcatcctgaggcctggccttgccatcagtgagatggcccgatcaatgttgcctgctgagcctattgctgtgtggactgtcaagaagaatatcaatgacatgtttgatgcttacattgttgtgtcatttactaatgtcacgcttgtgctctctattggtgagaccattgaagaagtcagtgacagccagttcctggacaccacacactcccttgcagtcacgctccttggtgaggactctctaatgcaggtccacccaaatggcatccggcacatcagggaggatggtcgtgtcaatgagtggaggacgcctggaaagaaaactattacaaaggtcggatcaaaccgtctccaggtggtaatcgctcttagtggtggagagctcatctattttgagatggacatgactggtcagctcatggaggtggagaagcaggacatgtctggtgatgttgcatgcctggccattgcgccggtccctgaggggaggcaaaggtccaggtttcttgctgtaggatcctatgataacaccatccgtatcctctcactggaccctgacgattgcctgcagcctctaagtgtccagagtgtatcatcggcaccagagtcactcttattcttggaggttcaggcctctattggtggtgaggatggtgcagattatccagccaaccttttcctcaatgctggtctgcagaatggtgtccttttccggaccaatgtcgacatggttacgggtcagctatcggacacacgttctcgattccttggcctgagacctccaaagttgttcccttgtgtagttagccacaggcaagcaatgctctgcctatccagccgtccttggctgggctatatacatcaaggccattttctcttgacaccactgtcctgtgatacgcttgaatctgcatcatcattttcttctgatcagtgctcagaaggtgtagttgctgttgcgggagatgccctacggattttcaccattgaacgcttgggagagactttcaatgagacggccatccctctgcggtacaccccaaggaagtttgtgattctaccaaagaaaaaatatattgctgtcattgagagtgataagggcgcgttcagcgcagaagagcgagaagctgctaagaaagagtgcctcgaggcttctggtgcagcagagaatggaaatgcaaataatggcgatccaatggagaatggtgatggtcaagaagatggtgctgaggagggcaacacatttcctgatgaacaatatggttatccaaaggctgaatcagagaggtgggtttcctgcattaggatccttgatccaaggagtagggacacaacctgtcttctggaattgcaggaaaatgaggctgctgtcagtatttgcactgtgaatttccatgataaggagcacggaactctactggcggttggcactgccaagggattgcagttctggccaaggaggacccttgctggtggattcatccacatatataagtttgtggacgaagggaggtcacttgaacttctacataaaacgcaagtggaggaagtacctcttgcactgtgccaattccagggacgattacttgcaggtgttggttcagtgctcagactatacgatctggggaagagaaaattgctcagaaaatgtgaaaacaagctttttccaaggacaatagtgtctatccatacctaccgtgataggatctatgttggtgatatgcaagagtcatttcactattgcaagtacagacgagatgaaaaccaactctatatatttgctgatgatagtgttcccagatggcttacagcggcacaacacatagattttgacactatggctggagcagataagtttgggaatatatattttgctcgtcttcctcaggatatctcagatgagattgaagaagacccaactggaggcaagattaaatgggagcaagggaagttaaatggtgcccctaacaaagttgaagagattgtgcagtttcatgtcggtgatgttgtaacatgtttgcagaaggcctctttgattcctggtggaggggaatgtcttatttatgggactgtgatgggcagtgtgggagcactgcttgcattcacctccagggaagatgttgacttcttttctcacttggagatgcatcttcgtcaggagcatccaccattatgtggaagagatcacatggcttacagatctgcttattttccagtgaaggatgtgatagatggtgatctctgcgagcagtatccctccctcccagctgatatgcagaggaagattgctgatgaactggacagaactcctggtgagatcctgaagaagctagaagacatcaggaacaaaatcatctaa

SEQ ID NO: 466 - protein, 1232 aa, Sorghum bicolor
  misc_feature: Ceres ANNOT ID no. 6007758
  misc_feature (875)..(1175): Pfam Id: CPSF_A Pfam Desc: CPSF A subunit region
  misc_feature (1)..(1232): NCBI GI: 144925069 NCBI Desc: cpsf a subunit, c-terminal; wd40-like [medicago truncatula]
  misc_feature (1)..(1232): NCBI GI: 92868303 NCBI Desc: wd-40 repeat [medicago truncatula]
  misc_feature (375)..(1232): NCBI GI: 115444099 NCBI Desc: os02g0137400 [oryza sativa (japonica cultivar-group)]
  misc_feature (236)..(1232): NCBI GI: 92895982 NCBI Desc: cpsf a subunit, c-terminal; wd40-like [medicago truncatula]
  misc_feature (1)..(1230): NCBI GI: 54112121 NCBI Desc: splicing factor 3b, subunit 3 [homo sapiens]
MYLYSLTLQRATGAVCAVIGSFSGRDSKKSAASGSGSGSTQEIAVARGSTLDLLRPDPETGRLRTLLSVDVFGAIRSLAQFRLTGANKDYLVVGSDSGRLVILEYSPDRNRLDKVHQETFGKSGCRRIVPGQLLAVDPKGRALCIAALEKQKLVYVLNRDAAARLTISSPLEAHKSNTLTFALAALDCGFDNPVFAAIELEYAESDRDPTGQAANQAQKLLTFYELDLGLNHVSRKVSEPIDNGANLLVTVPGGGDGPSGVLVCCDNFVLYRNQGHPEIRAVIPRRADLPAERGVLIVAAATHKQKSMFFFLLQTEYGDIFKVDLDHNGDTVSELRIKYFDTIPVTSAVCVLRSGFLFAASEFGNHALYQFRDIGRDADVESSSATLMETEEGFQPVFFQPRALKNLMRIDEIESLMPVMDMRVANLFDEETPQLFTACGRGPRSTLRILRPGLAISEMARSMLPAEPIAVWTVKKNINDMFDAYIVVSFTNVTLVLSIGETIEEVSDSQFLDTTHSLAVTLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASIGGEDGADYPANLFLNAGLQNGVLFRTNVDMVTGQLSDTRSRFLGLRPPKLFPCVVSHRQAMLCLSSRPWLGYIHQGHFLLTPLSCDTLESASSFSSDQCSEGVVAVAGDALRIFTIERLGETFNETAIPLRYTPRKFVILPKKKYIAVIESDKGAFSAEEREAAKKECLEASGAAENGNANNGDPMENGDGQEDGAEEGNTFPDEQYGYPKAESERWVSCIRILDPRSRDTTCLLELQENEAAVSICTVNFHDKEHGTLLAVGTAKGLQFWPRRTLAGGFIHIYKFVDEGRSLELLHKTQVEEVPLALCQFQGRLLAGVGSVLRLYDLGKRKLLRKCENKLFPRTIVSIHTYRDRIYVGDMQESFHYCKYRRDENQLYIFADDSVPRWLTAAQHIDFDTMAGADKFGNIYFARLPQDISDEIEEDPTGGKIKWEQGKLNGAPNKVEEIVQFHVGDVVTCLQKASLIPGGGECLIYGTVMGSVGALLAFTSREDVDFFSHLEMHLRQEHPPLCGRDHMAYRSAYFPVKDVIDGDLCEQYPSLPADMQRKIADELDRTPGEILKKLEDIRNKII

SEQ ID NO: 467 - DNA, 969 bp, Sorghum bicolor
  misc_feature: Ceres ANNOT ID no. 6007762
  misc_feature: Encodes the peptide sequence at SEQ ID NO 468
atgccgggaggggaggacgtccgcaaggtctcgcgccaggacatacagcttgttcagaatctcattgaacgttgccttcagctatatatgaaccagaaagaagtggtggacaccctatctttccaggcaaaaatagaacctagtttcactgagcttgtctggcagaaactcgaagaagagaatcgtgatttttttaaggcatactatgtgaggctgatgcttatgaatcaaataatggccttcaataagctccttgagcagcagtatcagattatgactaaagatcatccttctgggatgccttctatgcctcctgctgctcctaatggctcaaactctaacacattgaaccaaaacgtgccctttctgccagacactatccccagtactgcaatgcaagataacttgttgcataatggaggttctagtagtatagtaaatggtgctccatccaatgaccagtttatctatgctggtaaagttgttcatggccttcctggtggcatggatgcttcatcaagccttctagcagcacacaattcgactgttgggcagtttaatggacacaatggagcaacaataaagacagagtctggctactcaagcaactcagattttggattcggtaatgagaacgtgttcctagagcagtcggttggagatgtatcaggtggatcctttagcagctctgagttgaatggacaaccactaggcgatccaattttggacatggattcatcttcgtatggtttcttgagccagattcctcgtaatttcagcttttcggatttgacagaggatttcagccacagcgcagaaatattagagaactatggtcgatcccctttcatcccttccgaggcaaataacttcccagagtctaccactggagaacatacagaaataggaaataggcggttagatacaatatctgagggtgttcattttgaagattttggaagtgaataa

SEQ ID NO: 468 - protein, 322 aa, Sorghum bicolor
  misc_feature: Ceres ANNOT ID no. 6007762
  misc_feature (1)..(322): NCBI GI: 115444095 NCBI Desc: os02g0137100 [oryza sativa (japonica cultivar-group)]
  misc_feature (53)..(300): NCBI GI: 115469832 NCBI Desc: os06g0705300 [oryza sativa (japonica cultivar-group)]
  misc_feature (4)..(289): NCBI GI: 113205376 NCBI Desc: uncharacterized plant-specific domain tigr01589 family protein [solanum demissum]
  misc_feature (10)..(209): NCBI GI: 124359984 NCBI Desc: uncharacterized plant-specific domain 01589 [medicago truncatula]
  misc_feature (5)..(255): NCBI GI: 124359986 NCBI Desc: uncharacterized plant-specific domain 01589 [medicago truncatula]
  misc_feature: Useful for making plants with modulated drought sensitivity
  misc_feature: Functional homolog of the protein sequence given in SEQ ID NO 13418
MPGGEDVRKVSRQDIQLVQNLIERCLQLYMNQKEVVDTLSFQAKIEPSFTELVWQKLEEENRDFFKAYYVRLMLMNQIMAFNKLLEQQYQIMTKDHPSGMPSMPPAAPNGSNSNTLNQNVPFLPDTIPSTAMQDNLLHNGGSSSIVNGAPSNDQFIYAGKVVHGLPGGMDASSSLLAAHNSTVGQFNGHNGATIKTESGYSSNSDFGFGNENVFLEQSVGDVSGGSFSSSELNGQPLGDPILDMDSSSYGFLSQIPRNFSFSDLTEDFSHSAEILENYGRSPFIPSEANNFPESTTGEHTEIGNRRLDTISEGVHFEDFGSE

SEQ ID NO: 469 - DNA, 3798 bp, Sorghum bicolor
  misc_feature: Ceres ANNOT ID no. 6007788
  misc_feature: Encodes the peptide sequence at SEQ ID NO 470
atggccggaaaaaagcggacccagactgacctcgcagttccggaggctgtgcctgcctcggacaatacccggaacgaggtcgcagccgcggaggcaccggcgaagaagaagaagctggccatggagcggaagaaggagaggaaggagctggacaaggagcgccaccgccagtctgccgaatccaccgctgccaaggcccagccgccggccgcggaggctgcggctccagcgaatcccccgcctgctccggtcgctgtggggccggggctgcatatgaacgtgttcagggacctggcatcaccagaggcatcggtgagagaggctgcggcggaggcgctagtggtggagctccggcaagtgcagaaggcgtacgagaagagcgcgcggaagggggagagtgaagctggcgatggggacagtgcctcacagatggaggctgagaaggacgacggactggataactgcgccccatcagcgcggtatgccatccggcggcttattcgcggtatctcttcttctagagagtatgcaaggcaaggatttgcattgggtcttgctgctgtgctcgaatcgattcgggcaatcaaggttgaatcgattatgaagttgatcccaaatttattggaatattcatcttctatgaagggaccggaagctaaggacaatcttttggggcgcctgtttggatttggagcaattgtgaggtctggtcgtgtttcacgacagtggacacgtgacaaaagctcacccattgttaaggaatttgtgagtttggttgtagaactcggtggcaagaaacgatatttgatggagcctgcagttgctgtgattctggatttagtcaggaagctgcctgatgaagccatactatctgaggttcttgaagctcctggtgttcaagattggttcaacaaagctgctgatgttggagatccagatgcactctttctagctttgaagttgcaagagagaacttatgtccagaaggagatatttgggaagctcctgcctcatccattcagctctgacaatttttttgcagaagaacatcttaaatccattgctgcttgtttcaaggaatctgccttttgtcttcctcgtattcatagtttatggcttgtcattacagacatgcttgttcgagaagcagcatctcagcatgatattaataccagttctggcaagaagcacaaaaaaaataagaaagccagctcctgtgaggatgacctaaggaatcttcgtaatttctgtgaggttgtaattgaaggatctttgctgctctcatctcatgacagaaagcatttagcatttagtatacttcttagcctcctcccaaaattgtctccttcagctatccaactagttctgtccagcaaagttgttcatggtttgatggatattttgtcaaatgaatcttcatggttgtataatgccggaaaacattttctgaaagagttagtgagtgtagcaagtcatgacaatgatcggtgtgctgctgtcattatcaacttacagaaatacagtggtggaagatttgactccatgacaaaaacaaaaattgttaaagagctggttggcaaattccataatgttgaagattgtttgtatcttgtgcaaaatttgatggccctattcgtggatgaagaatctgttacagatgagccatctgatcaaagtcagacaactgatgagaattcagaaattggcccaagtgaagagcaggaacttcttggccaagggaatactgatcttctgaagagctgggtggtgaatacaatttcttgtgttctaaaaaatttaaagcttacatctaaagggaattcagattctgaaatggctaagtgcattgaagaaaagtttcaagttcagacagaaatattaaaattccttgcagttcaaggtctgttctcagcatctttaggaactgaggttacatcatttgagttgcaagagaagttcaaatggccaaagaatcccatatccacatcactacgtaaggaatgcatagaacaacttcaattcttgctggaagatgcacaaaaggatgaagctttacatgttcctagtgaggtcaaatccaacgacttaggctactaccttatgcgtttcattaacaccgtatgcaacatcccctcagtcaccctcttcaggactttgagtggcaacgatgataacgcgttcaagaaattgatggctgtagaatcaatgcttttccatgaggagagaaaaattggtcctggattggagtctgctaagatgcatgcaatgcgttatctccttatccagttactgctacaagttcttctgcatccagatgagtattgggaggccgcagttgatgtgactatatgttgcaagaaatcctttcctgccattgctcaaggtgataattccagtgcacaagaatccgctgaacacggttcacaggagtctgatgaggatgggtctaaggaatctgacgaggatgtttcagaggatcccaatgaggaagtgtcactagagtttatggatgttcttgtccagactttcctctctgttttgcctcatgcatctggacctgtttttcgtgtgttctgtgatgatattacagaaactggtctccttgatatgttgagggtcgtgaagatagatttgaaaggccgtcgtcaaacagatagtgatgacgaagatgatggtcgtgttgatattgaagatgatgatgaaactgtaatggaagatgaagaggttggggaaattgatgatgttacagatgatgaagatgattctagtgatgaaggtgatgtggatgaagatgatttcaacaaagcagccccgaatgagacaaaaggtggagataaagcagaatctactaaagatggggatgattcagatgattcagatggcatggatgatgatgctatgttccgtattgatccttacattgcaaggatattcaaggagcgcaatcttcctggtagtgagactaagcaatctcaacttatgcgattcaagcttcgtgtgcttacgttacttgatatatatcttcagaggaatccagggaaagcaatggtgctggaggtgtattctttcttaatgcaagcttttgtaaaatcacatggtgctgatagtactgaacagttcaggcaacgtattgctggcatactgcagaggagggtattcaaagggaatgagtatccagaaggcgatgttgttgaatttggtaaacttgaaagcttgttggagaaagctctgaggttggcatcacgctcaagatataacacagttgcttctgtagcacagaacgctacattttggattctgaagatcatcaactcgatgaattgttctgaacaggaacttgcaagtgtgattgataagttccgttctatcttgaatgattacgacaggaagaaatcacggctgaagcttggttttgtgaaggaggttgctaagaggaatccttggatagggcatgagctttttggttttgttctgcagaggaccgagaacacgaaagctcaatatcggagaaatcaaatgctggagttggtggactacatactgaaatcatgggccggtgatgcatcagaggtgtttttgaaccatttggctcagttgtgcgggttgatacaagaagctctttcagctgttcctgaaaacaagtcgcgccgcaaggaagtacggaatttttgcactggaatcttgcaaacggtgttgaagcttgatctcaaagaacagttccagaacgcattgagtcctgaagcgtattccctctgcgaggccaaactaggaactgcgtttgccaccttcaaaaaatga

SEQ ID NO: 470 - protein, 1265 aa, Sorghum bicolor
  misc_feature: Ceres ANNOT ID no. 6007788
  misc_feature (236)..(1008): Pfam Id: DNA_pol_phi Pfam Desc: DNA polymerase phi
  misc_feature (1)..(1265): NCBI GI: 124359212 NCBI Desc: dna polymerase v [medicago truncatula]
  misc_feature (154)..(360): NCBI GI: 126133761 NCBI Desc: dna polymerase v that has motifs typical of dna polymerase family [pichia stipitis cbs 6054]
  misc_feature (816)..(1110): NCBI GI: 119610843 NCBI Desc: myb binding protein (p160) 1a, isoform cra_c [homo sapiens]
  misc_feature (816)..(1110): NCBI GI: 30046984 NCBI Desc: myb binding protein 1a [homo sapiens]
  misc_feature (816)..(1110): NCBI GI: 7657351 NCBI Desc: myb binding protein 1a [homo sapiens]
MAGKKRTQTDLAVPEAVPASDNTRNEVAAAEAPAKKKKLAMERKKERKELDKERHRQSAESTAAKAQPPAAEAAAPANPPPAPVAVGPGLHMNVFRDLASPEASVREAAAEALVVELRQVQKAYEKSARKGESEAGDGDSASQMEAEKDDGLDNCAPSARYAIRRLIRGISSSREYARQGFALGLAAVLESIRAIKVESIMKLIPNLLEYSSSMKGPEAKDNLLGRLFGFGAIVRSGRVSRQWTRDKSSPIVKEFVSLVVELGGKKRYLMEPAVAVILDLVRKLPDEAILSEVLEAPGVQDWFNKAADVGDPDALFLALKLQERTYVQKEIFGKLLPHPFSSDNFFAEEHLKSIAACFKESAFCLPRIHSLWLVITDMLVREAASQHDINTSSGKKHKKNKKASSCEDDLRNLRNFCEVVIEGSLLLSSHDRKHLAFSILLSLLPKLSPSAIQLVLSSKVVHGLMDILSNESSWLYNAGKHFLKELVSVASHDNDRCAAVIINLQKYSGGRFDSMTKTKIVKELVGKFHNVEDCLYLVQNLMALFVDEESVTDEPSDQSQTTDENSEIGPSEEQELLGQGNTDLLKSWVVNTISCVLKNLKLTSKGNSDSEMAKCIEEKFQVQTEILKFLAVQGLFSASLGTEVTSFELQEKFKWPKNPISTSLRKECIEQLQFLLEDAQKDEALHVPSEVKSNDLGYYLMRFINTVCNIPSVTLFRTLSGNDDNAFKKLMAVESMLFHEERKIGPGLESAKMHAMRYLLIQLLLQVLLHPDEYWEAAVDVTICCKKSFPAIAQGDNSSAQESAEHGSQESDEDGSKESDEDVSEDPNEEVSLEFMDVLVQTFLSVLPHASGPVFRVFCDDITETGLLDMLRVVKIDLKGRRQTDSDDEDDGRVDIEDDDETVMEDEEVGEIDDVTDDEDDSSDEGDVDEDDFNKAAPNETKGGDKAESTKDGDDSDDSDGMDDDAMFRIDPYIARIFKERNLPGSETKQSQLMRFKLRVLTLLDIYLQRNPGKAMVLEVYSFLMQAFVKSHGADSTEQFRQRIAGILQRRVFKGNEYPEGDVVEFGKLESLLEKALRLASRSRYNTVASVAQNATFWILKIINSMNCSEQELASVIDKFRSILNDYDRKKSRLKLGFVKEVAKRNPWIGHELFGFVLQRTENTKAQYRRNQMLELVDYILKSWAGDASEVFLNHLAQLCGLIQEALSAVPENKSRRKEVRNFCTGILQTVLKLDLKEQFQNALSPEAYSLCEAKLGTAFATFKK

SEQ ID NO: 471 - DNA, 1005 bp, Sorghum bicolor
  misc_feature: Ceres ANNOT ID no. 6007789
  misc_feature: Encodes the peptide sequence at SEQ ID NO 472
atggcggacaagccgagccgcgcgctggtcctctacgccgccggccacgccacggtgctcactcccccggcgggctccgcagccgcggggagccacctcgacgcgttcgcctcccgcgcctcctgcggccttctcaccctccgctccccgccggcttcccatcccacgaccggcgcggaggataatagcagcacgattctggagctggcgcagttgctcgacgtttatgatcatctctaccccggaaagaatgcggatagtggtcaagaagttgcccaagtggatccacaggagctagtggttcccaagctgtctgagaggtttatgggcctgagagctgccttggtcaccagttgtccccgcgtcagctcctttgcggcgaatcttggtttccaagtttttcagaccaatgatttcgcccctcaatctgcctcatccggcgttactaaagaggttggattaatcaaccgagcatttgatctgcttggattctcggatgggaatgtgcaggaaacatctgagttcgatctagttttcatgcatgttgccatggagaacacaagcagcaagttaggaaaattaggaatgaagacagatctcaatcggctggagaaattagttggtgcagtcatggaatctgcgcctgttggttcagctattgcttcacgtattcatgtatctgtcattttgagctatgggtctgcttctggaaataaggatgagttttccctattaacctcttcgaccgaagcagattcagacttgaatctactgcgcccacgccagagctacacaatgaaagcaggacatacattagatgatgtcagacttcatcatccaattctactggcacagtggcaggaaggagttacacgtgttgatttggctaaagggttttcttttgaggagtttataaagcatggtggaaaccttgctatgcttgctgagcgctttctacatgaggtggcatttaagctctggaaagcacccaaatatggggcttga

SEQ ID NO: 472 - protein, 334 aa, Sorghum bicolor
  misc_feature: Ceres ANNOT ID no. 6007789
  misc_feature: Useful for making plants with altered protein content
  misc_feature: Useful for making plants with modulated drought sensitivity
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13491
  misc_feature: GREAT-hit functional homolog of the protein sequence given in SEQ ID NO 13494
MADKPSRALVLYAAGHATVLTPPAGSAAAGSHLDAFASRASCGLLTLRSPPASHPTTGAEDNSSTILELAQLLDVYDHLYPGKNADSGQEVAQVDPQELVVPKLSERFMGLRAALVTSCPRVSSFAANLGFQVFQTNDFAPQSASSGVTKEVGLINRAFDLLGFSDGNVQETSEFDLVFMHVAMENTSSKLGKLGMKTDLNRLEKLVGAVMESAPVGSAIASRIHVSVILSYGSASGNKDEFSLLTSSTEADSDLNLLRPRQSYTMKAGHTLDDVRLHHPILLAQWQEGVTRVDLAKGFSFEEFIKHGGNLAMLAERFLHEVAFKLWKAPKYGA

SEQ ID NO: 473 - DNA, 1977 bp, Sorghum bicolor
  misc_feature: Ceres ANNOT ID no. 6007796
  misc_feature: Encodes the peptide sequence at SEQ ID NO 474
atggcgaacctgacgaacggctttgcgagcctccattgcgcaggggcgatgcatgtggacaaagggcacatgcaagcttcgggactgccttttctctctttcagaagatgctccaagcttgatatctccagactaggtaccgtgcctcgtttcatgggcgcaaaatctgctactgtctcccagcatcatgtgagacacaggatcagcgccaccagagcctctactttttcctgcctgcaagatgataccacaaaattcttcgatttcgtggttattggcagtggtgtcgctggcctaaggtatgctctggaagtttcaaagcacggctctgttgctattatcaccaaggcagagccttatgagagcaacacaaactatgcacaaggcggtgttagcgccgttctatgcccctcggattctgtagaaagtcacatggaagacacaattgttgccggggcttatctgtgtgacgaagagaccgtcagggtagtttgcacagaaggtccagagcgtgtcaaggaactaattgccatgggtgcctcattcgaccatggtgaagacggtaggctgcaccttgcaagggaaggtggacattctcacaacaggattgtccattctgctgatatgactggaagagagattgaaagagcactacttcaagcagttgacaatgatgataacatatcgttgtttggtcatcactttgctattgatctattgacatgccagaaaaatggtgaaatatattgctatggagtggattcgatagacattgaaactcagaaggtagtccgtttcatctcgaaagtgacactgcttgcatcaggaggagttggccatatatatcccacaaccaccaatccactggtagctacaggggatggaatcgcgatgtctcatcgtgctcaggctgtaatatccaatatggagtttgtgcagttccatccaactgcactttcagatgagggcctgccaatcaagccaaagacaagaagagagaatgcattcctcataacggaagcggtcagaggagacggaggaattctttacaatcagtccatggagagattcatgcccatgtacgacgatcgcgccgagttggcgccaagagatgtggttgcgaggagcatagatgaccagctgaagaagcgaggcgagaactacgtcctcctggacatcagccacaagccaagagagaaggttcttgctcacttccccaacatcgccgccgagtgcctgcggtacggcctggacatcacacggcagcccatcccggtggtcccggcggcgcactacatgtgcggcggcgtccgggccgggctgcagggggagaccaacgtgaagggcctgtacgtcgccggcgaggtcgcgtgcacggggctgcacggcgcgaaccggctggcgagcaactcgctgctggaggcgctggtgttcgccaggagggcggtgcagccgtccatcgaccacatgttggacgccgacggcgacggcgacggcgacggcgacgcttccctggcggcgagatgggcgcggccgacgctgccgtggtcgtcgctgggcgacggcgcgctgtcggacatcgtggagcggacgaggcaggccaggacggagctgcagtcggtgatgtgggagtacgtcggcatcgtgcggtcgacggggcggctgaagcaggccgagtggaagatcggcgacatggagtcggagtgggaggagtttttgttccggcgggggtggaagccgaccatggtgggcatcgaggcctgcgagatgcgcaacctcttctgctgcgccaagctcgtcgtcaagagcgcgctggccaggcgcgagagccgcggcctgcacttcaccgaggacttcccctacctggaggagagcaggaggaagcccacggtcatcttcccggccgccgtgcaggaggtcacgtggagctccaagccgttgcagagttcatcgagctggggcttgggggttcgttag

SEQ ID NO: 474 - protein, 658 aa, Sorghum bicolor
  misc_feature: Ceres ANNOT ID no. 6007796
  misc_feature (88)..(472): Pfam Id: FAD_binding_2 Pfam Desc: FAD binding domain
  misc_feature (535)..(650): Pfam Id: Succ_DH_flav_C Pfam Desc: Fumarate reductase/succinate dehydrogenase flavoproteinC-terminal domain
  misc_feature (88)..(459): Pfam Id: DAO Pfam Desc: FAD dependent oxidoreductase
  misc_feature (68)..(655): NCBI GI: 24111279 NCBI Desc: at5g14760/t9l3_60 [arabidopsis thaliana]
  misc_feature (68)..(655): NCBI GI: 9755744 NCBI Desc: l-aspartate oxidase-like protein [arabidopsis thaliana]
  misc_feature (88)..(575): NCBI GI: 68553301 NCBI Desc: l-aspartate oxidase [prosthecochloris aestuarii dsm 271]
  misc_feature (88)..(572): NCBI GI: 145220015 NCBI Desc: l-aspartate oxidase [prosthecochloris vibrioformis dsm 265]
  misc_feature (88)..(572): NCBI GI: 67938204 NCBI Desc: l-aspartate oxidase [chlorobium phaeobacteroides bs1]
MANLTNGFASLHCAGAMHVDKGHMQASGLPFLSFRRCSKLDISRLGTVPRFMGAKSATVSQHHVRHRISATRASTFSCLQDDTTKFFDFVVIGSGVAGLRYALEVSKHGSVAIITKAEPYESNTNYAQGGVSAVLCPSDSVESHMEDTIVAGAYLCDEETVRVVCTEGPERVKELIAMGASFDHGEDGRLHLAREGGHSHNRIVHSADMTGREIERALLQAVDNDDNISLFGHHFAIDLLTCQKNGEIYCYGVDSIDIETQKVVRFISKVTLLASGGVGHIYPTTTNPLVATGDGIAMSHRAQAVISNMEFVQFHPTALSDEGLPIKPKTRRENAFLITEAVRGDGGILYNQSMERFMPMYDDRAELAPRDVVARSIDDQLKKRGENYVLLDISHKPREKVLAHFPNIAAECLRYGLDITRQPIPVVPAAHYMCGGVRAGLQGETNVKGLYVAGEVACTGLHGANRLASNSLLEALVFARRAVQPSIDHMLDADGDGDGDGDASLAARWARPTLPWSSLGDGALSDIVERTRQARTELQSVMWEYVGIVRSTGRLKQAEWKIGDMESEWEEFLFRRGWKPTMVGIEACEMRNLFCCAKLVVKSALARRESRGLHFTEDFPYLEESRRKPTVIFPAAVQEVTWSSKPLQSSSSWGLGVR

SEQ ID NO: 475 - DNA, 678 bp, Sorghum bicolor
  misc_feature: Ceres ANNOT ID no. 6007800
  misc_feature: Encodes the peptide sequence at SEQ ID NO 476
atggccatggaggagggatcaggagcagtagagaacggaccgatcgtgggcacggtggctgacgcctctgccgccgccgccgccgccatcggcggcgacggcaaagggaaggaggaggccgaggggagacggccggctccggccgcctacgctgccgtcgtgatcgggggcaccttcgaccggctgcaccagggccaccatctcttcttgaaggcagcagcggagctggcgagggagaggattgtgatcggcgtctgcgacggacctatgctcgccaagaaacagtatgcctacctgatacaaccaatcgagaagcggatgcaaaatgtcaaggattatattaagtccataaagcctgaccttgatgttcatgtggagccgatcgtggacccttacggcccttccatcgttgacgaaggtcttgaggccataattgtcagcaaggagacattgccaggaggacacgctgtcaacaggaagagagcagagagagggctcactcagttacagatcgaggtggtagagctggtaccagagaaatcgactggaaataagataagctccacagcattcagaaagatggaagcagagagggaactgcagcaacaagaaaccgcaataggcagtcacagcattcagaaaattgaaagcagcgagggaattgcagcaacagaataa

SEQ ID NO: 476 - protein, 225 aa, Sorghum bicolor
  misc_feature: Ceres ANNOT ID no. 6007800
  misc_feature (54)..(194): Pfam Id: CTP_transf_2 Pfam Desc: Cytidylyltransferase
  misc_feature (47)..(198): NCBI GI: 92867322 NCBI Desc: cytidylyltransferase [medicago truncatula]
  misc_feature (46)..(206): NCBI GI: 34393473 NCBI Desc: bifunctional phosphopantetheine adenylyl transferase dephospho coa kinase-like protein [oryza sativa (japonica cultivar-group)]
  misc_feature (50)..(223): NCBI GI: 116126354 NCBI Desc: ensangp00000014315 [anopheles gambiae str. pest]
  misc_feature (39)..(192): NCBI GI: 94468668 NCBI Desc: possible dephospho-coa kinase [aedes aegypti]
  misc_feature (38)..(192): NCBI GI: 52219000 NCBI Desc: zgc:92337 [danio rerio]
MAMEEGSGAVENGPIVGTVADASAAAAAAIGGDGKGKEEAEGRRPAPAAYAAVVIGGTFDRLHQGHHLFLKAAAELARERIVIGVCDGPMLAKKQYAYLIQPIEKRMQNVKDYIKSIKPDLDVHVEPIVDPYGPSIVDEGLEAIIVSKETLPGGHAVNRKRAERGLTQLQIEVVELVPEKSTGNKISSTAFRKMEAERELQQQETAIGSHSIQKIESSEGIAATE

SEQ ID NO: 477 - DNA, 516 bp, Sorghum bicolor
  misc_feature: Ceres ANNOT ID no. 6007820
  misc_feature: Encodes the peptide sequence at SEQ ID NO 478
atggcttcctccagcgggagcgggagctcgggctctctgtcggcggcgacggcggcgctggccgcggcggcgggcacggaggaggagctgcgcgcgctcatggagcagcggcgcgccaagcggatgctgtccaaccgcgagtccgcgcggcggtcgcggatgcgcaagcagcgccacctcgacgagctcaccgcgcaggccgcgcacctgcgccgcgagaacgcgcacgtcgccaccgcgctcggactcaccacgcagggactcctcgccgtcgacgccgagaacgccgtcctccgcacccaggccgccgagctcgccgcgcgcctcggttccctcaacgacatcctcgcctgcatgaacaccaacgccgctgcggccgtcggcgccgtcgccgtctccgtctccctcacagccgccgccgcttcttcctccgacccctacctcgccttcgacggcgccaccgccttggacgacctcctcagatcctgccccgagaatatgtaccagctctgctag

SEQ ID NO: 478 - protein, 171 aa, Sorghum bicolor
  misc_feature: Ceres ANNOT ID no. 6007820
  misc_feature (33)..(96): Pfam Id: bZIP_1 Pfam Desc: bZIP transcription factor
  misc_feature (1)..(133): NCBI GI: 113367218 NCBI Desc: bzip transcription factor bzip124 [glycine max]
  misc_feature (1)..(133): NCBI GI: 22597162 NCBI Desc: bzip transcription factor atb2 [glycine max]
  misc_feature (1)..(133): NCBI GI: 113367222 NCBI Desc: bzip transcription factor bzip126 [glycine max]
  misc_feature (1)..(122): NCBI GI: 92879198 NCBI Desc: camp response element binding (creb) protein [medicago truncatula]
  misc_feature (1)..(120): NCBI GI: 113367220 NCBI Desc: bzip transcription factor bzip125 [glycine max]
  misc_feature: The sequence is a functional homolog of SEQ ID NO 159 in the 11/479,226US patent application
  misc_feature: The sequence is a functional homolog of SEQ ID NO 2218 in the 10/374,780US patent application
  misc_feature: The sequence is a functional homolog of SEQ ID NO 248 in the 10/225,066US patent application
  misc_feature: The sequence is a functional homolog of SEQ ID NO 2508 in the 10/374,780US patent application
  misc_feature: The sequence is a functional homolog of SEQ ID NO 36 in the 10/412,699US patent application
  misc_feature: The sequence is a functional homolog of SEQ ID NO 366 in the 10/412,699US patent application
  misc_feature: The sequence is a functional homolog of SEQ ID NO 466 in the 11/435,388US patent application
  misc_feature: The sequence is a functional homolog of SEQ ID NO 492 in the 10/225,066US patent application
  misc_feature: The sequence is a functional homolog of SEQ ID NO 74 in the 10/286,264US patent application
  misc_feature: The sequence is a functional homolog of SEQ ID NO 855 in the 11/479,226US patent application
  misc_feature: Useful for making plants with modulated growth and phenotype characteristics
  misc_feature: The sequence is a functional homolog of SEQ ID NO 74 in the 20030093837 US patent application
  misc_feature: The sequence is a functional homolog of SEQ ID NO 36 in the 20040045049 US patent application
  misc_feature: The sequence is a functional homolog of SEQ ID NO 366 in the 20040045049 US patent application
  misc_feature: The sequence is a functional homolog of SEQ ID NO 366 in the 10/412,699 US patent application
  misc_feature: The sequence is a functional homolog of SEQ ID NO 855 in the 11/479,226 US patent application
  misc_feature: The sequence is a functional homolog of SEQ ID NO 248 in the 10/225,066 US patent application
  misc_feature: The sequence is a functional homolog of SEQ ID NO 2508 in the 10/374,780 US patent application
  misc_feature: The sequence is a functional homolog of SEQ ID NO 74 in the 10/286,264 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MASSSGSGSSGSLSAATAALAAAAGTEEELRALMEQRRAKRMLSNRESARRSRMRKQRHLDELTAQAAHLRRENAHVATALGLTTQGLLAVDAENAVLRTQAAELAARLGSLNDILACMNTNAAAAVGAVAVSVSLTAAAASSSDPYLAFDGATALDDLLRSCPENMYQLC

SEQ ID NO: 479 - DNA, 819 bp, Sorghum bicolor
  misc_feature: Ceres ANNOT ID no. 6007821
  misc_feature: Encodes the peptide sequence at SEQ ID NO 480
atgatttgggtgttgtttatcatgcagttggcttctcatggcactcaaacagaagaaacaatgcagtctgtgccccactgtgatcacgcagaagtgttggattcgcagccaacaagttcacaactaaacctgatagagagatcaacagagcatctagcctcatctgaaatcaagccagttagtgttgatgatgacaatgaaaatgttgatgccaatgaagaaactcaccttgttatccaagacgttcctcagtgccggatttgccttgataatgaaggtgatgacttgattgcgccctgccgttgcaagggaacacagaagtatgtccataggtcctgtcttgataactggagatcaacaaaggaaggttttgcattttcacattgcactgaatgtcgagctgcattctttcttcgtgcaaatgttcctccagatcgatggtggttaagattgaagtttcaacttttggttgtcagggatcacacattgatcttctttattgtgcaacttgtagttgctttcatgggtatggtggtttacagagtttatggagatgaactgcgagaaatgtttggttatgaagagcacccatatgctttttatgccatggcgacactggctattgttttggttggtttgctgtatgggttcttcattgctataatatgtggacagaggataactgagcggcattaccatgttcttgcaaagcaagagttaaccaaggagtatattgtagaggatcttgaaggagctgaccaagtgccagaccttgatcctaaccatgttacagagttgaagatattaggactatattga

SEQ ID NO: 480 - protein, 272 aa, Sorghum bicolor
  misc_feature: Ceres ANNOT ID no. 6007821
  misc_feature (85)..(132): Pfam Id: zf-C3HC4 Pfam Desc: Zinc finger, C3HC4 type (RING finger)
  misc_feature (1)..(272): NCBI GI: 41052575 NCBI Desc: zinc finger (c3hc4-type ring finger) protein-like [oryza sativa (japonica cultivar-group)]
  misc_feature (44)..(222): NCBI GI: 40253895 NCBI Desc: zinc finger (c3hc4-type ring finger) protein -like [oryza sativa (japonica cultivar-group)]
  misc_feature (36)..(222): NCBI GI: 140040744 NCBI Desc: zinc finger, ring-type [medicago truncatula]
  misc_feature (59)..(222): NCBI GI: 53791481 NCBI Desc: zinc finger (c3hc4-type ring finger) protein -like [oryza sativa (japonica cultivar-group)]
  misc_feature (31)..(223): NCBI GI: 125951765 NCBI Desc: e3 ubiquitin-protein ligase march1 (membrane-associated ring finger protein 1) (membrane-associated ring-ch protein i) (march-i)
MIWVLFIMQLASHGTQTEETMQSVPHCDHAEVLDSQPTSSQLNLIERSTEHLASSEIKPVSVDDDNENVDANEETHLVIQDVPQCRICLDNEGDDLIAPCRCKGTQKYVHRSCLDNWRSTKEGFAFSHCTECRAAFFLRANVPPDRWWLRLKFQLLVVRDHTLIFFIVQLVVAFMGMVVYRVYGDELREMFGYEEHPYAFYAMATLAIVLVGLLYGFFIAIICGQRITERHYHVLAKQELTKEYIVEDLEGADQVPDLDPNHVTELKILGLY

SEQ ID NO: 481 - DNA, 1773 bp, Sorghum bicolor
  misc_feature: Ceres ANNOT ID no. 6007833
  misc_feature: Encodes the peptide sequence at SEQ ID NO 482
atgaactccctcctgaggccgccgctgccggggctgacgccgatcctgagcgcgaggcgcagggtctcgccgccgcaagcagcgccggtgcgggtcggctcggcggagctggccggcggcggcgggcgcagatgccggcgagggctggcagtggtggcgtcggcggctccgtcgtggatggaggaggctggggtggacgtgctggaggagggcgggcgttggaacccgtcggtgtcggactcgtaccgcccgacggggctgccgcggcccaacgccacggtgctggaggcgcaggcgcgggtgtgcacgggccccgcacagacgcgcccgctcggggaggagcaagccatgcgcgtcctcgacactatcctccgctccgcgatgggagaactcaaagaggagccagtctctagtgcacagttaggtgcattttttgcaggcatgacaatcagagctaactcatttccagaggccacacagtggagcgagggagagcgacgtgccatgagcatattttggccacgccttgtacaagttcttcctcctgaggtgaagtttatagcagatcctgaagggacgatcatgggtgcaaatggtttaacagggcctcggtatgttggccaaggaactggggagatgagactcgttggtgctctgagggaagtgcttgctggtggccatttaggttatgaggaggttcaatgtgtactaaaggatattctaccaattggatcaagttcagatttgacggaggttagtgaagcactgctagcggcatttttgattggacagcggatgaatagagaaactgatcgtgagctcaaagcgtattgcctagcctttgatgatgaactaggtcctcctccggttgctgacatcaagtccttgacacactatggtgaaccatatgatggaaatacacgattttttaggaatactctatttgttgcagcggttcgatcctgctatggtgaatcgtgcctcctccatggtgttgaatggatgccacccaagggtggaataacagaaggacaaatgcttaaattcatgggcgcaaacatacacttatctccaacacaagccaagatactgttggaggatgagactactggttttgcatatttgaatcttcaagaagcttgtcccccattatattcgattattgggctcagggagcatattaagaaacggccaccattggctacctctgagaaagttcaacaatttgtgagggcacgggggagagaatcaatgattgcaggattttatcatgaaggctatgaagatcccttgcttatgctgatgagaagaagaactgttcatgctggactagttgtaaagggtgaagaaggtgcgctttcaatgacaaccaaggaaagatcagctcatgcatcaaaaggacttcctgttaaccactgttcagggtttcggacaccaaacaacatagattcctctgagactgatggtatttctagagaaagcttcagggtcattgtgaatgcccaggaacttggttttgaatccaccgaaactccaagaactgatagatcaattctaaagaacttggagctcggtctggcagcactaggcggcgagaaaggagcagcctatgaccgaatagttcttaatgcagctatggctgaccacttgctaggctgcagcggagccgaggatatcaacactgcacttgaccgggcgagagaagccattgatagcggtgaagctctgagaaggctcatgagttacataaaaatctcgcacacagtgtcctag

SEQ ID NO: 482 - protein, 590 aa, Sorghum bicolor
  misc_feature: Ceres ANNOT ID no. 6007833
  misc_feature (251)..(579): NCBI GI: 146326599 NCBI Desc: glycosyltransferase [candidatus vesicomyosocius okutanii ha]
  misc_feature (251)..(579): NCBI GI: 118602674 NCBI Desc: glycosyl transferase, family 3 [candidatus ruthia magnifica str. cm (calyptogena magnifica)]
  misc_feature (260)..(579): NCBI GI: 74055783 NCBI Desc: anthranilate phosphoribosyltransferase-like protein [thiobacillus denitrificans atcc 25259]
  misc_feature (251)..(467): NCBI GI: 86605684 NCBI Desc: glycosyl transferase family protein [cyanobacteria bacterium yellowstone a-prime]
  misc_feature (251)..(467): NCBI GI: 86607831 NCBI Desc: glycosyl transferase family protein [cyanobacteria bacterium yellowstone b-prime]
MNSLLRPPLPGLTPILSARRRVSPPQAAPVRVGSAELAGGGGRRCRRGLAVVASAAPSWMEEAGVDVLEEGGRWNPSVSDSYRPTGLPRPNATVLEAQARVCTGPAQTRPLGEEQAMRVLDTILRSAMGELKEEPVSSAQLGAFFAGMTIRANSFPEATQWSEGERRAMSIFWPRLVQVLPPEVKFIADPEGTIMGANGLTGPRYVGQGTGEMRLVGALREVLAGGHLGYEEVQCVLKDILPIGSSSDLTEVSEALLAAFLIGQRMNRETDRELKAYCLAFDDELGPPPVADIKSLTHYGEPYDGNTRFFRNTLFVAAVRSCYGESCLLHGVEWMPPKGGITEGQMLKFMGANIHLSPTQAKILLEDETTGFAYLNLQEACPPLYSIIGLREHIKKRPPLATSEKVQQFVRARGRESMIAGFYHEGYEDPLLMLMRRRTVHAGLVVKGEEGALSMTTKERSAHASKGLPVNHCSGFRTPNNIDSSETDGISRESFRVIVNAQELGFESTETPRTDRSILKNLELGLAALGGEKGAAYDRIVLNAAMADHLLGCSGAEDINTALDRAREAIDSGEALRRLMSYIKISHTVS

SEQ ID NO: 483 - DNA, 1638 bp, Sorghum bicolor
  misc_feature: Ceres ANNOT ID no. 6007835
  misc_feature: Encodes the peptide sequence at SEQ ID NO 484
atggagcaagctggtgagatgggagagattggacgagaagctcgccatggaggtgtgcttcagagtggcagagacactggagaacacatagacaagacagtggtggatagcgaagaagatgagcaatttctgccaaaatggaggaagttcttggcccatgttggacctggagctcttgtggccattggcttcctggatcctagcaacttggaaactgacatgcaagctggggctgacttcaagtaccagcttctctgggtcatcttagttggaatgatctttgcacttctgatccaaacactagctgccaaccttggagtgaagacagggatgcatcttgctgaactctgcagggaagagtacccgcgtttcgtcaacatttgcttgtggatcatcgcggagctggcagtgatatctgatgacatccctaaagtgctgggcacagcctttgcattcaacatactgctcaagatcccagtgtggtctggagtcatcctcacagtgttcagcaccctcttgcttcttggggtgcagagatttggggcccgcaaactggagttcatcatagcagctttcatgttcaccatggcagcctgcttcttcggagagctgagctacctgaggccgtccgcgagagaggtcgtcaagggcatgttcgtccccactctccatgggaaaggcgccgcagccaacgcgatcgcgctcttcggcgccatcatcacgccgtacaacctgttcttgcactcggcgcttgtgctctcgagaaagaccccacgatcagcgaagagcgtcagagctgcctgcaggtacttcctcgccgagtgcagcctcgcgttcgtggtggcgttcctcatcaatgtcacggtggtcatcgtcgcggcgaccatctgcaatgcagacaacctctccccggatgacgcggacacgtgcggcgacctcactctgcagtccacccctctgttgctcaggaacgttttggggaggtcgagctccgtcgtgtacgctgttgcgctgctggcttccgggcagagcaccaccattagctgcacgtttgctgggcaggtcatcatggaggggttcctggacatgaggatgaagagctgggtgcggaacctgatcacgcgagtcatcgccatcgctcccagcctcgtcgtctccatcgtcagcggcccgtcaggcgccggcaagctcatcgtcttctcatcgatggtgctgtcgttcgagctgccattcgcgctcatcccgctgctcaagttctgcaacagcagcaacaaagtcgggcctctcaaggaatccatctacacggtggtgatcgcgtggatgctgagcttcgcgctcatcgtggtgaacacctacttcctggtgtggacgtacgtggactggctagtgcacagcgacggccgcctccccaagtacgccaccgcgctgctctccgtcgtcgtcttcgcgctcatggccgcctacctcgtcttcgtcgtctacctcacgttcaggagagacgcggtggccacgtacgtgccggtgtcggagcgggcgcaggcgcaggtggaggccggcggcggggcgcaggccgtggctgacgacgacgccgaccagccggtgcccctcaggaaggacctggctgatgcctccatgtag

SEQ ID NO: 484 - protein, 545 aa, Sorghum bicolor
  misc_feature: Ceres ANNOT ID no. 6007835
  misc_feature (70)..(433): Pfam Id: Nramp Pfam Desc: Natural resistance-associated macrophage protein
  misc_feature (28)..(545): NCBI GI: 51318208 NCBI Desc: root-specific metal transporter [malus baccata]
  misc_feature (36)..(542): NCBI GI: 92870517 NCBI Desc: natural resistance-associated macrophage protein [medicago truncatula]
  misc_feature (47)..(542): NCBI GI: 30267434 NCBI Desc: root-specific metal transporter [lycopersicon esculentum]
  misc_feature (26)..(533): NCBI GI: 2231132 NCBI Desc: integral membrane protein [oryza sativa]
  misc_feature (37)..(542): NCBI GI: 92870519 NCBI Desc: natural resistance-associated macrophage protein [medicago truncatula]
MEQAGEMGEIGREARHGGVLQSGRDTGEHIDKTVVDSEEDEQFLPKWRKFLAHVGPGALVAIGFLDPSNLETDMQAGADFKYQLLWVILVGMIFALLIQTLAANLGVKTGMHLAELCREEYPRFVNICLWIIAELAVISDDIPKVLGTAFAFNILLKIPVWSGVILTVFSTLLLLGVQRFGARKLEFIIAAFMFTMAACFFGELSYLRPSAREVVKGMFVPTLHGKGAAANAIALFGAIITPYNLFLHSALVLSRKTPRSAKSVRAACRYFLAECSLAFVVAFLINVTVVIVAATICNADNLSPDDADTCGDLTLQSTPLLLRNVLGRSSSVVYAVALLASGQSTTISCTFAGQVIMEGFLDMRMKSWVRNLITRVIAIAPSLVVSIVSGPSGAGKLIVFSSMVLSFELPFALIPLLKFCNSSNKVGPLKESIYTVVIAWMLSFALIVVNTYFLVWTYVDWLVHSDGRLPKYATALLSVVVFALMAAYLVFVVYLTFRRDAVATYVPVSERAQAQVEAGGGAQAVADDDADQPVPLRKDLADASM

SEQ ID NO: 485 - DNA, 1989 bp, Sorghum bicolor
  misc_feature: Ceres ANNOT ID no. 6007847
  misc_feature: Encodes the peptide sequence at SEQ ID NO 486
atgggggtccgtagaagggtggtggtcgacgctgctgccttgctcatactccagctgtgttgttgctgcattattgctcttgcccgggcagcggcagcgacaatgccgtcggcgacggacatcgtcggagacgttggggagcggcaacagcaagaggtcggcgccaagtacagggacccgaggcagccgctgaacgcgcgggtcgacgacctgctgcggcggatgacgctggcggagaagatcgggcagatgtcgcagatcgacagggagaatgccaccgctggcgtcatcagcaagtacttcatagggagcgtgctcaggggcggaggccgcgtgccggcggccggcgctccgccggaggcgtgggtggagatggtcgaggagatacagcgcgcggcggtgtcgtcgacgcgcctcgggatcccagtcatgttcggcatcgacgccgtccacggccacggctacgtctacaaggccaccgtcttcccgcacaacgtcggcctcggatgcaccagagacccagagctcgcaaggaagatcggagcagcagttgcattggaggtcagggccaccggaatccctttcatcttcgctccatgcctggcggtgtgcagagaccctcggtggggccggtgctacgagagcttcagcgagcacccagagctagtgcagaacatgacctccattgtctccggcttccagggcgagatcccggcgactggccgcctcggcacgccctacgtcgccgggcagcgcaatgtggcggcgtgtgcgaagcactacgtcggtgacggcggcaccacaaggggaatcaatgagaacaacacggtggccaccttccatgacctcctcggcatccacatgaggccctactatactgctgccattcgaggtgtctccaccatcatggtctcctactccagctggaacggtgtcaagatgcacgccaaccgcttcctcatcaccgacttcctcaagactaggctccgcttcaggggttttgtgctctcggattggctagggcttgataggatcacaagcccagaacatgccgactaccttttgtccatcaagctgggtatccttgctggcattgacatggtcatgattccatacaggtacacagagttcatcgacgacctcacgttgctggtgcagaacggcaccatcccgttgagccgtatcgacgacgccgtccgccgcatcctgcgcgtcaagttcaccatgggcctcttcgacaacccctacgccgacaccagcctcgtcggcgagctcggcaagcaggagcaccgcgacctggcgcgcgaggccgtgcgcaagtcccttgtcctcctcaagaacggcaagcccggcgccaagccactgctgccacttcccaagaagccctcctacggccgcagcgtcctggtcgccggcagccacggcgacgacctcggcagccagtgcggcggctggaccatcacctggcagggccagacggggaacaacctcaccgccgggaccaccatcctcgacggcatcaagcgcgccgtcgtccccggcacggacgtcgtctactccgagaaccccgacgcgggcttcgtccagcagaacaaggcgcggttcgactatgccatcgtcgtcgtcggcgagcctccctacgccgagacacacggcgacaacctgaacctgaccatccctgcgcccgggccggacgtcatccggaacgtgtgcggcagcatcaggtgcgtcgtggtgctcgtctccggccggccgctggtggtggagccgttcatcgacgccatggacgcgctggtagcggcgtggctgccggggacggaggggcagggcgtcagcgacgttctgttcggcgactacgggttcaccgggaagctgtcgaggacgtggttccggtcggtggatcagctgcccatgaatgtcggcgatgcgcactatgacccattgttcccgtttgggttcggcctcgagacacagccgtccacatattaa

SEQ ID NO: 486 - protein, 662 aa, Sorghum bicolor
  misc_feature: Ceres ANNOT ID no. 6007847
  misc_feature (133)..(370): Pfam Id: Glyco_hydro_3 Pfam Desc: Glycosyl hydrolase family 3 N terminal domain
  misc_feature (442)..(659): Pfam Id: Glyco_hydro_3_C Pfam Desc: Glycosyl hydrolase family 3 C terminal domain
  misc_feature (56)..(658): NCBI GI: 8809764 NCBI Desc: exoglucanase precursor [zea mays]
  misc_feature (56)..(658): NCBI GI: 1588407 NCBI Desc: beta-d-glucan exohydrolase
  misc_feature (56)..(658): NCBI GI: 1203832 NCBI Desc: beta-d-glucan exohydrolase, isoenzyme exoii
  misc_feature (56)..(658): NCBI GI: 20259685 NCBI Desc: beta-d-glucan exohydrolase [triticum aestivum]
  misc_feature (56)..(658): NCBI GI: 46451431 NCBI Desc: cell wall beta-glucosidase [secale cereale]
  misc_feature: The sequence is a functional homolog of SEQ ID NO. 525 in the 11/188,298 US application
MGVRRRVVVDAAALLILQLCCCCIIALARAAAATMPSATDIVGDVGERQQQEVGAKYRDPRQPLNARVDDLLRRMTLAEKIGQMSQIDRENATAGVISKYFIGSVLRGGGRVPAAGAPPEAWVEMVEEIQRAAVSSTRLGIPVMFGIDAVHGHGYVYKATVFPHNVGLGCTRDPELARKIGAAVALEVRATGIPFIFAPCLAVCRDPRWGRCYESFSEHPELVQNMTSIVSGFQGEIPATGRLGTPYVAGQRNVAACAKHYVGDGGTTRGINENNTVATFHDLLGIHMRPYYTAAIRGVSTIMVSYSSWNGVKMHANRFLITDFLKTRLRFRGFVLSDWLGLDRITSPEHADYLLSIKLGILAGIDMVMIPYRYTEFIDDLTLLVQNGTIPLSRIDDAVRRILRVKFTMGLFDNPYADTSLVGELGKQEHRDLAREAVRKSLVLLKNGKPGAKPLLPLPKKPSYGRSVLVAGSHGDDLGSQCGGWTITWQGQTGNNLTAGTTILDGIKRAVVPGTDVVYSENPDAGFVQQNKARFDYAIVVVGEPPYAETHGDNLNLTIPAPGPDVIRNVCGSIRCVVVLVSGRPLVVEPFIDAMDALVAAWLPGTEGQGVSDVLFGDYGFTGKLSRTWFRSVDQLPMNVGDAHYDPLFPFGFGLETQPSTY

SEQ ID NO: 487 - DNA, 768 bp, Sorghum bicolor
  misc_feature: Ceres ANNOT ID no. 6007857
  misc_feature: Encodes the peptide sequence at SEQ ID NO 488
atggcggtggtgggcgtcctcgcgctgcagggctcctacaacgagcacatggccgcgctgaggaggatcggggtgaggggcgtggaggtgcgcaagccggagcagctcctcggtgtcgactcgctcatcatccccggcggcgagagcaccaccatggccaagctcgccaactaccacaacctgttccctgcacttcgagagtttgtcggaggtggaaagcctgtctggggaacctgcgctgggctcatctttcttgcaaacaaagcagtagggcaaaaaacagggggccaggaacttgtcggaggactagattgtactgtccaccgaaacttttttgggagtcagcttcaaagctttgagacagagctatctgtgccaaagctttcagagaaggaaggagggaataatacatgccgtggtgtatttatacgggcacctgctatattggaagtaggtccagatgttgaaatattggcagattgtcctgttcctgctgacagacccagcattaccatatcatttggggagggtactgaggaagaagtgtattcaaaagatcgggtaattgttgcagtacggcaagggaacatccttgcaactgctttccacccagaattgacatcagactccagatggcaccgcttcttcctggacatggataaagaatcccaagcaaaggccttctctgcgttgtcgatatcatcatcttcaagagacactgaaaacctgccaaagaataagccgcttgatctgcccatttttgagtaa

SEQ ID NO: 488 - protein, 255 aa, Sorghum bicolor
  misc_feature: Ceres ANNOT ID no. 6007857
  misc_feature (6)..(222): Pfam Id: SNO Pfam Desc: SNO glutamine amidotransferase family
  misc_feature (33)..(211): Pfam Id: GATase_3 Pfam Desc: CobB/CobQ-like glutamine amidotransferase domain
  misc_feature (1)..(255): NCBI GI: 140051169 NCBI Desc: sno glutamine amidotransferase [medicago truncatula]
  misc_feature (4)..(255): NCBI GI: 9757756 NCBI Desc: amidotransferase hish-like protein [arabidopsis thaliana]
  misc_feature (4)..(156): NCBI GI: 76261068 NCBI Desc: sno glutamine amidotransferase:cobb/cobq-like glutamine amidotransferase [chloroflexus aurantiacus j-10-fl]
  misc_feature (3)..(160): NCBI GI: 68565786 NCBI Desc: glutamine amidotransferase subunit pdxt (glutamine amidotransferase glutaminase subunit pdxt)
  misc_feature (4)..(162): NCBI GI: 117928554 NCBI Desc: sno glutamine amidotransferase [acidothermus cellulolyticus 11b]
  misc_feature: Useful for making plants with modulated drought sensitivity
  misc_feature: GREAT-hit functional homolog of the protein sequence encoded by LOCUS at5g60540
  misc_feature: Useful for making plants with modulated drought sensitivity
  misc_feature: Functional homolog of the protein sequence given in SEQ ID NO 13887
MAVVGVLALQGSYNEHMAALRRIGVRGVEVRKPEQLLGVDSLIIPGGESTTMAKLANYHNLFPALREFVGGGKPVWGTCAGLIFLANKAVGQKTGGQELVGGLDCTVHRNFFGSQLQSFETELSVPKLSEKEGGNNTCRGVFIRAPAILEVGPDVEILADCPVPADRPSITISFGEGTEEEVYSKDRVIVAVRQGNILATAFHPELTSDSRWHRFFLDMDKESQAKAFSALSISSSSRDTENLPKNKPLDLPIFE

SEQ ID NO: 489 - DNA, 963 bp, Sorghum bicolor
  misc_feature: Ceres ANNOT ID no. 6007859
  misc_feature: Encodes the peptide sequence at SEQ ID NO 490
atgctcccgctcatctctcctccgcgccctggtgccgcagggccccgcgccatcgccaacgcaggcgccactgcccccgccaccgccaggccggccgtcatcctcccagttgcgccctctccctcaccttctctcccgctgcttcctcttgccctctcgcccgggctcgggaacaacacgggcgactacgcgcggctcgccgcggcgctacgggacgaccacggcctccccgcggccgtcgtggcgcgggtcacccgccccgactggctccgcaacgccgcgggcctcgccgacgccagctactggcggggcaccctccgcccgcgccccgtgctcgactggtacctgaagagggtggatgacgcggtgtctgaggcgagggagctatgcgcaccagctgggggctggctcgcgcgtgtgtacatggcggagtttgaggcttccgacataagtttactgctcacccttggcacccctcacttgcctcctccaaaaggtgtacctggggtaattgatcagactagaggactactgaactacgtcgagaagaattgtgctccagcagtttatacaccagaattaagatatgtgtgcattgctggaaggtacattcaaggtgctcctcttctggggaactccgcagctgcttctgatgagatccttgcagttgacactccttcagaaggaggtgaggctgttattacgggtagcaatgacaaatctactcggtcaagtgtcacgtggagagcccggttcgtcgggcaagggtacaaacaggtttgtggccaagcggatgtgtggggcgacggcgtcgtacctgaaatggcagcgcatctggaaggagcactgaacataagctttgacggcgtgtaccactctcctgtaggctctgatgatgaacaaaggccctggtatggctctccagcaatcctcaagcagtgggtgcatcaccttctcagttga

SEQ ID NO: 490 - protein, 320 aa, Sorghum bicolor
  misc_feature: Ceres ANNOT ID no. 6007859
  misc_feature (49)..(208): NCBI GI: 76258204 NCBI Desc: probable lipase [chloroflexus aurantiacus j-10-fl]
  misc_feature (234)..(318): NCBI GI: 116074771 NCBI Desc: esterase/lipase/thioesterase family active site [synechococcus sp. rs9916]
  misc_feature (255)..(314): NCBI GI: 76260243 NCBI Desc: probable lipase [chloroflexus aurantiacus j-10-fl]
  misc_feature (255)..(314): NCBI GI: 10198166 NCBI Desc: lipa [chloroflexus aurantiacus]
  misc_feature (225)..(314): NCBI GI: 87303536 NCBI Desc: esterase/lipase/thioesterase family active site protein [synechococcus sp. wh 5701]
MLPLISPPRPGAAGPRAIANAGATAPATARPAVILPVAPSPSPSLPLLPLALSPGLGNNTGDYARLAAALRDDHGLPAAVVARVTRPDWLRNAAGLADASYWRGTLRPRPVLDWYLKRVDDAVSEARELCAPAGGWLARVYMAEFEASDISLLLTLGTPHLPPPKGVPGVIDQTRGLLNYVEKNCAPAVYTPELRYVCIAGRYIQGAPLLGNSAAASDEILAVDTPSEGGEAVITGSNDKSTRSSVTWRARFVGQGYKQVCGQADVWGDGVVPEMAAHLEGALNISFDGVYHSPVGSDDEQRPWYGSPAILKQWVHHLLS

SEQ ID NO: 491 - DNA, 759 bp, Sorghum bicolor
  misc_feature: Ceres ANNOT ID no. 6007862
  misc_feature: Encodes the peptide sequence at SEQ ID NO 492
atggcggcctcgtcgtccttcaagccgaacccgctgtcgctgagcgtgccggaccctgcgctcgatcgctggctccgggacagcggctacctcgacctcctcgattccaccaccaccggagcgccgtcgtcaacctcggccccctccacctccgcctccgccgccgccaggcccggaaccggcccggtctcctcgggcgtcgcggccgacgtcctcgccttcgcgcgcaccctcgcctcgctcctcgcgctcaaccccttcgcgcgcctctccaccgccgacctggccgcgcccaccccgtcctggtcgctcgccttcgtcggtccccccggcgccgcgtcctactcctggccgcccacgccgacccaggccaggctccgcgtccaggagaacgtccgccggtacgcgcgcaactacgccgcgctcaccatcctcgtcttcgcgtgctgcctgtatcggatgccgatggcgctgctggggatgctggccagcctcgccgtctgggagggcgtgcgctactgccgtgaccattggggcctcaccaccagggctccaggggttgcccaggctctgctgcactgcgcgcagattgctactgctatactactgtacgtctgcaacctacagtttgctctcgtgtatgccatcggattgagctatgcattgatgatgttgcacgcctcgcttcggaagttgaccccctcaagtctaccagatcccagtaataagaacaggagggcgcagccgagacggagctag

SEQ ID NO: 492 - protein, 252 aa, Sorghum bicolor
  misc_feature: Ceres ANNOT ID no. 6007862
  misc_feature (67)..(244): Pfam Id: PRA1 Pfam Desc: PRA1 family protein
  misc_feature (2)..(172): NCBI GI: 115478078 NCBI Desc: os09g0134400 [oryza sativa (japonica cultivar-group)]
MAASSSFKPNPLSLSVPDPALDRWLRDSGYLDLLDSTTTGAPSSTSAPSTSASAAARPGTGPVSSGVAADVLAFARTLASLLALNPFARLSTADLAAPTPSWSLAFVGPPGAASYSWPPTPTQARLRVQENVRRYARNYAALTILVFACCLYRMPMALLGMLASLAVWEGVRYCRDHWGLTTRAPGVAQALLHCAQIATAILLYVCNLQFALVYAIGLSYALMMLHASLRKLTPSSLPDPSNKNRRAQPRRS

SEQ ID NO: 493 - DNA, 936 bp, Sorghum bicolor
  misc_feature: Ceres ANNOT ID no. 6007879
  misc_feature: Encodes the peptide sequence at SEQ ID NO 494
atggcgccaggaagcagcattgtgactgtagtccccgagtcggactgtggtgatgacgatgggctttctgaggcacttgggggtatccggcttgacgtagactctgcaagtaaaccatggtctacatcactagccaatgttgcattatcatcactgtctggcttgaatgatttgctcgaatgtccagtgtgtaccaactcaatgcgcccacctatactccagtgcccaaatggccacacaatctgctctagttgcaagcacagggtggagaaccattgcccaacttgtcgccaggaactgggaaacatcaggtgcttagctcttgagaaggtggcagaacaactccagcttccatgcaaataccagagtatgggatgcactgagattcacccatacaagaacaaactcaagcacgaggagctctgcaggttcaggccgtacaactgtccgtacgcaggttcagagtgtctgatcacaggtgatgttccgtttctggtgtctcatctcatcaatgaccataaggtggacttgcatgagggctgcacgtttaaccaccgatatgtgaagcccaacccttacgaagtggaaaatgctacatggatgctcactgttttcaagtgttttgggcagcacttctgcctgcactttgaggcgttcctgctggggatggcgccggtgtacatggcgtttctgcggttcatgggtgaggagagcgaggcgcaggggttcgggtacagcctagaggtgggtgggggcgggcggaagctgacatggcagggcacgccgcggagcatcagggacagccaccggaaggtgcgggacagcttcgacgggctcatcatccacaggaacatggcactcttcttctcaggcggcggtaggcaggagctcaagctgcgggtcactggccgcatctggaaggagcaagggcaatga

SEQ ID NO: 494 - protein, 311 aa, Sorghum bicolor
  misc_feature: Ceres ANNOT ID no. 6007879
  misc_feature (103)..(302): Pfam Id: Sina Pfam Desc: Seven in absentia protein family
  misc_feature (41)..(311): NCBI GI: 6850870 NCBI Desc: seven in absentia-like protein [arabidopsis thaliana]
  misc_feature (41)..(311): NCBI GI: 21536945 NCBI Desc: seven in absentia-like protein [arabidopsis thaliana]
  misc_feature (44)..(309): NCBI GI: 92883480 NCBI Desc: zinc finger, ring-type; seven in absentia protein [medicago truncatula]
  misc_feature (44)..(311): NCBI GI: 92873199 NCBI Desc: zinc finger, ring-type; seven in absentia protein [medicago truncatula]
  misc_feature (57)..(309): NCBI GI: 63095207 NCBI Desc: sina [phyllostachys praecox]
MAPGSSIVTVVPESDCGDDDGLSEALGGIRLDVDSASKPWSTSLANVALSSLSGLNDLLECPVCTNSMRPPILQCPNGHTICSSCKHRVENHCPTCRQELGNIRCLALEKVAEQLQLPCKYQSMGCTEIHPYKNKLKHEELCRFRPYNCPYAGSECLITGDVPFLVSHLINDHKVDLHEGCTFNHRYVKPNPYEVENATWMLTVFKCFGQHFCLHFEAFLLGMAPVYMAFLRFMGEESEAQGFGYSLEVGGGGRKLTWQGTPRSIRDSHRKVRDSFDGLIIHRNMALFFSGGGRQELKLRVTGRIWKEQGQ

SEQ ID NO: 495 - DNA, 1053 bp, Sorghum bicolor
  misc_feature: Ceres ANNOT ID no. 6007883
  misc_feature: Encodes the peptide sequence at SEQ ID NO 496
atggggagcaatgaccctagcacaccctccaaggcttcaaaggcatcagaacaagatcaacctccagctaccacatccagtggaacaccttcagtgtaccctgaatggcccagctttcaggcctactcagcaattccaccacatgggttcttcccccctaccgttgctgcaaatccacaggcccatccatacatgtggggagctcagcccatggtaccaccttatgggacgccaccaccaccttatgtgatgtatccacctggaacagtatatgcccatccctctacacctcctactatgcatccatttagtcattatcctatgccaacaaacggacatgctgaaacccctggagctgcaccaagtgctccagaaatgaatgggaaaagtgagcctggcagaacatctgctccatctgccaatgggattacctcccacagtgagagtggaagtgagagtgagagtgaaggaagtgatgccaattctcaaaatgattcacactcaaaggacaatgatggaaaggaagatggcaattctcagaatggcatatcttattcagcatcacaaggaatgttaaaccaaaccatggcgatgcttccagtacaaccgggtgcaatggttggaggagttcctagctccacagctaacttgaatattggaatggattattgggcagcttcaggttctgcagctgtccctggaacgcatggcaaagcaccagttggttcagctcggggagaccaatgggatgaaagggaactcaagaagcaaaaacgaaagcagtctaatagagaatcagcacgcagatcccggctgcgcaaacaggctgagtgcgaggagcttgggcaacgtgctgaagctttgaggtcggagaactcctctctcagggccgagcttgagcggatcagaaaggagtatgaacagctactttcacagaatgcttccctcaaggaaaagctgggggccaccagtgattctattcctgatatgaatgaaaagaacgacggcgacggcagctacaagagacaacatgattccgatgcccagtcttga

SEQ ID NO: 496 - protein, 350 aa, Sorghum bicolor
  misc_feature: Ceres ANNOT ID no. 6007883
  misc_feature (1)..(166): Pfam Id: MFMR Pfam Desc: G-box binding protein MFMR
  misc_feature (251)..(314): Pfam Id: bZIP_1 Pfam Desc: bZIP transcription factor
  misc_feature (251)..(305): Pfam Id: bZIP_2 Pfam Desc: Basic region leucine zipper
  misc_feature (1)..(343): NCBI GI: 21633 NCBI Desc: hbp-1a [triticum aestivum]
  misc_feature (1)..(343): NCBI GI: 100838 NCBI Desc: histone-specific transcription factor hbp1 - wheat
  misc_feature (1)..(347): NCBI GI: 27469354 NCBI Desc: bzip transcription factor zip1 [hordeum vulgare subsp. vulgare]
  misc_feature (1)..(320): NCBI GI: 113367212 NCBI Desc: bzip transcription factor bzip117 [glycine max]
  misc_feature (1)..(320): NCBI GI: 140064568 NCBI Desc: camp response element binding (creb) protein; g-box binding, mfmr [medicago truncatula]
  misc_feature: The leaves start out wild-type green and gradually turn yellow-greenin color, while the cotyledons stay wild-type green.
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1225 in the 10/412,699US patent application
  misc_feature: The sequence is a functional homolog of SEQ ID NO 1762 in the 10/374,780US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 910 in the 10/374,780US patent application
  misc_feature: The sequence is a functional homolog of SEQ ID NO 911 in the 10/374,780US patent application
  misc_feature: The sequence is a functional homolog of SEQ ID NO 922 in the 10/374,780US patent application
  misc_feature: Useful for biocontainment applications
  misc_feature: Useful for making plants with altered Lignin content
  misc_feature: Useful for making plants with altered alkaloid content
  misc_feature: Useful for making plants with altered terpenoid content
  misc_feature: Useful for making plants with modulated growth and phenotype characteristics
  misc_feature: Functional homolog of the protein sequence given in SEQ ID NO 13330
  misc_feature: The sequence is a functional homolog of SEQ ID NO 12 in the 20040045049 US patent application
  misc_feature: The sequence is a functional homolog of SEQ ID NO 1225 in the 20040045049 US patent application
  misc_feature: The sequence is a functional homolog of SEQ ID NO 1762 in the 20060162006 US patent application
  misc_feature: The sequence is a functional homolog of SEQ ID NO 910 in the 20060162006 US patent application
  misc_feature: The sequence is a functional homolog of SEQ ID NO 911 in the 20060162006 US patent application
  misc_feature: The sequence is a functional homolog of SEQ ID NO. 512 in the 11/188,298 US application
  misc_feature: The sequence is a functional homolog of SEQ ID NO. 337 in the 11/188,298 US application
MGSNDPSTPSKASKASEQDQPPATTSSGTPSVYPEWPSFQAYSAIPPHGFFPPTVAANPQAHPYMWGAQPMVPPYGTPPPPYVMYPPGTVYAHPSTPPTMHPFSHYPMPTNGHAETPGAAPSAPEMNGKSEPGRTSAPSANGITSHSESGSESESEGSDANSQNDSHSKDNDGKEDGNSQNGISYSASQGMLNQTMAMLPVQPGAMVGGVPSSTANLNIGMDYWAASGSAAVPGTHGKAPVGSARGDQWDERELKKQKRKQSNRESARRSRLRKQAECEELGQRAEALRSENSSLRAELERIRKEYEQLLSQNASLKEKLGATSDSIPDMNEKNDGDGSYKRQHDSDAQS

SEQ ID NO: 497 - DNA, 1197 bp, Sorghum bicolor
  misc_feature: Ceres ANNOT ID no. 6007899
  misc_feature: Encodes the peptide sequence at SEQ ID NO 498
atgccgctctgctgctcccccacctccgctgccgccgccgcggcggcatctcccggcgtcgcccgcagcgggggcctcctgcgccgctcgcgcccagtccccggcgtcgtgaggtgtaaaaagattgattctctgagggcaatcaatggagcactgccttgtattccggtgtccgacaggtcgctactgactcctgtaaacttgccggttttccgggatccaaacatgaggaacgacacgaggctgcgcatcttctcaggcacagccaatccttccctttctcaggaaatagcaagttacttggggctagaacttgggaagattaacataaagaggttcgctgatggtgaaatatatgttcagttgcaagaaagtgtacggggctgtgatgttttccttgtgcaaccgtcgtgccctccagcaaatgaaaatcttatggaacttctgatcatgattgatgcctgtaggagagcatcagctaagaatattactgcagttatcccttattttggttatgcaagggctgacaggaagtctcagggccgggaatctatagctgcaaagcttgtagctaatatgattaccgaagctggtgctaaccgtgtccttgtttgtgatcttcattccagtcaagcaatgggatacttcgacatcccagtagatcatgtttatggccagcctgttattcttgattatctcgccagcaagacaatatgttcaaatgacttggtagttgtttctcctgatgttggaggtgttgccagggcacgtgcttttgccaaaaagctgtcagatgcacctctggctattgtagataaaagaaggcaaggacataatgtcgctgaggtaatgaatcttattggagatgtgagaggaaaagtggctgttatgatggatgatatgatcgacacagcaggtactattgccaaaggagctgagctactgcatcaggaaggagctcgagaagtatatgcttgctgtacacatgctgtttttagcccacctgccatcgaaaggttatcaagtggattgtttcaagaagtaatcatcacaaacactatccctctaaaggaggagaagacttttccgcagctgaccattctttcagttgctaacctcttaggcgaaacaatctggcgtgttcacgatgattgctcggttggtcatgagccatactccagcttggatattgactga

SEQ ID NO: 498 - protein, 398 aa, Sorghum bicolor
  misc_feature: Ceres ANNOT ID no. 6007899
  misc_feature (217)..(350): Pfam Id: Pribosyltran Pfam Desc: Phosphoribosyl transferase domain
  misc_feature (9)..(398): NCBI GI: 68571763 NCBI Desc: ribose-phosphate pyrophosphokinase 1 (phosphoribosyl pyrophosphate synthetase 1)
  misc_feature (77)..(387): NCBI GI: 4902849 NCBI Desc: phosphoribosyl pyrophosphate synthase [spinacia oleracea]
  misc_feature (2)..(387): NCBI GI: 4902851 NCBI Desc: phosphoribosyl pyrophosphate synthase isozyme 2 [spinacia oleracea]
  misc_feature (2)..(387): NCBI GI: 51971799 NCBI Desc: phosphoribosyl pyrophosphate synthetase [arabidopsis thaliana]
  misc_feature (27)..(387): NCBI GI: 92885984 NCBI Desc: ribose-phosphate pyrophosphokinase [medicago truncatula]
  misc_feature (9)..(398): SWISSPROT Homolog: EC 2.7.6.1 Ribose-phosphate pyrophosphokinase 1
  misc_feature: Useful for making plants with modulated biomass
  misc_feature: Functional homolog of the protein sequence given in SEQ ID NO 13893
MPLCCSPTSAAAAAAASPGVARSGGLLRRSRPVPGVVRCKKIDSLRAINGALPCIPVSDRSLLTPVNLPVFRDPNMRNDTRLRIFSGTANPSLSQEIASYLGLELGKINIKRFADGEIYVQLQESVRGCDVFLVQPSCPPANENLMELLIMIDACRRASAKNITAVIPYFGYARADRKSQGRESIAAKLVANMITEAGANRVLVCDLHSSQAMGYFDIPVDHVYGQPVILDYLASKTICSNDLVVVSPDVGGVARARAFAKKLSDAPLAIVDKRRQGHNVAEVMNLIGDVRGKVAVMMDDMIDTAGTIAKGAELLHQEGAREVYACCTHAVFSPPAIERLSSGLFQEVIITNTIPLKEEKTFPQLTILSVANLLGETIWRVHDDCSVGHEPYSSLDID

SEQ ID NO: 499 - DNA, 1128 bp, Sorghum bicolor
  misc_feature: Ceres ANNOT ID no. 6007903
  misc_feature: Encodes the peptide sequence at SEQ ID NO 500
atggcggcgccggcgccggcggccacccgcctccacgccccgttcctcctgtttccttccccgccgcgaccgcaccctccactacgcctccgcttcctcctgccgtccccgccgccggtccgcctccgccgccgcttcccgctgctcgcggcggccgctgtctccaccgccgccgctggcggcgatggcggcggcggggaggacgccaccgcttccgccaggaaggccgaaaaggccaggcagctgcagaagcgggtcgtcgtcggcgtcgccatcggggtgggcgccggcggcgtcgtggtcgccggcggctgggtgttcgccgccgccgtctcggccgccgtacttgccggctcccgggagtacttcgagctcgttcgcggcactgctggcggaggcgggacgccgccgccgcgctacgtgtcccgcgcgtgctccgccatctgcgctttcatgcccatccttgcgctgtactatggacgcatggatgttactgtgacattttctgcattcgtcattgcaatatcattgcttttacaaagaggaaatcctcgttttgctcagctaactagttcagtttttgggttattttactgcggctatctaccttctttctgggttaagcttcgatcaggactggctgcccctgccttaaatacaagtatagcatacagttggccaattcttcttggtggacaagctcactggacagttggacttgtagcaaccttgatggctattagtagcatcattgctgctgatacatctgctttcctttgtggaagggcatttggtcgtactcctttgactaacataagccctaagaagaccttggaaggtgctttagctggcctagctggctgtgtactgaccactgtgctgctgtcaaccgtctttcgctggccaagatcgctgttgagtgctacagcttatggaatcctgatctttctgggttcattatttggagatcttgttgaatctctgattaagcgtgatgctggtgtgaaggactctggatcactcattcctggtcatggtggaattcttgaccgagttgacagctacgttttcacaggggcactttgttactcttttgtcagagtagctctacccttgtatggggtctga

SEQ ID NO: 500 - protein, 375 aa, Sorghum bicolor
  misc_feature: Ceres ANNOT ID no. 6007903
  misc_feature (83)..(369): Pfam Id: CTP_transf_1 Pfam Desc: Cytidylyltransferase family
  misc_feature (3)..(359): NCBI GI: 115443953 NCBI Desc: os02g0126900 [oryza sativa (japonica cultivar-group)]
  misc_feature (7)..(375): NCBI GI: 42571237 NCBI Desc: phosphatidate cytidylyltransferase family protein [arabidopsis thaliana]
  misc_feature (7)..(266): NCBI GI: 145362203 NCBI Desc: phosphatidate cytidylyltransferase family protein [arabidopsis thaliana]
  misc_feature (85)..(372): NCBI GI: 119486447 NCBI Desc: phosphatidate cytidylyltransferase [lyngbya sp. pcc 8106]
  misc_feature (87)..(372): NCBI GI: 16330180 NCBI Desc: phosphatidate cytidylyltransferase [synechocystis sp. pcc 6803]
MAAPAPAATRLHAPFLLFPSPPRPHPPLRLRFLLPSPPPVRLRRRFPLLAAAAVSTAAAGGDGGGGEDATASARKAEKARQLQKRVVVGVAIGVGAGGVVVAGGWVFAAAVSAAVLAGSREYFELVRGTAGGGGTPPPRYVSRACSAICAFMPILALYYGRMDVTVTFSAFVIAISLLLQRGNPRFAQLTSSVFGLFYCGYLPSFWVKLRSGLAAPALNTSIAYSWPILLGGQAHWTVGLVATLMAISSIIAADTSAFLCGRAFGRTPLTNISPKKTLEGALAGLAGCVLTTVLLSTVFRWPRSLLSATAYGILIFLGSLFGDLVESLIKRDAGVKDSGSLIPGHGGILDRVDSYVFTGALCYSFVRVALPLYGV

SEQ ID NO: 501 - DNA, 1293 bp, Sorghum bicolor
  misc_feature: Ceres ANNOT ID no. 6007906
  misc_feature: Encodes the peptide sequence at SEQ ID NO 502
atgcccccgccgccgccgcggttggcgccaaaccccgccgccgtactccacgcggcactcctcagggcctcctccttctctgccgcttgccgcctgcctccccgcatctccttcaactccctgctcgcggccgccgcgtcctcccaggacacgcgcctccgcgcgctcgccctcccggcgctcgcgctcgcccacgcctccggtcgcgtgcctctcgactcgtacgccctctgctccgcgctccgctccacgccctccgccgcggacacgctccacgcgctcgcctccaagtctggctggctcggcagcgtcttcgtgtcctgcgcgctcgccgcgtcctatggcggatccggccggtaccaggacgcccggaagctgttcgacgaaagtccttccaagaatggagtcttcgggaacgccgttctcgccgcttatgtgggcgcggccaagtgggtgcccgtgctggggttcgcgcggaggttctcagagctacagctgcaggtcgacgggtacaccatgacggctgtggtgcgggcatgtggtgaggtggcaaatgctgatctcggtgtccaggcgcacgggcatgctatcaggaggttgggaggtatagaggtggatgtgttcttggtcagcgcgtttgtggacatgtatgccaagtgtgggcttatcagccaagcggagtgtgtgttcggccttgcacagcaggagactggtggcagaggtgacgtcgtgctgtggacggccatgttgaatgcctatgcgcggcatggacagtgcaaggaggttatccggatgtatgacctgatggtggcttctggtgtctacccggatgaattggctatgttagctgtgctctcagcttgccagcacgctggggaggtggtcaaggggctcaactactttgaatccatgcacgcagattacgggttggtgcccacaccagagcactacggttgtgtggtcaacatgctgtgccgggcaggggaagtgaccaaggcgtgggaaattgccaccaaggatggctgtgattgtgcaatcggcgtatccacatggggggcactgctcagtgcttgccaggcgtgtttaaatgttgaggttgggagaatggcagctcagaaggcaatcgaattggaccctaccaatgttgggatttacattgagctgtcaaatttgtatgcaagggcttgcttgtgggatgatattgaccagctgcgggaggtgatgaaggagaaagggttggaaaaggatgttggatgtacttgggggctgagcttggttcacgaaagaacttga

SEQ ID NO: 502 - protein, 430 aa, Sorghum bicolor
  misc_feature: Ceres ANNOT ID no. 6007906
  misc_feature (244)..(278): Pfam Id: PPR Pfam Desc: PPR repeat
  misc_feature (32)..(421): NCBI GI: 11994419 NCBI Desc: selenium-binding protein-like [arabidopsis thaliana]
  misc_feature (32)..(421): NCBI GI: 15230593 NCBI Desc: pentatricopeptide (ppr) repeat-containing protein [arabidopsis thaliana]
  misc_feature (37)..(421): NCBI GI: 18394615 NCBI Desc: pentatricopeptide (ppr) repeat-containing protein [arabidopsis thaliana]
  misc_feature (37)..(421): NCBI GI: 6714305 NCBI Desc: f15h18.4 [arabidopsis thaliana]
  misc_feature (36)..(421): NCBI GI: 87241511 NCBI Desc: tetratricopeptide-like helical [medicago truncatula]
MPPPPPRLAPNPAAVLHAALLRASSFSAACRLPPRISFNSLLAAAASSQDTRLRALALPALALAHASGRVPLDSYALCSALRSTPSAADTLHALASKSGWLGSVFVSCALAASYGGSGRYQDARKLFDESPSKNGVFGNAVLAAYVGAAKWVPVLGFARRFSELQLQVDGYTMTAVVRACGEVANADLGVQAHGHAIRRLGGIEVDVFLVSAFVDMYAKCGLISQAECVFGLAQQETGGRGDVVLWTAMLNAYARHGQCKEVIRMYDLMVASGVYPDELAMLAVLSACQHAGEVVKGLNYFESMHADYGLVPTPEHYGCVVNMLCRAGEVTKAWEIATKDGCDCAIGVSTWGALLSACQACLNVEVGRMAAQKAIELDPTNVGIYIELSNLYARACLWDDIDQLREVMKEKGLEKDVGCTWGLSLVHERT

SEQ ID NO: 503 - DNA, 876 bp, Sorghum bicolor
  misc_feature: Ceres ANNOT ID no. 6007909
  misc_feature: Encodes the peptide sequence at SEQ ID NO 504
atgacctccgctcactccaagctctactccgatgacgtcagcctcgtcgtggtcgtcgtcgacacgaaccccttcttctgggccgccgccgcgctccccttcgccgacttctttgcgcacttgatccacttcgtgaactcgatcctgctgctgaaccacctcaatcgtgtggtcgtcatcgccgcgggagtcagctcctgtgcctacatcctggattccagcgatgccagcccctctggcggcgtgggcgtctcggacaccttcgacaaggcaagccgcaaggcggaggagttcattgcacaagacgcccgtgccactgcagccaacagttctgttgcttctgccaatgccgcgtcgctgctctctggggcgctgtccctcgctttgtgctatatacagaggattttccggtctgggactcggcatccgcaacctcggattctatgcctgcagggatctccagatggacctgaacaatatgtggcagtgatgaattcaatattttctgctcaacgttccatggtaccaattgattcttgtattgtgggaacccaggattctgctttcttgcagcaggcttcatacataacaggaggagtttatttgaagccccaagaactaaatggtctgtttcaataccttgccgctgtatttgcaactgatttacactctagagcatttctgcgccttccaaaaactcttggagtggactttcgtgcttcgtgtttctgtcataagaagaccatcgacatgggatatgtctgttcagtttgtttgtcaatattctgcaagaatcagaagaagtgttcaacctgtgggtcagaattcagtcgtgtcatgcctgatttgaattccatgccagatcaaagcaagtag

SEQ ID NO: 504 - protein, 291 aa, Sorghum bicolor
  misc_feature: Ceres ANNOT ID no. 6007909
  misc_feature (12)..(273): Pfam Id: Tfb4 Pfam Desc: Transcription factor Tfb4
  misc_feature (2)..(272): NCBI GI: 144924298 NCBI Desc: transcription factor tfb4 [medicago truncatula]
  misc_feature (1)..(291): NCBI GI: 6714290 NCBI Desc: f15h18.15 [arabidopsis thaliana]
  misc_feature (46)..(281): NCBI GI: 34783739 NCBI Desc: gtf2h3 protein [homo sapiens]
  misc_feature (46)..(281): NCBI GI: 1039318 NCBI Desc: basic transcription factor 2, 35 kd subunit [homo sapiens]
  misc_feature (46)..(281): NCBI GI: 119618832 NCBI Desc: general transcription factor iih, polypeptide 3, 34kda, isoform cra_a [homo sapiens]
MTSAHSKLYSDDVSLVVVVVDTNPFFWAAAALPFADFFAHLIHFVNSILLLNHLNRVVVIAAGVSSCAYILDSSDASPSGGVGVSDTFDKASRKAEEFIAQDARATAANSSVASANAASLLSGALSLALCYIQRIFRSGTRHPQPRILCLQGSPDGPEQYVAVMNSIFSAQRSMVPIDSCIVGTQDSAFLQQASYITGGVYLKPQELNGLFQYLAAVFATDLHSRAFLRLPKTLGVDFRASCFCHKKTIDMGYVCSVCLSIFCKNQKKCSTCGSEFSRVMPDLNSMPDQSK

SEQ ID NO: 505 - DNA, 1128 bp, Sorghum bicolor
  misc_feature: Ceres ANNOT ID no. 6007916
  misc_feature: Encodes the peptide sequence at SEQ ID NO 506
atggagatcacggaggcgtcaccgtcgccggccccggccgcacagccggcgccagcgccggcaccggagacggcgacgacgatgacgacgctggcgagctctcagcctgcgccggcagctccggaggctgcgctgtccgtggcggcggtagcggggaggggagacgggaagaggaagcgggggaggccgcggaagtacgggcccgacgggaccccgctgcggccgctgaatgcgacgccgatctctgcgtcggcgccggacgacgcgggagtgggccagtacacgcccgcggcggccgtcggggccgtcatgaagaggggcaggggacgcccggtcgggttcatcagccgcgtcacgccgatatcggtggccgtgacggccgccgcgcccaccccggcggtggtcgtgtccgcgcctccgccagcgccagcgccggcgccgcactcccagctcgcgccgctcggtgaattggtagcttgtgcttctggtgccaactttacacctcatattattaatgttgctgctggtgaggatgtcaatatgaaggtcatatctttctcccaacaaggtccaagggcaatttgcattctatcggccaatggtgttattgcaaatgttacactgcgtcaacaagactcattaggtggtacagttacttatgagggccggttcgagcttctctccttgtctggatctttcactcccaccgatagcggtggcaccagaagccgctcaggtgggatgagcgtctccttagcagccgccgacggccgtgtcatcggaggcggagtcgccggcctcctcgtggctgctagccctgtccaggtcgtggtgggaagcttcctaccgagttaccagatggaccagaacgccaacaagaagccggtcatagagatcaagacagtgccgccaccgccgccggcgaccgtcgggttcaccatctcgagcggggacatggacgacgcgtacagcggcagccatcagccacggtcagtgggagcgaaagggagctcgacgatggcattgttcaaggtggagaactggacggcgcccgcgcccgatcaggcgaagaagacaccgccgccgccgccgacgtccgaggccaaagtccccgttcccggagggtga

SEQ ID NO: 506 - protein, 375 aa, Sorghum bicolor
  misc_feature: Ceres ANNOT ID no. 6007916
  misc_feature (7)..(305): NCBI GI: 92884627 NCBI Desc: hmg-i and hmg-y, dna-binding [medicago truncatula]
  misc_feature (148)..(293): NCBI GI: 23506149 NCBI Desc: at4g12080/f16j13_150 [arabidopsis thaliana]
  misc_feature (1)..(338): NCBI GI: 119657406 NCBI Desc: tpa: at-hook motif nuclear localized protein 2 [oryza sativa (japonica cultivar-group)]
  misc_feature (161)..(333): NCBI GI: 115477244 NCBI Desc: os08g0512400 [oryza sativa (japonica cultivar-group)]
  misc_feature (27)..(340): NCBI GI: 2598227 NCBI Desc: at-hook protein 1 [arabidopsis thaliana]
  misc_feature: The sequence is a functional homolog of SEQ ID NO 10 in the 10/669,824US patent application
  misc_feature: The sequence is a functional homolog of SEQ ID NO 10 in the 10/870,198US patent application
  misc_feature: The sequence is a functional homolog of SEQ ID NO 1395 in the 10/374,780US patent application
  misc_feature: The sequence is a functional homolog of SEQ ID NO 1399 in the 10/374,780US patent application
  misc_feature: The sequence is a functional homolog of SEQ ID NO 1400 in the 10/374,780US patent application
  misc_feature: The sequence is a functional homolog of SEQ ID NO 1402 in the 10/374,780US patent application
  misc_feature: The sequence is a functional homolog of SEQ ID NO 1403 in the 10/374,780US patent application
  misc_feature: The sequence is a functional homolog of SEQ ID NO 1404 in the 10/374,780US patent application
  misc_feature: The sequence is a functional homolog of SEQ ID NO 1406 in the 10/374,780US patent application
  misc_feature: The sequence is a functional homolog of SEQ ID NO 1408 in the 10/374,780US patent application
  misc_feature: The sequence is a functional homolog of SEQ ID NO 1410 in the 10/374,780US patent application
  misc_feature: The sequence is a functional homolog of SEQ ID NO 150 in the 10/412,699US patent application
  misc_feature: The sequence is a functional homolog of SEQ ID NO 1507 in the 10/412,699US patent application
  misc_feature: The sequence is a functional homolog of SEQ ID NO 1509 in the 10/412,699US patent application
  misc_feature: The sequence is a functional homolog of SEQ ID NO 1510 in the 10/412,699US patent application
  misc_feature: The sequence is a functional homolog of SEQ ID NO 182 in the 10/666,642US patent application
  misc_feature: The sequence is a functional homolog of SEQ ID NO 22 in the 10/669,824US patent application
  misc_feature: The sequence is a functional homolog of SEQ ID NO 22 in the 10/870,198US patent application
  misc_feature: The sequence is a functional homolog of SEQ ID NO 26 in the 10/669,824US patent application
  misc_feature: The sequence is a functional homolog of SEQ ID NO 26 in the 10/870,198US patent application
  misc_feature: The sequence is a functional homolog of SEQ ID NO 28 in the 10/669,824US patent application
  misc_feature: The sequence is a functional homolog of SEQ ID NO 28 in the 10/870,198US patent application
  misc_feature: The sequence is a functional homolog of SEQ ID NO 290 in the 10/374,780US patent application
  misc_feature: The sequence is a functional homolog of SEQ ID NO 32 in the 10/669,824US patent application
  misc_feature: The sequence is a functional homolog of SEQ ID NO 32 in the 10/870,198US patent application
  misc_feature: The sequence is a functional homolog of SEQ ID NO 340 in the 11/435,388US patent application
  misc_feature: The sequence is a functional homolog of SEQ ID NO 342 in the 10/714,887US patent application
  misc_feature: The sequence is a functional homolog of SEQ ID NO 344 in the 11/435,388US patent application
  misc_feature: The sequence is a functional homolog of SEQ ID NO 346 in the 10/714,887US patent application
  misc_feature: The sequence is a functional homolog of SEQ ID NO 346 in the 11/435,388US patent application
  misc_feature: The sequence is a functional homolog of SEQ ID NO 348 in the 10/714,887US patent application
  misc_feature: The sequence is a functional homolog of SEQ ID NO 348 in the 11/435,388US patent application
  misc_feature: The sequence is a functional homolog of SEQ ID NO 350 in the 10/714,887US patent application
  misc_feature: The sequence is a functional homolog of SEQ ID NO 350 in the 11/435,388US patent application
  misc_feature: The sequence is a functional homolog of SEQ ID NO 352 in the 10/714,887US patent application
  misc_feature: The sequence is a functional homolog of SEQ ID NO 352 in the 11/435,388US patent application
  misc_feature: The sequence is a functional homolog of SEQ ID NO 354 in the 10/714,887US patent application
  misc_feature: The sequence is a functional homolog of SEQ ID NO 374 in the 10/374,780US patent application
  misc_feature: The sequence is a functional homolog of SEQ ID NO 38 in the 10/669,824US patent application
  misc_feature: The sequence is a functional homolog of SEQ ID NO 38 in the 10/870,198US patent application
  misc_feature: The sequence is a functional homolog of SEQ ID NO 6 in the 10/225,066US patent application
  misc_feature: The sequence is a functional homolog of SEQ ID NO 604 in the 10/225,066US patent application
  misc_feature: The sequence is a functional homolog of SEQ ID NO 64 in the 10/669,824US patent application
  misc_feature: The sequence is a functional homolog of SEQ ID NO 64 in the 10/870,198US patent application
  misc_feature: The sequence is a functional homolog of SEQ ID NO 738 in the 10/412,699US patent application
  misc_feature: The sequence is a functional homolog of SEQ ID NO 830 in the 11/435,388US patent application
  misc_feature: The sequence is a functional homolog of SEQ ID NO 90 in the 10/669,824US patent application
  misc_feature: Useful for making plants with modulated growth and phenotype characteristics
  misc_feature: Useful for making plants with modulated low light sensitivity
  misc_feature: Functional homolog of the protein sequence given in SEQ ID NO 13342
  misc_feature: The sequence is a functional homolog of SEQ ID NO 150 in the 20040045049 US patent application
  misc_feature: The sequence is a functional homolog of SEQ ID NO 1507 in the 20040045049 US patent application
  misc_feature: The sequence is a functional homolog of SEQ ID NO 1509 in the 20040045049 US patent application
  misc_feature: The sequence is a functional homolog of SEQ ID NO 1510 in the 20040045049 US patent application
  misc_feature: The sequence is a functional homolog of SEQ ID NO 738 in the 20040045049 US patent application
  misc_feature: The sequence is a functional homolog of SEQ ID NO 26 in the 20040128712 US patent application
  misc_feature: The sequence is a functional homolog of SEQ ID NO 28 in the 20040128712 US patent application
  misc_feature: The sequence is a functional homolog of SEQ ID NO 32 in the 20040128712 US patent application
  misc_feature: The sequence is a functional homolog of SEQ ID NO 38 in the 20040128712 US patent application
  misc_feature: The sequence is a functional homolog of SEQ ID NO 64 in the 20040128712 US patent application
  misc_feature: The sequence is a functional homolog of SEQ ID NO 90 in the 20040128712 US patent application
  misc_feature: The sequence is a functional homolog of SEQ ID NO 6 in the 20050160493 US patent application
  misc_feature: The sequence is a functional homolog of SEQ ID NO 604 in the 20050160493 US patent application
MEITEASPSPAPAAQPAPAPAPETATTMTTLASSQPAPAAPEAALSVAAVAGRGDGKRKRGRPRKYGPDGTPLRPLNATPISASAPDDAGVGQYTPAAAVGAVMKRGRGRPVGFISRVTPISVAVTAAAPTPAVVVSAPPPAPAPAPHSQLAPLGELVACASGANFTPHIINVAAGEDVNMKVISFSQQGPRAICILSANGVIANVTLRQQDSLGGTVTYEGRFELLSLSGSFTPTDSGGTRSRSGGMSVSLAAADGRVIGGGVAGLLVAASPVQVVVGSFLPSYQMDQNANKKPVIEIKTVPPPPPATVGFTISSGDMDDAYSGSHQPRSVGAKGSSTMALFKVENWTAPAPDQAKKTPPPPPTSEAKVPVPGG

SEQ ID NO: 507 - DNA, 1524 bp, Sorghum bicolor
  misc_feature: Ceres ANNOT ID no. 6007918
  misc_feature: Encodes the peptide sequence at SEQ ID NO 508
atggcctcctccatctccgccgccgccaaggcctccacggccttcgcccacaagaaggagctcgccgcgccggcgcccgcgcagcaccgcgcgggctcgagccgccggaccaagccatgccgcgtgcgcgccgtcgcctcgcctgcgcgcgctccccgcgccccgtcgtccaccggctcggtgaagagcgcgatgacgatgacggagaagatcctggcgcgggcgtcggagcgcgcggcgctggagcccggggagaacgtgtgggtggacgtcgacgtgctcatgacgcacgacgtctgcggccccggcaccatcggcatcttcaagaaggaattcggggaggacgccaaggtctgggaccgcgagaaggtcgtcatcatcccggaccactacatcttcaccaccgacgagcgtgccaaccgcaatgtcgacatcctcagggacttctgtctcgagcagaacatcaagtacttctatgacatcaaggacctcagcaatttcaaggctaatccagactacaaaggtgtctgccacgttgcacttgctcaggaaggccactgccgaccaggcgaggttctcctgggcactgattctcatacgtgcaatgctggagcctttggtcaatttgctaccggaattggaaacaccgatgctggttttgtgttgggcactggaaaggctcttctcaaggtgccacctacaatcaggtttgtattagatggagaaatgccgccttatttacttgcgaaggatctgattttgcaaattattggtgagatttcagtatctggcgcaacctacaaatcaatggagtttgttggatcaactgtagagagtctaactatggaagagcgtatgacactatgcaacatggttattgaagctggtggaaagaacggtgttgtgcctgctgatgaaactacatttaaataccttgagggtaagacatcagttgattatgaacctgtctacagtgatgctcaggccagattttttagtgactaccgttttgatgtatcaaaactggagccagtagttgccaagccacattcgcctgacaaccgtgctctagcaagagaatgcaaagatgtcaaggttgaccgagtctatattggttcttgcactggtggtaagactgaggacttccttgctgctgcaaaggtgttcttagcctcgggaaagaaggttaaagttcccacatttcttgtccctgccacacaaaaggtgtggatggacgtatatagcctccctgtaccaggatctggtggcaaaacttgctcccagatatttgaggaggctggttgtgatacaccagcaagtcctagctgtggtgcttgtttgggtggtcctcgtgatacatatgcacggatgaatgaacctatggtctgcgtgtccactacgaacaggaacttcccgggcaggatggggcacaaggaagggcagatctacctggcgtctccctacactgcagctgcctcagccctgacggggtatgttacggaccccagggacttcctcatgtaa

SEQ ID NO: 508 - protein, 507 aa, Sorghum bicolor
  misc_feature: Ceres ANNOT ID no. 6007918
  misc_feature (66)..(497): Pfam Id: Aconitase Pfam Desc: Aconitase family (aconitate hydratase)
  misc_feature (1)..(460): NCBI GI: 92895939 NCBI Desc: 3-isopropylmalate dehydratase large subunit [medicago truncatula]
  misc_feature (348)..(506): NCBI GI: 140056581 NCBI Desc: 3-isopropylmalate dehydratase large subunit [medicago truncatula]
  misc_feature (65)..(506): NCBI GI: 113476324 NCBI Desc: homoaconitate hydratase family protein [trichodesmium erythraeum ims101]
  misc_feature (64)..(506): NCBI GI: 119356679 NCBI Desc: homoaconitate hydratase family protein [chlorobium phaeobacteroides dsm 266]
  misc_feature (64)..(506): NCBI GI: 78189855 NCBI Desc: 3-isopropylmalate dehydratase [chlorobium chlorochromatii cad3]
MASSISAAAKASTAFAHKKELAAPAPAQHRAGSSRRTKPCRVRAVASPARAPRAPSSTGSVKSAMTMTEKILARASERAALEPGENVWVDVDVLMTHDVCGPGTIGIFKKEFGEDAKVWDREKVVIIPDHYIFTTDERANRNVDILRDFCLEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTVESLTMEERMTLCNMVIEAGGKNGVVPADETTFKYLEGKTSVDYEPVYSDAQARFFSDYRFDVSKLEPVVAKPHSPDNRALARECKDVKVDRVYIGSCTGGKTEDFLAAAKVFLASGKKVKVPTFLVPATQKVWMDVYSLPVPGSGGKTCSQIFEEAGCDTPASPSCGACLGGPRDTYARMNEPMVCVSTTNRNFPGRMGHKEGQIYLASPYTAAASALTGYVTDPRDFLM

SEQ ID NO: 509 - DNA, 243 bp, Sorghum bicolor
  misc_feature: Ceres ANNOT ID no. 6007946
  misc_feature: Encodes the peptide sequence at SEQ ID NO 510
atggggagggcggcggcggcggcatcagccggcggcggaggagatgagcagaagacgtcgtggccggaggtggtggggtgggtgacgctgaacgcggcgttcaagatcaacagcgacaggcccgacgtgtcgactgccttctacagtgagaccacaccgctgccgacggactatgaccccaaccgcgtcatcatcgtcgccgacggtggcagcgtcgttgtcaggactccagttatcggctag

SEQ ID NO: 510 - protein, 80 aa, Sorghum bicolor
  misc_feature: Ceres ANNOT ID no. 6007946
  misc_feature (18)..(80): Pfam Id: potato_inhibit Pfam Desc: Potato inhibitor I family
  misc_feature (6)..(80): NCBI GI: 75994171 NCBI Desc: maize protease inhibitor [zea mays subsp. parviglumis]
  misc_feature (6)..(80): NCBI GI: 475253 NCBI Desc: proteinase inhibitor [zea mays]
  misc_feature (6)..(80): NCBI GI: 75994169 NCBI Desc: maize protease inhibitor [zea mays subsp. parviglumis]
  misc_feature (6)..(80): NCBI GI: 75994145 NCBI Desc: maize protease inhibitor [zea mays subsp. parviglumis]
  misc_feature (11)..(80): NCBI GI: 48093414 NCBI Desc: mpi [zea perennis]
MGRAAAAASAGGGGDEQKTSWPEVVGWVTLNAAFKINSDRPDVSTAFYSETTPLPTDYDPNRVIIVADGGSVVVRTPVIG

SEQ ID NO: 511 - DNA, 213 bp, Sorghum bicolor
  misc_feature: Ceres ANNOT ID no. 6007947
  misc_feature: Encodes the peptide sequence at SEQ ID NO 512
atgagcgtgaggatgtcatggccggaggtggttgggtggtcggcagcggatgccaaggctcagatcaagagcgacaggcccgatgtcaccatcgaggtgttgccatggagcacctacgcgccgcccaagtatttcaacaacctccgcgtccgcgtctacgtcgacacctcctacgccggctcacccgtcgtttacgttcccgtcgttggttaa

SEQ ID NO: 512 - protein, 70 aa, Sorghum bicolor
  misc_feature: Ceres ANNOT ID no. 6007947
  misc_feature (4)..(70): Pfam Id: potato_inhibit Pfam Desc: Potato inhibitor I family
  misc_feature (3)..(55): NCBI GI: 75994157 NCBI Desc: maize protease inhibitor [zea mays subsp. parviglumis]
  misc_feature (4)..(64): NCBI GI: 58396949 NCBI Desc: subitilisin-chymotrypsin inhibitor [oryza sativa (japonica cultivar-group)]
  misc_feature (4)..(55): NCBI GI: 75994171 NCBI Desc: maize protease inhibitor [zea mays subsp. parviglumis]
  misc_feature (4)..(55): NCBI GI: 75994143 NCBI Desc: maize protease inhibitor [zea mays subsp. parviglumis]
  misc_feature (4)..(55): NCBI GI: 75994153 NCBI Desc: maize protease inhibitor [zea mays subsp. parviglumis]
MSVRMSWPEVVGWSAADAKAQIKSDRPDVTIEVLPWSTYAPPKYFNNLRVRVYVDTSYAGSPVVYVPVVG

SEQ ID NO: 513 - DNA, 249 bp, Sorghum bicolor
  misc_feature: Ceres ANNOT ID no. 6007949
  misc_feature: Encodes the peptide sequence at SEQ ID NO 514
atgggcagattcctcaccccggccaccaccgccgccgcgaacgacgacggcgacttgaagacgtcatggccagaggtggtggggtgggtgacgctaaatgcgtcgttcaagatcaccgccgaccggcccgacgtgtcgactgccttctacagtgataccaccccgctgccgacggattacaaccccaaacgcgtcatcatcatcttcgactccggcaacgtcgtcgtcagaactcccgttgttggttag

SEQ ID NO: 514 - protein, 82 aa, Sorghum bicolor
  misc_feature: Ceres ANNOT ID no. 6007949
  misc_feature (20)..(82): Pfam Id: potato_inhibit Pfam Desc: Potato inhibitor I family
  misc_feature (15)..(82): NCBI GI: 54610713 NCBI Desc: chymotrypsin inhibitor precursor [lumbricus terrestris]
  misc_feature (20)..(82): NCBI GI: 124121 NCBI Desc: subtilisin inhibitor i (asi-i) [contains: subtilisin inhibitor ii (asi-ii)]
  misc_feature (8)..(82): NCBI GI: 48093418 NCBI Desc: mpi [tripsacum dactyloides]
  misc_feature (8)..(82): NCBI GI: 75994169 NCBI Desc: maize protease inhibitor [zea mays subsp. parviglumis]
  misc_feature (8)..(82): NCBI GI: 75994171 NCBI Desc: maize protease inhibitor [zea mays subsp. parviglumis]
MGRFLTPATTAAANDDGDLKTSWPEVVGWVTLNASFKITADRPDVSTAFYSDTTPLPTDYNPKRVIIIFDSGNVVVRTPVVG

SEQ ID NO: 515 - DNA, 261 bp, Sorghum bicolor
  misc_feature: Ceres ANNOT ID no. 6007950
  misc_feature: Encodes the peptide sequence at SEQ ID NO 516
atgagcagccagaagacgtcgtggccggaggtggtggggtggccagcgactgcggcggtgacgcagatcagcagcgacaggcccgacgtcgccatcgaggtggtccaggtcggcaccaacgtggcgccggggtacaacgccctccgcgtccgtgtctacttcgacgccggcaacgccaccggccccgtcgtttacgttcccgtcgttggaccagaatcatactttctatatttagcagacatgatgacgatcaaggaataa

SEQ ID NO: 516 - protein, 86 aa, Sorghum bicolor
  misc_feature: Ceres ANNOT ID no. 6007950
  misc_feature (5)..(70): Pfam Id: potato_inhibit Pfam Desc: Potato inhibitor I family
  misc_feature (5)..(70): NCBI GI: 124121 NCBI Desc: subtilisin inhibitor i (asi-i) [contains: subtilisin inhibitor ii (asi-ii)]
  misc_feature (5)..(55): NCBI GI: 58396949 NCBI Desc: subitilisin-chymotrypsin inhibitor [oryza sativa (japonica cultivar-group)]
  misc_feature (5)..(55): NCBI GI: 48093402 NCBI Desc: mpi [zea perennis]
  misc_feature (5)..(55): NCBI GI: 48093414 NCBI Desc: mpi [zea perennis]
  misc_feature (5)..(55): NCBI GI: 48093416 NCBI Desc: mpi [zea perennis]
MSSQKTSWPEVVGWPATAAVTQISSDRPDVAIEVVQVGTNVAPGYNALRVRVYFDAGNATGPVVYVPVVGPESYFLYLADMMTIKE

SEQ ID NO: 517 - DNA, 237 bp, Sorghum bicolor
  misc_feature: Ceres ANNOT ID no. 6007952
  misc_feature: Encodes the peptide sequence at SEQ ID NO 518
atggggagggcgatgccggcagccggcggcggagaagatgggcagaagtcgtcgtggccggaggtggtggggtgggtgatgctgaacgcatcggacaagatcaccagagacagaccggacgtgtcgattgcattctacagtcagaccaccacactgccgaccaactacgaccccaaccgcgtcatcatcgtcggcgacaacggcagcgtcgtcgtcaggactcctgtcatcggctag

SEQ ID NO: 518 - protein, 78 aa, Sorghum bicolor
  misc_feature: Ceres ANNOT ID no. 6007952
  misc_feature (16)..(78): Pfam Id: potato_inhibit Pfam Desc: Potato inhibitor I family
  misc_feature (9)..(78): NCBI GI: 75994171 NCBI Desc: maize protease inhibitor [zea mays subsp. parviglumis]
  misc_feature (9)..(78): NCBI GI: 475253 NCBI Desc: proteinase inhibitor [zea mays]
  misc_feature (9)..(78): NCBI GI: 75994169 NCBI Desc: maize protease inhibitor [zea mays subsp. parviglumis]
  misc_feature (6)..(78): NCBI GI: 124127 NCBI Desc: subtilisin-chymotrypsin inhibitor ci-1b
  misc_feature (9)..(78): NCBI GI: 48093414 NCBI Desc: mpi [zea perennis]
MGRAMPAAGGGEDGQKSSWPEVVGWVMLNASDKITRDRPDVSIAFYSQTTTLPTNYDPNRVIIVGDNGSVVVRTPVIG

SEQ ID NO: 519 - DNA, 234 bp, Sorghum bicolor
  misc_feature: Ceres ANNOT ID no. 6007958
  misc_feature: Encodes the peptide sequence at SEQ ID NO 520
atgacgaagacgttcgcgccgccgaaggaccacggggagaagaaggagtcgtggccggaggtgaagggctggccggcgacgcaggcggcgcagacgatcgcccacgagaggcccgacgtggccgtcgaggtgctcccgccggggtcgtacgtgatcccgggctacaacgccaagcgcgtccgcgtccacatcgacgacaacggcaatgtctccgaggtccccgtcatcggctag

SEQ ID NO: 520 - protein, 77 aa, Sorghum bicolor
  misc_feature: Ceres ANNOT ID no. 6007958
  misc_feature (15)..(77): Pfam Id: potato_inhibit Pfam Desc: Potato inhibitor I family
  misc_feature (15)..(77): NCBI GI: 124121 NCBI Desc: subtilisin inhibitor i (asi-i) [contains: subtilisin inhibitor ii (asi-ii)]
  misc_feature (15)..(77): NCBI GI: 603890 NCBI Desc: pathogenesis-related protein pr-6 type [sambucus nigra]
  misc_feature (14)..(77): NCBI GI: 27734408 NCBI Desc: subtilisin inhibitor clsi-i
  misc_feature (13)..(77): NCBI GI: 37359345 NCBI Desc: protease inhibitor [vitis vinifera]
  misc_feature (6)..(77): NCBI GI: 48093418 NCBI Desc: mpi [tripsacum dactyloides]
MTKTFAPPKDHGEKKESWPEVKGWPATQAAQTIAHERPDVAVEVLPPGSYVIPGYNAKRVRVHIDDNGNVSEVPVIG

SEQ ID NO: 521 - DNA, 234 bp, Sorghum bicolor; identical to SEQ ID NO: 519
  misc_feature: Ceres ANNOT ID no. 6007963
  misc_feature: Encodes the peptide sequence at SEQ ID NO 522

SEQ ID NO: 522 - protein, 77 aa, Sorghum bicolor; identical to SEQ ID NO: 520
  misc_feature: Ceres ANNOT ID no. 6007963
  misc_feature (15)..(77): Pfam Id: potato_inhibit Pfam Desc: Potato inhibitor I family
  misc_feature (15)..(77): NCBI GI: 124121 NCBI Desc: subtilisin inhibitor i (asi-i) [contains: subtilisin inhibitor ii (asi-ii)]
  misc_feature (15)..(77): NCBI GI: 603890 NCBI Desc: pathogenesis-related protein pr-6 type [sambucus nigra]
  misc_feature (14)..(77): NCBI GI: 27734408 NCBI Desc: subtilisin inhibitor clsi-i
  misc_feature (13)..(77): NCBI GI: 37359345 NCBI Desc: protease inhibitor [vitis vinifera]
  misc_feature (6)..(77): NCBI GI: 48093418 NCBI Desc: mpi [tripsacum dactyloides]

SEQ ID NO: 523 - DNA, 213 bp, Sorghum bicolor
  misc_feature: Ceres ANNOT ID no. 6007970
  misc_feature: Encodes the peptide sequence at SEQ ID NO 524
atgagcgtgccgattcccgggaaatcgtcatggccggagctggtgggcgtgaatgcgacgctggcggcgacggcgatcgcccatgacaggccggacgtggccgtggaggtgctcccgccgggggcgccggtcatcccagactacaaccccttgcgcgtccgtgtcttcatcgacaacaacaaccttgtctcccaggtccccgtcatcggctag

SEQ ID NO: 524 - protein, 70 aa, Sorghum bicolor
  misc_feature: Ceres ANNOT ID no. 6007970
  misc_feature (8)..(70): Pfam Id: potato_inhibit Pfam Desc: Potato inhibitor I family
  misc_feature (6)..(70): NCBI GI: 124121 NCBI Desc: subtilisin inhibitor i (asi-i) [contains: subtilisin inhibitor ii (asi-ii)]
  misc_feature (1)..(70): NCBI GI: 124007196 NCBI Desc: protease inhibitor hpi (protease inhibitor 1) (hbpi1)
  misc_feature (1)..(70): NCBI GI: 37901103 NCBI Desc: protease inhibitor protein 1 [hevea brasiliensis]
  misc_feature (8)..(70): NCBI GI: 27734408 NCBI Desc: subtilisin inhibitor clsi-i
  misc_feature (1)..(70): NCBI GI: 37359345 NCBI Desc: protease inhibitor [vitis vinifera]
MSVPIPGKSSWPELVGVNATLAATAIAHDRPDVAVEVLPPGAPVIPDYNPLRVRVFIDNNNLVSQVPVIG

SEQ ID NO: 525 - DNA, 1032 bp, Sorghum bicolor
  misc_feature: Ceres ANNOT ID no. 6007980
  misc_feature: Encodes the peptide sequence at SEQ ID NO 526
atggtggcgctcacctccttatcccctgggccaccgcgcccttctccgtctccggcgactcctcgccgccggccgccggcgccgaaacctcatgtctatgcctcgtcacgtcgtcgcgggaggatcctacgcgccgcgactgccgcggccgccacgcctggcgctgacgactaccactccaccatccgctccctcaactcccgcggccgccacgtcccccgaaaatccctcgggcagaactacatgctcaactccaaggtgaacgaggagctggtggcggcggccggggtggaggagggggacgtcgtgctcgagatcggcccgggcaccggctcgctcaccgccgcgctgctacaggcgggcgctaccgtcttcgccgtcgagaaggacaagcatatggctaccctcgttaaagataggtttggatctacagaacagttgaaggtcatcgaggaagacatcacaaaatttcacatccgttcccattttcttcctttcatgaaggagaaataccatgccaccaaaaaacttgcaaaggttgtatcaaacttaccattcaatgtcagctccgaagttgtcaaactactactcccaatgggggatgttttctctgtcgtggtgcttatgcttcaggatgaaacagcggtacgccttgctgatgcttcaatacaaattccggagtaccgacctatcaacgtgtttgtgaatttctactcaaaacctgaatacaagttcagagtggacagagagaattttttccctcggccaaaggttaatggtgctgttatcagcttcaaactaaagaatgcggaggagtatccgccagttagttcccccaaaagcttcttttcaatggtgaattctgctttcatggggaagcgcaagatgcttagaaaatctcttcaacatctatgctcttcttctgagatcgaggctgctcttgacaacattggtcttccagttacagctagaccttctgatctaattttggatgatttcgtgagattgcacaaccatttgacgaaagtatga

SEQ ID NO: 526 - protein, 343 aa, Sorghum bicolor
  misc_feature: Ceres ANNOT ID no. 6007980
  misc_feature (70)..(342): Pfam Id: RrnaAD Pfam Desc: Ribosomal RNA adenine dimethylase
  misc_feature (11)..(342): NCBI GI: 124360236 NCBI Desc: sam (and some other nucleotide) binding motif [medicago truncatula]
  misc_feature (44)..(239): NCBI GI: 8570453 NCBI Desc: identical to dimethyladenosine transferase (pfc1) from arabidopsis thaliana gbaf051326 and contains a ribosomal rna adenine dimethylases pf00398 domain. this gene may be cut off
  misc_feature (147)..(285): NCBI GI: 115443901 NCBI Desc: os02g0122900 [oryza sativa (japonica cultivar-group)]
  misc_feature (65)..(340): NCBI GI: 62900537 NCBI Desc: dimethyladenosine transferase (s-adenosylmethionine-6-n', n'-adenosyl(rrna) dimethyltransferase) (16s rrna dimethylase) (high level
  misc_feature (65)..(340): NCBI GI: 62900537 (continued) kasugamycin resistance protein ksga) (kasugamycin dimethyltransferase)
  misc_feature (73)..(340): NCBI GI: 33236942 NCBI Desc: dimethyladenosine transferase [chlamydophila pneumoniae tw-183]
MVALTSLSPGPPRPSPSPATPRRRPPAPKPHVYASSRRRGRILRAATAAAATPGADDYHSTIRSLNSRGRHVPRKSLGQNYMLNSKVNEELVAAAGVEEGDVVLEIGPGTGSLTAALLQAGATVFAVEKDKHMATLVKDRFGSTEQLKVIEEDITKFHIRSHFLPFMKEKYHATKKLAKVVSNLPFNVSSEVVKLLLPMGDVFSVVVLMLQDETAVRLADASIQIPEYRPINVFVNFYSKPEYKFRVDRENFFPRPKVNGAVISFKLKNAEEYPPVSSPKSFFSMVNSAFMGKRKMLRKSLQHLCSSSEIEAALDNIGLPVTARPSDLILDDFVRLHNHLTKV

SEQ ID NO: 527 - DNA, 1653 bp, Sorghum bicolor
  misc_feature: Ceres ANNOT ID no. 6007997
  misc_feature: Encodes the peptide sequence at SEQ ID NO 528
  misc_feature: Down-regulated in root tissues in response to methyl jasmonate treatment
atggttgctgcacctgcgcgcatcatcttctccttctcctctgtggagcctcttctcattgcagcttcgccggcagcagctagaaacagccggcaaggccgccaccgtggccaattcatccgccctttggcggcatccaacactctgctgggcaatgattttgatctccaggagggcctgacggacgtccaaaagattcttcatcaacgtcaaaagagcaaccgggagatgatggtcaccatcgataacctcaagcgcctctgcgtcgaccactacttcgaagaagagatcgagagcgccatgagtgcttgcatgaatctcgtccacagcaatgatctcttcgatgcaacccttgcattcaggctcctgagagaggcaggctatgatgtttcagcaaaagatgatgttttatggaggttcactgacaacagcggcgaattcaagcttcctcttagcaaggacatccgagggctcctaagcctgcatgacatgtctcacatgaacattggaggagaggcattgctcgacaaggcaaaagagttctcaagcaagcaccttgcatctgccattaggtacctggagccaagccttgcagagtatgtgaggcagtccctggaccacccttaccacctgagcgtgatgccgtacaaagctaggcatcacctcacctacctgcagagcctgcccaccagagacacggcggtggagaaactagcaattgcagagtttcagctcaacaaattgctgcatcagaaagaaatgcaagagattaaaagatggtggatggacctaggattggctcaagaaatacctgtggtgcgggaccaggtgctgaaatggtacatgtggtccatgacagccctccaaggatattctttctccagatatcgggttgagatgacaaagataatctcgcttgtctatgttgtggacgacatatttgaccttgttggcacactagaggagctctctctcttcactgaagctgtcaaaatgtggaatactgcggctgctgattcactccctagttacatgagatcatgctacaaggctctttacaccattacaaatgagattgcagatatggctgaaaaggagcatggattgaacccagctaataatcttagaaaagcatggacggtgttgtttgatggatttatggttgaggcaaaatggctagcaaaccatcaggttcctactgcagaggattacctgagaaatggtgttgtcacgtcaggagtgccgcttacatttgtacacatattcattatgctagggtgtgatcaaaatagtgaagcactcattgaccacatgccctctgtcatctcttgcccagccaagattctccgactttgggatgacatgggcagtgcagaggatgaatctcaggaaggattcgatggatcgtataaaaatttctacctcatggagaaccctagatgcagccctactgatgcggaagcacatatgcgtagcttgatcgcaagggagtgggaggagctcaatagggagtgtttatgcacgaggaccttctcctctaacttcacacaggtctgcttgaacatcgcgagaatggtcagtgtcatgtactcgtacaacaaggaacaaaggcttcttgtccttgaggactatgcaagaatgttgatactttga

SEQ ID NO: 528 - protein, 550 aa, Sorghum bicolor
  misc_feature: Ceres ANNOT ID no. 6007997
  misc_feature (234)..(502): Pfam Id: Terpene_synth_C Pfam Desc: Terpene synthase family, metal binding domain
  misc_feature (50)..(229): Pfam Id: Terpene_synth Pfam Desc: Terpene synthase, N-terminal domain
  misc_feature (1)..(550): NCBI GI: 62754282 NCBI Desc: terpene synthase 2 [zea mays]
  misc_feature (1)..(550): NCBI GI: 62754284 NCBI Desc: terpene synthase 3 [zea mays]
  misc_feature (58)..(547): NCBI GI: 115482650 NCBI Desc: os10g0489500 [oryza sativa (japonica cultivar-group)]
  misc_feature (63)..(549): NCBI GI: 42562865 NCBI Desc: terpene synthase/cyclase family protein [arabidopsis thaliana]
  misc_feature (4)..(549): NCBI GI: 29468398 NCBI Desc: linalool synthase [arabidopsis thaliana]
  misc_feature: Down-regulated in root tissues in response to methyl jasmonate treatment
MVAAPARIIFSFSSVEPLLIAASPAAARNSRQGRHRGQFIRPLAASNTLLGNDFDLQEGLTDVQKILHQRQKSNREMMVTIDNLKRLCVDHYFEEEIESAMSACMNLVHSNDLFDATLAFRLLREAGYDVSAKDDVLWRFTDNSGEFKLPLSKDIRGLLSLHDMSHMNIGGEALLDKAKEFSSKHLASAIRYLEPSLAEYVRQSLDHPYHLSVMPYKARHHLTYLQSLPTRDTAVEKLAIAEFQLNKLLHQKEMQEIKRWWMDLGLAQEIPVVRDQVLKWYMWSMTALQGYSFSRYRVEMTKIISLVYVVDDIFDLVGTLEELSLFTEAVKMWNTAAADSLPSYMRSCYKALYTITNEIADMAEKEHGLNPANNLRKAWTVLFDGFMVEAKWLANHQVPTAEDYLRNGVVTSGVPLTFVHIFIMLGCDQNSEALIDHMPSVISCPAKILRLWDDMGSAEDESQEGFDGSYKNFYLMENPRCSPTDAEAHMRSLIAREWEELNRECLCTRTFSSNFTQVCLNIARMVSVMYSYNKEQRLLVLEDYARMLIL

SEQ ID NO: 529 - DNA, 1662 bp, Sorghum bicolor
  misc_feature: Ceres ANNOT ID no. 6008001
  misc_feature: Encodes the peptide sequence at SEQ ID NO 530
atgtctgctgcaccggcacgcatcttctccttctcctccgtggagcctcttctccttgcagcttcgccggcggcagctagaaacaacagccggcaaggccgccaccgtggcgattccatccgcccttcttcggctgcagcggccaacacgctgctgctgcgtaatgacatcgacctccaggagggattgacagacatccaaaagattctgcatcaacgtcagaagaatgcccgggagatgatgatcaccatcgataacctcaagcgcctctgcatcgaccactactttgaggaagagatcgagagcgccatgagcagcacatgcatggatctcatccacagcgatgatctcttcgatgcaacacttgcattcaggctcctgagagaggccggccatgatgtttcagcaaatgatgttttacggaggttcactgatgacagtggtgaattcaagcttcctcttagcatggatatcagagggctcttgagcctgcatgacatgtctcacctggacattggaggcgaggtgttgctctacaaggcaaaagagttctcaagcaagcaccttgcatctgccattaggtacttggagccaagccttgcagagtatgtgagacagtctctggaccacccctaccatctaagcctaatgcagtacaaagctaggcatcacctcacctatctacagagcatgcccattagagacactgtagtggagaaactagcagttgcagagtttcagctcaataaattactgcatcagcaagaaattcaagaggttaaaagatggtggatggacctaggattggttcaagaaatacctgtggtgcgggaccaggtgatgaaatggtacatgtggtccatgacagcagtccaaggatgttcgttctccagataccgggttgagatcacaaaaataatcgcgcttgtctatgttgtggatgacatatttgaccttgttggcacattagaagagttgtcccttttcacggaggccgtcaaagtgtggaatatggcggctgctgattcactccccagatgcatgaggtcatgctacatggctctttacacggttacaaatgagatcacagatatggtcgaaaaggagcatggattgaaccatgttaatcatcttagaaaagcatgggcagtgttgtttgatggattcatggttgaggcgaagtggctagcaactgagcaggttccaactgcagaggactacctgagaaatggtgttgtcacatcaggagtgccgcttacatttgtacacatattcatcatgctagggtatgatcaaagtatcgaagcacttattgaccagatgccctctgtcatctcttgcccagccaagatcctccggctttgggatgacatgggtagtgcaaaggatgaagctcaagaaggattagatggttcatatatggacttctatctcatggagaaccctagatgtggccctagtgatgttgaagcacatatgcgaaacttgatcgcaagggagtgggaggagctgaatagggagtgtttatgcaagaggacattctcctctaacttgacacaaacttgcttgaacgccgcgagaatgatcagtgtcatgtactcatacaacaaggaacagaggcttcttgtccttgaggactatgcaaggatgttgatactttga

SEQ ID NO: 530 - protein, 553 aa, Sorghum bicolor
  misc_feature: Ceres ANNOT ID no. 6008001
  misc_feature (237)..(505): Pfam Id: Terpene_synth_C Pfam Desc: Terpene synthase family, metal binding domain
  misc_feature (48)..(232): Pfam Id: Terpene_synth Pfam Desc: Terpene synthase, N-terminal domain
  misc_feature (1)..(553): NCBI GI: 62754282 NCBI Desc: terpene synthase 2 [zea mays]
  misc_feature (1)..(553): NCBI GI: 62754284 NCBI Desc: terpene synthase 3 [zea mays]
  misc_feature (61)..(550): NCBI GI: 115482650 NCBI Desc: os10g0489500 [oryza sativa (japonica cultivar-group)]
  misc_feature (1)..(552): NCBI GI: 42562865 NCBI Desc: terpene synthase/cyclase family protein [arabidopsis thaliana]
  misc_feature (39)..(552): NCBI GI: 144923857 NCBI Desc: terpene synthase-like; terpenoid synthase [medicago truncatula]
MSAAPARIFSFSSVEPLLLAASPAAARNNSRQGRHRGDSIRPSSAAAANTLLLRNDIDLQEGLTDIQKILHQRQKNAREMMITIDNLKRLCIDHYFEEEIESAMSSTCMDLIHSDDLFDATLAFRLLREAGHDVSANDVLRRFTDDSGEFKLPLSMDIRGLLSLHDMSHLDIGGEVLLYKAKEFSSKHLASAIRYLEPSLAEYVRQSLDHPYHLSLMQYKARHHLTYLQSMPIRDTVVEKLAVAEFQLNKLLHQQEIQEVKRWWMDLGLVQEIPVVRDQVMKWYMWSMTAVQGCSFSRYRVEITKIIALVYVVDDIFDLVGTLEELSLFTEAVKVWNMAAADSLPRCMRSCYMALYTVTNEITDMVEKEHGLNHVNHLRKAWAVLFDGFMVEAKWLATEQVPTAEDYLRNGVVTSGVPLTFVHIFIMLGYDQSIEALIDQMPSVISCPAKILRLWDDMGSAKDEAQEGLDGSYMDFYLMENPRCGPSDVEAHMRNLIAREWEELNRECLCKRTFSSNLTQTCLNAARMISVMYSYNKEQRLLVLEDYARMLIL

SEQ ID NO: 531 - DNA, 1407 bp, Sorghum bicolor
  misc_feature: Ceres ANNOT ID no. 6008013
  misc_feature: Encodes the peptide sequence at SEQ ID NO 532
atgggcggcgggcggaagcggcggcggcgcggcggctcggatgctccgtcgatgcacccgcggaaccgctacgccgccgccgcgccggacttcgccgcgctggcggagctctacccgtccttccgccccttcgtctccgtctccgaccgcggccgcgcgtccgtcgacttcaccgatttctccgccactcgggagctcacgcgtgtactcctcctccatgaccatggcgtcaactggtggattccagatggacagctctgccctactgttccaaacaggtccaactacattcactggatcgaggatcttctctcctcagatctgataccaccaatatccagctcaagtgagagagtgaagggctttgacattggaacaggtgccaattgcatctaccctctccttggagcatctttactgggatggacctttgttggatctgatgtcactaatgttgctcttgaatgggctcagaagaatgtggagagcaatccacgcctagcagaactaattgaaatcagaaatgcaaatgcaccgtcctctgagtctgaatctgttgtcagggaagcagcaagggagaagattttagagcctgcggaggatgtagctatgccaaagccacatatccttgttggtgttgtaaaggagagtgagagctttgacttctgtatgtgcaatcctccattctttgagagcatagaggaagctggtcttaacccaaaaacatcgtgcggtgggacagctgaagagatggtttgccctggtggcgagctggcatttgttacacaaatcattgaagatagtgtttcccttaagaactctttcagatggtttacatcgatgatcggcagaaaggcaaacttaaagttattgatctcaaaggttcgtgaggctggggcctcagtcgtgaaaactactgaatttgtacaagggcagacagctagatggggccttgcttggtcattcattgctccaagaccaagaaaaatggtcctcagctccactgctccagcaaaaaaccaccattcctttatgcttcagggccttcggcgtgaacatggcgcgttccaagttctgaaatcaactgaggctttctttctagcttctaatctatcatgcaaaactgatccgttatcctttgcggttgatgtcacattgtctgatgagcagattgaggctgcaatattgcatggggatgattatgccggttctctagaagacagctctgcaaagttacaaagtgttgtcaaaggaatatcatttcgtattacagtgtttgaacaaattcctgggaccctcctaatcaaaggctcatcattgaataaagcattgtcaggtaccttctcatcattattctctcagttggaggacgcgttaaggatggaatgtctcagtaaggcacgatag

SEQ ID NO: 532 - protein, 468 aa, Sorghum bicolor
  misc_feature: Ceres ANNOT ID no. 6008013
  misc_feature (12)..(324): Pfam Id: Methyltransf_10 Pfam Desc: Protein of unknown function (DUF890)
  misc_feature (1)..(468): NCBI GI: 41052744 NCBI Desc: sam-dependent methyltransferase-like protein [oryza sativa (japonica cultivar-group)]
  misc_feature (17)..(207): NCBI GI: 49257234 NCBI Desc: mgc81116 protein [xenopus laevis]
  misc_feature (17)..(173): NCBI GI: 50417838 NCBI Desc: zgc:100981 protein [danio rerio]
  misc_feature (17)..(249): NCBI GI: 56205950 NCBI Desc: novel protein [mus musculus]
  misc_feature (56)..(175): NCBI GI: 28829833 NCBI Desc: similar to zk1128.2.p [caenorhabditis elegans] [dictyostelium discoideum]
MGGGRKRRRRGGSDAPSMHPRNRYAAAAPDFAALAELYPSFRPFVSVSDRGRASVDFTDFSATRELTRVLLLHDHGVNWWIPDGQLCPTVPNRSNYIHWIEDLLSSDLIPPISSSSERVKGFDIGTGANCIYPLLGASLLGWTFVGSDVTNVALEWAQKNVESNPRLAELIEIRNANAPSSESESVVREAAREKILEPAEDVAMPKPHILVGVVKESESFDFCMCNPPFFESIEEAGLNPKTSCGGTAEEMVCPGGELAFVTQIIEDSVSLKNSFRWFTSMIGRKANLKLLISKVREAGASVVKTTEFVQGQTARWGLAWSFIAPRPRKMVLSSTAPAKNHHSFMLQGLRREHGAFQVLKSTEAFFLASNLSCKTDPLSFAVDVTLSDEQIEAAILHGDDYAGSLEDSSAKLQSVVKGISFRITVFEQIPGTLLIKGSSLNKALSGTFSSLFSQLEDALRMECLSKAR

SEQ ID NO: 533 - DNA, 1716 bp, Sorghum bicolor
  misc_feature: Ceres ANNOT ID no. 6008017
  misc_feature: Encodes the peptide sequence at SEQ ID NO 534
atggcggcgagcgcgctgctgacggggtcgccgtggctgcgcatgcgcctcctcccggacgcgcccgcgagccccttccgccacctccacctccgccgggccctctccgtccgcgcctccgccgccggcaccggcaccggcaccgacggcagctccggccccgtacgcgtccgcttcgcgccgtcgcccaccggcaacctccacgtcggcggcgcccgcaccgcgctcttcaactacctcttcgcgcgctccaaggggggacgcttcgtgctccgcgtcgaggacaccgacctcgagcgctccaccaggaagtctgaggaggccgtcctcgccgacctcgcctggctcggcctcgaatgggacgaaggtcctgatgtcggtggggagtttgggccttatcgccagtcagagcggaattcactatacaagcaatatgctgagaagcttttggactctggtgcggtttatcgctgcttttgctccaatgaggaacttgaacaaatgaaggaagtcgcaaagcagagacaacttcctcctgtgtatatggggaagtgggcaagtgcctcagatgtagaagtacagcaggaattagagaaagggacaccttacacttaccgcttccgtgtgccaaaggaagggtcattgaaaattaatgacttaattcgtggtgaggtcagttggaacttagacacacttggtgatttcgtgattatgagaagcaatggacagcctgtgtataacttctgtgtgacagttgacgatgctaccatgcaaatatctcatgttatcagagctgaagagcatttaccaaacacattgcggcaagctctaatttacaaagctcttggattctcaatgccttcatttgctcatgtttcacttattctggctcctgacagaagtaaactgtctaaacggcatggagctacttctgtcgggcagtataaagagatgggctatctacctcaggcaatggtgaattatttagcactactgggctggggtgatggtactgaaaatgagttcttcactattgataacctagtccagaaattcactataaatcgtgtcaataaaagtggagcagtctttgatgcaacaaaattgaaatggatgaatggacaacatttaagatcatttcctcatgatgaactcatcaaggcttttgaagatcggtggaagaacacaggcattctccaggaatctgaaagtggttttgctcaggaagctgccgagcttttgaaggatggtattgatttgataacagatgctgatgcagctcttacaaatttgttgtcgtatccccttcatactactttaagcagtgaggaagctaaacctgtggtgcaagacaagatttctgaggttgctttgagtcttattactgcgtatgatagcggtgaactcactcaagcactagccgagggccgtgatggttggcagaagtgggttaaaggttttggaaagtctatcaaaagaaagggcaaagggctcttcatgccgctccgagtactgttgaccgggaagcttcatgggcctgacatgggcggcagcatagccctaatacacaaagccggcatctgcggtgctgtgacttcacagtccaactttgtgactctagatgagcggttcaggatcctcaaggaggttgactgggagtcgttggcgaaggagcaagaaacccctgctgaatctgctgttcctgccgcttcatag

SEQ ID NO: 534 - protein, 571 aa, Sorghum bicolor
  misc_feature: Ceres ANNOT ID no. 6008017
  misc_feature (54)..(371): Pfam Id: tRNA-synt_1c Pfam Desc: tRNA synthetases class I (E and Q), catalytic domain
  misc_feature (1)..(571): NCBI GI: 2500980 NCBI Desc: glutamyl-trna synthetase (glutamate--trna ligase) (glurs)
  misc_feature (1)..(571): NCBI GI: 603849 NCBI Desc: glutamate--trna ligase [hordeum vulgare subsp. vulgare]
  misc_feature (4)..(571): NCBI GI: 10176953 NCBI Desc: glutamate-trna ligase [arabidopsis thaliana]
  misc_feature (4)..(571): NCBI GI: 21387183 NCBI Desc: glutamate-trna ligase [arabidopsis thaliana]
  misc_feature (5)..(558): NCBI GI: 603867 NCBI Desc: glutamate--trna ligase [nicotiana tabacum]
  misc_feature (1)..(571): SWISSPROT Homolog: EC 6.1.1.17 Glutamyl-tRNA synthetase
MAASALLTGSPWLRMRLLPDAPASPFRHLHLRRALSVRASAAGTGTGTDGSSGPVRVRFAPSPTGNLHVGGARTALFNYLFARSKGGRFVLRVEDTDLERSTRKSEEAVLADLAWLGLEWDEGPDVGGEFGPYRQSERNSLYKQYAEKLLDSGAVYRCFCSNEELEQMKEVAKQRQLPPVYMGKWASASDVEVQQELEKGTPYTYRFRVPKEGSLKINDLIRGEVSWNLDTLGDFVIMRSNGQPVYNFCVTVDDATMQISHVIRAEEHLPNTLRQALIYKALGFSMPSFAHVSLILAPDRSKLSKRHGATSVGQYKEMGYLPQAMVNYLALLGWGDGTENEFFTIDNLVQKFTINRVNKSGAVFDATKLKWMNGQHLRSFPHDELIKAFEDRWKNTGILQESESGFAQEAAELLKDGIDLITDADAALTNLLSYPLHTTLSSEEAKPVVQDKISEVALSLITAYDSGELTQALAEGRDGWQKWVKGFGKSIKRKGKGLFMPLRVLLTGKLHGPDMGGSIALIHKAGICGAVTSQSNFVTLDERFRILKEVDWESLAKEQETPAESAVPAAS

SEQ ID NO: 535 - DNA, 1107 bp, Sorghum bicolor
  misc_feature: Ceres ANNOT ID no. 6008018
  misc_feature: Encodes the peptide sequence at SEQ ID NO 536
atggcgtcctccatactctccgactgctcctcggcccgcctcctccctctccgccgcgcgctcctccctccggcgcccggcctccgcccctgccccgctctagctcaccccaggcgcctcctcgtcgccgcccggccccagctgctcccgcgcccgcgacgcatggactcggtccccgccgccaccgcctcgtccgccgactcagcgaccgtttcagccgatgcacttgccaaagtgattgacgggaagcttgtggcgaagcaagtgagagaagaaatagctgtcgaggttaccaggatgaaggatgcaatcggcatagtgcctggcctggctgtcatccttgtcgggtcgaggaaggattcacagacttacgtgcggaacaagaagaaggcgtgcgaagcagtcggtataaagtcgtatgaggtcaacttgcctgaggacagctccgaggaggaggttatcaagcacatagcgagcttcaacagtgacccgtccgtgcatggcatcttggttcagttgcccttacctcgtcatatgaacgatgagaatattttgaatgctgtcagtattgaaaaggatgttgatggctttcatccactgaacattggacgactcgcaatgcaaggtcgagatccattctttgtaccttgcaccccaaaaggatgcatggagttgctacaccgatatggagttgaaattaaagggaagagagctgttgtaatcggaagaagcaatattgttggaatgcctgctgcattgttattgcaaaaagcaaatgcaactgtcagcattgtacattcacaaactaagaaccctgaggaaataacacgacaggcagatatagtcatcgcagcagttggagttgccaacttggtcagagggaattggataaaacctggagcagctattattgatgttggtatcaacccagttgatgacccagaaagccctcggggttataggctcgtcggagatgtttgttatgaggaagcctccaaggttgccggagcaatcacaccagttccaggaggtgttgggccgatgacaattgcaatgcttttgtcaaacacacttgagtcagctaaaagaatccacaaattcaaataa

SEQ ID NO: 536 - protein, 368 aa, Sorghum bicolor
  misc_feature: Ceres ANNOT ID no. 6008018
  misc_feature (198)..(365): Pfam Id: THF_DHG_CYH_C Pfam Desc: Tetrahydrofolate dehydrogenase/cyclohydrolase, NAD(P)-bindingdomain
  misc_feature (78)..(195): Pfam Id: THF_DHG_CYH Pfam Desc: Tetrahydrofolate dehydrogenase/cyclohydrolase, catalyticdomain
  misc_feature (1)..(368): NCBI GI: 115443867 NCBI Desc: os02g0120900 [oryza sativa (japonica cultivar-group)]
  misc_feature (57)..(368): NCBI GI: 87162643 NCBI Desc: tetrahydrofolate dehydrogenase/cyclohydrolase [medicago truncatula]
  misc_feature (76)..(363): NCBI GI: 6002383 NCBI Desc: 5,10-methylenetetrahydrofolate dehydrogenase: 5,10-methenyltetrahydrofolate cyclohydrolase [pisum sativum]
  misc_feature (79)..(364): NCBI GI: 3786006 NCBI Desc: methylenetetrahydrofolate dehydrogenase [arabidopsis thaliana]
  misc_feature (52)..(362): NCBI GI: 48716904 NCBI Desc: methylenetetrahydrofolate dehydrogenase-like [oryza sativa (japonica cultivar-group)]
MASSILSDCSSARLLPLRRALLPPAPGLRPCPALAHPRRLLVAARPQLLPRPRRMDSVPAATASSADSATVSADALAKVIDGKLVAKQVREEIAVEVTRMKDAIGIVPGLAVILVGSRKDSQTYVRNKKKACEAVGIKSYEVNLPEDSSEEEVIKHIASFNSDPSVHGILVQLPLPRHMNDENILNAVSIEKDVDGFHPLNIGRLAMQGRDPFFVPCTPKGCMELLHRYGVEIKGKRAVVIGRSNIVGMPAALLLQKANATVSIVHSQTKNPEEITRQADIVIAAVGVANLVRGNWIKPGAAIIDVGINPVDDPESPRGYRLVGDVCYEEASKVAGAITPVPGGVGPMTIAMLLSNTLESAKRIHKFK

SEQ ID NO: 537 - DNA, 1245 bp, Sorghum bicolor
  misc_feature: Ceres ANNOT ID no. 6008026
  misc_feature: Encodes the peptide sequence at SEQ ID NO 538
atgctgcagtgcatcttcctcctctccgattccggggaggtgatggtggagaagcagatggcggcgcaccgcgtggaccgcgccatctgcgcctggttctgggactacgtcgccgcccacgccgccggcgacccttccaaagttgtggtgtcaccaacgcattacttgtttcaaatctatcgtgatggtgtaacgttcttggcgtgcacccaagtggagatggccccactgatggctgtcgagtttctctctcgcgtggccgatgtcttgacagattatcttggagatctgaatgaagatataatcaaggacaactttgtaattgtatatcagattttagatgagatgatggataatggttttccactcactactgagccaaacatcttgaaagagatgattgccccacctaatattgtgaacaaaatgctgaatgttgttactggtaagagttctacacttggcagcaaacttccagatgcagctgcttcttttgtaccttggcgatcaacaatagtcaaggatgcaagcaatgaagtctatgttaacatagttgaggaacttgatgcatgtgtaaacagagaggggggtctagtgaaatgtgaagcatatggtgaagttcaagtaaactgcagcctcccaggtgtgccagagttgaccatgtcatttgccaaccctacaattatcaatgatgttactttccacccctgtgttcgattcaggccttgggaatcaagtcaggttctatcatttgttcctcccgatgggcagttcaagctcatgagttacagggttaagaaattgaagaagacaccaatttatgtgaaacctcaattaacatcagattctgggaattgccgtgttagtgtaatggttgggattcgaaatgatcctgggaaacctatcgattcaataacagtgcagtttcagctgccccctcttattgtttctgctgatttgactgcaaactatggtacagttgacatccttgctgacaagacctgtctttggacaattgggcagataccaaaagataaagcaccagcgctctctggaaatttacgtctagaggaaggactcacgcagttgcatacattgccaacatttcaggtgaaattcaagattatgggagttgccctgtctggtcttcaaattgataagctggatgtgaaaaacacaccgaacgctccatataaaggtttcagagcccaaactcaagctggaaagtatgaggtcagatcttag

SEQ ID NO: 538 - protein, 414 aa, Sorghum bicolor
  misc_feature: Ceres ANNOT ID no. 6008026
  misc_feature (166)..(414): Pfam Id: Adap_comp_sub Pfam Desc: Adaptor complexes medium subunit family
  misc_feature (1)..(413): NCBI GI: 42562792 NCBI Desc: clathrin adaptor complexes medium subunit family protein [arabidopsis thaliana]
  misc_feature (1)..(414): NCBI GI: 5803000 NCBI Desc: adaptor-related protein complex 3, mu 2 subunit [homo sapiens]
  misc_feature (1)..(414): NCBI GI: 62860224 NCBI Desc: loc549404 [xenopus tropicalis]
  misc_feature (1)..(414): NCBI GI: 37150783 NCBI Desc: adaptor protein complex 3 mu3a [cricetulus griseus]
  misc_feature (1)..(414): NCBI GI: 46370095 NCBI Desc: adaptor-related protein complex 3, mu 1 subunit [homo sapiens]
MLQCIFLLSDSGEVMVEKQMAAHRVDRAICAWFWDYVAAHAAGDPSKVVVSPTHYLFQIYRDGVTFLACTQVEMAPLMAVEFLSRVADVLTDYLGDLNEDIIKDNFVIVYQILDEMMDNGFPLTTEPNILKEMIAPPNIVNKMLNVVTGKSSTLGSKLPDAAASFVPWRSTIVKDASNEVYVNIVEELDACVNREGGLVKCEAYGEVQVNCSLPGVPELTMSFANPTIINDVTFHPCVRFRPWESSQVLSFVPPDGQFKLMSYRVKKLKKTPIYVKPQLTSDSGNCRVSVMVGIRNDPGKPIDSITVQFQLPPLIVSADLTANYGTVDILADKTCLWTIGQIPKDKAPALSGNLRLEEGLTQLHTLPTFQVKFKIMGVALSGLQIDKLDVKNTPNAPYKGFRAQTQAGKYEVRS

SEQ ID NO: 539 - DNA, 657 bp, Sorghum bicolor
  misc_feature: Ceres ANNOT ID no. 6008028
  misc_feature: Encodes the peptide sequence at SEQ ID NO 540
atggaaggcggcggcggcggcggtgaccgggccgctgccacgcccacgcgtatgaccaccgtatcgcggcactacttcggaggcagtgcgtccgagcgccaccacgacctccgggtcgacatcatcgagaacatcgaagaggactacggcatgtttgtctggccatgcagtgtcattcttgcagagtatgtctggcagcagagatcacggttctctgcttccagagttgttgagcttggtgcgggaacctcactgccgggattagtagctgcaaaggttggagcagatgtaacactaacagacattgcacagaatacagaagtttcaggacttacatggggagactgggatgaaacggtatttgatttacgtcctgacattattcttggagctgatgtactttatgactcatcaaattttgatgatctgttcgccacggtgacctttcttctcgaaaattcttctggggcggttttcataaccacataccacaaccgcagtggtcatcatctgattgagtttttgatggtcaagtggggcttgaagtgtttgaaactcctggatggtttctccttcctcccaccatgcaaggctgcttcacttcaggggaatattcagcttgttgaaatcacgcttgacaaggaaaaacataaatga

SEQ ID NO: 540 - protein, 218 aa, Sorghum bicolor
  misc_feature: Ceres ANNOT ID no. 6008028
  misc_feature (108)..(215): NCBI GI: 49522942 NCBI Desc: mgc84354 protein [xenopus laevis]
  misc_feature (1)..(101): NCBI GI: 21357923 NCBI Desc: cg5013-pa [drosophila melanogaster]
  misc_feature (1)..(101): NCBI GI: 125777752 NCBI Desc: ga18595-pa [drosophila pseudoobscura]
  misc_feature (104)..(210): NCBI GI: 116116620 NCBI Desc: ensangp00000013956 [anopheles gambiae str. pest]
  misc_feature (37)..(104): NCBI GI: 31980786 NCBI Desc: riken cdna 1110005a03 [mus musculus]
MEGGGGGGDRAAATPTRMTTVSRHYFGGSASERHHDLRVDIIENIEEDYGMFVWPCSVILAEYVWQQRSRFSASRVVELGAGTSLPGLVAAKVGADVTLTDIAQNTEVSGLTWGDWDETVFDLRPDIILGADVLYDSSNFDDLFATVTFLLENSSGAVFITTYHNRSGHHLIEFLMVKWGLKCLKLLDGFSFLPPCKAASLQGNIQLVEITLDKEKHK

SEQ ID NO: 541 - DNA, 1428 bp, Sorghum bicolor
  misc_feature: Ceres ANNOT ID no. 6008033
  misc_feature: Encodes the peptide sequence at SEQ ID NO 542
atgccagcggtggcgtccatcccggcgccgccggcggctgcccagcggcggaggttctcccccgtggcctcggcctctctgcgccgggtcgcgtcgggcgggggttccagctggcggagcgagcggcggctcatgtcggagctggaacgcacggtgacggcgggcgcggccgagcgcgtcatccgcagctacgtcggcaccaagtcggagcgcgccgcgctcgccgcgctctccaggctcctcatggactccgaccccctcgccatcccgttctatgaggcagtcacacaggcccggtggttcaaatggagctcaatccatgctgctgcagttgccgcgttgcttgaaggcaatggaagcaccggagaatcaaggacccttatctctgactccatctcgcagcatctccagtccaccaatgaggtagctctcttctactgcgacctcatggcggctttctcctctcgcgggctgaaggaccgggcaatggatttctacacagagctacggtccatgccactctctgggcgcaagacctacatggccatgataaagtccttgtgcctgatgggtctgccctcagaggctgagaaaacacttagggagatggtttctctggggtaccagcctgaggcattccagtttgggtcagtcgcgaaatgctatgggaagtctggctccctggttgacatggagagggttattacgtccatggctgatgccggcatccgcttcggcactggtgcagcagacactgtgctttcatgctacagctcctgccgtgatcactccaagatgctggcatggttaaagaagatgcggaaattgcgtatcgcgccaactacgaaaggctacaactttgtgctgaactcatgttcctcactcgcttcggtggttcaagagcttgatccttcacttccactgtcaacgactgggttggtcaagaggctcaggtctatatctacaccggcagcagaagtcgagctggtgcaagaactcctggcctcctcgtcggtgcttgacaaggcgatggagtggtcagaaacagaggtgaagctgaatctgcacggattcagtacagtttcagcctatgtactgatgctgcaatgggtggatgcggtaaagggtcgcgaattgccattggaggtgtcagtggtgtgtggcattggaaaacatagtgatgtccgaggtgagcctaaagtgcgtgaactggcacaggaggtactgagccggatggggagccccctacagctgtctacaaggaacaaagggcggcttgtggcaaagcgagacagggtgaagcagtggctggccagctttcccgtgcctgaggagggaacagatcaatggcctgatgcaacaagccaacaaccgtatgtatttacacttttcagaaaacttggacaatttttttccaacctggtctag

SEQ ID NO: 542 - protein, 475 aa, Sorghum bicolor
  misc_feature: Ceres ANNOT ID no. 6008033
  misc_feature (178)..(212): Pfam Id: PPR Pfam Desc: PPR repeat
  misc_feature (39)..(441): NCBI GI: 51477396 NCBI Desc: pentatricopeptide (ppr) repeat protein-like [cucumis melo]
  misc_feature (17)..(291): NCBI GI: 115450301 NCBI Desc: os03g0115300 [oryza sativa (japonica cultivar-group)]
  misc_feature (103)..(439): NCBI GI: 9755886 NCBI Desc: 67kd chloroplastic rna-binding protein, p67.1 [raphanus sativus]
  misc_feature (114)..(289): NCBI GI: 124359380 NCBI Desc: tetratricopeptide-like helical [medicago truncatula]
  misc_feature (103)..(439): NCBI GI: 9755888 NCBI Desc: rsp67.2 [raphanus sativus]
MPAVASIPAPPAAAQRRRFSPVASASLRRVASGGGSSWRSERRLMSELERTVTAGAAERVIRSYVGTKSERAALAALSRLLMDSDPLAIPFYEAVTQARWFKWSSIHAAAVAALLEGNGSTGESRTLISDSISQHLQSTNEVALFYCDLMAAFSSRGLKDRAMDFYTELRSMPLSGRKTYMAMIKSLCLMGLPSEAEKTLREMVSLGYQPEAFQFGSVAKCYGKSGSLVDMERVITSMADAGIRFGTGAADTVLSCYSSCRDHSKMLAWLKKMRKLRIAPTTKGYNFVLNSCSSLASVVQELDPSLPLSTTGLVKRLRSISTPAAEVELVQELLASSSVLDKAMEWSETEVKLNLHGFSTVSAYVLMLQWVDAVKGRELPLEVSVVCGIGKHSDVRGEPKVRELAQEVLSRMGSPLQLSTRNKGRLVAKRDRVKQWLASFPVPEEGTDQWPDATSQQPYVFTLFRKLGQFFSNLV

SEQ ID NO: 543 - DNA, 1317 bp, Sorghum bicolor
  misc_feature: Ceres ANNOT ID no. 6008069
  misc_feature: Encodes the peptide sequence at SEQ ID NO 544
atggcgcctagggctgctccggcgctgcgggtgctcccgctcgcgctcgccgcggccatcttctcggggctcacagccatcctcatctacctctccggcgtctcctcctcacatggcggcgctcggctctcggaggcggacctagcggcgctcgctgcgctgcggggcagcttcagcaagtgcgtggatgcaaatgggctaggactgaaagccgtgaccggagaggactactgtcgagttgtgatacaatacccaagtgacacagtttctaagtggagagatccaatcacccataaggttgaaggtctgtcatttgagttcaatctgtgtgaagctgtgtcctcatgggagcaggtcagaaacagcacaacagtactcacaaaggagtacattgatgctttgccaaatggctgggaggagtatgcatggagaaggatcaacaaaggaatccttctgaataagtgccagaacagaagcctttgcatggaaaagctctcactagttctacctgagacatcaccatatgttcctcaccagtttggtagatgcgctgttgttgggaactcaggtgatcttcttaaaactaaatttggggatgaaattgattcttatgatgccgtcttcagagaaaatggtgcacccacccagagttacactgaatatgttggtactaagagtacatttcgccttctgaatagaggatctgcaaaggcactagataaagttgtcgagttagatgaaacaaaaaaagaggtactgatcgttaagacgacaatacatgatatcatgaaccaaatgattcgggaacttccaataaccaatccagtatacctcatgctaggcacatcatttggttcctcagctaaaggaacagggcttaaagctcttgaatttgccctctccatctgtgacagtgttgatatgtatggcttcacagtagatccagaggtcagaaagggacacactccactacatggtagagcatattatcagatgatggaatgtcttggcctggtaaaaatccattcaccgatgcgaggtgatcctggcaggacagtgaagtggctgcctaccagggctaccattgaggctgccagagttgcttctgagaaattgttgaagagacctggtgctggaagcaatggccctctggggacttgcaccatgataaagaagcgcaggaaagggaacgaaccaaacagatctggtctacgagatgctgccatgaagcaccttgaggacatgaaaggtgtcaccaggtatcccctggagcggaatgcagggggtgggtacctctgcctgatcaatgatagatag

SEQ ID NO: 544 - protein, 438 aa, Sorghum bicolor
  misc_feature: Ceres ANNOT ID no. 6008069
  misc_feature (105)..(360): Pfam Id: Glyco_transf_29 Pfam Desc: Glycosyltransferase family 29 (sialyltransferase)
  misc_feature (1)..(438): NCBI GI: 83318980 NCBI Desc: sialyltransferase like protein [zea mays]
  misc_feature (9)..(438): NCBI GI: 41053248 NCBI Desc: sialyltransferase-like protein [oryza sativa (japonica cultivar-group)]
  misc_feature (9)..(438): NCBI GI: 70663514 NCBI Desc: sialyltransferase-like protein [triticum aestivum]
  misc_feature (1)..(373): NCBI GI: 70663510 NCBI Desc: sialyltransferase-like protein [saccharum officinarum]
  misc_feature (9)..(435): NCBI GI: 70663490 NCBI Desc: sialyltransferase-like [glycine max]
MAPRAAPALRVLPLALAAAIFSGLTAILIYLSGVSSSHGGARLSEADLAALAALRGSFSKCVDANGLGLKAVTGEDYCRVVIQYPSDTVSKWRDPITHKVEGLSFEFNLCEAVSSWEQVRNSTTVLTKEYIDALPNGWEEYAWRRINKGILLNKCQNRSLCMEKLSLVLPETSPYVPHQFGRCAVVGNSGDLLKTKFGDEIDSYDAVFRENGAPTQSYTEYVGTKSTFRLLNRGSAKALDKVVELDETKKEVLIVKTTIHDIMNQMIRELPITNPVYLMLGTSFGSSAKGTGLKALEFALSICDSVDMYGFTVDPEVRKGHTPLHGRAYYQMMECLGLVKIHSPMRGDPGRTVKWLPTRATIEAARVASEKLLKRPGAGSNGPLGTCTMIKKRRKGNEPNRSGLRDAAMKHLEDMKGVTRYPLERNAGGGYLCLINDR

SEQ ID NO: 545 - DNA, 1125 bp, Sorghum bicolor
  misc_feature: Ceres ANNOT ID no. 6008076
  misc_feature: Encodes the peptide sequence at SEQ ID NO 546
atggctgccccgcacgacgaggccgcggcgtggtccgaggaggcggcgcgccgggtctgggccggcgccgtgccgctccaggtccacctccacgacgccgacgtcaccgcactgcccccgccgccggccttcctgactttggggccaagaattgggtacttgcccctcttgatacctgttataaaggctcatttcagcaatgcgctcccacctggtgttgacactgtttggtttgaatataaagggctgcctttaaaatggtatgtgccaattggtgctctctttgaccttctatgcgcagatccagaaagaccatggaatctaatagtccattttaggggatatccctcagaaatcttgtcaccatgcgagggtgaagatagcgtgaagtggagctacatgaattccctgaaagaggccaccttcatcattactgggaacagtaagagtgtgatgaatatgtcacatgctgatcaagtcgctctgtgggaatctgtaatgaaaggtaacttagatgggtataaaagtatctccaccaggcttaagattggaccattcgaagatgatgggttagtacgaacagcctccgcagagcggaaacgtcaacaaaattctgatgaacctgaatcacctggatctagcaaaccatgcagggtccctgttcgactatatgtacgcaatgttcaagaagaccttgagtatatagaagatgcagtacctgttagtgactgggaaggtgtgtcctacataaatcggccatttgagattcgcaaggttgaaggtagaagctacatcaccctggaacacgcattgcaaacattgcttccagagttcttcagctcaaaggccgcaagtagagccgacggctcccaccctgcaggggcactggactcagctgcagacagttcagacgccaccaactcttcaagaagttctaaggaggcagaacaagccctggcaagtccacgagaggtgggtgctgccaagaaaacgaaagtgaagctggtaagggtgcaaggcatcgagctggacatggacatcccgttcctttgggtcgccaataacctgaagaaccctgaatactacctccacatctgtgtatacgtcggcactagaaaacaatag

SEQ ID NO: 546 - protein, 374 aa, Sorghum bicolor
  misc_feature: Ceres ANNOT ID no. 6008076
  misc_feature (87)..(370): Pfam Id: APG5 Pfam Desc: Autophagy protein Apg5
  misc_feature (1)..(374): NCBI GI: 76150386 NCBI Desc: autophagy protein 5 [zea mays]
  misc_feature (1)..(362): NCBI GI: 76150378 NCBI Desc: autophagy protein 5 [saccharum officinarum]
  misc_feature (1)..(374): NCBI GI: 41053243 NCBI Desc: apg5 (autophagy 5)-like protein [oryza sativa (japonica cultivar-group)]
  misc_feature (1)..(374): NCBI GI: 75135758 NCBI Desc: probable autophagy protein 5
  misc_feature (15)..(279): NCBI GI: 76150368 NCBI Desc: autophagy protein 5 [glycine max]
MAAPHDEAAAWSEEAARRVWAGAVPLQVHLHDADVTALPPPPAFLTLGPRIGYLPLLIPVIKAHFSNALPPGVDTVWFEYKGLPLKWYVPIGALFDLLCADPERPWNLIVHFRGYPSEILSPCEGEDSVKWSYMNSLKEATFIITGNSKSVMNMSHADQVALWESVMKGNLDGYKSISTRLKIGPFEDDGLVRTASAERKRQQNSDEPESPGSSKPCRVPVRLYVRNVQEDLEYIEDAVPVSDWEGVSYINRPFEIRKVEGRSYITLEHALQTLLPEFFSSKAASRADGSHPAGALDSAADSSDATNSSRSSKEAEQALASPREVGAAKKTKVKLVRVQGIELDMDIPFLWVANNLKNPEYYLHICVYVGTRKQ

SEQ ID NO: 547 - DNA, 1407 bp, Sorghum bicolor
  misc_feature: Ceres ANNOT ID no. 6008077
  misc_feature: Encodes the peptide sequence at SEQ ID NO 548
atggcggacgagaagcttgccaagctgcgcgaagccaccgccggcctcacgcagatcagcgataatgagaagtccggcttcctcagcctcgtcggccgctacctcagcggcgacgaggagctcatcgagtgggccaagatccacacgcccaccgacgaggtggtggtgccgtacgacaccctggaatcccctcctgaagacattgaggccaccaagaagctgctcgacaagctcgccgtgctcaagctcaacggcggcctggggacgaccatgggatgcaccggacccaaatcggtcatcgaagtgcgcaacggatttactttccttgacctgattgtgatccagatcgagtcactcaacaagaagtatggcagcaatgtgccgctgcttctgatgaactccttcaacacccatgaagacaccttgaaaattgttgagaaatacgcgaattcaagcattgaaatccacacattcaatcagagccagtaccctcgtgtggtagctgacgagttcttgccatggccgtccaagggaaagactgacaagaatggctggtaccctcctggccatggtgatatcttcccatcactgatgaacagtggaaagctcgatttactactctcacagggaaaagagtatgtgttcattgcaaactcggataatttgggcgctattgtcaccccgaaaactttggctgatgtaaaaggtggcacactgatctcatacgaaggaagagttcagcttctggagattgcacaagtgcctgatgcacatgtgaatgagttcaaatcaattgagaaattcaagatattcaacaccaacaatctgtgggtgaacttgaaggccatcaaacgccttgttgaagctgatgcactcaagatggagatcattccgaatcctaaggaagtcgatggtgtgaaagttcttcagctggaaacagcagctggtgcagcaattaggttctttgaccacgccattggtatcaacgttccaaggtcccggttcctaccagttaaggcaacatcagatttacagctagtacagtctgatctatataccttggttgatggcttcgttacacgtaattcagctagagcaaatccatcaaatccctcaattgaacttggtcctgagttcaagaaggttgggtgcttccttagtcgcttcaagtcaatccctagcattgttgagcttgacagcttgaaggtttctggtgatgtttggtttggttctggcattgtactgaaggggaaagtgaccatcacagcaaaatctggcgtcaagctagaaatcccagacggagcagtgcttgagaacaagttagaactcctagagaagtcaacaaattttagcattcctcttatggatatgataaggaatgatatcaatggccctgaggacctttag

SEQ ID NO: 548 - protein, 468 aa, Sorghum bicolor
  misc_feature: Ceres ANNOT ID no. 6008077
  misc_feature (23)..(416): Pfam Id: UDPGP Pfam Desc: UTP--glucose-1-phosphate uridylyltransferase
  misc_feature (1)..(440): NCBI GI: 76160958 NCBI Desc: udp-glucose pyrophosphorylase-like protein [solanum tuberosum]
  misc_feature (226)..(443): NCBI GI: 4140688 NCBI Desc: udpglucose pyrophosphorylase [gracilaria gracilis]
  misc_feature (226)..(441): NCBI GI: 47086583 NCBI Desc: zgc:85662 [danio rerio]
  misc_feature (226)..(441): NCBI GI: 32766594 NCBI Desc: zgc:85662 protein [danio rerio]
  misc_feature (226)..(441): NCBI GI: 37747787 NCBI Desc: mgc68615 protein [xenopus laevis]
  misc_feature (117)..(440): SWISSPROT Homolog: EC 2.7.7.9 UTP--glucose-1-phosphate uridylyltransferase
  misc_feature: The sequence is a functional homolog of SEQ ID NO. 445 in the 11/188,298 US application
MADEKLAKLREATAGLTQISDNEKSGFLSLVGRYLSGDEELIEWAKIHTPTDEVVVPYDTLESPPEDIEATKKLLDKLAVLKLNGGLGTTMGCTGPKSVIEVRNGFTFLDLIVIQIESLNKKYGSNVPLLLMNSFNTHEDTLKIVEKYANSSIEIHTFNQSQYPRVVADEFLPWPSKGKTDKNGWYPPGHGDIFPSLMNSGKLDLLLSQGKEYVFIANSDNLGAIVTPKTLADVKGGTLISYEGRVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNSARANPSNPSIELGPEFKKVGCFLSRFKSIPSIVELDSLKVSGDVWFGSGIVLKGKVTITAKSGVKLEIPDGAVLENKLELLEKSTNFSIPLMDMIRNDINGPEDL

SEQ ID NO: 549 - DNA, 672 bp, Sorghum bicolor
  misc_feature: Ceres ANNOT ID no. 6008078
  misc_feature: Encodes the peptide sequence at SEQ ID NO 550
atggcttccactgccctgccttctagaaccttccaccgccgcgcgctcccctcgtctgccccgtctcatcattcgagggagaccttcgcccccggctgcctccccggcgccgtctcccggcggcgagcggccgtgcagctcctctccgccggattcttgacgtccgtcgcgccgccaccgccgtcgctcgccgcgaggaggggacgcattgtagtaccgccggaggactacgccactgcacctgatggtctgaagtactatgatcttgttgaagggaaggggccaattgctgaaaagggctcaactgtgcaggttcatttcgactgcatataccgtggcatcactgcagtgtcaagccgtgaatcgaagctcctagcagggaatcggagtattgcccagccttatgagttcactgttgggtcgctgcctgggaaagaacgaaagcgggactttgcagacaatgccaatgggctatactcagcgcaagctgctccaaagcctccagccgccatgtacacgataactgaggggatgaaagtagggggaaagaggagagtaattgtccctccagaactgggatatgggaaaaggggaatgagtgagataccgcctgatgccccttttgaactggatatagagctactggaactcatttctcctgcagaaaaatga

SEQ ID NO: 550 - protein, 223 aa, Sorghum bicolor
  misc_feature: Ceres ANNOT ID no. 6008078
  misc_feature (92)..(215): Pfam Id: FKBP_C Pfam Desc: FKBP-type peptidyl-prolyl cis-trans isomerase
  misc_feature (1)..(223): NCBI GI: 115443817 NCBI Desc: os02g0117600 [oryza sativa (japonica cultivar-group)]
  misc_feature (39)..(219): NCBI GI: 92875104 NCBI Desc: peptidylprolyl isomerase, fkbp-type [medicago truncatula]
  misc_feature (38)..(223): NCBI GI: 25402930 NCBI Desc: protein f2d10.32 [imported] - arabidopsis thaliana
  misc_feature (80)..(158): NCBI GI: 145341630 NCBI Desc: peptidyl-prolyl cis-trans isomerase, fkbp-type [ostreococcus lucimarinus cce9901]
  misc_feature (176)..(217): NCBI GI: 78063108 NCBI Desc: peptidylprolyl isomerase [burkholderia sp. 383]
MASTALPSRTFHRRALPSSAPSHHSRETFAPGCLPGAVSRRRAAVQLLSAGFLTSVAPPPPSLAARRGRIVVPPEDYATAPDGLKYYDLVEGKGPIAEKGSTVQVHFDCIYRGITAVSSRESKLLAGNRSIAQPYEFTVGSLPGKERKRDFADNANGLYSAQAAPKPPAAMYTITEGMKVGGKRRVIVPPELGYGKRGMSEIPPDAPFELDIELLELISPAEK

SEQ ID NO: 551 - DNA, 2778 bp, Sorghum bicolor
  misc_feature: Ceres ANNOT ID no. 6008079
  misc_feature: Encodes the peptide sequence at SEQ ID NO 552
atgaacatagcttttctcatgttgttggttctctctctgtttcacttccctaatgggatccacaaaagcttagcggcaaggccttcggttgttagtattgggtctattcttcggttgaactccactactggaggcgtttcagatgttgccatccacgcagcagtggatgatatcaactcagatccaacagttctaaatggaacaacattacgagttgacacgaaagatacaaattgtgatgatggtttccttggcatggttcaagctttgcagttcatggagactgatgttattgcaatcatcgggccacagtgctctcctattgctcatataatttcttatgtcgcaaatgagctccgagttcctttgatgtcctttgcgtcagatgcaactctatcatcaatccagttcccgttcttcatgcggactatgcccagcgatctctaccaaatggcagctgtggcggcagttgttgattactaccaatggaagatagtgactgccatatacgttgatgatgattatggtcgaaatggcattgctgctttggatgatgaacttactgcaaggcgctgcaaaatttcatacaaggttgggttccgttccaatgctaaaaaaagtgagcttctaaatctattggttactgttagtaatatggagtctcgtgttattatcctccatactggttcggaacctggactcaagcttttgtcaattgctaatgggctaaatatgatgggcaacggctatgtatggattgcaactgattggctttctgcttatcttgatgctaattcatcggtccctgctgaaacaataaatggcatgcaaggtgttctgactgtacgtccacacacccctaagtcaaagatgaagagtaatcttgtgtccaggtggagcagcttaagtaagaaatacaaccacagtgatcttcgcatcagtgcttatggtttttatgtttatgatagtgtgtggactgtagctcgggccttggatgcattctttgatgatggtgggaggatttcctttacaaatgactcaaggttgcgtgatgaaactgggggaactcttcaccttgaagccatgagtatttttgacatgggaaacaaattactggagaaggttagaaatgtgaacttcactggggtgtctggacaagtgcaatttaatgctcagtttgaactcattcatcctgcctatgatgtcataagcataattgggaatggcatgcggaccattggtttttggtcaaactatacaagattgctatcgactgtacttccagaggacctgtattcgaagcctcctaatacttctcttgccaatcaacaactctatgatgtcatttggcctggagagactgcacagaagcctcgaggctgggcctttccttccaatgccaaggagttgaaaattggcgtccctaacagatttagctttaaagagtttgttagccaagataatgctactgggtcaatgatgggctattgcatcgatgtcttcactcaagcattgtcattgcttccttatccagttacatacaggtttatacctttcggcaatggtactaaaaatcctcattatgacgaacttgtacagatggtagtggacaatgattttgatgcagcagtaggggatatcgtaattacaatgagccgaactaaaactgttgatttcacccagccctttattgagtcaggcctggttatcttggctccaatcaaaaaacatataacaagttcttgggcattcttgcagccatttacattggggatgtggtgtgttacagggttgtcttttcttgttgtgggtgcggttatttggatacttgagcatcgaataaatgatgaatttcgtggctcgccgcggcaacaaataataactatcgtttggttcagcttttcgactttattttttgcacatagagaaaacactatgagtaccttaggacgtggtgttctgatcatatggctatttgttgtattgatcattcaatcaagctatactgcaagtcttacttccatcctaaccgtgcaacaacttgatacttctataagaggaattgatgacctgaaagagagtgattatccaatcggtttccaagttggttcttttgctgaagattacatggtcaaggaactgaacatttcacggtcgaggctaaaagctcttggctctcctgaagaatatgctgaaaacctcaagctaggccctaagaaaggaggtgttatggctattgttgatgagcgcccctatgttgagctgtttttgtctacttactgcaagattgctgttgctggctcagattttaccagtacaggatggggctttgcatttccaagggattcccctctgcaagtagacctgtccaccgcaatcctaacactgtcggagaatggggaactgcagcggatccatgacaagtggctcaagacagccgattgctcaattgacaacactgagtttgtggactcgaaccagctccgccttgagagcttcatgggcctgttcctcatttgtggcgcagcatgtgtcctcgccctgctcatttacttcggcatcacgctacgccagtacctgagacatgaacagccgggatcagcaatctccgtagatgcaggatcatcgacatcgaagcgcagtctcagaaaattcatttcattcgtcgatgacaggcagccgccaccaaagaaaaagcggaccatgagcctctcaagaagttcaatgccaacaacgccaatgagtaaccgtcctggtttttttcccttgacacattga

SEQ ID NO: 552 - protein, 925 aa, Sorghum bicolor
  misc_feature: Ceres ANNOT ID no. 6008079
  misc_feature (46)..(407): Pfam Id: ANF_receptor Pfam Desc: Receptor family ligand binding region
  misc_feature (589)..(854): Pfam Id: Lig_chan Pfam Desc: Ligand-gated ion channel
  misc_feature (1)..(918): NCBI GI: 92875111 NCBI Desc: ionotropic glutamate receptor; extracellular ligand-binding receptor [medicago truncatula]
  misc_feature (22)..(893): NCBI GI: 75232900 NCBI Desc: glutamate receptor 3.1 precursor (ligand-gated ion channel 3.1)
  misc_feature (5)..(920): NCBI GI: 39545692 NCBI Desc: glr3.3 [arabidopsis thaliana]
  misc_feature (1)..(916): NCBI GI: 127519383 NCBI Desc: glutamate receptor [malus hupehensis]
  misc_feature (5)..(914): NCBI GI: 42573179 NCBI Desc: glutamate receptor family protein (glr3.2) (glur2) [arabidopsis thaliana]
MNIAFLMLLVLSLFHFPNGIHKSLAARPSVVSIGSILRLNSTTGGVSDVAIHAAVDDINSDPTVLNGTTLRVDTKDTNCDDGFLGMVQALQFMETDVIAIIGPQCSPIAHIISYVANELRVPLMSFASDATLSSIQFPFFMRTMPSDLYQMAAVAAVVDYYQWKIVTAIYVDDDYGRNGIAALDDELTARRCKISYKVGFRSNAKKSELLNLLVTVSNMESRVIILHTGSEPGLKLLSIANGLNMMGNGYVWIATDWLSAYLDANSSVPAETINGMQGVLTVRPHTPKSKMKSNLVSRWSSLSKKYNHSDLRISAYGFYVYDSVWTVARALDAFFDDGGRISFTNDSRLRDETGGTLHLEAMSIFDMGNKLLEKVRNVNFTGVSGQVQFNAQFELIHPAYDVISIIGNGMRTIGFWSNYTRLLSTVLPEDLYSKPPNTSLANQQLYDVIWPGETAQKPRGWAFPSNAKELKIGVPNRFSFKEFVSQDNATGSMMGYCIDVFTQALSLLPYPVTYRFIPFGNGTKNPHYDELVQMVVDNDFDAAVGDIVITMSRTKTVDFTQPFIESGLVILAPIKKHITSSWAFLQPFTLGMWCVTGLSFLVVGAVIWILEHRINDEFRGSPRQQIITIVWFSFSTLFFAHRENTMSTLGRGVLIIWLFVVLIIQSSYTASLTSILTVQQLDTSIRGIDDLKESDYPIGFQVGSFAEDYMVKELNISRSRLKALGSPEEYAENLKLGPKKGGVMAIVDERPYVELFLSTYCKIAVAGSDFTSTGWGFAFPRDSPLQVDLSTAILTLSENGELQRIHDKWLKTADCSIDNTEFVDSNQLRLESFMGLFLICGAACVLALLIYFGITLRQYLRHEQPGSAISVDAGSSTSKRSLRKFISFVDDRQPPPKKKRTMSLSRSSMPTTPMSNRPGFFPLTH

SEQ ID NO: 553 - DNA, 1158 bp, Sorghum bicolor
  misc_feature: Ceres ANNOT ID no. 6008084
  misc_feature: Encodes the peptide sequence at SEQ ID NO 554
atggccatggccgccccgccgccgcccacggctgtctgcgctcgccacttccggctccacctcccctgctcctcccgcctgcccatggccgccgcctctgcctcctcctcttcaccgctccggcgccgccgccggctcgccgtctccccgcgcgccgaagctggtacagggactgggacggggaccgggaccggggacgtggaggcgctcagggccggggtgtccgtgtacaagccgcgctcctacgacgtgctcgtcactgacgccgcgcgctccctcgcctgcgccatcgacgacggcaagacccggctcgagatcgagttcccgcctctgccaagcagcatatcttcttacaagggctcctcagatgagttcatcgatgcgaacatccagcttgctcttgttgttgctaggaagctcaaagagctcaaggggactaagtcctgtatagtgtttcctgatcaacctgaaaagcgcagggcgtcacagttgttcaggacagctatagatacgattgagggtgtaactgtcagttccctggatgatgtacccaccgaccctgtcaacagcttcttcaaatcaataagaaacaccctggattttgacttctcagatgacaatgaagatagatggaaatctgatgaaccaccgtcattatatatcttcattaacagcagcacacgtgaccttgcttctatagagaagtatgtggaaaagtttgccacatctgttccagcccttctattcaatcttgaactagatacattgcgttctgacttggggcttctggggtttcccccaaaagatttgcactatcggttcctttctcagttcaccccagtattttatatcagacaacgtgactattccaagacaatcgcagtcgctccatacatagtgaattacagtggagctgtattccgtcgatatccaggcccctggcaggtcatgctgaagcagctcgatggctcctatgcatgtgttgcagagagtgaagctcggttcactttgggacaggcgaaagaagaactattgagggttattggtttacaagaagaagagggaagctcacttgaatttctcagaagaggatacaagaatgctacttggtgggaagagaacgttgatcaagagacgtcggctgcgtggcgaacttga

SEQ ID NO: 554 - protein, 385 aa, Sorghum bicolor
  misc_feature: Ceres ANNOT ID no. 6008084
  misc_feature: Useful for making plants with modulated oxidative stress sensitivity
  misc_feature: GREAT-hit functional homolog of the protein sequence given in SEQ ID NO 12913
  misc_feature: Useful for making plants with modulated oxidative stress sensitivity
  misc_feature: Functional homolog of the protein sequence given in SEQ ID NO 12913
MAMAAPPPPTAVCARHFRLHLPCSSRLPMAAASASSSSPLRRRRRLAVSPRAEAGTGTGTGTGTGDVEALRAGVSVYKPRSYDVLVTDAARSLACAIDDGKTRLEIEFPPLPSSISSYKGSSDEFIDANIQLALVVARKLKELKGTKSCIVFPDQPEKRRASQLFRTAIDTIEGVTVSSLDDVPTDPVNSFFKSIRNTLDFDFSDDNEDRWKSDEPPSLYIFINSSTRDLASIEKYVEKFATSVPALLFNLELDTLRSDLGLLGFPPKDLHYRFLSQFTPVFYIRQRDYSKTIAVAPYIVNYSGAVFRRYPGPWQVMLKQLDGSYACVAESEARFTLGQAKEELLRVIGLQEEEGSSLEFLRRGYKNATWWEENVDQETSAAWRT

SEQ ID NO: 555 - DNA, 1533 bp, Sorghum bicolor
  misc_feature: Ceres ANNOT ID no. 6008087
  misc_feature: Encodes the peptide sequence at SEQ ID NO 556
atggagtacgagcgcattgagaagccgttccccgtccagggcggcgggttctcgcccaagcggctgcgcgcgatgctgctcggggtggacaagcgccgcaaggggcaggacgacgccgaggaggaggaggacggcggcgactacggcgccgtgcccagggcccacgccagatccgacgccggcgacggtggtggaggcgccatgtgcgaagaatacaaggacgtcgacgtggtgagcaccatctcagagtcctcatcctcgctggagacagggggcgggcaccggtcccgagacgcccaccccatccccgtgggttccaggatcagggtgcctgaagaggactcgtgtgactcggagagtgtggcatccaactttgagttccacaaggagcgaggagccactgcccggtcagcggcggcggcatcggtcgtccctccattctcaaagcctgccccatcaaagtgggacgatgcacagaagtggattgccagcccgacgacaaaccgtcctagcaggggtggcggtggggctcctgttcctaagaagattgagaagcctagcgctggcatcgggaggttgccggcgaccaaggttgtgttggaggcaacagaggagatagatactaagaggattgatccgagccaagagaagagggaaattgggtggcagaaagcggtgaattgggcgccgcccgacccctgtcccgaagtggagccttgtccaaagactacacttgctgcagaaagtacaatggctgcttcagctgttacttttaaccgtcatgatgcatccaccacgcttcaaagtgcaacaacatgcatacctcctccatcaacagttcggtcagtgtcaatgagggatatgggcacagaaatgactcctattgcaagccaagaaccatctcgaacaggaacaccggtgagagcaacaagtccaaattgttctcggccaacaactccacgaaggacgctaggccccaacgcaattggtgctgttatcagccatggggaatgtagcaattcagaattaagtgaacaggaactgcaaacaaaaactaggagggagataatgcttcttggcacacagctaggtaagaccagtattgcagcatgggcaagcaagaaggaagaggaaaaagatgcatcactttcactgaaaacagtgcccatggaccaatcaacacagaacataactgcaatccgtgcagctgcatgggaagaggcagagaaggccaaatatttagcaagattcaaacgagaagaaatcaagatccaggcttgggaggatcatcagaaagcccaaatagaagctgaaatgagaaaaattgaggttgaggtagagcggatgcgtgcccgtgcgcaagacaagctgatgacccagctcgcatcggcaaggcacaatgcagatgagaagcgtgccgccgcagagctgaaaaggaaccgtgcagccgcaaggacggctgaacaggcagagcacatcaggagaaccggccgggtgccgccttcgtttggctgctggaactggtgctcgtag

SEQ ID NO: 556 - protein, 510 aa, Sorghum bicolor
  misc_feature: Ceres ANNOT ID no. 6008087
  misc_feature (394)..(504): Pfam Id: Remorin_C Pfam Desc: Remorin, C-terminal region
  misc_feature (70)..(510): NCBI GI: 38344336 NCBI Desc: osjnba0058k23.18 [oryza sativa (japonica cultivar-group)]
  misc_feature (70)..(510): NCBI GI: 116309948 NCBI Desc: h0714h04.6 [oryza sativa (indica cultivar-group)]
  misc_feature (280)..(510): NCBI GI: 115460610 NCBI Desc: os04g0620200 [oryza sativa (japonica cultivar-group)]
  misc_feature (283)..(505): NCBI GI: 53850525 NCBI Desc: at1g53860 [arabidopsis thaliana]
  misc_feature (137)..(493): NCBI GI: 92884019 NCBI Desc: remorin, c-terminal region [medicago truncatula]
  misc_feature: The sequence is a functional homolog of SEQ ID NO 104 in the 10/666,642US patent application
  misc_feature: The sequence is a functional homolog of SEQ ID NO 1040 in the 10/666,642US patent application
  misc_feature: The sequence is a functional homolog of SEQ ID NO 1041 in the 10/666,642US patent application
  misc_feature: The sequence is a functional homolog of SEQ ID NO 1042 in the 10/666,642US patent application
  misc_feature: The sequence is a functional homolog of SEQ ID NO 264 in the 10/666,642US patent application
  misc_feature: Useful for making plants with modulated growth and phenotype characteristics
  misc_feature: The sequence is a functional homolog of SEQ ID NO 104 in the 20070033671 US patent application
  misc_feature: The sequence is a functional homolog of SEQ ID NO 104 in the 20070033671 US patent application
  misc_feature: The sequence is a functional homolog of SEQ ID NO 1040 in the 20070033671 US patent application
  misc_feature: The sequence is a functional homolog of SEQ ID NO 1041 in the 20070033671 US patent application
  misc_feature: The sequence is a functional homolog of SEQ ID NO 1042 in the 20070033671 US patent application
  misc_feature: The sequence is a functional homolog of SEQ ID NO 264 in the 20070033671 US patent application
  misc_feature: The sequence is a functional homolog of SEQ ID NO 1040 in the 10/666,642 US patent application
  misc_feature: The sequence is a functional homolog of SEQ ID NO 264 in the 10/666,642 US patent application
MEYERIEKPFPVQGGGFSPKRLRAMLLGVDKRRKGQDDAEEEEDGGDYGAVPRAHARSDAGDGGGGAMCEEYKDVDVVSTISESSSSLETGGGHRSRDAHPIPVGSRIRVPEEDSCDSESVASNFEFHKERGATARSAAAASVVPPFSKPAPSKWDDAQKWIASPTTNRPSRGGGGAPVPKKIEKPSAGIGRLPATKVVLEATEEIDTKRIDPSQEKREIGWQKAVNWAPPDPCPEVEPCPKTTLAAESTMAASAVTFNRHDASTTLQSATTCIPPPSTVRSVSMRDMGTEMTPIASQEPSRTGTPVRATSPNCSRPTTPRRTLGPNAIGAVISHGECSNSELSEQELQTKTRREIMLLGTQLGKTSIAAWASKKEEEKDASLSLKTVPMDQSTQNITAIRAAAWEEAEKAKYLARFKREEIKIQAWEDHQKAQIEAEMRKIEVEVERMRARAQDKLMTQLASARHNADEKRAAAELKRNRAAARTAEQAEHIRRTGRVPPSFGCWNWCS

SEQ ID NO: 557 - DNA, 1212 bp, Sorghum bicolor
  misc_feature: Ceres ANNOT ID no. 6008093
  misc_feature: Encodes the peptide sequence at SEQ ID NO 558
atggatccagtcggcggcacggcggggtatcggggaccagcggaagtgcgcgcccgcgcgcccggcaagatcatcctcgcgggcgagcacgccgtcgtccacggctccgccgccgttgccgccgccatcgatctctacaccaggtcctccctcctcctccgccccacaggagagggtggcggcgctgacttcggcgcggtggagctgtacctcagggactcgcgcctcaccttctcgtggccatgctcgcgcctccgcggggcgctaggggaggagatcggcgccaaccccggggctccggcgccgtgctcccctgaccagttggccgccattgcctggctcttggaggaccaagagatccctgaggccaagatctggctctccgccggcctctctgctttccttttcctctacacctccatcttgggatgcaggcctggcaaggcagaggtgacctcggacctgcccatgggtgcagggctcggctcgtcggctgcattctgtgtgtccatgtcaggggcgctattgacagctgctggcgcagtcagtgttggagcaagcaggggtgctgagggatgggaggtgttggagaaggctgatcttgagctggtcaaccagtgggcgttccaaggggaaaagatcattcatggcaagccttctggcatcgacaattccgtcagcactttcgggaaaatgatcaaattcaagaagggggaactgacaaacctcgagtctaggaacccagtcaaaatgcttattactgatacaagagttggtaggaacacaaaggccctggttgctggtgtatctgaaagagcatctaggcatccagatgctatggcttctgtcttccatgcagtgaactctattagtgaagagctttcaagcattgttgagttagcagccgaggatgagatagccatcacctctaaggaggataagctagcagagcttatggagatgaaccaaggtttgcttcagtgcatgggagtcagccattcttctatagaaactgtgttgcgaaccactctgaaatatagcttggtctcaaagctaactggagctggtggtggtggctgtgtgttgactctaataccgactttatcggccaatattgttctagagaaagtcaccacagagctcgaatctcatggttatcgctgcttcaaagttgaggttggtgggcgaggtctccaagtattccgaggataa

SEQ ID NO: 558 - protein, 403 aa, Sorghum bicolor
  misc_feature: Ceres ANNOT ID no. 6008093
  misc_feature (148)..(231): Pfam Id: GHMP_kinases_N Pfam Desc: GHMP kinases N terminal domain
  misc_feature (304)..(383): Pfam Id: GHMP_kinases_C Pfam Desc: GHMP kinases C terminal
  misc_feature (15)..(399): NCBI GI: 16417946 NCBI Desc: mevalonate kinase [hevea brasiliensis]
  misc_feature (15)..(400): NCBI GI: 87240539 NCBI Desc: mevalonate kinase/phosphomevalonate kinase [medicago truncatula]
  misc_feature (15)..(400): NCBI GI: 21536584 NCBI Desc: mevalonate kinase [arabidopsis thaliana]
  misc_feature (15)..(400): NCBI GI: 5578718 NCBI Desc: mevalonate kinase [arabidopsis thaliana]
  misc_feature (8)..(400): NCBI GI: 62089024 NCBI Desc: mevalonate kinase variant [homo sapiens]
  misc_feature (15)..(400): SWISSPROT Homolog: EC 2.7.1.36 Mevalonate kinase
MDPVGGTAGYRGPAEVRARAPGKIILAGEHAVVHGSAAVAAAIDLYTRSSLLLRPTGEGGGADFGAVELYLRDSRLTFSWPCSRLRGALGEEIGANPGAPAPCSPDQLAAIAWLLEDQEIPEAKIWLSAGLSAFLFLYTSILGCRPGKAEVTSDLPMGAGLGSSAAFCVSMSGALLTAAGAVSVGASRGAEGWEVLEKADLELVNQWAFQGEKIIHGKPSGIDNSVSTFGKMIKFKKGELTNLESRNPVKMLITDTRVGRNTKALVAGVSERASRHPDAMASVFHAVNSISEELSSIVELAAEDEIAITSKEDKLAELMEMNQGLLQCMGVSHSSIETVLRTTLKYSLVSKLTGAGGGGCVLTLIPTLSANIVLEKVTTELESHGYRCFKVEVGGRGLQVFRG

SEQ ID NO: 559 - DNA, 2385 bp, Sorghum bicolor
  misc_feature: Ceres ANNOT ID no. 6008108
  misc_feature: Encodes the peptide sequence at SEQ ID NO 560
atggaggcctacgcgggtgctgcgcccgcggccggcgtattcgcgggctacggcaccgcagccacgcgctccttcaccctccgccgccgccgcgggtctccgcgttccagcgccgggcgggtgcgcctcgtccgggcgccgccgccacgcgccgccggggactcgggggacctgcccccgcttgacaagtgggacattatggagctagatttcggcaggttccttggggaggaccccaagcttaccctcgcgaagattcttcttaagaagtcagatccggatgcctcatccctcgacgtagagaaactaattgccacaaaaagagacaagctagatgatattctgagggagtgcatggaagctaataagaaggaccagggtttcaacacatcagaaagtggatccactttgaatacgacacgtccgacaacaagcaagctgaccgaaggcaaaagttctttgaatatttccaggcctgttatgggcaaacctatccaaggtgggcctccgttgactttacttcgaccagcaggaagcaaaccgaagcaagatgagccttctctggttcagccacgaccagttggaagcaaagcaaatgaagatacaccttcattgatcttgtcacggccaattgggagcaaaccaaatgtacggggcattccgatacaagatagttggcccagtaaagagagtttagctgctgcaacagagttcagtgaggtggggagcatctcaagaacaagcgaggtggatgccaccttgcggaaacccaccgtgtatcagagtgaggatgatgatttgaagtcgaagcttaaaatcaagccaaatattaacctgaaaatgaggaaagatatgaacgaggacttaacgaatatttctctccttcaaaagccagatgttgcaaaagatacttctaatccagagcaggacaatgcctctgctagccctgccacagtttctgctacagaggataacagtgaacttgagccagaatcaaatggtcttgatgaaaaattagtaactgaaaatgtttatgaatcatctgggcttgatgatgattctactgcaggactacagccatcaggtcaaactttcattgaagaaacaagtacttctgctggaccagtggataaccaatcagctaccggcaacaatttctctatgcaggctttcttgcaaggaaaacctaaaagagaaaacgaatcgactgaaatatggccatctgaagtagatgagaagatgaattctactgataataaaaattatgttgatgatgggggaaatgtcttaccatcaaaactggaggacatcacagagagtgactggacaaggttagagcattacgcaagtaccggagaaaaggttgaggtggagctgataaattgcagtgcaaagggatttgttgtgtcacttgactcactgataggtttcttaccataccgtaatcttgctacaaagtggaaattcttagcctttgagacttggttaagaaggaagggtggtgatccttccttgtacaagcagagtttgggattagaggatagttttgaggttaatgagagaaacatagaaccagaatctagctcagtttccaaaatagctggtgaggatcaagaatctcagtcatctaagccgaagtttgaagatcttattcgagcatacaaccaagaaaaatccaagtttttatcttcatttattggtcaaagactccgagtatcagttgtcctggctgacagaaattccaagcggatatttttctctatgaagccaaaagagagcgaagaatttatccagaaaaagagaaacctgatggctaggctcaacgttggagatattgttcagtgcgctatcaagagatttgtttactttgggatatttgttgaggttgaaggtgttcctgcattgattcagcaatgggaagtttcgtgggatgacactttagatccagcagtttcttacaaaattggtcaggttgtggatgctaaagttattcaactggattataataatagccgcatatttttgtcacttaaagatgtaaagcctaatccatccttaggtgctttggaagcagtaattggtgaggatttatcgcttggtgaagctcttgaacctgtgcaatcagattttgagtggcctgaggtagatgcccttatggaagagctgcggaaaatagagggtgtaagagatgtctataaaggacgattcttccaaagcccagggttagctccgacgtttcaggtttacatggcacctgtggttggtccgaaatacaagctcctggcacggtatggaaacaatgttcaagaggtgatggtggagacaacacttgggaaagaagagttgaaagaggcaattttgatgtgcactaatagggttagctga

SEQ ID NO: 560 - protein, 794 aa, Sorghum bicolor
  misc_feature: Ceres ANNOT ID no. 6008108
  misc_feature (606)..(678): Pfam Id: S1 Pfam Desc: S1 RNA binding domain
  misc_feature (1)..(794): NCBI GI: 41052819 NCBI Desc: heat shock factor protein hsf8-like [oryza sativa (japonica cultivar-group)]
  misc_feature (98)..(793): NCBI GI: 8698727 NCBI Desc: contains similarity to s1 protein from homo sapiens gbu27517 and contains a s1 rna binding pf00575 domain. est gbf15427, gbf15428 comes from this gene. [arabidopsis thaliana]
  misc_feature (552)..(706): NCBI GI: 106889181 NCBI Desc: rna binding s1 [roseiflexus sp. rs-1]
  misc_feature (552)..(706): NCBI GI: 118064766 NCBI Desc: rna binding s1 [roseiflexus castenholzii dsm 13941]
  misc_feature (563)..(700): NCBI GI: 138895802 NCBI Desc: 30s ribosomal protein s1 [geobacillus thermodenitrificans ng80-2]
  misc_feature: Useful for making plants with altered terpenoid content
  misc_feature: GREAT-hit functional homolog of the protein sequence given in SEQ ID NO 13299
  misc_feature: The sequence is a functional homolog of SEQ ID NO. 282 in the 11/188,298 US application
MEAYAGAAPAAGVFAGYGTAATRSFTLRRRRGSPRSSAGRVRLVRAPPPRAAGDSGDLPPLDKWDIMELDFGRFLGEDPKLTLAKILLKKSDPDASSLDVEKLIATKRDKLDDILRECMEANKKDQGFNTSESGSTLNTTRPTTSKLTEGKSSLNISRPVMGKPIQGGPPLTLLRPAGSKPKQDEPSLVQPRPVGSKANEDTPSLILSRPIGSKPNVRGIPIQDSWPSKESLAAATEFSEVGSISRTSEVDATLRKPTVYQSEDDDLKSKLKIKPNINLKMRKDMNEDLTNISLLQKPDVAKDTSNPEQDNASASPATVSATEDNSELEPESNGLDEKLVTENVYESSGLDDDSTAGLQPSGQTFIEETSTSAGPVDNQSATGNNFSMQAFLQGKPKRENESTEIWPSEVDEKMNSTDNKNYVDDGGNVLPSKLEDITESDWTRLEHYASTGEKVEVELINCSAKGFVVSLDSLIGFLPYRNLATKWKFLAFETWLRRKGGDPSLYKQSLGLEDSFEVNERNIEPESSSVSKIAGEDQESQSSKPKFEDLIRAYNQEKSKFLSSFIGQRLRVSVVLADRNSKRIFFSMKPKESEEFIQKKRNLMARLNVGDIVQCAIKRFVYFGIFVEVEGVPALIQQWEVSWDDTLDPAVSYKIGQVVDAKVIQLDYNNSRIFLSLKDVKPNPSLGALEAVIGEDLSLGEALEPVQSDFEWPEVDALMEELRKIEGVRDVYKGRFFQSPGLAPTFQVYMAPVVGPKYKLLARYGNNVQEVMVETTLGKEELKEAILMCTNRVS

SEQ ID NO: 561 - DNA, 1749 bp, Sorghum bicolor
  misc_feature: Ceres ANNOT ID no. 6008111
  misc_feature: Encodes the peptide sequence at SEQ ID NO 562
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
atggaagcgtggccgcctctcgcccccgcggcggccgccgccgccaccccgaccgcggctgcctccggcgaagcggcggccgctcccgccgttgctggggcgtggggagcagtggcaacggcgcagcgtaaggctgtggtgaaggagtcggcggcgcaggcggtgagccgcatcgtggcgagctgcgccaactccagcggagtggcggtcgccgtggtggatgccaacgccgtcatctccggcggctccgctctctccacctccgcggagcggcttgtcaccgtgccggaggtgctcgaggaggtcagggacgcggctgcgcggcggcggctcgggctcctccccgtccccgtcgagaccgttgagcctgcgccggagttcgttaagaaagttaccaggtttgccagggagacaggagacatccaaacactttcagatgttgatatcaagattattgctttggcttacatgttagaagctgagatccatgggactagccatttgcgggagcaccctcctcctctgcgtgaggtgaatgtcagaaagctatccgaagctccactgcctggttggggctcaaatgtgcctaacctgaaagagtgggaagagttggatcagatgtctgaagctggtggagagatcaattctcgaatacttcctctgaaggatattgagaatcaagatatcccaatgagtgagaccaacagtgtctgtgaagcacaagaggatacagagcaccagccttcagagaaggatgcacctgttgcatgggaggaggatgagaacaatgtaggttggatgcctgctgttagccgcagcacacacagaagatatttgcggaggaaggcaaggcgtgatgcactcaaggaatctggagaaagttttgagacaagttctgttgctccatcagtcgatgatgataaagatctctctgaaaatagtggattggagcatggtctgacttcaacagattctatccctgagaaaatcagtgcaagttctgatggtcttgaacatcaagtagaggatgatactgaaattgctggaggacatttgcattctgaccagcaagcttacggtgatgatactgatgtgtgcaccaaagaattggataacctagatataaagtgtgaggatgagggaggtgatgatgcacattccatagatgatgagagcagtgagcagagttggaccctgaggtccttatctgaatcaactgtagcatgtgtcactagtgattatgccatgcaaaatgtcatcctgcagattggcctccgtctcatagcaccaggtggcatgcagatacgacagatgcataggtgggttttgaggtgccatgcttgctataaggtgacccaagaggttggcaaaatattttgtccgaagtgtggcaatggtgggaccttacggaaggtttcagtaactgttggtgaaaatgggatcactatggcttcacggcgcccacgtgttacacttcgaggcacaaaattttccctcccaatgccccaaggtggaagagatgccataactaagaaccccattcttcgtgaggaccaacttcctcagaaggttcttcatcctaaatcgaagaagtccagcaaggaggatgatttcttgggcgtcgacgacatattttcgcacagtggtgataagaaggcaccattgaaacctccagtgaggaaggcactcgcaatgtttagtgggaaaagaaatccaaacgacaaccacttttctcgcaagaagcactaa

SEQ ID NO: 562 - protein, 582 aa, Sorghum bicolor
  misc_feature: Ceres ANNOT ID no. 6008111
  misc_feature (434)..(505): Pfam Id: NOB1_Zn_bind Pfam Desc: Nin one binding (NOB1) Zn-ribbon like
  misc_feature (368)..(581): NCBI GI: 33638121 NCBI Desc: nin one binding protein [rattus norvegicus]
  misc_feature (378)..(581): NCBI GI: 7661532 NCBI Desc: nin one binding protein [homo sapiens]
  misc_feature (378)..(581): NCBI GI: 119603691 NCBI Desc: psmd8 binding protein 1, isoform cra_a [homo sapiens]
  misc_feature (374)..(581): NCBI GI: 33355456 NCBI Desc: nin one binding protein [bos taurus]
  misc_feature (353)..(581): NCBI GI: 54035096 NCBI Desc: loc398701 protein [xenopus laevis]
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
MEAWPPLAPAAAAAATPTAAASGEAAAAPAVAGAWGAVATAQRKAVVKESAAQAVSRIVASCANSSGVAVAVVDANAVISGGSALSTSAERLVTVPEVLEEVRDAAARRRLGLLPVPVETVEPAPEFVKKVTRFARETGDIQTLSDVDIKIIALAYMLEAEIHGTSHLREHPPPLREVNVRKLSEAPLPGWGSNVPNLKEWEELDQMSEAGGEINSRILPLKDIENQDIPMSETNSVCEAQEDTEHQPSEKDAPVAWEEDENNVGWMPAVSRSTHRRYLRRKARRDALKESGESFETSSVAPSVDDDKDLSENSGLEHGLTSTDSIPEKISASSDGLEHQVEDDTEIAGGHLHSDQQAYGDDTDVCTKELDNLDIKCEDEGGDDAHSIDDESSEQSWTLRSLSESTVACVTSDYAMQNVILQIGLRLIAPGGMQIRQMHRWVLRCHACYKVTQEVGKIFCPKCGNGGTLRKVSVTVGENGITMASRRPRVTLRGTKFSLPMPQGGRDAITKNPILREDQLPQKVLHPKSKKSSKEDDFLGVDDIFSHSGDKKAPLKPPVRKALAMFSGKRNPNDNHFSRKKH

SEQ ID NO: 563 - DNA, 306 bp, Sorghum bicolor
  misc_feature: Ceres ANNOT ID no. 6008147
  misc_feature: Encodes the peptide sequence at SEQ ID NO 564
atgggcaagggtacgggcagcttcggcaagcgccgcaacaagacgcacacgctgtgcatccgctgcggccgccgcagcttccacctccagaagagcacctgctcctcctgcggctaccccgccgcccgcatccgcaagtataactggagtgtgaaggccatcaggcgcaagacaactggtaccggaaggatgaggtacatgcgtcacgtgcctcgccgcttcaagagcaacttcagagaaggcgatcacaataagacgagtgaatacataatgttgatcatagtaaagacggcctttttattgtag

SEQ ID NO: 564 - protein, 101 aa, Sorghum bicolor
  misc_feature: Ceres ANNOT ID no. 6008147
  misc_feature (2)..(55): Pfam Id: Ribosomal_L37e Pfam Desc: Ribosomal protein L37e
  misc_feature (2)..(81): NCBI GI: 115474631 NCBI Desc: os08g0128500 [oryza sativa (japonica cultivar-group)]
  misc_feature (1)..(81): NCBI GI: 44662866 NCBI Desc: ribosomal protein l37 [glycine max]
  misc_feature (2)..(85): NCBI GI: 145348682 NCBI Desc: ribosomal protein l37, component of cytosolic 80s ribosome and 60s large subunit [ostreococcus lucimarinus cce9901]
  misc_feature (1)..(87): NCBI GI: 6323214 NCBI Desc: protein component of the large (60s) ribosomal subunit, has similarity to rpl37bp and to rat l37 ribosomal protein [saccharomyces cerevisiae]
  misc_feature (2)..(87): NCBI GI: 49258864 NCBI Desc: chain y, structure of the ribosomal 80s-eef2-sordarin complex from yeast obtained by docking atomic models for rna and protein components into a 11.7 a cryo-em map. this file, 1s1i,
  misc_feature (2)..(87): NCBI GI: 49258864 (continued) contains 60s subunit. the 40s ribosomal subunit is in file 1s1h
MGKGTGSFGKRRNKTHTLCIRCGRRSFHLQKSTCSSCGYPAARIRKYNWSVKAIRRKTTGTGRMRYMRHVPRRFKSNFREGDHNKTSEYIMLIIVKTAFLL

SEQ ID NO: 565 - DNA, 1839 bp, Sorghum bicolor
  misc_feature: Ceres ANNOT ID no. 6008176
  misc_feature: Encodes the peptide sequence at SEQ ID NO 566
atgccgggcctcgccgcctccgacaactcgcccccatcggcggcgccaccgccacggcggctctcatcgccactcccccgccgggcgccgccgtccccgtctccctcggcctcctcgcgcgccaagccacggaagccctctccctcgcccgctccagcacccgacgccgacgactcgctcgacaacccggatctgggcccgttcctcctcaagcaggcacgggacgccatggtgtcgggtgagggcggcggcgccgcgcgcgcgctcgagttcgccgagcgtgccgccagggcgctcgagcgacgcggcgagggcgccgagctcgagctcgccatgagcctccatgtcgccgccgctatacactgtggactcggtcgacacgccgacgccattcctgttctcgagcgcgccgtcgccgtcgtcacgccgccgccgccagaggcgcctgctgctgacggcgagggggagggggtgggcgaggcggctggcggcggcggcgacgaccagcagcgtgctgagcctgaccagaggggcgaggagtggtcccttgctgccttctctggatggatgcagctcggcgacacgcacgccatgctcggacgcatggatgagtccattgcctgctatggcaaggggctcgagatccagatggccgcgctcggcgagcgcgatccccgcgtcgccgagacctgcaggtaccttgcggaagcacatgtgcaagctctgcagttcgacgaggcagagaagctgtgccgcaaagccctcgagatccaccgggagcacagtgctccagcatccctcgaggaggcctcggaccgccgcctgatggccctcatcctggacgccaagggcgactacgacggtgcccttgagcacctcgtgcttgcctcgatgaccatggttgccaacggccgtgacatcgaggttgccaccattgacgtcgccataggcaacacctacctcgccctcgcccgcttcgacgaggccgtcttctcctaccagaaggcgctgactgttctcaaatcggcccgtggcgacgaccatccgacggtagcgtcagtctacgtccgccttgctgacctttaccaccggacaggcaggctccgcgagtccaaatcctactgcgagaacgccctgcgtgtctatgccaagcccgcgcctggtgctgctcctgatgagattgctggaggcttgatggagattgctgccatctatgaggcacttggtgatctcgatgaggccctaaagcttcttcagagggcgctcaagttgcttgaggactcaccggggcagtggagcaccgttgctggtattgaggcacaaatgggtgttctgtactacatggtggggaggtatgcagattcaaggaactcatttgagagcgcggttgcaaagttgagggccagtggtgagaggaagtcagcatttttcggcgttctattgaaccagatggggctagcttgcgtgcagctgttcaagatagatgaggctgcacagttgtttgaggaggcaagggcagttctggagcaggagtgtggcgcttctcatcctgatactcttggtgtgtacagcaaccttgctgcaatctatgatgccatgggaagagtggaggatgcaattgagatcctggagcacgtgctgaaggtgagggaagagaagcttggcacagcgaacccagatgtggaggatgagaagaagcggctggcggagctcctgaaagaggcagggcggtcccgaaaccggaagcagaagtcgctggagaacctgttcgtgaccaactcgcagcgggcgaagaaggaggccgggaggaggtggtccaacttcgggttcaggagctga

SEQ ID NO: 566 - protein, 612 aa, Sorghum bicolor
  misc_feature: Ceres ANNOT ID no. 6008176
  misc_feature (228)..(261): Pfam Id: TPR_2 Pfam Desc: Tetratricopeptide repeat
  misc_feature (395)..(428): Pfam Id: TPR_2 Pfam Desc: Tetratricopeptide repeat
  misc_feature (228)..(261): Pfam Id: TPR_1 Pfam Desc: Tetratricopeptide repeat
  misc_feature (395)..(428): Pfam Id: TPR_1 Pfam Desc: Tetratricopeptide repeat
  misc_feature (1)..(612): NCBI GI: 41052919 NCBI Desc: kinesin light chain-like protein [oryza sativa (japonica cultivar-group)]
  misc_feature (176)..(599): NCBI GI: 102140007 NCBI Desc: glycoside hydrolase family 17 protein [musa acuminata]
  misc_feature (176)..(599): NCBI GI: 102139902 NCBI Desc: kinesin light chain-related [musa acuminata]
  misc_feature (174)..(535): NCBI GI: 42572867 NCBI Desc: kinesin light chain-related [arabidopsis thaliana]
  misc_feature (176)..(593): NCBI GI: 20152971 NCBI Desc: similar to a. thaliana protein bab01483 similar to kinesin light chain [hordeum vulgare subsp. vulgare]
MPGLAASDNSPPSAAPPPRRLSSPLPRRAPPSPSPSASSRAKPRKPSPSPAPAPDADDSLDNPDLGPFLLKQARDAMVSGEGGGAARALEFAERAARALERRGEGAELELAMSLHVAAAIHCGLGRHADAIPVLERAVAVVTPPPPEAPAADGEGEGVGEAAGGGGDDQQRAEPDQRGEEWSLAAFSGWMQLGDTHAMLGRMDESIACYGKGLEIQMAALGERDPRVAETCRYLAEAHVQALQFDEAEKLCRKALEIHREHSAPASLEEASDRRLMALILDAKGDYDGALEHLVLASMTMVANGRDIEVATIDVAIGNTYLALARFDEAVFSYQKALTVLKSARGDDHPTVASVYVRLADLYHRTGRLRESKSYCENALRVYAKPAPGAAPDEIAGGLMEIAAIYEALGDLDEALKLLQRALKLLEDSPGQWSTVAGIEAQMGVLYYMVGRYADSRNSFESAVAKLRASGERKSAFFGVLLNQMGLACVQLFKIDEAAQLFEEARAVLEQECGASHPDTLGVYSNLAAIYDAMGRVEDAIEILEHVLKVREEKLGTANPDVEDEKKRLAELLKEAGRSRNRKQKSLENLFVTNSQRAKKEAGRRWSNFGFRS

SEQ ID NO: 567 - DNA, 1410 bp, Sorghum bicolor
  misc_feature: Ceres ANNOT ID no. 6008183
  misc_feature: Encodes the peptide sequence at SEQ ID NO 568
atgtcttcgtcggcgcttttgccggcgacgggaactccccacactgggtcatgtggcaaaacagcctctacaagttttactggttctaccaaacatgagctgagcttgcatgggaatgttaagccgttgcaattagcagcaaatggatcctctcgtttggcttacagaagcctagtacttaaaaatcagtggaatctttctgctagctcttcctctgcaaatgcagttaccacctttgatgatgatgaagttgtaccttccagtgttagtgatgaaaaaattggagtactgttattaaatcttggtggtccagagaccctcgacgatgttcaaccatttttgttcaacctatttgctgatccagatatcattcgactccctagactcttcaggtttcttcaaagaccactggctaaacttatttctacttttagagctcctaagagtaaagaagggtatgcttcaatcggtggtgggtctccgttaaggaaaattactgatgaacaggcaaatgctttgaagattgctctggaaaagaaaaacttgaacgcaaatatatatgttgggatgcggtattggtaccctttcacagaagaagccattgatcaaattaagaaggataagattaccaagctcgttgttcttccactttaccctcagtactccatatcaacgagtgggtcaagcattcgtgttctccaagacattgtcaaggaagattcatatttttctggtttgccaatttccattattgaatcatggtaccaacgagatggctatgtgaaatcaatggctgacctaattgaaaaagaactatctgccttttccaatcctgaagaggttatgatattcttcagtgcacatggtgtgccacttacctatgttgaggatgctggagatccttacagagatcagatggaggattgtattgctttgatcatgggggagttgagatcaagaggaatcttaaatagttacactttggcataccagagtcgggtggggccagttcaatggctgaagccatatactgatgaagttttagtagaacttggtcaaaagggtgtgaagagcctcctggctgttccagtaagctttgtgagcgagcacattgagacattggaagaaatcgacatggagtacaaggagttggctctagaatcaggcattaagaactggggtcgggttcctgctcttggatgtacttcaacattcatctccgaccttgcagatgctgtagtcgaagccctgccctctgcttcagcactagcaaccagaaagcctggagacactgattccagcatggacctgatgcattacctgaccaagatgttctttggctcgatcttggcatttgtcctgctgttatcaccaagactagtttcagctttccggaacaccatgctttag

SEQ ID NO: 568 - protein, 469 aa, Sorghum bicolor
  misc_feature: Ceres ANNOT ID no. 6008183
  misc_feature (93)..(417): Pfam Id: Ferrochelatase Pfam Desc: Ferrochelatase
  misc_feature (15)..(468): NCBI GI: 2460251 NCBI Desc: ferrochelatase [hordeum vulgare]
  misc_feature (15)..(468): NCBI GI: 1170242 NCBI Desc: ferrochelatase ii, chloroplast precursor (protoheme ferro-lyase) (heme synthetase)
  misc_feature (15)..(468): NCBI GI: 474966 NCBI Desc: ferrochelatase [hordeum vulgare subsp. vulgare]
  misc_feature (75)..(469): NCBI GI: 1170239 NCBI Desc: ferrochelatase ii, chloroplast precursor (protoheme ferro-lyase) (heme synthetase)
  misc_feature (29)..(466): NCBI GI: 79328715 NCBI Desc: ferrochelatase [arabidopsis thaliana]
  misc_feature (15)..(468): SWISSPROT Homolog: EC 4.99.1.1 Ferrochelatase-2, chloroplast precursor
MSSSALLPATGTPHTGSCGKTASTSFTGSTKHELSLHGNVKPLQLAANGSSRLAYRSLVLKNQWNLSASSSSANAVTTFDDDEVVPSSVSDEKIGVLLLNLGGPETLDDVQPFLFNLFADPDIIRLPRLFRFLQRPLAKLISTFRAPKSKEGYASIGGGSPLRKITDEQANALKIALEKKNLNANIYVGMRYWYPFTEEAIDQIKKDKITKLVVLPLYPQYSISTSGSSIRVLQDIVKEDSYFSGLPISIIESWYQRDGYVKSMADLIEKELSAFSNPEEVMIFFSAHGVPLTYVEDAGDPYRDQMEDCIALIMGELRSRGILNSYTLAYQSRVGPVQWLKPYTDEVLVELGQKGVKSLLAVPVSFVSEHIETLEEIDMEYKELALESGIKNWGRVPALGCTSTFISDLADAVVEALPSASALATRKPGDTDSSMDLMHYLTKMFFGSILAFVLLLSPRLVSAFRNTML

SEQ ID NO: 569 - DNA, 6522 bp, Sorghum bicolor
  misc_feature: Ceres ANNOT ID no. 6008197
  misc_feature: Encodes the peptide sequence at SEQ ID NO 570
atgtccaacctcggcggcgccgaggcgcacgcgcgcttcaagcagtacgactacggcgccaactccagcctcgtgctcaccaccgactcccgcccgcgcgacacccacgagcccacaggcgagcccgagacgctccggggcaggatcgacccgaggtccttcggcgaccgcgccgtccacaacaagccgcccgagctcgacgagaagctctccaaggcgcgatcaaaaaagtccaagcgccgggacgacgcgcccgacctcccccgccgcgacgccaagcgcaggcgccgcgccgcctccgtacacgaggtctccgtcctctctctcaccgaagacgccgtctacaagccccagaccaaggagacgcgcgccgcatacgaggccctgctcagcctcatccagcaccagctcggcggccagcccctcgacgtcctcgctggggccgccgacgaggtgctcgccacgctcaagaacgacaaggtcaagaaccctgacaagaagaaggtgatcgagcagctgctcaaccctatctccagccagctctttgaccagctcgtctccatcggcaagctcatcaccgacttccatgatgccggtgcaccttctgccgacgccatggacactaccctggatgatgatgttggggttgctgtcgagtttgaggaagatgaagccgaggagagtgattttgatcaggtgcaagatgacctggatgaggatgatgaagatgatgcagctgagttgaatggtcctggaggtatgcagatgggcagtgagttagacgacgacaacgacatgcacaacgccaaccaggggctggccgtcaatgttcaggacatcgatgcttactggctccagaggaagatatcccaggcatatggggatggggtcattgatgcccagcagggccagaagcttgccgaggatattttgaagatcattgctgagggcgacgacagagacatcgagaattgcctcctcatgctcttggactttgataagtttgatctcatcaagttgctgctacgcaaccgtctcaagattgtgtggtgtacccgcttagccagggccgaagatcaggaacagaggaagaagatagaggaagagatggcaagtgacccaagcttggctctgatattggagcagctacatgcaaccagagcatccgcaaaggagaggcagaagaacctggagaaaagcatcagggatgaggctaagaggctcctcaacaatgatgctgccgccggcgctgatggtgccagggaccgcagggcagccgagcgggacatggagagtggaatgctgaaaggacagaggaagctgcttgatctcaagagcctctcgttccagcagggtggtctctttatggctaacaagaaatgtgaacttcctactgggtcctttagaacctctcataagggatatgaggaggttcatgtgccagcactgaaggctatgccctatgaaacaggggagaagattgtcaagatatgtgatatgccagagtttgcacgggcagctttcgaagggatgacacagctgaacagagttcagagcagggtctatgatactgctcttttgaaaccagacaatatccttctctgtgctccaactggtgctggcaaaacaaacgtggctgtgcttaccatccttcaacagattggtatgcatatgcaggatggagagtttgacaataccaagtacaaaattgtctatgtggccccaatgaaagcattggtcgctgaagtcgttgggaacttgtcgaagcgtctggcaggttacaacgttactgtcaaggagctcagtggagatcagaacttgaccaagcaacagattgatgaaacacaggttattgtcacgacacctgagaaatgggatattgtaaccaggaaatcaggggacagaacctatacccaaatggtgaagctgttaatcattgatgagatccatctgctacatgataacagagggcctgttctggaaagtattgttgctaggactgtcaggcagattgagacaaccaaggagcatattcgtctggttgggctctctgcgactctaccaaactacgaagatgttgcactattcttgcgcgttcccaaagaaagcctcttctactttgacaacagttaccgaccttgccctcttgctcagcaatacattgggattacagtgaggaagccagtacagaggatgccattgatgaatgagatctgttatgagaaggttatggccgctgctggtaagcatcaagtgctcatatttgtacactcgaggaaggagacagcaataactgccaaagccatcagagacatggcgttggcaaatgacacagtcagccgctttctgaagaacgatagtgtaagccaagagatccttggcactaacgctgaacttgtcaaaagcaatgatcttaaagacctcctgccatatgggtttgctattcatcatgctggtatggcaagggttgaccgtgagcttgttgaggcactttatgctgacaagcacattcaagtacttgtatccactgctacccttgcatggggtgtcaatttgcctgcacatactgttattataaagggtacacagatttacaacccagaggaaggtgattggacagaactaagccctctggatgttatgcagatgcttggtcgtgcaggaaggcctcagtatgatacacatggagagggaataatcttgactagccacagtgaattgcggttctacctgtctcttatgaaccagcagctgcctattgagagtcagttcatatccaaattggctgatcaattgaatgcagagattgttctggggactattcagaatgctcgtgaagcatgctcgtggcttggctatacttacctctatatccggatgctccgaaatccaacattgtatggtttgccagcagatatcttggagagtgacaaaacacttgatgaaatgagagctgatttggtacattccgctgcaaatctactggataagaataatctgataaagtatgacaggaaaacaggatactttcaagttactgacctgggaaggattgccagttattactacattagtcatggaacaatctcaacatacaatgaatacctgaaacctacaatgggtgatatcgagctgtgtcgactgttttctctgagtgaagaatttaagtatgtaggtgtcaggctagatgagaaaatggaactggcaaagcttttggaccgtgtgccaattcctgtgaaagagagcttggacgaacccagtgcaaagataaatgttctgctgcaagcatatatttctaggttgaaactggaaggacattctcttagttctgatatggtctacatccaacagagtgctggacgtctcctacgagcactatttgagattgttttgaagaggggatgggctcaactagcagagaaagcgctgaatctttgcaggatggttgataaacaaatgtggagtgtccagactcccttgcggcaatttactggaattccaaaggcgatcttaatgaaactggagaaaaaggagttggcttgggagagatactatgatctgtcctcacaagaaattggtgaactaatccgctatcccaagatggggaggcagctgcacaagtgcatccaccagttaccaaagttgaatctttcagctcatgtccagcccatcactcgtacagttttgggctttgaactgacaattacacctgatttccagtgggatgataaggtacatggatatgtggagcccttttgggttattgttgaggataatgatggcgagtacattcttcacactgaatatttcatgcttaagaaacagtatgttgatgaagatcatactttgaacttcacagtgccaacatatgagccactgccgcctcaatatttcatacgtgttgtgtctgacaagtggcttggttctctgacaattctccctgtctgctttaggcacttgattctaccagaaaaatatgctccgccaactgaattgcttgatctgcagcctctacctgttagtgcattgaggaatgcaagatatgagggcctctatagtgcctttaagcatttcaatcccatccagactcaggtattcactgtcttgtataacaccgatgacagcgtgttggtcgctgcaccaacgggcagtgggaagacgatatgtgctgagtttgctatactaaggaaccaccagagggcagtgtccggtgagagcaacatgcgggtcgtttatatagctcccattgaagctctcacaaaagaaagatacagggactgggaacggaaatttggagaatttgccaaggtagttgagctcactggtgaaaccgcagctgatttgaagcttctggataaaggagaaatcataatcagtactcctgaaaagtgggatgcactgtctcgccggtggaaacagcgaaagcacatccaacaggtcagcttattcatagttgatgaacttcatctacttgggtctgataagggacatgttttggaagtcattgtatctaggatgaggcgtatttcaagtcatactggcagtaacatacggatcgtagcactttcagcttcacttgctaatgctaaggatctcggtgaatggattggtgctacctctcatggcctcttcaacttccctccagcagtgagacctgtgccattggaaatttacattcagggtgtggatatagcaaactttgaggcaaggatgcaagcaatgacaaagcccacctacactgccatcacacagcatgcaaagaacagtaaacctgccctggtgtatgtaccgacaaggaagcatgcaaggttgactgcattggacttgtgtgcatactctagtgttgacggtggtggaactctgtttctccttgggtcagaagatgagatggatactttcacccgaggtgttgaagaagagacacttaagaatacacttaaatgtggtgtaggatatgtgcatgagggtctaagtgaacttgatcaagaacttgtaacccagctgttccttgctgggaggatccaagtgtgtgttgcgagcagcacaatgtgttggggaagaccattgcctgctcatttggttgttgtcatggggacccagtattatgatggccgtgagaatgctcacactgattatccaattacagatcttcttcaaatgatgggtcatgccagcagaccacttaaagacaactcggggaaatgtgttatattgtgtcacgcacctcgcaaagagtactacaagaagttcctttttgaggccttccctgttgagagcaatcttcaccatttcttgcatgatcatatgaatgctgaggtggtggttggtgttgtagagaataagcaagatgccgtggattatcttacttggactttcatgtatcggcggctgacaaagaatcctaacttctacaatctccagggtgtaactcacaggcatctttcagatcatctttctgagctagttgaggctttcctgaatgatcttgaatcaagcaagtgtgtggctatagaggaggacatgtacctgaagcccctgaaccttggccttattgcttcatactactatgttagctacacgactattgagcgtttcagctctatgctgacccagaagactaagatgaaaggactcctagagattctagcatctgcttcagaatatgcagagcttctgggtcgtccgggtgaggaagaattcattgagaggcttgttcgccaccagaggttctctatcgacaagcctaagtatggtgatccacatgtgaaggccaatgctctgctgcaagcccatttttcaaggcacacagtggtcggaaacctggcagctgatcagcgtgagattcttttttctgcccataggttgctccaggcaatggttgatgttatatccagcaatggttggcttagcgttgctcttagtgcaatggagtcgagtcaaatggtgacacaaggcatgtgggatcgggattctgtgctgcttcaagttccacacttcacgaaagacatggcccggaggtgccaggaaaatgaagcgaagcccattgagagtatctttgatcttgctgaggtgggtgttgatgagatgcgggatcttttacagctatcaaactctcagctgcaggacatcattgaattcttcaagcggttccctaatgttgatatgacctatgtggtccgtgcgggtgacgatataagcactggtgacaatgtaaccgtgcaggtaacgctggagcgcgacatgactaacttgccatctgaggttggttcagtccatgcgccaaggttccccaagcccaaggaagaaggctggtggctggtgatcggtgacagctccacaaaccagttactggccatcaaaagagtggcactccagaagagggcgagagtgaaacttgagttctctgctcctccagaagcagggagaaaaaattacatgatttacttgatgtcagactcttacttgggctgtgaccaggagtatgagttcaccgttgatgtcaaggatgctggtggggattga

SEQ ID NO: 570 - protein, 2173 aa, Sorghum bicolor
  misc_feature: Ceres ANNOT ID no. 6008197
  misc_feature (1012)..(1317): Pfam Id: Sec63 Pfam Desc: Sec63 Brl domain
  misc_feature (1845)..(2165): Pfam Id: Sec63 Pfam Desc: Sec63 Brl domain
  misc_feature (515)..(693): Pfam Id: DEAD Pfam Desc: DEAD/DEAH box helicase
  misc_feature (1359)..(1532): Pfam Id: DEAD Pfam Desc: DEAD/DEAH box helicase
  misc_feature (807)..(891): Pfam Id: Helicase_C Pfam Desc: Helicase conserved C-terminal domain
  misc_feature (1355)..(1528): Pfam Id: ResIII Pfam Desc: Type III restriction enzyme, res subunit
  misc_feature (7)..(2169): NCBI GI: 54642194 NCBI Desc: ga19239-pa [drosophila pseudoobscura]
  misc_feature (69)..(2169): NCBI GI: 55233826 NCBI Desc: ensangp00000009625 [anopheles gambiae str. pest]
  misc_feature (206)..(2173): NCBI GI: 40217847 NCBI Desc: activating signal cointegrator 1 complex subunit 3-like 1 [homo sapiens]
  misc_feature (206)..(2173): NCBI GI: 20521660 NCBI Desc: kiaa0788 protein [homo sapiens]
  misc_feature (206)..(2173): NCBI GI: 45861372 NCBI Desc: 200 kda u5 snrnp-specific spliceosomal protein [homo sapiens]
MSNLGGAEAHARFKQYDYGANSSLVLTTDSRPRDTHEPTGEPETLRGRIDPRSFGDRAVHNKPPELDEKLSKARSKKSKRRDDAPDLPRRDAKRRRRAASVHEVSVLSLTEDAVYKPQTKETRAAYEALLSLIQHQLGGQPLDVLAGAADEVLATLKNDKVKNPDKKKVIEQLLNPISSQLFDQLVSIGKLITDFHDAGAPSADAMDTTLDDDVGVAVEFEEDEAEESDFDQVQDDLDEDDEDDAAELNGPGGMQMGSELDDDNDMHNANQGLAVNVQDIDAYWLQRKISQAYGDGVIDAQQGQKLAEDILKIIAEGDDRDIENCLLMLLDFDKFDLIKLLLRNRLKIVWCTRLARAEDQEQRKKIEEEMASDPSLALILEQLHATRASAKERQKNLEKSIRDEAKRLLNNDAAAGADGARDRRAAERDMESGMLKGQRKLLDLKSLSFQQGGLFMANKKCELPTGSFRTSHKGYEEVHVPALKAMPYETGEKIVKICDMPEFARAAFEGMTQLNRVQSRVYDTALLKPDNILLCAPTGAGKTNVAVLTILQQIGMHMQDGEFDNTKYKIVYVAPMKALVAEVVGNLSKRLAGYNVTVKELSGDQNLTKQQIDETQVIVTTPEKWDIVTRKSGDRTYTQMVKLLIIDEIHLLHDNRGPVLESIVARTVRQIETTKEHIRLVGLSATLPNYEDVALFLRVPKESLFYFDNSYRPCPLAQQYIGITVRKPVQRMPLMNEICYEKVMAAAGKHQVLIFVHSRKETAITAKAIRDMALANDTVSRFLKNDSVSQEILGTNAELVKSNDLKDLLPYGFAIHHAGMARVDRELVEALYADKHIQVLVSTATLAWGVNLPAHTVIIKGTQIYNPEEGDWTELSPLDVMQMLGRAGRPQYDTHGEGIILTSHSELRFYLSLMNQQLPIESQFISKLADQLNAEIVLGTIQNAREACSWLGYTYLYIRMLRNPTLYGLPADILESDKTLDEMRADLVHSAANLLDKNNLIKYDRKTGYFQVTDLGRIASYYYISHGTISTYNEYLKPTMGDIELCRLFSLSEEFKYVGVRLDEKMELAKLLDRVPIPVKESLDEPSAKINVLLQAYISRLKLEGHSLSSDMVYIQQSAGRLLRALFEIVLKRGWAQLAEKALNLCRMVDKQMWSVQTPLRQFTGIPKAILMKLEKKELAWERYYDLSSQEIGELIRYPKMGRQLHKCIHQLPKLNLSAHVQPITRTVLGFELTITPDFQWDDKVHGYVEPFWVIVEDNDGEYILHTEYFMLKKQYVDEDHTLNFTVPTYEPLPPQYFIRVVSDKWLGSLTILPVCFRHLILPEKYAPPTELLDLQPLPVSALRNARYEGLYSAFKHFNPIQTQVFTVLYNTDDSVLVAAPTGSGKTICAEFAILRNHQRAVSGESNMRVVYIAPIEALTKERYRDWERKFGEFAKVVELTGETAADLKLLDKGEIIISTPEKWDALSRRWKQRKHIQQVSLFIVDELHLLGSDKGHVLEVIVSRMRRISSHTGSNIRIVALSASLANAKDLGEWIGATSHGLFNFPPAVRPVPLEIYIQGVDIANFEARMQAMTKPTYTAITQHAKNSKPALVYVPTRKHARLTALDLCAYSSVDGGGTLFLLGSEDEMDTFTRGVEEETLKNTLKCGVGYVHEGLSELDQELVTQLFLAGRIQVCVASSTMCWGRPLPAHLVVVMGTQYYDGRENAHTDYPITDLLQMMGHASRPLKDNSGKCVILCHAPRKEYYKKFLFEAFPVESNLHHFLHDHMNAEVVVGVVENKQDAVDYLTWTFMYRRLTKNPNFYNLQGVTHRHLSDHLSELVEAFLNDLESSKCVAIEEDMYLKPLNLGLIASYYYVSYTTIERFSSMLTQKTKMKGLLEILASASEYAELLGRPGEEEFIERLVRHQRFSIDKPKYGDPHVKANALLQAHFSRHTVVGNLAADQREILFSAHRLLQAMVDVISSNGWLSVALSAMESSQMVTQGMWDRDSVLLQVPHFTKDMARRCQENEAKPIESIFDLAEVGVDEMRDLLQLSNSQLQDIIEFFKRFPNVDMTYVVRAGDDISTGDNVTVQVTLERDMTNLPSEVGSVHAPRFPKPKEEGWWLVIGDSSTNQLLAIKRVALQKRARVKLEFSAPPEAGRKNYMIYLMSDSYLGCDQEYEFTVDVKDAGGD

SEQ ID NO: 571 - DNA, 1065 bp, Sorghum bicolor
  misc_feature: Ceres ANNOT ID no. 6008199
  misc_feature: Encodes the peptide sequence at SEQ ID NO 572
atgtcaggcgacggggacgcgcgcggcctcgaggcggcggcgtccgccgcggccgaggcagcgcgggagctgcgggaggcggccgcggccctagtcgccacccgcgccgccgaggaggacgcgctgcgccgccgcgccgtggcgctcgacgccgacgtccgccgcctccagggctcgctccacgccctcgactcctccacgatcgacaaggtcgaggaggaactggagcgtgccagggtggcaatcacggatagtgatgtggcttcgtttctacctagcaagcgaaatgggaagtttcttaagacgtttctaggccctgtgaatgtgcgggtggcgaggaaagaagataagctcaaaatcaaggatgagtacaacaattatagggataggactgcctataagtttctgttgtttccatctatcctcctcctactgagatggtggatatgggatggatgccttccagcattggctgttcaaatttaccaggcttggttactatacctgtacacaagctttgctttgcgtgagaatgtattaattgcgaatggaagtgacattcgtccatggtggatatatcaccactatctagcaatgctgatggctcttattagccttacatgggagataaaaggacaacctgattgttctagcaagcagaggggggtgcaacttttcttgcgttgggcaatcatgcaaggcattgcaatgcatctacagaacagataccagcgccaaagattgcgtactcgaatagctctaggaaaggctaaaagaatggatgtcgtcgctggagaaacagctggtgtggaggggcagttgttgctgctatatcctgtccttttcatattacagggttttgaagcatatgttggagttttgcttcttcagacagctttgcatgggcttgcctcccagtggcaggttgtagtctgcgggatcttgctggtggttatggcagtcggcaactttgtcaacactatggagacactgctcctgaaactgaggttcaaagcaaagatgaagagagcaaagaacagacaggatcgcccacatcaaaattga

SEQ ID NO: 572 - protein, 354 aa, Sorghum bicolor
  misc_feature: Ceres ANNOT ID no. 6008199
  misc_feature (2)..(347): Pfam Id: TMPIT Pfam Desc: TMPIT-like protein
  misc_feature (3)..(348): NCBI GI: 140070513 NCBI Desc: loc548366 protein, related [medicago truncatula]
  misc_feature (11)..(305): NCBI GI: 115474821 NCBI Desc: os08g0152800 [oryza sativa (japonica cultivar-group)]
  misc_feature (43)..(331): NCBI GI: 30354641 NCBI Desc: transmembrane protein induced by tumor necrosis factor alpha [homo sapiens]
  misc_feature (55)..(346): NCBI GI: 53734460 NCBI Desc: zgc:103681 [danio rerio]
  misc_feature (43)..(331): NCBI GI: 13994300 NCBI Desc: transmembrane protein induced by tumor necrosis factor alpha [homo sapiens]
MSGDGDARGLEAAASAAAEAARELREAAAALVATRAAEEDALRRRAVALDADVRRLQGSLHALDSSTIDKVEEELERARVAITDSDVASFLPSKRNGKFLKTFLGPVNVRVARKEDKLKIKDEYNNYRDRTAYKFLLFPSILLLLRWWIWDGCLPALAVQIYQAWLLYLYTSFALRENVLIANGSDIRPWWIYHHYLAMLMALISLTWEIKGQPDCSSKQRGVQLFLRWAIMQGIAMHLQNRYQRQRLRTRIALGKAKRMDVVAGETAGVEGQLLLLYPVLFILQGFEAYVGVLLLQTALHGLASQWQVVVCGILLVVMAVGNFVNTMETLLLKLRFKAKMKRAKNRQDRPHQN

SEQ ID NO: 573 - DNA, 1620 bp, Sorghum bicolor
  misc_feature: Ceres ANNOT ID no. 6008217
  misc_feature: Encodes the peptide sequence at SEQ ID NO 574
atggcgtcgccgcaccttcccttcctctccttccccaaaaccctaccgccaccacctccaccgctcaagccccacgcccaccgcacctccctcgccgtcgccgctgctcctgctcccccgcccgccccgcctgacggcgcggggcccgccgcgcccacgcgtggcgaccgcttcctcggccgccagctggccaccgaggccgccgcgcgcgtgctcgcgcccgacgacgccgacaggcgccgccgacgcaaggagaagcgccgggcactgtcgcggaagccctccggcctcgcctcttgctacgggtgcggcgccccgctgcagacggcggaggaggccgcgccgggatacgtagaccccgacacgtacgaactgaaaaagaggcaccaccaactgagaaccgttctatgtggaaggtgcaagctgctctctcatggccacatggtcactgctgttggtggccacggcggttatcctgggggcaagcagtttgtttctgcggaacagctcagggagaagctgtcatacctccgtcacgagaaagcactgatagtcaaattggttgacatcgttgacttcaatgggagtttcctggcacgagtacgtgactttgctggtgcaaatccgattattcttgtgataacaaaggttgatctccttcccagagacactgatttgaattgcataggcgactgggttgtcgagtcagttgtcaagaagaagcttaatgtccttagtgtccatttgacaagctcaaagtcactggtcggtatcacaggggttatatcagagattcaacaggaaaagaagggttctgcaaatgttgggaaatctgcatttatcagtgcaatgctaagaacaatggcatacaaggatccggtggcagcggcagctcaaaaatacaagcctatacagtctgctgttcctggaacaacccttggccctattcaaattgaagcatttttaggcggagggaaattgtatgatacacctggagtccaccttcaccataggcaggcagcagttatccatgctgatgatctgccttctcttgcaccacaaagtcgtttgaaagggcgatgttttcccgctaatgatacagatgttgaattgagtgggaattcattattctgggctgggctagtccgcattgatgttgtcaaggctcttccacgcgcacggctgacattctatgggcccaagaagctaaagattaatatggtcccgacaacagaagcagatcaattttacgagactgaagttggagttacattgactccaccaactggtaaggagagagctgaaggatggcaagggcttcaaggtgttcgcgagttgaagataaagtatgaggaacgtgacaggcctgcttgtgacatcgcgatctctgggcttgggtggatttctgtggagccatcaggcgtgccctcaaacagctctgatgacaatgtcgaggaagaatacgatggcggtgagctgcatctggtagtacatgtacccaaaccggttgaggtcttcgtccgccccccattgcctgttggtaaagcagcgtcgcaatggtaccagtatcaagagctcacagaggaagaagaggagttgaggcctaaatggcactactga

SEQ ID NO: 574 - protein, 539 aa, Sorghum bicolor
  misc_feature: Ceres ANNOT ID no. 6008217
  misc_feature (142)..(295): NCBI GI: 108951298 NCBI Desc: nitric oxide synthase [oryza sativa (japonica cultivar-group)]
  misc_feature (101)..(235): NCBI GI: 108951289 NCBI Desc: nitric oxide synthase [arabidopsis thaliana]
  misc_feature (135)..(474): NCBI GI: 56963402 NCBI Desc: gtpase [bacillus clausii ksm-k16]
  misc_feature (182)..(471): NCBI GI: 52081117 NCBI Desc: gtp-binding protein [bacillus licheniformis atcc 14580]
  misc_feature (119)..(475): NCBI GI: 124522262 NCBI Desc: gtp-binding protein, hsr1-related [bacillus coagulans 36d1]
  misc_feature (29)..(539): SWISSPROT Homolog: EC 1.14.13.39 Nitric-oxide synthase 1
  misc_feature: Useful for making plants with modulated flowering time
  misc_feature: Functional homolog of the protein sequence given in SEQ ID NO 13928
MASPHLPFLSFPKTLPPPPPPLKPHAHRTSLAVAAAPAPPPAPPDGAGPAAPTRGDRFLGRQLATEAAARVLAPDDADRRRRRKEKRRALSRKPSGLASCYGCGAPLQTAEEAAPGYVDPDTYELKKRHHQLRTVLCGRCKLLSHGHMVTAVGGHGGYPGGKQFVSAEQLREKLSYLRHEKALIVKLVDIVDFNGSFLARVRDFAGANPIILVITKVDLLPRDTDLNCIGDWVVESVVKKKLNVLSVHLTSSKSLVGITGVISEIQQEKKGSANVGKSAFISAMLRTMAYKDPVAAAAQKYKPIQSAVPGTTLGPIQIEAFLGGGKLYDTPGVHLHHRQAAVIHADDLPSLAPQSRLKGRCFPANDTDVELSGNSLFWAGLVRIDVVKALPRARLTFYGPKKLKINMVPTTEADQFYETEVGVTLTPPTGKERAEGWQGLQGVRELKIKYEERDRPACDIAISGLGWISVEPSGVPSNSSDDNVEEEYDGGELHLVVHVPKPVEVFVRPPLPVGKAASQWYQYQELTEEEEELRPKWHY

SEQ ID NO: 575 - DNA, 687 bp, Sorghum bicolor
  misc_feature: Ceres ANNOT ID no. 6008225
  misc_feature: Encodes the peptide sequence at SEQ ID NO 576
atggacaaggctatcatgagcaataatcaggcaggcaaagtcttgaagaaaggaaaaaagaaacaggccaaggatgaactggatcgccagaagcaggctgagaagaagcggcgccgcctggagaaagcgctggcaaactcggctgccatcatctcagagctggaaaagaagaagcagaagaagaaggaagaacagcaaaggctggatgaggaaggtgctgccatagctgaagcagttgctcttcatgttctcataggtgaggactccgatgaaccctgccatttgatgctcaacaagcacatcaggtgcaaccattgggatgcctcggctgcttttgaattcaccgtggatgcacaatccactgatatctacccctctgatgatggactgatatgcgccagccatgcgtatgctcccagacccaaagggagatgggctgattgggggattggccagccattgccatcttggggagaagtgagtgacctccagggcccgtactatcaaggaacattccatcagtctgttacctgccctggtttcatagccgcccaagctgtgtcatcgttgcagatcagagaagagtcatcagagatcacctctccaagccaaggggcggctgctgcaaccgtggttaacaggatgcttggtggcaccaacaggctcaacctttacagagagatataa

SEQ ID NO: 576 - protein, 228 aa, Sorghum bicolor
  misc_feature: Ceres ANNOT ID no. 6008225
  misc_feature: The sequence is a functional homolog of SEQ ID NO 919 in the 10/666,642US patent application
  misc_feature: Useful for making plants with modulated growth and phenotype characteristics
  misc_feature: The sequence is a functional homolog of SEQ ID NO 919 in the 20070033671 US patent application
  misc_feature: The sequence is a functional homolog of SEQ ID NO 919 in the 10/666,642 US patent application
MDKAIMSNNQAGKVLKKGKKKQAKDELDRQKQAEKKRRRLEKALANSAAIISELEKKKQKKKEEQQRLDEEGAAIAEAVALHVLIGEDSDEPCHLMLNKHIRCNHWDASAAFEFTVDAQSTDIYPSDDGLICASHAYAPRPKGRWADWGIGQPLPSWGEVSDLQGPYYQGTFHQSVTCPGFIAAQAVSSLQIREESSEITSPSQGAAAATVVNRMLGGTNRLNLYREI

SEQ ID NO: 577 - DNA, 498 bp, Sorghum bicolor
  misc_feature: Ceres ANNOT ID no. 6008245
  misc_feature: Encodes the peptide sequence at SEQ ID NO 578
atggtgctggtgcgcaggtcgctcaccatgagccgcccccggagctgccacgacgctgacgaccgtggctggaatccgctccatgttgctgctcgcaagggagacctcaaggaggtccgacgtctgctggatgatggcatggacgtcaatgcacctgcatggggaccaaaatgtcctggtgctaccccacttcatctggctgctcagggtgggcatgttaaaatcatggatgaactattggagcgtggtgccaatattgatgctcgaaccaaaggggcctgtggctggactcctctacacattgctgccaaggaaaggaacaagaaggctgtgagattcctgattgagaatggagcattccttcctcctgagatgaatgaccataggttcaatccccccctccattactgctctgggttagaatgggcatatgagatgaagcgcgtgcaagacgaaagcgattcgcctggcgagacttcattgagttcggataactag

SEQ ID NO: 578 - protein, 165 aa, Sorghum bicolor
  misc_feature: Ceres ANNOT ID no. 6008245
  misc_feature (22)..(54): Pfam Id: Ank Pfam Desc: Ankyrin repeat
  misc_feature (59)..(91): Pfam Id: Ank Pfam Desc: Ankyrin repeat
  misc_feature (94)..(126): Pfam Id: Ank Pfam Desc: Ankyrin repeat
  misc_feature (21)..(138): NCBI GI: 108868779 NCBI Desc: ankyrin 2,3/unc44 [aedes aegypti]
  misc_feature (20)..(120): NCBI GI: 28373837 NCBI Desc: chain a, 4ank: a designed ankyrin repeat protein with four identical consensus repeats
  misc_feature (21)..(138): NCBI GI: 108868778 NCBI Desc: serine/threonine-protein kinase ripk4 [aedes aegypti]
  misc_feature (23)..(120): NCBI GI: 28373836 NCBI Desc: chain b, 3ank: a designed ankyrin repeat protein with three identical consensus repeats
  misc_feature (18)..(135): NCBI GI: 28274854 NCBI Desc: ankyrin repeat protein e4_8 [synthetic construct]
  misc_feature: The sequence is a functional homolog of SEQ ID NO 1839 in the 10/374,780US patent application
  misc_feature: The sequence is a functional homolog of SEQ ID NO 1841 in the 10/374,780US patent application
  misc_feature: Useful for making plants with modulated growth and phenotype characteristics
  misc_feature: The sequence is a functional homolog of SEQ ID NO 1839 in the 20060162006 US patent application
  misc_feature: The sequence is a functional homolog of SEQ ID NO 1841 in the 20060162006 US patent application
MVLVRRSLTMSRPRSCHDADDRGWNPLHVAARKGDLKEVRRLLDDGMDVNAPAWGPKCPGATPLHLAAQGGHVKIMDELLERGANIDARTKGACGWTPLHIAAKERNKKAVRFLIENGAFLPPEMNDHRFNPPLHYCSGLEWAYEMKRVQDESDSPGETSLSSDN

SEQ ID NO: 579 - DNA, 1815 bp, Sorghum bicolor
  misc_feature: Ceres ANNOT ID no. 6008247
  misc_feature: Encodes the peptide sequence at SEQ ID NO 580
  misc_feature: Down-regulated in shoot tissues in response to salicylic acid treatment
atggcttcagcgttcgggaccgggaccgcctccacttgcggcatcaagcctgcacctacaggagttgcgcttgctgcgcccaagatgcacctttccctcgtctcgccctcgctggtttcgcttccgcgcaagatgaggccccagaggaagtgcaacttcagagtaaacgccgcaaaggagctgcacttcaacaaggatggctcggctatcaggaaactgcaaaatggggtcaacaagcttgcagatctcgttggggttactcttggaccaaaggggcggaatgtagtcctcgagagcaagtatggctcacctaagattgtcaatgatggtgtcactgtggcaaaggaggttgaacttgaggaccctgtcgaaaatattggtgctaaattggtccgccaagctgctgctaaaacaaatgacttggctggtgacgggacaaccacttcggtcgtccttgctcaagggatgatcactgagggtgtaaaggttgtagctgctggtgctaatccagtgcagatcacccgtggtattgagaaaacagccaaagcgctagtcagcgaactccaaaagatgtccaaggaggttgaggacagtgagcttgctgatgttgctgcagttagtgctggaaataactatgaaattgggaatatgatagctgaggccatgaaaaaagttgggcggcagggagtggtcacacttgaagagggaaagagtgctgaaaataacctctatgttgtagagggaatgcagtttgaccgtggctatatttctccctactttgtaactgacagtgaaaaaatgacagtcgagtacgagaactgcaagctgctccttgtggacaagaaaattaacaacgccagagatcttatcactatcctggaggatgctattagaagtggatatccaattctaatagtcgcagaggatattgagcaggaagctcttgcaacccttgtggttaataggcttagaggtgcattgaagattgctgctatcaaggcccctggttttggagagcgcaagagtcaatatcttgatgacattgctactctcactggaggcactgtcatcagagaagaagttggattatccttagacaaggcagacaatcaggtcctaggaactgctgccaaggttgtagtaactaaggattcaacaacaatagtgggagatggcactacacaggaggaagtaaacaaaagggtgacacaaatcaagaaccagattgaggctactgaacaagaatatgagaaagaaaaactaaacgagaggatagctaaactctctggtggtgttgctgtcattcaggtaggagcacagacagaaactgagcttaaggaaaagaaactgagggttgaggatgccctgaatgctacaaaggcagcagttgaagaaggtattgttgtcggtggtggctgtacccttctgaggctttcatcaaaagttgatgcaattatagaaacccttgagaatgatgaacagaaggttggggctgaaattgtaaggaagtccttgagctatccacttaaattgattgcaaagaatgcaggtgttaatggcagtgtggttactgagaaggttcttgccaatgagaacttcaggtatgggtacaatgcggctacagggaagtacgaggatttgatggctgctggtatcattgatcccaccaaggtcgtgaggtgctgcttggagcatgctgcatcggtggcaaaaaccttcatcacctctgacgccgttgttgttgacattaaagtgcctgagcaagcacctgctcctgcaaacccaatggctggtggctcaggttttggattctaa

SEQ ID NO: 580 - protein, 604 aa, Sorghum bicolor
  misc_feature: Ceres ANNOT ID no. 6008247
  misc_feature (80)..(584): Pfam Id: Cpn60_TCP1 Pfam Desc: TCP-1/cpn60 chaperonin family
  misc_feature (1)..(603): NCBI GI: 806808 NCBI Desc: chaperonin precursor [pisum sativum]
  misc_feature (1)..(604): NCBI GI: 4204266 NCBI Desc: rubisco subunit binding-protein beta subunit [arabidopsis thaliana]
  misc_feature (1)..(604): NCBI GI: 81601 NCBI Desc: chaperonin 60 beta precursor - arabidopsis thaliana
  misc_feature (1)..(604): NCBI GI: 1762130 NCBI Desc: chaperonin-60 beta subunit
  misc_feature (21)..(604): NCBI GI: 79330970 NCBI Desc: atp binding / protein binding [arabidopsis thaliana]
  misc_feature: Useful for making plants with modulated nitrogen use efficiency
  misc_feature: Functional homolog of the protein sequence given in SEQ ID NO 13023
  misc_feature: Down-regulated in shoot tissues in response to salicylic acid treatment
MASAFGTGTASTCGIKPAPTGVALAAPKMHLSLVSPSLVSLPRKMRPQRKCNFRVNAAKELHFNKDGSAIRKLQNGVNKLADLVGVTLGPKGRNVVLESKYGSPKIVNDGVTVAKEVELEDPVENIGAKLVRQAAAKTNDLAGDGTTTSVVLAQGMITEGVKVVAAGANPVQITRGIEKTAKALVSELQKMSKEVEDSELADVAAVSAGNNYEIGNMIAEAMKKVGRQGVVTLEEGKSAENNLYVVEGMQFDRGYISPYFVTDSEKMTVEYENCKLLLVDKKINNARDLITILEDAIRSGYPILIVAEDIEQEALATLVVNRLRGALKIAAIKAPGFGERKSQYLDDIATLTGGTVIREEVGLSLDKADNQVLGTAAKVVVTKDSTTIVGDGTTQEEVNKRVTQIKNQIEATEQEYEKEKLNERIAKLSGGVAVIQVGAQTETELKEKKLRVEDALNATKAAVEEGIVVGGGCTLLRLSSKVDAIIETLENDEQKVGAEIVRKSLSYPLKLIAKNAGVNGSVVTEKVLANENFRYGYNAATGKYEDLMAAGIIDPTKVVRCCLEHAASVAKTFITSDAVVVDIKVPEQAPAPANPMAGGSGFGF

SEQ ID NO: 581 - DNA, 5388 bp, Sorghum bicolor
  misc_feature: Ceres ANNOT ID no. 6008256
  misc_feature: Encodes the peptide sequence at SEQ ID NO 582
  misc_feature: Down-regulated in root tissues in response to methyl jasmonate treatment
atggaaccctcgccctcctcccgccgccgctcccgcgccgccgccgccgccgacaagggcaaggaccccgacccctcctcctccgaccacccttctcccccggtccccgacgaagacgccgatgtgcccttcccccagtccttcacctccgccagcaccgccctccagggccttctccgcaggctcggcgccggcctcgacgacctcctcccctcctcctcctcagcgccctcctccgccacgtccggtcacctcaagaggatcctcgccggcctccaggcgcacggcgacgagtcgcgccagctccagtccctcatgcagctctgcgagatgctctccatcggcaccgaggactcgcttgccgccttcccagtcgacgccttcgtcccaatcctcgtcgggatgctcggccgcgaggacgagcctgccaccgctggtgccagcccagacgtcatgctgctcgctgcgcgggcactcgccaacctcgttgatgtgctcccctcctcctgctctgcggtcgtgcactacggggccatacagtgcttctgtgctcgactgctcaccatagagtacatggacctcgccgagcagtctctacaagcccttaagaagatctctctggagcacccaaccgcctgtttgcgagctggtgcgctaatggccgttctatcgtaccttgacttcttctccactggggttcagagggtagccttgtctactgctgcaaatatttgcaggaagctgccgtccgatgcttctgagtttgtcatggaagctgtccccttgctcacaaatctcctaaatcaccatgattccaaggtactggagcatgcttctgtttgtttgacacgcattgctgaagcttttgcccattaccccgacaaacttgatgaactctgcaatcatggattagttgctcaagctgctagcttgatagctgttggcaactcctctggccaggcgtcactgagtacatccacatatacaggcttaatccgtcttctctcaatatgtgcgagtggatccctgctggcagttaaaacactacttcttcttgggatcagcggcactcttaaagacattctttctggctctgctttgatttctggagcatcagtctcccctgctgtaacaaggcctgctgatcagatgtttgagattgtgagccttgctgatgatttacttccgcatatgcctgccagaatcattaagttaccaacatactaccatgcatataaaggctcttcaacaaagaaatctgcttccatcaaacaagagggggctggttcaacaggaaatgaaaggtctggccgtgagaggctattgcgtgagcaacctgagctcctacaacagttcggtatggatttgttacccacaatgacacaggtgtatggttctagtgtaaatgcaccaatacgtcacaagtgtttatcgatcattgggaagttaatgtactacagctccgctgagacaatccagtctctccttggcacaacaaacatatccagcttccttgcaggcattcttgcatggaaagatcctcaagtgttgattcctgctcttcagatagcagaaataatgatggaaaagcttccagaggcattttccaagctgtttgtgagggaaggtgtcgttcatgccgtggagtcacttatatgttcggaatcctccaacacaatgccttctcaggtgccacctcaggataaagataatgattctgccatgccatcacgtcctagacgtcaacgccggcgtgggggtgctgtggcagcagaaaatagttcattagatgaatcaaatagttccaaccttggggttacatgctcaacaacaatcacttcagaagctccaaataccagccttcgtttggcagttagcgatcatgcaaagtctttcaaagataaatacttcccggcagacactgattcaagtgatattggggttactgatgaccttcttaaactgagggcactctgtgcaaagttgaatactgtatctgagaatgtcaaaacaaaagccaaagggaaatcaaaagctataagcgctaattttttggacatctcaattgatgtcgaagaacaattagacaaaataatatctgaaattctctctgagcttagcaaagttaatggtgtttccacatttgaattcattagaagtggtgttgtcacagcattgcttgactatttgtcctgtgggacatttgggaaggaaaaggtatctgaaggaaacctacctcagcttcgtcagcaggtccttaggcgatacaagtccttcatatcggttgccctttctattgatcatgaacgggatgaaactcccatggcactgttggttcagaaactgcaaagtgcattgtcttcgctggaacgtttccctgttgtgctcagccagtctagtaggattggtattggagggtcccgtttgacttcaggtcttagtgctctggctcaacccttcaagcttcgtctgtcccgagctcaaggcgaaaaatcacttcgggattattcatcaaatattgtgcttatcgatccatttgccagtctagcagctgttgaagaattcctttggcccagagttcaacgcggtgaggttccgtcgaagcctataattccatctggtaataattctgaatctggggttcctggcaccacagctggtgcgtcattaacagctgcaatggctcaatctggtcggcgtccaacaacaagatcaaagtcgtctgctgcaggggttggtacatctaagaaggattctcatgatgaaagcactagtactgccaaagggaaaggcaaagctattgtaaagccaaactcagatgaatcaaaaggacctaatacaaggaatgctgcccgccaaaaatctgcttcagagaaagattcggaaatgaagcgagctcagggccacagtagttctgaggatgaagagcttgacacatctcctgttgagattgatgatgctttgatgattgatgatgatgacatttcagatgatgacgacgacgacgacgacgacgatgatcatgaggttctccaagaagggtctcttccaatctgttctcaagatggtgtgcatgatgtgaaactgagtgatgctgatgagtgtaacattggctcagccagttttagccaggcgcagccatcatctggttctggtgctagaaacacttctagcagggtaccggattctactgaatttcgaagtacaagcacattcggttcaagaggtgcaatgtcatttgttgctgcgacaatggctgggctggcttctgttggtggtcgcagtgttagaggtggccgagatcggcgtggtctgtcacttggaggtagcatgaatgatcacaataaacttatattcactgctggtgggaagcagcttagcaaacatttgactgtatatcaagctatccaacgtcaacttatgctcgacgaggatgatgaagaaaggtttaatggatctgatataccgaacgatggaaaccgtttctggggtgatgtgttcacaataacgtaccagaaggctgataaccaagttgagaagggatgccaagggacttccacctcattaaacataaaatcagattcatacaggtccatctctgaagcacaaggtgtttctcttcttgatagcatcttacaaggagaacttccttgtgatcttgagagaacaaactcaacatacaacattttagcattattgcgtgtactggaggggcttaatcagttatcctctcgtttaagactacagggagcatctgatgattttgctgagggaaaaatcactaccttggatgagctatatagaactggagccaaggtaccttctgaagtgtttgtcaatagcaaattgacaccaaagcttgctcggcaaatgcaggacgttctcgcactatgtagtggcagtttaccttcttggtgttatcaaatgaccaaggcctgcccatttctgtttccttttgagacaaggaggcagtacttctattccacagcctttgggttgtcgcgagcattgaatcgacttcagcaacagcagagtgacaatcacagctctggtggtgaaagagaggtccggtttggcaggttacaacgtcagaaagttcgtgtttcccgtaaccgtattctagattctgctgctaaagttatggagatgttctccagtcagagggctgttcttgaggtggaatactttggcgaagttggaactgggctggggcctactttggagttttatactctcttaagccatgaactacaaagtgctcaactgggattatggagatctagttcatatgattcaggattgcacattgataggaaggatgtgattagtttagatcctgaagatgactcatcaggaaaaggacccaacacagatctaccaggtgatggcaggcatttgatacaagctcctcttggattgttccctcgaccttggccacctaaagttgatgcttcagaaggtagcagattgttcaaagttttggagcatttccgcttaataggtcaagtgatggcaaaagtcctgcaagatggcagacttttagatttgcctttatcaacagcattttataagcttatacttggacaggaacttgatttgtttgacatagtctcatttgattctgagtttgggaagacattgcaagaactgcgagttcttgttgaacgaaagcagttccttgaatccacttgtggcaagaatcagctacaagttgcagatttgcgtttccatggtgcttctattgaagatttgtgtttagattttactcttccaggttatcctgattatgtgctcaaagagggggaaggaagcacaattgttaatatttacaatttagaagagtatattactttggtagtggatgctacagttaagtcagggataaagcgacaggttgaggcatttagatcagggtttaatcaggtgtttgacatgtcatccctccacatattttcacctcaagaacttgactatctaatatgtggccgacaagaaatttgggagttggaatcgctggtggataacataaaatttgatcatggatacactgctaaaagtcctgcgatcgttaatctacttgagattttgtcggaattcacccctgagcagcagcatgcgttctgccagtttgtaactggtgctcctcgtcttccacccggtggattggcagcccttaatcctaagcttactatagttaggaagcacccttcaagtgctgtgaatacttcaaattcaactggggcgacagagtcagctgatgatgatttacctagtgtgatgacatgcgccaattatctgaagcttcccccgtactccacaaaagaaatcatgcgcaagaagttgctttatgcgatcctggaaggccgaggatcgtttgatctttcataa

SEQ ID NO: 582 - protein, 1795 aa, Sorghum bicolor
  misc_feature: Ceres ANNOT ID no. 6008256
  misc_feature (1411)..(1795): Pfam Id: HECT Pfam Desc: HECT-domain (ubiquitin-transferase)
  misc_feature (37)..(1795): NCBI GI: 92878894 NCBI Desc: hect [medicago truncatula]
  misc_feature (8)..(1795): NCBI GI: 32965334 NCBI Desc: hect ubiquitin-protein ligase 3 [arabidopsis thaliana]
  misc_feature (13)..(1441): NCBI GI: 30692023 NCBI Desc: hect-domain-containing protein / ubiquitin-transferase family protein [arabidopsis thaliana]
  misc_feature (1075)..(1795): NCBI GI: 115443623 NCBI Desc: os02g0101700 [oryza sativa (japonica cultivar-group)]
  misc_feature (1467)..(1795): NCBI GI: 115461807 NCBI Desc: os05g0122400 [oryza sativa (japonica cultivar-group)]
  misc_feature: Down-regulated in root tissues in response to methyl jasmonate treatment
MEPSPSSRRRSRAAAAADKGKDPDPSSSDHPSPPVPDEDADVPFPQSFTSASTALQGLLRRLGAGLDDLLPSSSSAPSSATSGHLKRILAGLQAHGDESRQLQSLMQLCEMLSIGTEDSLAAFPVDAFVPILVGMLGREDEPATAGASPDVMLLAARALANLVDVLPSSCSAVVHYGAIQCFCARLLTIEYMDLAEQSLQALKKISLEHPTACLRAGALMAVLSYLDFFSTGVQRVALSTAANICRKLPSDASEFVMEAVPLLTNLLNHHDSKVLEHASVCLTRIAEAFAHYPDKLDELCNHGLVAQAASLIAVGNSSGQASLSTSTYTGLIRLLSICASGSLLAVKTLLLLGISGTLKDILSGSALISGASVSPAVTRPADQMFEIVSLADDLLPHMPARIIKLPTYYHAYKGSSTKKSASIKQEGAGSTGNERSGRERLLREQPELLQQFGMDLLPTMTQVYGSSVNAPIRHKCLSIIGKLMYYSSAETIQSLLGTTNISSFLAGILAWKDPQVLIPALQIAEIMMEKLPEAFSKLFVREGVVHAVESLICSESSNTMPSQVPPQDKDNDSAMPSRPRRQRRRGGAVAAENSSLDESNSSNLGVTCSTTITSEAPNTSLRLAVSDHAKSFKDKYFPADTDSSDIGVTDDLLKLRALCAKLNTVSENVKTKAKGKSKAISANFLDISIDVEEQLDKIISEILSELSKVNGVSTFEFIRSGVVTALLDYLSCGTFGKEKVSEGNLPQLRQQVLRRYKSFISVALSIDHERDETPMALLVQKLQSALSSLERFPVVLSQSSRIGIGGSRLTSGLSALAQPFKLRLSRAQGEKSLRDYSSNIVLIDPFASLAAVEEFLWPRVQRGEVPSKPIIPSGNNSESGVPGTTAGASLTAAMAQSGRRPTTRSKSSAAGVGTSKKDSHDESTSTAKGKGKAIVKPNSDESKGPNTRNAARQKSASEKDSEMKRAQGHSSSEDEELDTSPVEIDDALMIDDDDISDDDDDDDDDDDHEVLQEGSLPICSQDGVHDVKLSDADECNIGSASFSQAQPSSGSGARNTSSRVPDSTEFRSTSTFGSRGAMSFVAATMAGLASVGGRSVRGGRDRRGLSLGGSMNDHNKLIFTAGGKQLSKHLTVYQAIQRQLMLDEDDEERFNGSDIPNDGNRFWGDVFTITYQKADNQVEKGCQGTSTSLNIKSDSYRSISEAQGVSLLDSILQGELPCDLERTNSTYNILALLRVLEGLNQLSSRLRLQGASDDFAEGKITTLDELYRTGAKVPSEVFVNSKLTPKLARQMQDVLALCSGSLPSWCYQMTKACPFLFPFETRRQYFYSTAFGLSRALNRLQQQQSDNHSSGGEREVRFGRLQRQKVRVSRNRILDSAAKVMEMFSSQRAVLEVEYFGEVGTGLGPTLEFYTLLSHELQSAQLGLWRSSSYDSGLHIDRKDVISLDPEDDSSGKGPNTDLPGDGRHLIQAPLGLFPRPWPPKVDASEGSRLFKVLEHFRLIGQVMAKVLQDGRLLDLPLSTAFYKLILGQELDLFDIVSFDSEFGKTLQELRVLVERKQFLESTCGKNQLQVADLRFHGASIEDLCLDFTLPGYPDYVLKEGEGSTIVNIYNLEEYITLVVDATVKSGIKRQVEAFRSGFNQVFDMSSLHIFSPQELDYLICGRQEIWELESLVDNIKFDHGYTAKSPAIVNLLEILSEFTPEQQHAFCQFVTGAPRLPPGGLAALNPKLTIVRKHPSSAVNTSNSTGATESADDDLPSVMTCANYLKLPPYSTKEIMRKKLLYAILEGRGSFDLS

SEQ ID NO: 583 - DNA, 1161 bp, Sorghum bicolor
  misc_feature: Ceres ANNOT ID no. 6008258
  misc_feature: Encodes the peptide sequence at SEQ ID NO 584
atggcgaagcccatctccattgaggtgtggaaccccagcggcaagtaccgcgtggtgagcaccaagtccatgccgggcacgcgatggatccgcctgctcaccgacaacgactgccgccttgagatatgcaccgagcagaagaccatcctctcagtggacgacatcctggcgctcatcggcgatcgctgtgacggcgtgattggacagctcactgaggactggggggacgtgctcttctctgcgctcaagcgcgccggaggcacggccttcagcaacatggccgtcggctacaacaacgtcgacgtcgaggctgccaacaggaacggaatcgccgtcggcaacacgcctggtgttctgacggagacgacggctgagctcgcggcctccctcacgctgtcggcagccaggaggatcgtcgaggccgaccagttcatgagggctggtctctacgacggatggctcccacacctgttcgttggcaacctgctcaaggggcagactgttggagtcattggagctggtcgcattggctctgcctatgcacgcatgatgattgagggcttcaagatgaatctcatctactacgacctgtatcaggccacacggcttgagaagtttgtcacagcatatgggcagttcctgaaagcaaatggtgaggagcctgtcacctggaagagggccgccaccatggaggatgtcctcagggaggctgatgtgataagtctgcatccggttctggacaagaccacgtaccatctgataaaccctgaaaggctggccatcatgaagaaggaggctgttcttgtgaatgcaagccgagggcccgtgatcgatgaagtcgccctggtggagcacctcaaggctaaccccatgtttcgtgttggcctcgacgtctttgaggatgagccttacatgaaacctggtctcgctgacatgaagaatgccgtcgttgtgccgcacattgcatcagcctccaagtggacccgtgagggaatggcaacactgactgctctcaacgttcttggtaagatcaagggttaccctgtgtggggaaaccccaatcaggtggagcccttcttggacgagaattcgacgccaccgcgtgcctgcccaagcatcgttaatgccaaacagcttggcctgccatcggcaaagctttag

SEQ ID NO: 584 - protein, 386 aa, Sorghum bicolor
  misc_feature: Ceres ANNOT ID no. 6008258
  misc_feature (128)..(322): Pfam Id: 2-Hacid_dh_C Pfam Desc: D-isomer specific 2-hydroxyacid dehydrogenase, NAD bindingdomain
  misc_feature (18)..(357): Pfam Id: 2-Hacid_dh Pfam Desc: D-isomer specific 2-hydroxyacid dehydrogenase, catalyticdomain
  misc_feature (1)..(386): NCBI GI: 13873334 NCBI Desc: hydroxypyruvate reductase [bruguiera gymnorrhiza]
  misc_feature (1)..(386): NCBI GI: 118723307 NCBI Desc: hydroxypyruvate reductase [solenostemon scutellarioides]
  misc_feature (1)..(386): NCBI GI: 2055273 NCBI Desc: hydroxypyruvate reductase [arabidopsis thaliana]
  misc_feature (1)..(386): NCBI GI: 1304042 NCBI Desc: hydroxypyruvate reductase [cucurbita cv. kurokawa amakuri]
  misc_feature (1)..(381): NCBI GI: 1304044 NCBI Desc: hydroxypyruvate reductase [cucurbita cv. kurokawa amakuri]
  misc_feature (1)..(380): SWISSPROT Homolog: EC 1.1.1.29 Glycerate dehydrogenase
MAKPISIEVWNPSGKYRVVSTKSMPGTRWIRLLTDNDCRLEICTEQKTILSVDDILALIGDRCDGVIGQLTEDWGDVLFSALKRAGGTAFSNMAVGYNNVDVEAANRNGIAVGNTPGVLTETTAELAASLTLSAARRIVEADQFMRAGLYDGWLPHLFVGNLLKGQTVGVIGAGRIGSAYARMMIEGFKMNLIYYDLYQATRLEKFVTAYGQFLKANGEEPVTWKRAATMEDVLREADVISLHPVLDKTTYHLINPERLAIMKKEAVLVNASRGPVIDEVALVEHLKANPMFRVGLDVFEDEPYMKPGLADMKNAVVVPHIASASKWTREGMATLTALNVLGKIKGYPVWGNPNQVEPFLDENSTPPRACPSIVNAKQLGLPSAKL

SEQ ID NO: 585 - DNA, 1257 bp, Sorghum bicolor
  misc_feature: Ceres ANNOT ID no. 6008269
  misc_feature: Encodes the peptide sequence at SEQ ID NO 586
atggatgcctccaagctccgcgagcttcgcgacttcgtcgaggcgtgcaagaaggacccttccctcctcgccgaccccagcctcgccttcttccgggattacctccagagtctgggtgccaaaattccacccgccgctgccgcctccttcgagaagcccaagagatcttccatggacgacattgatgatgatgatgatgacggcgatctggatatgagggatcccactcctgagccagacgagctcgatgaggagattgttgagtctgatcttgagcttgaaggagacattgtacagtctgaccatgatgacccaccacagaagatgggtgatccttcggtggaggtgactgaggaaaatcgtgatgcctctcaagaagcaaaaggcaaggctatggaagcaatgtctgaaggaaaactcgaagatgctattgaacaccttaccaacgcaattgtgctgaatccactctcagcaatcatgtatggtactagagcatctgtgtttataaaaatgaagaaaccaactgctgccattcgtgatgccaatgctgctctagagatcaacccagactctgcaaaaggctataaaactcgtggaatggcatatgccatgcttggcaaatgggaggaagccgctcgtgatctgcacacagcatctaacatggattatgatgaggagatcagtgctgtgctcaagaaggtggagcctaatgctcacaagatagtggaacatcgcaggaagtacgagaggctgagaaaagagagggaggaaaagagagcagagcgtgatcggcttcgtcgacgtgcagaggcacaggctgcttatgacaaggccaagaggaaggagcaatcgtcaagtcgctcatcaggaggtgcatctcccagaggtttccctggagggatgcccggtggaggtttccctggagggatgcccggtggaggtttccctggagggatgcccagtggaggtttccctggagggatgtccggtgggggtttccctggagggatgcctggtgggggtttccctgggagtggcatgcctggaggtttccctgggggtggcatgcctggaaatgttgatatgagtaaaatcctgaatgaccctgacctgatggcagcattcagtgacccagaggtcatggcggcgctacaagatgtgatgaacaatcctgccaactttgctaagcaccaagcgaatcccaaggtgggccctatcatcacaaagatgatggccaagttcagtgggtcccagtga

SEQ ID NO: 586 - protein, 418 aa, Sorghum bicolor
  misc_feature: Ceres ANNOT ID no. 6008269
  misc_feature (158)..(191): Pfam Id: TPR_1 Pfam Desc: Tetratricopeptide repeat
  misc_feature (1)..(386): NCBI GI: 21593067 NCBI Desc: hsp associated protein like [arabidopsis thaliana]
  misc_feature (38)..(377): NCBI GI: 7269113 NCBI Desc: hsp associated protein like [arabidopsis thaliana]
  misc_feature (107)..(393): NCBI GI: 30421186 NCBI Desc: abi3-interacting protein 1; cnaip1 [chamaecyparis nootkatensis]
  misc_feature (1)..(270): NCBI GI: 14581677 NCBI Desc: hsp70 interacting protein/thioredoxin chimera [vitis labrusca]
  misc_feature (1)..(391): NCBI GI: 49522464 NCBI Desc: mgc89381 protein [xenopus tropicalis]
  misc_feature: Useful for making plants with altered terpenoid content
  misc_feature: GREAT-hit functional homolog of the protein sequence given in SEQ ID NO 13123
  misc_feature: Useful for making plants with altered terpenoid content
  misc_feature: Functional homolog of the protein sequence given in SEQ ID NO 13123
MDASKLRELRDFVEACKKDPSLLADPSLAFFRDYLQSLGAKIPPAAAASFEKPKRSSMDDIDDDDDDGDLDMRDPTPEPDELDEEIVESDLELEGDIVQSDHDDPPQKMGDPSVEVTEENRDASQEAKGKAMEAMSEGKLEDAIEHLTNAIVLNPLSAIMYGTRASVFIKMKKPTAAIRDANAALEINPDSAKGYKTRGMAYAMLGKWEEAARDLHTASNMDYDEEISAVLKKVEPNAHKIVEHRRKYERLRKEREEKRAERDRLRRRAEAQAAYDKAKRKEQSSSRSSGGASPRGFPGGMPGGGFPGGMPGGGFPGGMPSGGFPGGMSGGGFPGGMPGGGFPGSGMPGGFPGGGMPGNVDMSKILNDPDLMAAFSDPEVMAALQDVMNNPANFAKHQANPKVGPIITKMMAKFSGSQ

SEQ ID NO: 587 - DNA, 1476 bp, Sorghum bicolor
  misc_feature: Ceres ANNOT ID no. 6008272
  misc_feature: Encodes the peptide sequence at SEQ ID NO 588
  misc_feature: Up-regulated in root tissues in response to salicylic acid treatment
atgggctcgaaatcggtagacgaggtgctcgatgccgccgccgccgccggagtccattactccgcactccgtctggacggcctcaacacccaggtttccgccgcctcgtacgaggaacaaccaacgacgtctggcctggagaatggccaccaggagccctttgttattggtgttgctgggggtgcatcgtcaggcaaaagtaccgtgtgcaagatgatcattgatcagctccgtgaccagcgtgttgtggttgttacgcaggagtccttttattatggattgacggatgaagaattagtccatgtccatgattataactttgatcacccagatgcatttcatacagagctacttctctcttgtatgcaaaacttgaaacgtggcaaagctgtcgacatccctaattacaacttcaagacatacaagagtgtcccaaatgcaaggaaggttaatccatcggatgttattattttggaaggaattctagtttttcatgactcgcgcctcagggatttgatgaacatgaagatcttcgttgatacagatgctgacgtacggttaacaaggaggatccgtcgtgataccattgacaagggtagagatatcaaagctgtgttagatcagtactcaaaatttgttaagcctgcttttgaagacttcatcctcccaacaaagaagtatgctgatattatcatcccacgaggtggagacaatgatgtggcaattgacctaattgttcagcatattcggactaaacttggacaacatgatctttgtaaaatacaccccaatttgtatgtaattcagactacttatcagatacgaggcatgcacacaataataagggatgctgccacagcaacacatgatttcatattttatgctgatcggttgattcgattggttgtcgaacatggtcttggtcatcttcctttccaggaaaagcaggtcatcactccgactggatctgtttacactggtgtggagttctccaaaaggttgtgtggtatctcagtgatcaggagtggcgaaagcatggagaatgcactacgggcatgctgtaaaggtataaagattgggaagattcttattcatcgggaaggagacaatggacaacagctcatctatcaaaatttaccaaaagatattgcaaataggcatgttctgctgttggaccccatattgggaacaggaaattcagcagttcaagccatctcccttttattgaagaagggtgtacaggaagcaaatattatatttcttaatcttatttcagcgccccaaggagtgcatgtggtgagcaagagattccctagagtgaagatcgttacttcggagattgagtttggtctaaatgatgatttccgtgtcgtacctgggatgggcgaatttggagacagatactttggaacagatgattatcagtcattgacgccattcttctgtgacgataaaaatcgtgtcaggctcttgtga

SEQ ID NO: 588 - protein, 491 aa, Sorghum bicolor
  misc_feature: Ceres ANNOT ID no. 6008272
  misc_feature (55)..(241): Pfam Id: PRK Pfam Desc: Phosphoribulokinase / Uridine kinase family
  misc_feature (286)..(433): Pfam Id: Pribosyltran Pfam Desc: Phosphoribosyl transferase domain
  misc_feature (1)..(473): NCBI GI: 92874915 NCBI Desc: phosphoribosyltransferase; aaa atpase; phosphoribulokinase/uridine kinase [medicago truncatula]
  misc_feature (1)..(473): NCBI GI: 110737140 NCBI Desc: uracil phosphoribosyl transferase like protein [arabidopsis thaliana]
  misc_feature (72)..(473): NCBI GI: 30687242 NCBI Desc: uracil phosphoribosyltransferase / ump pyrophosphorylase (upt1) [arabidopsis thaliana]
  misc_feature (12)..(473): NCBI GI: 115480023 NCBI Desc: os09g0505800 [oryza sativa (japonica cultivar-group)]
  misc_feature (182)..(324): NCBI GI: 8778301 NCBI Desc: f14j16.5 [arabidopsis thaliana]
  misc_feature (277)..(473): SWISSPROT Homolog: EC 2.4.2.9 Uracil phosphoribosyltransferase
  misc_feature (48)..(250): SWISSPROT Homolog: EC 2.7.1.48 Uridine-cytidine kinase 2
  misc_feature: Up-regulated in root tissues in response to salicylic acid treatment
  misc_feature: The sequence is a functional homolog of SEQ ID NO. 532 in the 11/188,298 US application
MGSKSVDEVLDAAAAAGVHYSALRLDGLNTQVSAASYEEQPTTSGLENGHQEPFVIGVAGGASSGKSTVCKMIIDQLRDQRVVVVTQESFYYGLTDEELVHVHDYNFDHPDAFHTELLLSCMQNLKRGKAVDIPNYNFKTYKSVPNARKVNPSDVIILEGILVFHDSRLRDLMNMKIFVDTDADVRLTRRIRRDTIDKGRDIKAVLDQYSKFVKPAFEDFILPTKKYADIIIPRGGDNDVAIDLIVQHIRTKLGQHDLCKIHPNLYVIQTTYQIRGMHTIIRDAATATHDFIFYADRLIRLVVEHGLGHLPFQEKQVITPTGSVYTGVEFSKRLCGISVIRSGESMENALRACCKGIKIGKILIHREGDNGQQLIYQNLPKDIANRHVLLLDPILGTGNSAVQAISLLLKKGVQEANIIFLNLISAPQGVHVVSKRFPRVKIVTSEIEFGLNDDFRVVPGMGEFGDRYFGTDDYQSLTPFFCDDKNRVRLL

SEQ ID NO: 589 - DNA, 999 bp, Sorghum bicolor
  misc_feature: Ceres ANNOT ID no. 6008352
  misc_feature: Encodes the peptide sequence at SEQ ID NO 590
atggccgtgcaagcgcaattcggcggcctcctgctccccccacccttcgcggccgaggaggagcagcagatgctggcgctcaaggactacggcgcgctcctctccgccgccgcggcgacgcccggtgtcgccggtggctacgcgtggcagcactacgactactgcgccgcgcagagcgagctcacgtgcaacggcggtggcggggcggcgctgtccgtgcccgtgccctcgcgcaagcgcggcagggaggaggacgagggcgacgacctccttcactacgcgccgttcctgcctctcccggtgacgcggcggccgcactccgccacgccgccggcggcggctgcggcgtcgacgagcggccgggaagaagagatgtcggcggagcacgcgctgtggcggcggctgcagcacggcgcggaggtggacgcgctggtgcgcgccgagtgcgaccgcctgcgcgcggggctggagctggcgcggagacggcagcgccaggcgctggtccgcgccgcggccgtgtccgtctcggcgatggccgggcgggtgcgtgacgccgaggcgcagctggaggcctgccggcgccgtgccgcggagctcgaggagggggtccggcttgcggccgccgatgcgcaggcgtggcgcggcgtcgcgcggggcaacgaggccgtcgccgcggggctccaagccacgctcgacgcgctcctcctccgttcctcctcggccgagggattcggcgactccgaccccgacgacgcgcagtcgtgctgctgcttctacgtcgaggaggcgccggacaccgccgccgccgccacggcctcgtcgtcctcgacttggagcggcaagtgggcgtgcaaggcgtgcggcgtgggggaggcgtcggtgctgctgctgccgtgccggcacctgtgcctgtgcaaggcgtgcgagcggcggacggacgcgtgccccgtctgctccggcgacaagaacgcggccatccacatcgcgccgcccatctga

SEQ ID NO: 590 - protein, 332 aa, Sorghum bicolor
  misc_feature: Ceres ANNOT ID no. 6008352
  misc_feature (25)..(328): NCBI GI: 38346144 NCBI Desc: osjnbb0118p14.4 [oryza sativa (japonica cultivar-group)]
  misc_feature (113)..(328): NCBI GI: 38346142 NCBI Desc: osjnbb0118p14.2 [oryza sativa (japonica cultivar-group)]
  misc_feature (150)..(331): NCBI GI: 49388268 NCBI Desc: sbp1-like [oryza sativa (japonica cultivar-group)]
  misc_feature (150)..(331): NCBI GI: 115446417 NCBI Desc: os02g0524500 [oryza sativa (japonica cultivar-group)]
  misc_feature (76)..(328): NCBI GI: 45602841 NCBI Desc: s-ribonuclease binding protein sbp1 [petunia x hybrida]
MAVQAQFGGLLLPPPFAAEEEQQMLALKDYGALLSAAAATPGVAGGYAWQHYDYCAAQSELTCNGGGGAALSVPVPSRKRGREEDEGDDLLHYAPFLPLPVTRRPHSATPPAAAAASTSGREEEMSAEHALWRRLQHGAEVDALVRAECDRLRAGLELARRRQRQALVRAAAVSVSAMAGRVRDAEAQLEACRRRAAELEEGVRLAAADAQAWRGVARGNEAVAAGLQATLDALLLRSSSAEGFGDSDPDDAQSCCCFYVEEAPDTAAAATASSSSTWSGKWACKACGVGEASVLLLPCRHLCLCKACERRTDACPVCSGDKNAAIHIAPPI

SEQ ID NO: 591 - DNA, 1038 bp, Sorghum bicolor
  misc_feature: Ceres ANNOT ID no. 6008360
  misc_feature: Encodes the peptide sequence at SEQ ID NO 592
atggccgtgcaagcgcagttcggcggcctcgccgggtgcctattcccctacggcggcggcggcggcgggtgggccgaagatcagctgcaggcgctcctgtcagccgccgctgcgggcaacaacaagcaggcgcagcagcagtaccactgcgccgccggtggcgtggccagcgccgcgcagagcgagctgacctgcaacggcgggggcggtttgggtggcgtggtggcgtcgcggaagcgcggcagggacggcgacctcgagccgcagtaccaccaccacgtgccgtcctcgtcggccgcgctgctcccgatcccgccggcggtgaacatcgcgagcagtagccgcatggcggactccgcggcggcgtccaccagcgggcggcgcctgctgctaccgacggcggacgcgctgttggcggacgaactgcgccggcagggcgcggaggtggacgcgctggtgcgcgccggctgcgagcgcctccggtccgggctggagcgcgctcgcaagcggcagtgcgaggcgctggcgcgcgccgccgcggcgtcggccaccgcgcacgcgctgcgggagaaggaagccgagctggccgccgcccggcgccgcgcgcaggagctcgaggagcggctgcggcaggcggccgccgagacgcaggcgtggtgcggcctggcgcgcagcaacgaggccgccgcgtcgggcctgcgcgccacgctcgacgcgctgctcctccgcgccggcgccggtggcggttgcgtcacggcgcagcacgcagctgaggaggaggggttcggcgagtccggcggcggcggcgcggacgacgacgcgcagtcgtgctgcttcgtcgaggccggcgcgccgtcgtcgtggaagccccccgcggcgaagtgggcgtgcagggcgtgcggcgagggggaggcgtcggtgctgctgctgccgtgccggcacctgtgcctgtgcaaagcgtgcgagcccagggcggacgtgtgccccgtctgctccggcgacaagaacgcggccatccacatcgcgccgcccaactga

SEQ ID NO: 592 - protein, 345 aa, Sorghum bicolor
  misc_feature: Ceres ANNOT ID no. 6008360
  misc_feature (1)..(341): NCBI GI: 38346144 NCBI Desc: osjnbb0118p14.4 [oryza sativa (japonica cultivar-group)]
  misc_feature (33)..(341): NCBI GI: 38346142 NCBI Desc: osjnbb0118p14.2 [oryza sativa (japonica cultivar-group)]
  misc_feature (158)..(344): NCBI GI: 49388268 NCBI Desc: sbp1-like [oryza sativa (japonica cultivar-group)]
  misc_feature (158)..(344): NCBI GI: 115446417 NCBI Desc: os02g0524500 [oryza sativa (japonica cultivar-group)]
  misc_feature (77)..(341): NCBI GI: 21593126 NCBI Desc: inhibitor of apoptosis-like protein [arabidopsis thaliana]
MAVQAQFGGLAGCLFPYGGGGGGWAEDQLQALLSAAAAGNNKQAQQQYHCAAGGVASAAQSELTCNGGGGLGGVVASRKRGRDGDLEPQYHHHVPSSSAALLPIPPAVNIASSSRMADSAAASTSGRRLLLPTADALLADELRRQGAEVDALVRAGCERLRSGLERARKRQCEALARAAAASATAHALREKEAELAAARRRAQELEERLRQAAAETQAWCGLARSNEAAASGLRATLDALLLRAGAGGGCVTAQHAAEEEGFGESGGGGADDDAQSCCFVEAGAPSSWKPPAAKWACRACGEGEASVLLLPCRHLCLCKACEPRADVCPVCSGDKNAAIHIAPPN

SEQ ID NO: 593 - DNA, 1449 bp, Sorghum bicolor
  misc_feature: Ceres ANNOT ID no. 6008388
  misc_feature: Encodes the peptide sequence at SEQ ID NO 594
atgctgccggcggctgccaccgctgcagcgccggacccctcgtgctccaccttcccctcctcccgccgcgctcccactgccgcttcgcgtcacagcttcgttgtcgcaacaagagccaccaccggcagcagcagcagctcgggcctcttctctctccggtgtcacggtcgccttccctgccgctctcgctgtcgctgccacgcctggtggaacaataatgagcgagcgcgccggggctctggcgccagccgcggtcgccattgccgggccgtcgcgtcggcgccggaccacatggacgagcagccggcgagggggaggtaccacccgttcgaggagatcgccgaggcggtgcagctggacgacggcgagccggcccacctcaccgacgccgagtccgcccgaacaatcgtcgaggtgaacaacaaggcgacggtgatgatctccacgctcgtcggcgacggcgtgcaggagcggatcattctcccggagttcccctacctcaccgacgagaacggagatatctacttcgaggtcgacaacgaggacgcgctgctggagagcgtcatgggggaggacaagatcgcgcacgttatcatcggattggataacacgcaggtctttgccgacttggatctcgcagcagcctcaggcacagattttgcacaagaagatgatgacggcgatgaggacgatgacggctccgacgacgacgaggaaagcgactttgatgacgacttcaacgacgtggagggtgtgttttcggttgatgaggacgacgaagatgacgatgaggacgaggacgatgacgacgacctaccaagctggtccaacctcgagaccgtgaattcttgccatccattgtactttgcaaggatgatcgtagagactgcaaccaagaataacatagactggttggaccgtccacctgcaagccttgttgtcgagggccagctgagacctgcctttgctgaggagagcaccatggttgccaagcatatatcaagtgatgcgccaaaggaagataaaaaggagagtggtgccacctttttcaaggtcgaggtcctcagcattgagttgatcactgcatatggaactgagccaaaggtaaagattgaagaataccaaaaggctaagcccgacatcattgcgcattctgcaccaaacgtaatatcgcgcctgagagctggtggagacaagatcacacaggccctgaaatctctctgctggaggtgcaaggccattcaagtagaggaggcagcggtgatcggagtggactgccttggatttgacttgagagtgtgttcaggaactcaagtgcagacattgagatttgctttccctaccaaggctacttccgagttcgccgcagagaagcaaatacatgagctgctgtttcctaggaatacacatcaagaagggcaatcgccacaagcacaacagaattcatga

SEQ ID NO: 594 - protein, 482 aa, Sorghum bicolor
  misc_feature: Ceres ANNOT ID no. 6008388
  misc_feature (24)..(249): NCBI GI: 115485811 NCBI Desc: os11g0544000 [oryza sativa (japonica cultivar-group)]
  misc_feature (216)..(271): NCBI GI: 35210492 NCBI Desc: aspartic acid-rich protein aspolin1 [theragra chalcogramma]
  misc_feature (213)..(271): NCBI GI: 126437618 NCBI Desc: aaa atpase containing von willebrand factor type a (vwa) domain-like [mycobacterium sp. jls]
  misc_feature (217)..(271): NCBI GI: 108801632 NCBI Desc: aaa atpase containing von willebrand factor type a (vwa) domain-like protein [mycobacterium sp. mcs]
  misc_feature (111)..(271): NCBI GI: 119504419 NCBI Desc: vcbs protein [marine gamma proteobacterium htcc2080]
MLPAAATAAAPDPSCSTFPSSRRAPTAASRHSFVVATRATTGSSSSSGLFSLRCHGRLPCRSRCRCHAWWNNNERARRGSGASRGRHCRAVASAPDHMDEQPARGRYHPFEEIAEAVQLDDGEPAHLTDAESARTIVEVNNKATVMISTLVGDGVQERIILPEFPYLTDENGDIYFEVDNEDALLESVMGEDKIAHVIIGLDNTQVFADLDLAAASGTDFAQEDDDGDEDDDGSDDDEESDFDDDFNDVEGVFSVDEDDEDDDEDEDDDDDLPSWSNLETVNSCHPLYFARMIVETATKNNIDWLDRPPASLVVEGQLRPAFAEESTMVAKHISSDAPKEDKKESGATFFKVEVLSIELITAYGTEPKVKIEEYQKAKPDIIAHSAPNVISRLRAGGDKITQALKSLCWRCKAIQVEEAAVIGVDCLGFDLRVCSGTQVQTLRFAFPTKATSEFAAEKQIHELLFPRNTHQEGQSPQAQQNS

SEQ ID NO: 595 - DNA, 1647 bp, Sorghum bicolor
  misc_feature: Ceres ANNOT ID no. 6008397
  misc_feature: Encodes the peptide sequence at SEQ ID NO 596
atggctctaaccctcctccgagggatgaggacgccagtctcctccggctcaaaccccggcctcttcttcgccgttctacgtcctcggctgtcccgcttcacggctcgggcggagagtgcgcaggccacggagcccaaagcggcgcccccgcccaggtcgattcagctggcgaccaaggaggcggcggagcagaagacacagggcttcgaagccgtcatcgggatcgagacccacgtccagctctccaccgtcaccaaggcgttctgctcctgcccgtacagctacggcgcccagcccaacagcaccgtctgccccacctgcatgggccacccggggacgctgccggttctcaacgagaaggtggtcgagtgcgccgtgaagctggggctcgcactcaactgcgagatctcgatgacgtccaagtttgatcgcaagcagtatttctacccggacctccccaaggggtaccagatttcgcagtttgacatccccattgccaagaagggtcatgtcgatttggaccttccggtggagtttggtggtgggcataggaagtttgggatcaccagggttcacatggaagaagatgcaggcaagctgcttcattctgaatccagcagttactctcaggtcgacctaaacagggctggtgtacctttgcttgaaattgtctcagagccagacatgagaacagggatagaggctgctgagtatggtgctgagctgcaaaggatcgttaggtacctgggagtgagtaatggtaacatgcaagaaggttcccttcgttgtgatgtgaatgtttctattcgaccagttgggcaatcagaatttggcacaaaggtggaaataaagaatatgaactcattttctgcgataaatagggcaatcgattatgagatctcccggcagattctgctccataaagaaggccaggctgatcaaattgtacaagaaacccgcctgtgggatgaatcttctcagaaaacttttacaatgagaaaaaaggagggacttgccgactatagatattttccagaacccgatcttcctgaagtagttctcactagtgactatattaatgaaatcagcaagtcaatgccggaacttccagaagcaaagcgtaggcgttatgaaaatatgggactcagcatgcaagatgttctgttccttgctaatgatgataatattggtcatttctatgattctactcttgagcatggtgctgacgcaaagctggctgccaactggatcatgggtgacattgctgcttatctcaaagatgaaaaggtctccattgatgaaattaaattaacacctctagagctttctgaactgatagcatccattaagaatggaacaataagtgggaagatcggcaaggagatactggccgagctcattgccaaaggtggaacagttaagggtgtgatagaagagaaagatttggttcagatagcagatccagcagcaatcgaggcaatggtggataaagtaattgctgataatccaaagcaacttgagcagtaccgtgctggaaaaactaagctacaaggattttttgctggccaggtgatgaaagcatcgaagggcaaggccaacccagttttgttgaataaaatccttggagagaagttgaatgccaattag

SEQ ID NO: 596 - protein, 548 aa, Sorghum bicolor
  misc_feature: Ceres ANNOT ID no. 6008397
  misc_feature (67)..(310): Pfam Id: GatB_N Pfam Desc: PET112 family, N terminal region
  misc_feature (398)..(545): Pfam Id: GatB_Yqey Pfam Desc: GatB/Yqey domain
  misc_feature (329)..(396): Pfam Id: GatB Pfam Desc: PET112 family, C terminal region
  misc_feature (1)..(548): NCBI GI: 115485825 NCBI Desc: os11g0544800 [oryza sativa (japonica cultivar-group)]
  misc_feature (1)..(484): NCBI GI: 42571801 NCBI Desc: glutamyl-trna(gln) amidotransferase b family protein [arabidopsis thaliana]
  misc_feature (1)..(462): NCBI GI: 42571799 NCBI Desc: glutamyl-trna(gln) amidotransferase b family protein [arabidopsis thaliana]
  misc_feature (189)..(462): NCBI GI: 8778692 NCBI Desc: t1n15.14 [arabidopsis thaliana]
  misc_feature (69)..(546): NCBI GI: 47115803 NCBI Desc: aspartyl/glutamyl-trna(asn/gln) amidotransferase subunit b (asp/glu-adt subunit b)
MALTLLRGMRTPVSSGSNPGLFFAVLRPRLSRFTARAESAQATEPKAAPPPRSIQLATKEAAEQKTQGFEAVIGIETHVQLSTVTKAFCSCPYSYGAQPNSTVCPTCMGHPGTLPVLNEKVVECAVKLGLALNCEISMTSKFDRKQYFYPDLPKGYQISQFDIPIAKKGHVDLDLPVEFGGGHRKFGITRVHMEEDAGKLLHSESSSYSQVDLNRAGVPLLEIVSEPDMRTGIEAAEYGAELQRIVRYLGVSNGNMQEGSLRCDVNVSIRPVGQSEFGTKVEIKNMNSFSAINRAIDYEISRQILLHKEGQADQIVQETRLWDESSQKTFTMRKKEGLADYRYFPEPDLPEVVLTSDYINEISKSMPELPEAKRRRYENMGLSMQDVLFLANDDNIGHFYDSTLEHGADAKLAANWIMGDIAAYLKDEKVSIDEIKLTPLELSELIASIKNGTISGKIGKEILAELIAKGGTVKGVIEEKDLVQIADPAAIEAMVDKVIADNPKQLEQYRAGKTKLQGFFAGQVMKASKGKANPVLLNKILGEKLNAN

SEQ ID NO: 597 - DNA, 1116 bp, Sorghum bicolor
  misc_feature: Ceres ANNOT ID no. 6008428
  misc_feature: Encodes the peptide sequence at SEQ ID NO 598
atggcctccctcatccgcttcctctcttcctccccctcctactccaccactcacctcccgcgccagcaccagccccagccgccgccagccgcagccgcagcggcgcgcccatcacggttccgcctcctgttcgcgcgcgccgcggcgcggcgcgaccccgagccgacgccggtgccggcggtcgaggagaggaggtcgctggccgtcaggacgggggagctgttcctagggctggcggcgctgctgctgcgcggggccggggccggggccggggcggcggtggaggaggtggaggcgagggacggggtggtgtgggagcagcgacccgaggacgtggacgcggagcgggcgcggcgggagctcactagccccggcttcagcttctccgcggcggggctgctcttcccctaccacctcggcgccgcgcagtgcctcatggaccgcggatacatcaccgagaaaactccgttagctggctcatcagcgggtgccataatctgtgcagtgatcgcatctgggaacacaatgcaagatgctctgcaggtgaccaaagttctagctgacaactgccggagtaaaggcactgcgtttcgccttggggctgtactcaaggatgtccttgatgagtttctcccagatgatcttcacattaggtgtaatggaagaattcgtgttgctattactcggctatcctggaggcctaggggcttgctggtggaccaatttgactccaaagaagatgtcattaatgcagtcattacatcctccttcattcctgggtacttagcacccagaccagctactttcttccgtaataggctctgcattgatgggggccttacattgtttatgccgcccacttctgctgcagaaacagtccgaatatgtgcttttccagccagccgcttgggattgcaagatattgggatcagtccagattgcaatccagagaacagagctagtccaagacagctgtttaactgggctctggaacctgctgaagatgaaactctagacaaattatacgagcttgggtacctggacgcagctgtttgggctgagcagaattctgccgagcttatcacgaagaatggtcaatcccttgtcgctgattga

SEQ ID NO: 598 - protein, 371 aa, Sorghum bicolor
  misc_feature: Ceres ANNOT ID no. 6008428
  misc_feature (126)..(290): Pfam Id: Patatin Pfam Desc: Patatin-like phospholipase
  misc_feature (9)..(371): NCBI GI: 115485843 NCBI Desc: os11g0546300 [oryza sativa (japonica cultivar-group)]
  misc_feature (91)..(364): NCBI GI: 124360437 NCBI Desc: patatin [medicago truncatula]
  misc_feature (62)..(293): NCBI GI: 42571733 NCBI Desc: patatin-related [arabidopsis thaliana]
  misc_feature (125)..(330): NCBI GI: 66362936 NCBI Desc: patatin like esterase [cryptosporidium parvum]
  misc_feature (125)..(330): NCBI GI: 46229463 NCBI Desc: patatin like esterase [cryptosporidium parvum]
MASLIRFLSSSPSYSTTHLPRQHQPQPPPAAAAAARPSRFRLLFARAAARRDPEPTPVPAVEERRSLAVRTGELFLGLAALLLRGAGAGAGAAVEEVEARDGVVWEQRPEDVDAERARRELTSPGFSFSAAGLLFPYHLGAAQCLMDRGYITEKTPLAGSSAGAIICAVIASGNTMQDALQVTKVLADNCRSKGTAFRLGAVLKDVLDEFLPDDLHIRCNGRIRVAITRLSWRPRGLLVDQFDSKEDVINAVITSSFIPGYLAPRPATFFRNRLCIDGGLTLFMPPTSAAETVRICAFPASRLGLQDIGISPDCNPENRASPRQLFNWALEPAEDETLDKLYELGYLDAAVWAEQNSAELITKNGQSLVAD

SEQ ID NO: 599 - DNA, 1941 bp, Sorghum bicolor
  misc_feature: Ceres ANNOT ID no. 6008441
  misc_feature: Encodes the peptide sequence at SEQ ID NO 600
atggagaagatctccgtcgccgtccgcttccgccctctcaacccggcggccgctgacctctctccatccggcgccggtggaggcggcgaccgcgagtggcgtatcgacgacacccgcgtctccctcctccaccgcgccgccggccccgtccccggcgcctccttcgccttcgaccacgtgttcgacggtgccgcgaccaacgagcggatctacggcgcgctcgtccgggaactcatcggcgccgtcgtcggcgggttcaacggcaccgccttcgcctacggccagaccagcagcgggaagacgttcaccatgaacggctccgacgccgaccccggcatcattccccgcgcggtccgcgatgtcttcgacaccgtgcgtcaggccgacgaccgtgagttcctcatccgggtgtcctacatggagatctacaacgaggagatcaacgacctcttgacgattgagggccagaagctgcagattcatgagagcttagagcgtggagtgtatgtggccggtttgcgggaggagatcgtgaacagtgcagagcaagtgcttgagctcctccagcttggagaagcgaataggcattttggagagaccaacatgaatgtgcggagcagtcggtcacacactattttcagaatggtaattgaaagcagcggtaaggaccagataaactgtggggatgctatccgcgtatctgttttgaatttggtggaccttgctgggtcagaaagaatcatcaagacaggggcagaaggggtacgcttgaatgaggggaagtatattaacaagagcctgatgattcttggaaatgtcattaataagttgagtgacaacggaaaacaaagagggcacattccctatcgtgatagtaagttgacacgcattctccaacctgcgcttggaggcaatgcaaagacatctatcatctgcactgctgcacctgaagagattcacattgaggaaactagaggaactcttcaattcgcaagtagagcaaaatgtgtcagcaattgtgcccaagtaaatgagattctaacagatgctgctttgctgaagaggcaaaagctagagatagaggaacttcgtaaaaaactgcagggctcccattctgaagggttggagcaggttgtgctaaaactacggaatgacatgcacaagtctgaacttgagcgtgatcgactggccatggaacttgaagaggaaaaaaagttacgggtgactctagaacaacatttgactgagcaacagaagaagctagaggccacatcgtcagaccactttactgattcagtccagttggatgcactgaaaactccagattcgaagtctgtaccagatggctttgttgtctgccgctcacgttattcaaatgatgttgagttcagcccattacctgaaaatttggataatttcgctcatgaagatctatggacacgcctcaacaaaggttgtgttactgatcttgacatgcttgagatgacacctggtctgaaacgcgaggcatcctttatacaagatacatcagctgtgccattggaggaacctactgacgctagatgccagaggttagaaaaggagtgcatttctgatcggcaacagtttgaggaatcaaaggcaagatgcaccaatctcgagaaagagtgcgacatgctgagggacgagaacttgtccctgcaacagaagctctccgccgccaggcaggaggcccaccgcctcgccactgagaagcaggagctggccggggagctgggcacagagaggcagaagttggatgagctgaagcaggatatccggatgatcagccgtggcttcttgcagcgggaagggcagctcacgtcgctctacaccaagtccaaggccatcctggagaactgcaagacctcccagctccgctctatgttttttagccaaacggtttcaactccacgcacttag

SEQ ID NO: 600 - protein, 646 aa, Sorghum bicolor
  misc_feature: Ceres ANNOT ID no. 6008441
  misc_feature (9)..(338): Pfam Id: Kinesin Pfam Desc: Kinesin motor domain
  misc_feature (1)..(599): NCBI GI: 6526979 NCBI Desc: kinesin-like protein [arabidopsis thaliana]
  misc_feature (55)..(599): NCBI GI: 8778739 NCBI Desc: t30e16.9 [arabidopsis thaliana]
  misc_feature (275)..(632): NCBI GI: 115485881 NCBI Desc: os11g0552600 [oryza sativa (japonica cultivar-group)]
  misc_feature (1)..(426): NCBI GI: 22330953 NCBI Desc: kinesin motor protein-related [arabidopsis thaliana]
  misc_feature (4)..(599): NCBI GI: 68533047 NCBI Desc: cenpe variant protein [homo sapiens]
  misc_feature: The sequence is a functional homolog of SEQ ID NO. 359 in the 11/188,298 US application
MEKISVAVRFRPLNPAAADLSPSGAGGGGDREWRIDDTRVSLLHRAAGPVPGASFAFDHVFDGAATNERIYGALVRELIGAVVGGFNGTAFAYGQTSSGKTFTMNGSDADPGIIPRAVRDVFDTVRQADDREFLIRVSYMEIYNEEINDLLTIEGQKLQIHESLERGVYVAGLREEIVNSAEQVLELLQLGEANRHFGETNMNVRSSRSHTIFRMVIESSGKDQINCGDAIRVSVLNLVDLAGSERIIKTGAEGVRLNEGKYINKSLMILGNVINKLSDNGKQRGHIPYRDSKLTRILQPALGGNAKTSIICTAAPEEIHIEETRGTLQFASRAKCVSNCAQVNEILTDAALLKRQKLEIEELRKKLQGSHSEGLEQVVLKLRNDMHKSELERDRLAMELEEEKKLRVTLEQHLTEQQKKLEATSSDHFTDSVQLDALKTPDSKSVPDGFVVCRSRYSNDVEFSPLPENLDNFAHEDLWTRLNKGCVTDLDMLEMTPGLKREASFIQDTSAVPLEEPTDARCQRLEKECISDRQQFEESKARCTNLEKECDMLRDENLSLQQKLSAARQEAHRLATEKQELAGELGTERQKLDELKQDIRMISRGFLQREGQLTSLYTKSKAILENCKTSQLRSMFFSQTVSTPRT

SEQ ID NO: 601 - DNA, 801 bp, Sorghum bicolor
  misc_feature: Ceres ANNOT ID no. 6008462
  misc_feature: Encodes the peptide sequence at SEQ ID NO 602
atgtcgccgtcggagccgacgcgggaggagagcgtgtacatggccaagctggcggagcaggcggagcggtacgaggagatggtcgagttcatggagcgcgtggcgcgctccgcgggcggcgcggggggcggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgaggccgagctcgcccgcatctgcgacggcatcctcgcgctgctcgactcccacctcgtcccgtccgccggcgccgccgagtccaaggtcttctacctcaagatgaagggcgactaccacaggtaccttgctgagttcaagtcaggtgcggagaggaaggatgctgcggagagcaccatgaatgcttacaaagctgctcaggatattgctcttgctgatttggcaccaacccaccccatcaggcttgggctggcactcaacttctcagtgttctactatgagattctgaactcccctgatcgcgcttgcaaccttgcaaagcaggcttttgatgaggcaatctctgagctagacagcctgggagaggagtcctacaaggacagcactctgatcatgcagctcctgcgtgacaacttgaccctatggacttcggacaccaacgaggatggcggcgacgagatcaaggaagctgctgccccgaaagagtccacagagggtcagtaa

SEQ ID NO: 602 - protein, 266 aa, Sorghum bicolor
  misc_feature: Ceres ANNOT ID no. 6008462
  misc_feature (8)..(249): Pfam Id: 14-3-3 Pfam Desc: 14-3-3 protein
  misc_feature (1)..(266): NCBI GI: 83271058 NCBI Desc: 14-3-3e [hordeum vulgare subsp. vulgare]
  misc_feature (1)..(266): NCBI GI: 9798603 NCBI Desc: tawin1 [triticum aestivum]
  misc_feature (1)..(261): NCBI GI: 110278805 NCBI Desc: 14-3-3-like protein gf14-d (g-box factor 14-3-3 homolog d)
  misc_feature (5)..(261): NCBI GI: 115485847 NCBI Desc: os11g0546900 [oryza sativa (japonica cultivar-group)]
  misc_feature (1)..(266): NCBI GI: 2921512 NCBI Desc: gf14 protein [fritillaria agrestis]
  misc_feature: The sequence is a functional homolog of SEQ ID NO 155 in the 11/479,226US patent application
  misc_feature: The sequence is a functional homolog of SEQ ID NO 1777 in the 11/479,226US patent application
  misc_feature: The sequence is a functional homolog of SEQ ID NO 2216 in the 10/374,780US patent application
  misc_feature: The sequence is a functional homolog of SEQ ID NO 2350 in the 10/374,780US patent application
  misc_feature: The sequence is a functional homolog of SEQ ID NO 34 in the 10/412,699US patent application
  misc_feature: The sequence is a functional homolog of SEQ ID NO 342 in the 10/412,699US patent application
  misc_feature: The sequence is a functional homolog of SEQ ID NO 344 in the 10/412,699US patent application
  misc_feature: The sequence is a functional homolog of SEQ ID NO 404 in the 10/374,780US patent application
  misc_feature: The sequence is a functional homolog of SEQ ID NO 52 in the 10/903,236US patent application
  misc_feature: The sequence is a functional homolog of SEQ ID NO 68 in the 11/375,241US patent application
  misc_feature: The sequence is a functional homolog of SEQ ID NO 780 in the 10/225,066US patent application
  misc_feature: The sequence is a functional homolog of SEQ ID NO 782 in the 11/479,226US patent application
  misc_feature: The sequence is a functional homolog of SEQ ID NO 786 in the 11/479,226US patent application
  misc_feature: The sequence is a functional homolog of SEQ ID NO 789 in the 11/479,226US patent application
  misc_feature: The sequence is a functional homolog of SEQ ID NO 790 in the 10/225,066US patent application
  misc_feature: The sequence is a functional homolog of SEQ ID NO 793 in the 11/479,226US patent application
  misc_feature: The sequence is a functional homolog of SEQ ID NO 797 in the 11/479,226US patent application
  misc_feature: The sequence is a functional homolog of SEQ ID NO 801 in the 11/479,226US patent application
  misc_feature: The sequence is a functional homolog of SEQ ID NO 805 in the 11/479,226US patent application
  misc_feature: The sequence is a functional homolog of SEQ ID NO 809 in the 11/479,226US patent application
  misc_feature: The sequence is a functional homolog of SEQ ID NO 864 in the 10/225,066US patent application
  misc_feature: Useful for making plants with modulated drought sensitivity
  misc_feature: Useful for making plants with modulated growth and phenotype characteristics
  misc_feature: GREAT-hit functional homolog of the protein sequence given in SEQ ID NO 13373
  misc_feature: The sequence is a functional homolog of SEQ ID NO 34 in the 20040045049 US patent application
  misc_feature: The sequence is a functional homolog of SEQ ID NO 34 in the 20040045049 US patent application
  misc_feature: The sequence is a functional homolog of SEQ ID NO 342 in the 20040045049 US patent application
  misc_feature: The sequence is a functional homolog of SEQ ID NO 344 in the 20040045049 US patent application
  misc_feature: The sequence is a functional homolog of SEQ ID NO 864 in the 20050160493 US patent application
  misc_feature: The sequence is a functional homolog of SEQ ID NO 1777 in the 20070022495 US patent application
  misc_feature: The sequence is a functional homolog of SEQ ID NO 786 in the 20070022495 US patent application
  misc_feature: The sequence is a functional homolog of SEQ ID NO 789 in the 20070022495 US patent application
  misc_feature: The sequence is a functional homolog of SEQ ID NO 793 in the 20070022495 US patent application
  misc_feature: The sequence is a functional homolog of SEQ ID NO 797 in the 20070022495 US patent application
  misc_feature: The sequence is a functional homolog of SEQ ID NO 801 in the 20070022495 US patent application
  misc_feature: The sequence is a functional homolog of SEQ ID NO 809 in the 20070022495 US patent application
  misc_feature: Useful for making plants with modulated drought sensitivity
  misc_feature: Functional homolog of the protein sequence given in SEQ ID NO 13373
  misc_feature: Useful for making plants with modulated water use efficiency
  misc_feature: Functional homolog of the protein sequence given in SEQ ID NO 13942
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 801 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
  misc_feature: The sequence is a functional homolog of SEQ ID NO 809 in the 11/479,226 US patent application
  misc_feature: The sequence is a functional homolog of SEQ ID NO 1777 in the 11/479,226 US patent application
  misc_feature: The sequence is a functional homolog of SEQ ID NO. 275 in the 11/188,298 US application
MSPSEPTREESVYMAKLAEQAERYEEMVEFMERVARSAGGAGGGEELSVEERNLLSVAYKNVIGARRASWRIISSIEQKEEGRGNEAHAASIRAYRSKIEAELARICDGILALLDSHLVPSAGAAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAPKESTEGQ

SEQ ID NO: 603 - DNA, 1851 bp, Sorghum bicolor
  misc_feature: Ceres ANNOT ID no. 6008463
  misc_feature: Encodes the peptide sequence at SEQ ID NO 604
atgaggctgtgggaggaggacgaggtggaggtggtggagggggaggaggacgaggaggaggaggggatggaggtggacgcggaggcggggtggccgcagtggggggcgccggcggcggcagcggcggcggggctcggggagcccagggcggcggcgatcgtcgtggcggacgcgtcggaggtcgacttccccgtcatctacgtcaacgccgccttcgaggccgccacggggtaccgcgcgcacgaggtgctcggccgcaactgccgattcctacaatttcgggatccacgtgcccaaaggcgacatccccttgttgatcccatggttgtttcagagattcggcgatgcctcaatgaggggattgaattccaaggcgagctgctgaatttccggaaggacggtgctccactttacaacagattaaggctcattcctatgcatggggatgatggctatgtgacacatgttattgggatccagctattctctgacgcaaacatcgatctcagcagcgtatcatatccggtgtataagcaacagtccaacaggctgagcattcaagatctgaactcagcttctcatgagcatgctccgaaaatccagagttctgaccactgtgctatatttcaattgtcagatgaagttcttgcacacaacatcctatctcgcctgtcaccaagagatgttgcatccattggatcagtctgtaccagaatgcatgagctaaccaaaaacaatcatctgaggaagatggtctgccagaatgcatggggaagggatgtcactgtcaggcttgagatgagcaccaagatggtaggatggggtcgtcttgcaagagagttaacaactcttgaggcagcctcatggaggaagttcacagttggagggcgcgttgagccttcccgatgcaatttcagtgcctgtgctgttggtaaccgtcttgtcctttttggaggggaaggtgtcaacatgcagcctatggatgacacgtttgtgcttaacttggaggctgcaaggccagaatggcgccgcgtcaaggtttctgcctccccgcctggccggtggggccacactctatcatggctgaacgggtcatggctggtagtatttggaggctgcggacagcaaggtttgctcaacgatgtctttgtccttgaccttgatgctcagcagccaacgtggagggaggttgcaagcgaggctcctccactgccacggtcttggcacagctcatgcaccctggatggttcgaagcttgtcgtctcaggtgggtgcaccgagtctggtgttcttctcagcgacaccttcctccttgacctcacaaaggagaagcctgcatggagggagattcctacatcctggtcgcctccatcccgcctcggccacaccatgtctgtctatggtacaactaaactgttcatgtttggtggactggcaaagagcggctcgctccgactgcgctccagcgacgcctactcgattgatgtcagtgaagatagtccgcagtggagacagttggcgacgactggattcccaaatgtcggcccgccaccaaggctcgatcacgttgcagtgagcctgccctgtggacggatcatcatatttgggggctccattgcggggctccactccccagcgcagctgttcctgatcgatcccgcagaggagaagccgacatggaggatcctgaacgtacctggccagccccccaagttcgcctgggggcacagcacctgcgtggttggcggcaccagggtcctggttctcggaggccacactggggaggaatggatactgaacgaactacatgagctctgcctagcaagcaggcccgacgaagacgacgactga

SEQ ID NO: 604 - protein, 616 aa, Sorghum bicolor
  misc_feature: Ceres ANNOT ID no. 6008463
  misc_feature (519)..(567): Pfam Id: Kelch_2 Pfam Desc: Kelch motif
  misc_feature (206)..(254): Pfam Id: F-box Pfam Desc: F-box domain
  misc_feature (15)..(615): NCBI GI: 110832734 NCBI Desc: adagio-like protein 3
  misc_feature (46)..(615): NCBI GI: 115485849 NCBI Desc: os11g0547000 [oryza sativa (japonica cultivar-group)]
  misc_feature (52)..(614): NCBI GI: 92891190 NCBI Desc: cyclin-like f-box; galactose oxidase, central [medicago truncatula]
  misc_feature (52)..(614): NCBI GI: 6960305 NCBI Desc: fkf1 [arabidopsis thaliana]
  misc_feature (51)..(614): NCBI GI: 34499885 NCBI Desc: fkf1 [mesembryanthemum crystallinum]
  misc_feature: The sequence is a functional homolog of SEQ ID NO. 354 in the 11/188,298 US application
MRLWEEDEVEVVEGEEDEEEEGMEVDAEAGWPQWGAPAAAAAAGLGEPRAAAIVVADASEVDFPVIYVNAAFEAATGYRAHEVLGRNCRFLQFRDPRAQRRHPLVDPMVVSEIRRCLNEGIEFQGELLNFRKDGAPLYNRLRLIPMHGDDGYVTHVIGIQLFSDANIDLSSVSYPVYKQQSNRLSIQDLNSASHEHAPKIQSSDHCAIFQLSDEVLAHNILSRLSPRDVASIGSVCTRMHELTKNNHLRKMVCQNAWGRDVTVRLEMSTKMVGWGRLARELTTLEAASWRKFTVGGRVEPSRCNFSACAVGNRLVLFGGEGVNMQPMDDTFVLNLEAARPEWRRVKVSASPPGRWGHTLSWLNGSWLVVFGGCGQQGLLNDVFVLDLDAQQPTWREVASEAPPLPRSWHSSCTLDGSKLVVSGGCTESGVLLSDTFLLDLTKEKPAWREIPTSWSPPSRLGHTMSVYGTTKLFMFGGLAKSGSLRLRSSDAYSIDVSEDSPQWRQLATTGFPNVGPPPRLDHVAVSLPCGRIIIFGGSIAGLHSPAQLFLIDPAEEKPTWRILNVPGQPPKFAWGHSTCVVGGTRVLVLGGHTGEEWILNELHELCLASRPDEDDD

SEQ ID NO: 605 - DNA, 951 bp, Sorghum bicolor
  misc_feature: Ceres ANNOT ID no. 6008522
  misc_feature: Encodes the peptide sequence at SEQ ID NO 606
atggttcctgccgcgccccggctgctcgccggcattgtcgccgcggcggcggcgctgctgttgctgctagttgcgccgtcggcggcagagctgacgcgggtggagcacccgcccaagaccgagggctccctcgccatccttgccgttggcgactgggggcgcaaggggcagttcaaccagaccctggtggcccagcagatgggagtggtgggggagaagctggacattgacttcgtcatctccacgggcgacaacatctacgacgacggcattgccaacaccagcgacccgctcttcaaggagtgcttcaccaacatctacaccgcccagagcctccagacgccgtggtacattgtactcggtaaccatgactacacgggcaatgcgctggcgcagcaagatcccgccatccgcgaagtggacagccggtacctcaaccttgccaagtccttcatcgtcaactcaggaatcgcggacttcttcctcgttgacacgtcaccgttttacctcaagtactggaacagcagcaagtacgattggagaaacgtttctcctcgcgacacctatatcgaaaacctcctcaaggatctggatgatgcccttgtccaatccgaggctccatggaagattgtggttggtcaccaccccatcagcagcggctgcgagcatggcaacaccactgagctccaggagttgctccgaccaattcttgaggcatttcagttcatgacaagcggcggtgggtccaaggcatgggctggcaagttcaagaccacatctgacaagatagagttcatctacgacggccagggattcatgtcgatgaagttgagcaacacggaggcgcacctagtcttctacgacgtcgctggcaatgtcctccacacctatgacagcaccaagagcgaagaagaagaagaagaggaagaagaagaagaagatgttgactaa

SEQ ID NO: 606 - protein, 316 aa, Sorghum bicolor
  misc_feature: Ceres ANNOT ID no. 6008522
  misc_feature (44)..(297): Pfam Id: Metallophos Pfam Desc: Calcineurin-like phosphoesterase
  misc_feature (15)..(238): NCBI GI: 126165540 NCBI Desc: purple acid phosphatase pap1 [oryza sativa (japonica cultivar-group)]
  misc_feature (19)..(238): NCBI GI: 20257477 NCBI Desc: purple acid phosphatase [arabidopsis thaliana]
  misc_feature (12)..(271): NCBI GI: 21536860 NCBI Desc: acid phosphatase type 5 [arabidopsis thaliana]
  misc_feature (18)..(291): NCBI GI: 47716659 NCBI Desc: purple acid phosphatase 1 [solanum tuberosum]
  misc_feature (27)..(276): NCBI GI: 8778212 NCBI Desc: f10b6.10 [arabidopsis thaliana]
MVPAAPRLLAGIVAAAAALLLLLVAPSAAELTRVEHPPKTEGSLAILAVGDWGRKGQFNQTLVAQQMGVVGEKLDIDFVISTGDNIYDDGIANTSDPLFKECFTNIYTAQSLQTPWYIVLGNHDYTGNALAQQDPAIREVDSRYLNLAKSFIVNSGIADFFLVDTSPFYLKYWNSSKYDWRNVSPRDTYIENLLKDLDDALVQSEAPWKIVVGHHPISSGCEHGNTTELQELLRPILEAFQFMTSGGGSKAWAGKFKTTSDKIEFIYDGQGFMSMKLSNTEAHLVFYDVAGNVLHTYDSTKSEEEEEEEEEEEDVD

SEQ ID NO: 607 - DNA, 633 bp, Sorghum bicolor
  misc_feature: Ceres ANNOT ID no. 6008604
  misc_feature: Encodes the peptide sequence at SEQ ID NO 608
atggccacgggctcctcaccccccgccaggcagcagcccttcaagctgatcctggggtcgtcgtcggtggcgcgcaagcacatcctcgaggagatggggcttgagttccagactgcggacatcgacgagaagagcatcaggagagagaatcctgatgacctggtaatggtcctcgcggaggccaaggctgatgctatcatgtccagactgaaccttgctgattaccagaaagaaggcaatcaaccaacactcctgatcacttctgacatagtggtcgtccatgaagggattattagagaaaagccaaccaccaaggaagaagcacgccaattcctgaaaggctattccggaggtcatgtgtcaactgttgggtctgtagttgtaactaatcttacaactgggaagagacttggaagtttggacaaagctgaggtttatttccacgatataccagaagaggtcatcgagagcttgatcgatgagggagtagtatttagggtcgcaggtggcttgctacttgaacatccattgacactgccatttgtcgaagcagtggttggttctagtgatagcgtcatggggctgtcaaaggagatcgcaaacaagctgattcatgacgcattgtctacttag

SEQ ID NO: 608 - protein, 210 aa, Sorghum bicolor
  misc_feature: Ceres ANNOT ID no. 6008604
  misc_feature (14)..(208): Pfam Id: Maf Pfam Desc: Maf-like protein
  misc_feature (5)..(208): NCBI GI: 77551376 NCBI Desc: maf-like protein [oryza sativa (japonica cultivar-group)]
  misc_feature (9)..(208): NCBI GI: 144924633 NCBI Desc: maf-like protein [medicago truncatula]
  misc_feature (9)..(208): NCBI GI: 22328154 NCBI Desc: maf family protein [arabidopsis thaliana]
  misc_feature (78)..(208): NCBI GI: 115451707 NCBI Desc: os03g0229600 [oryza sativa (japonica cultivar-group)]
  misc_feature (16)..(206): NCBI GI: 145343440 NCBI Desc: septum formation protein maf-like protein [ostreococcus lucimarinus cce9901]
MATGSSPPARQQPFKLILGSSSVARKHILEEMGLEFQTADIDEKSIRRENPDDLVMVLAEAKADAIMSRLNLADYQKEGNQPTLLITSDIVVVHEGIIREKPTTKEEARQFLKGYSGGHVSTVGSVVVTNLTTGKRLGSLDKAEVYFHDIPEEVIESLIDEGVVFRVAGGLLLEHPLTLPFVEAVVGSSDSVMGLSKEIANKLIHDALST

SEQ ID NO: 609 - DNA, 1305 bp, Sorghum bicolor
  misc_feature: Ceres ANNOT ID no. 6008636
  misc_feature: Encodes the peptide sequence at SEQ ID NO 610
atggggcgtatggatgccatcgcagctctaccggaggatgcccaactcgtgatcttctcccacgtgggcaatgtcaaagacctccttagcttcgccatgacgtgcaagtggtgggtgcaccgcttcactgacccggccttcctctctgaactatttaagggaaaccgcgcatgcctcatcggcttcttcttccagaagacaaggttcaagttcagaaggctactgattggcccaaggaatggtgcctccatctctgctcccaccttcatgctatcgccattgtcgtcactgattggccccacagaaaggtccttcacagccttcatccctgaccatgatggcaccttcaactacgccgagcctctggaagcacaccacgggatcatcctgatgcagcttgtgccccgcacctttgactgcacccagccagctgtgctgctcagcctctgcaacccaatgaccggcgagtgtcactttctcccacctctagaggctccccacttttctccactccttgggttgcattatcccgatgctaatttccaggtcaccatgaacgccattatcacagccgctgataacagtaacctcagcggagggcagctgctcctcatcaccagtaaaggatctggaccagacagtaaggtatacattcactcgtactccattgacacatgcagatggagcacaccgaccaggtggctagaagggagccgttactcccttgtgcgtgatagggctgctgttgttcaccgcggcgcagcacactggttgtgcacagattgcaaaactacggagagcgcgcaccgagatgatgagaacctgtacaaactcagtgtggaggtgggcacggcgcgtgtttctatgacaaagcttcccttccatgccgccggatcacgactcctctgtgtcagcaaggacgacaagctatcagtcgcttgtatctatgtcatgcatgtgactctatggacacagcaagaatacgcagaggaaggtgacaacacccctgtgccatggctccgcactgttatcaggataacgccggacccaaactatctccctccaactcggtatgctacctgccggcagtggtttcgccttaacaatgaatcactgctcgtgctgaactgggaacaccatagctactcaatcttcattctcgaccttgagaagaaggtgatggaagaggtcaagcgcagcttcctgcacgagacaaatagagaggaaaatctagcctttgtgccatatgagatagacttggtgaagttctttgtgttccggcttggtagaatatgtgaagactga

SEQ ID NO: 610 - protein, 434 aa, Sorghum bicolor
  misc_feature: Ceres ANNOT ID no. 6008636
  misc_feature (6)..(432): NCBI GI: 115475259 NCBI Desc: os08g0203800 [oryza sativa (japonica cultivar-group)]
MGRMDAIAALPEDAQLVIFSHVGNVKDLLSFAMTCKWWVHRFTDPAFLSELFKGNRACLIGFFFQKTRFKFRRLLIGPRNGASISAPTFMLSPLSSLIGPTERSFTAFIPDHDGTFNYAEPLEAHHGIILMQLVPRTFDCTQPAVLLSLCNPMTGECHFLPPLEAPHFSPLLGLHYPDANFQVTMNAIITAADNSNLSGGQLLLITSKGSGPDSKVYIHSYSIDTCRWSTPTRWLEGSRYSLVRDRAAVVHRGAAHWLCTDCKTTESAHRDDENLYKLSVEVGTARVSMTKLPFHAAGSRLLCVSKDDKLSVACIYVMHVTLWTQQEYAEEGDNTPVPWLRTVIRITPDPNYLPPTRYATCRQWFRLNNESLLVLNWEHHSYSIFILDLEKKVMEEVKRSFLHETNREENLAFVPYEIDLVKFFVFRLGRICED

SEQ ID NO: 611 - DNA, 1074 bp, Sorghum bicolor
  misc_feature: Ceres ANNOT ID no. 6008644
  misc_feature: Encodes the peptide sequence at SEQ ID NO 612
atggaaagaggaggccgagatgtgttcctaggtccaacaccgccgccgccgccgtcttgcccgttccacggatccgctaccgccgcccgctccggtggagcgcagatgctcaggttgggtctgtgctcaggtgccagcaagatgcagagcgtgttgtcgagggtgagggggcctttcactcccacgcagtggatggagctggagcatcaggccctgatctacaagcacttcgctgtcaatgcccctgtgccgtccagcttgctcctccctatcaaaagaagcctcaatccatggagtagccttggctccataggatgggcaccatttcgttctggctctggtgatgcagaaccaggaaggtgccgccgcacagatggcaagaagtggcggtgctccagagatgctgttggggaccagaaatactgtgagcgacacataaaacgtggttgccaccgttcaagaaagcatgtggaaggccgaaaggcgacacccaccattgcagatccaaccatggttgtttctggtggttcattgttgtacagccatgctgtgacttggcagcagcaggcaaaaagctcagctgctaatgttgctgatccattctcactagggtccaacaggaatttgctggataaacagaatataggcgaccagttctctgtatccacttccatggactcctttgacttctcagcgtcacattcttccccaaaccatgacaaagtagcattttcaccggtggagatgcagcatgaacatgatcagctgtatcttgtgcatggagcaggcagttcagcagaacacgttaacaagtctcaggatggtcagctactggtctccagggaaacaattgatgatggacctctaggtgaggttttcaaaggcaagagttgccagtcagcatctgcggacattttaactgaccaatggacttcaacttgtgagttgcattctccaaccggaatcctacaaatgtctagtagcaacagagtgacagtagagaaccacacaagtaacaatagctatctcatggcgaggatggtgaattctcatactgtcccaacactccactag

SEQ ID NO: 612 - protein, 357 aa, Sorghum bicolor
  misc_feature: Ceres ANNOT ID no. 6008644
  misc_feature (115)..(160): Pfam Id: WRC Pfam Desc: WRC
  misc_feature (57)..(93): Pfam Id: QLQ Pfam Desc: QLQ
  misc_feature (43)..(215): NCBI GI: 51039843 NCBI Desc: tpa: growth-regulating factor 7 [oryza sativa (japonica cultivar-group)]
  misc_feature (58)..(233): NCBI GI: 115460326 NCBI Desc: os04g0600900 [oryza sativa (japonica cultivar-group)]
  misc_feature (58)..(233): NCBI GI: 116310919 NCBI Desc: b0403h10-osigba0105a11.9 [oryza sativa (indica cultivar-group)]
  misc_feature (58)..(233): NCBI GI: 38345778 NCBI Desc: osjnba0083n12.16 [oryza sativa (japonica cultivar-group)]
  misc_feature (58)..(230): NCBI GI: 51039835 NCBI Desc: tpa: growth-regulating factor 3 [oryza sativa (japonica cultivar-group)]
  misc_feature: The sequence is a functional homolog of SEQ ID NO 1781 in the 10/374,780US patent application
  misc_feature: The sequence is a functional homolog of SEQ ID NO 1806 in the 11/479,226US patent application
  misc_feature: The sequence is a functional homolog of SEQ ID NO 452 in the 11/435,388US patent application
  misc_feature: The sequence is a functional homolog of SEQ ID NO 660 in the 11/435,388US patent application
  misc_feature: Useful for making plants with modulated growth and phenotype characteristics
  misc_feature: The sequence is a functional homolog of SEQ ID NO 1781 in the 20060162006 US patent application
  misc_feature: The sequence is a functional homolog of SEQ ID NO 452 in the 20060272060 US patent application
  misc_feature: The sequence is a functional homolog of SEQ ID NO 660 in the 20060272060 US patent application
MERGGRDVFLGPTPPPPPSCPFHGSATAARSGGAQMLRLGLCSGASKMQSVLSRVRGPFTPTQWMELEHQALIYKHFAVNAPVPSSLLLPIKRSLNPWSSLGSIGWAPFRSGSGDAEPGRCRRTDGKKWRCSRDAVGDQKYCERHIKRGCHRSRKHVEGRKATPTIADPTMVVSGGSLLYSHAVTWQQQAKSSAANVADPFSLGSNRNLLDKQNIGDQFSVSTSMDSFDFSASHSSPNHDKVAFSPVEMQHEHDQLYLVHGAGSSAEHVNKSQDGQLLVSRETIDDGPLGEVFKGKSCQSASADILTDQWTSTCELHSPTGILQMSSSNRVTVENHTSNNSYLMARMVNSHTVPTLH

SEQ ID NO: 613 - DNA, 1116 bp, Sorghum bicolor
  misc_feature: Ceres ANNOT ID no. 6008677
  misc_feature: Encodes the peptide sequence at SEQ ID NO 614
atgttgaggtgcttggtgcttgctgcagtgtcgttggcgctactcgtgctggctccgccggcacgggccggcatcccgttcacagagaaggacctggcgtcggaggagagcctgcgagcgctgtacgagcagtggcgcagccactacatggtgtcgcgcccagcaggcttgcaggaacaggacgacaaggcgcggtggttcaacgtgttcaaggagaacgtgcggtacatccacgaggcgaacaagaagggccggtcgttcaggctggcgctgaacaagttcgcggacatgaccacggacgagttccggcgcgcgtacgccgccggctccaggacgcggcaccaccgcgccctgagcagcggcattaggcggcacggcgatgggagcttcatgtatgcgcaagccgggaacctgccgctggccgtggactggcggcagcggggcgcggtcaccggcatcaaggaccaaggccagtgcgggagctgctgggcgttctcgaccatcgcagctgtagagggcataaacaagatcaggaccgggaagctggtgtcgctgtcggagcaggagctcgtggactgcgacgacgtcgacaaccaaggctgcaacggtggcctcatggactatgcgttccagtacatcaagaggaacggagggatcactaccgagtctaactatccgtatcttgccgagcagaggagctgtaacaaggcaaaagaacgatcccatgacgtgacaatagatggatatgaggatgtccctgctaacaacgaagatgctttacagaaagcagtcgcaaaccagccagtgtccattgctattgaggctagcggccaagacttccagttctactcagagggtgtcttcactggaagctgtgggacggagctagatcatggagttgcagctgttgggtatggcataactcgagatggcacgaaatattggatagtgaagaactcatggggcgaggactggggtgagaggggctatatcagaatgcaacgaggcatctcggactcgcaagggctctgcggcatagcaatggagccgtcttacccaactaaaatagcaacgacacacggtgccatcatgactgatgggcatgcatcctattaa

SEQ ID NO: 614 - protein, 371 aa, Sorghum bicolor
  misc_feature: Ceres ANNOT ID no. 6008677
  misc_feature (138)..(354): Pfam Id: Peptidase_C1 Pfam Desc: Papain family cysteine protease
  misc_feature (42)..(102): Pfam Id: Inhibitor_I29 Pfam Desc: Cathepsin propeptide inhibitor domain (I29)
  misc_feature (1)..(367): NCBI GI: 2224808 NCBI Desc: cysteine endopeptidase ep-a [hordeum vulgare subsp. vulgare]
  misc_feature (1)..(368): NCBI GI: 2224812 NCBI Desc: cysteine endopeptidase ep-a [hordeum vulgare subsp. vulgare]
  misc_feature (1)..(368): NCBI GI: 4100157 NCBI Desc: cysteine proteinase precursor [hordeum vulgare]
  misc_feature (5)..(355): NCBI GI: 396568 NCBI Desc: thiol-protease [hemerocallis hybrid cultivar]
  misc_feature (6)..(355): NCBI GI: 2944446 NCBI Desc: cysteine endopeptidase precursor [ricinus communis]
  misc_feature (138)..(354): SWISSPROT Homolog: EC 3.4.22.15 Cathepsin L
MLRCLVLAAVSLALLVLAPPARAGIPFTEKDLASEESLRALYEQWRSHYMVSRPAGLQEQDDKARWFNVFKENVRYIHEANKKGRSFRLALNKFADMTTDEFRRAYAAGSRTRHHRALSSGIRRHGDGSFMYAQAGNLPLAVDWRQRGAVTGIKDQGQCGSCWAFSTIAAVEGINKIRTGKLVSLSEQELVDCDDVDNQGCNGGLMDYAFQYIKRNGGITTESNYPYLAEQRSCNKAKERSHDVTIDGYEDVPANNEDALQKAVANQPVSIAIEASGQDFQFYSEGVFTGSCGTELDHGVAAVGYGITRDGTKYWIVKNSWGEDWGERGYIRMQRGISDSQGLCGIAMEPSYPTKIATTHGAIMTDGHASY

SEQ ID NO: 615 - DNA, 1329 bp, Sorghum bicolor
  misc_feature: Ceres ANNOT ID no. 6008686
  misc_feature: Encodes the peptide sequence at SEQ ID NO 616
atggagaacagcgccagggccagcaatggggaggtggcggctgtcccggactcgtggaacttcgtgccgaacgagaccctcctgggcctggcgtcgatctcggtgcgcggcgtgctagccaagatcaaggccgagatgggtgccgcaggcggcggcggcggcgggcggccggtgatcccgatgggccacggcgacccgtcggcgttcccgtgcttccggacgtcgccggaggccgtggacgccgtcgccggcgcgctccagtccggcgagtacaactcctactccacttgcgtcggccttgagccagcacggaggtccattgcgcagtacttatcccgtgatttgccatatgaattgtcactcgatgatgtctacctcacaaacggctgtgttcaagcaattgagataatctgctctgtgttagctcgtcctggtgccaatatcttgctcccaagacctggctacaagttttatgaggcgcgcgctgttttcaacggaatggaagcccggtacttcgatcttctacctgagaaagactgggaggttgacactgattgcgtccaagctcttgctgacaagaatactgttgccattgtcctcatcaacccaggaaacccatgtggcaatgtgtactcctatgagcacctggccaaggttgccgagacagcacggaagcttggcatatttgtaatagcagatgaggcttacgcacacttgacatttggagagaggaaatttgtgccgatgggtgtgtttggggctgtggctccagtgctcacactggggtcattatcaaagagatggctggtgcccggttggcggctgggatggattgttaccaatgatcctaatggtgtatttcagagaaccaaggtagccgctagcatcaggacctaccattatatctgctctgatcctacaacatttgttcaggcagcagttccgaacctcctggagaactccaaggaggaattcttccaacaaaccatcaaaattctcaaagaaagtgcagatctatgctgggagaagttgaaggacatcaacggagtcacatgcccaagcaaaccaatgggatccatgtttgtaatggtgaagctagatctgtcctgcctgcaggacatcaaagatgacatggacttctgctgccggctggcaaaggaggaatcagttgttgttctgccaggacgtgttgtgggatgcaaggattggctccggatcacctttgcaattgatccgtcttctctcgaagacggccttgacaggctcaattccttctgcctgcgacacagcagcaagccggccggtgctgtcagggcaggaaccctttag

SEQ ID NO: 616 - protein, 442 aa, Sorghum bicolor
  misc_feature: Ceres ANNOT ID no. 6008686
  misc_feature (56)..(422): Pfam Id: Aminotran_1_2 Pfam Desc: Aminotransferase class I and II
  misc_feature (8)..(432): NCBI GI: 6498122 NCBI Desc: nicotianamine aminotransferase a [hordeum vulgare subsp. vulgare]
  misc_feature (8)..(432): NCBI GI: 6469090 NCBI Desc: nicotianamine aminotransferase [hordeum vulgare subsp. vulgare]
  misc_feature (2)..(432): NCBI GI: 6469089 NCBI Desc: nicotianamine aminotransferase [hordeum vulgare subsp. vulgare]
  misc_feature (2)..(432): NCBI GI: 6469087 NCBI Desc: nicotianamine aminotransferase b [hordeum vulgare subsp. vulgare]
  misc_feature (32)..(430): NCBI GI: 27525396 NCBI Desc: tyrosine aminotransferase [solenostemon scutellarioides]
  misc_feature: Useful for making plants with modulated nitrogen use efficiency
  misc_feature: Functional homolog of the protein sequence given in SEQ ID NO 12942
  misc_feature: The sequence is a functional homolog of SEQ ID NO. 526 in the 11/188,298 US application
  misc_feature: The sequence is a functional homolog of SEQ ID NO. 286 in the 11/188,298 US application
  misc_feature: The sequence is a functional homolog of SEQ ID NO. 527 in the 11/188,298 US application
MENSARASNGEVAAVPDSWNFVPNETLLGLASISVRGVLAKIKAEMGAAGGGGGGRPVIPMGHGDPSAFPCFRTSPEAVDAVAGALQSGEYNSYSTCVGLEPARRSIAQYLSRDLPYELSLDDVYLTNGCVQAIEIICSVLARPGANILLPRPGYKFYEARAVFNGMEARYFDLLPEKDWEVDTDCVQALADKNTVAIVLINPGNPCGNVYSYEHLAKVAETARKLGIFVIADEAYAHLTFGERKFVPMGVFGAVAPVLTLGSLSKRWLVPGWRLGWIVTNDPNGVFQRTKVAASIRTYHYICSDPTTFVQAAVPNLLENSKEEFFQQTIKILKESADLCWEKLKDINGVTCPSKPMGSMFVMVKLDLSCLQDIKDDMDFCCRLAKEESVVVLPGRVVGCKDWLRITFAIDPSSLEDGLDRLNSFCLRHSSKPAGAVRAGTL

SEQ ID NO: 617 - DNA, 1302 bp, Sorghum bicolor
  misc_feature: Ceres ANNOT ID no. 6008695
  misc_feature: Encodes the peptide sequence at SEQ ID NO 618
atggagaacagcagcggcagcgccagcaatggcgaggtggcggcggctttccgggtcccggactcgtggaacttcgagccgaacgagaggctcctgggcctgatgtcgctctcggtgcgcggcgtgctagccaagatcaaggccgagatggttgccggcggcggcggcggcgctggtggaaggccggtgatcccgatgggccacggcgacccgtcggcgttcccgtgcttccggacggcgccggaggccgtggacgccgtcgccggcgcgctgcagtccggcgagtacaactcctactccacctgcgtcggccttgagccagcacggaggtccattgcacagtacttatcccgtgatttgccatatgaattgtcacttgatgatgtctacctcacaaacggctgtgctcaagcaattgagataatctgctctgtgttagctcgtcctggtgccaacatcttgctaccaaggcctggctacaagttctatgaggcgcgtgctgttttcaacggaatggaagcccggtacttcgatcttctacctgggaaagactgggaggttgacactgagtgtgtccaagctcttgcagacaagaatactgttgccattgtcattatcaacccaggaaacccatgtggcaatgttgctgagacggcacggaagcttggcatatttgtaatagcagatgaggcttatgcacacttgacatttggagagaggaaatttgtgccgatgggtgtgtttggggctgtggctccagtgctcacactggggtcattatcaaagagatggctggtgcccggttggcggcttggatggattgttacaaatgatcctaatggtgtatttcagagaaccaaggtagccgctagcatcaggacctatcattatatctgctctgatcctacaacatttgttcagggagcagttccaaacctcctggagaactcaaaggaggaattcttccaaaagaccatcaaaattctcaaagaaagtgcagacatgtgctgggaaaagatgaagcacatcaacggaatcacatgcccaagcaaaccaatgggatccatgtttgtaatggtgaaactggatctgtcctgcctgaaggacatcaaagatgacatggacttctgctgccggctggcaaaggaagaatcagtggttgttctgccaggacgtgttgtgggatgcaaggattggctccggatcacctttgcaattgacccatcttctctcgaagacggccttgacaggctcaagtccttctgcctgcgacacagcaagacggccggcggagtgatgtga

SEQ ID NO: 618 - protein, 433 aa, Sorghum bicolor
  misc_feature: Ceres ANNOT ID no. 6008695
  misc_feature (61)..(418): Pfam Id: Aminotran_1_2 Pfam Desc: Aminotransferase class I and II
  misc_feature (215)..(427): NCBI GI: 115485877 NCBI Desc: os11g0552000 [oryza sativa (japonica cultivar-group)]
  misc_feature (1)..(215): NCBI GI: 77551448 NCBI Desc: tyrosine aminotransferase [oryza sativa (japonica cultivar-group)]
  misc_feature (4)..(427): NCBI GI: 6498122 NCBI Desc: nicotianamine aminotransferase a [hordeum vulgare subsp. vulgare]
  misc_feature (2)..(427): NCBI GI: 6469089 NCBI Desc: nicotianamine aminotransferase [hordeum vulgare subsp. vulgare]
  misc_feature (4)..(427): NCBI GI: 6469090 NCBI Desc: nicotianamine aminotransferase [hordeum vulgare subsp. vulgare]
  misc_feature: Useful for making plants with modulated nitrogen use efficiency
  misc_feature: Functional homolog of the protein sequence given in SEQ ID NO 12942
  misc_feature: The sequence is a functional homolog of SEQ ID NO. 526 in the 11/188,298 US application
  misc_feature: The sequence is a functional homolog of SEQ ID NO. 286 in the 11/188,298 US application
  misc_feature: The sequence is a functional homolog of SEQ ID NO. 527 in the 11/188,298 US application
MENSSGSASNGEVAAAFRVPDSWNFEPNERLLGLMSLSVRGVLAKIKAEMVAGGGGGAGGRPVIPMGHGDPSAFPCFRTAPEAVDAVAGALQSGEYNSYSTCVGLEPARRSIAQYLSRDLPYELSLDDVYLTNGCAQAIEIICSVLARPGANILLPRPGYKFYEARAVFNGMEARYFDLLPGKDWEVDTECVQALADKNTVAIVIINPGNPCGNVAETARKLGIFVIADEAYAHLTFGERKFVPMGVFGAVAPVLTLGSLSKRWLVPGWRLGWIVTNDPNGVFQRTKVAASIRTYHYICSDPTTFVQGAVPNLLENSKEEFFQKTIKILKESADMCWEKMKHINGITCPSKPMGSMFVMVKLDLSCLKDIKDDMDFCCRLAKEESVVVLPGRVVGCKDWLRITFAIDPSSLEDGLDRLKSFCLRHSKTAGGVM

SEQ ID NO: 619 - DNA, 411 bp, Sorghum bicolor
  misc_feature: Ceres ANNOT ID no. 6008781
  misc_feature: Encodes the peptide sequence at SEQ ID NO 620
atgtcttcgtcggcggcgtaccctgacgcggacgagaatctggaggccatcatcacccgcgtcgagcagaagtcccgaaagatcgagaccctcctcaagcagtcgaagccggtggaggccctgaagacggcgctggaggggtcgcccctcaagacccgcgacgagcgatgcaagtctgcgaactggatcgtggtgcaccgcgcgatgatggcgatcagggacgtcgacggcatgttcaactccctggatcccgagtactacgacatcctcatgaagtacctttatagaggtttatctacaggggataggccaacatgtgaccagtgcctcaaaattcatgaaaagctgactgagaaggcaggcctaggctgtatattgcggtcccttgctgatactgtaaacactgtatga

SEQ ID NO: 620 - protein, 136 aa, Sorghum bicolor
  misc_feature: Ceres ANNOT ID no. 6008781
  misc_feature (3)..(135): Pfam Id: P16-Arc Pfam Desc: ARP2/3 complex 16 kDa subunit (p16-Arc)
  misc_feature (5)..(136): NCBI GI: 23505771 NCBI Desc: at4g01710/t15b16_22 [arabidopsis thaliana]
  misc_feature (11)..(132): NCBI GI: 19920586 NCBI Desc: cg9881-pa [drosophila melanogaster]
  misc_feature (20)..(131): NCBI GI: 119640027 NCBI Desc: actin related protein 2/3 complex subunit 5 [suberites domuncula]
  misc_feature (9)..(132): NCBI GI: 114864933 NCBI Desc: arp2/3 complex subunit arpc5 [anopheles funestus]
  misc_feature (27)..(132): NCBI GI: 125984442 NCBI Desc: ga22095-pa [drosophila pseudoobscura]
MSSSAAYPDADENLEAIITRVEQKSRKIETLLKQSKPVEALKTALEGSPLKTRDERCKSANWIVVHRAMMAIRDVDGMFNSLDPEYYDILMKYLYRGLSTGDRPTCDQCLKIHEKLTEKAGLGCILRSLADTVNTV

SEQ ID NO: 621 - DNA, 1998 bp, Sorghum bicolor
  misc_feature: Ceres ANNOT ID no. 6008784
  misc_feature: Encodes the peptide sequence at SEQ ID NO 622
atgtccatgccggagacgttcaccgtgaaggtcggggaggcgacgccggccgccggcggcaggccgtcggccgggcccgtctaccggagcatctatgccaaggacggcctcatggtgctcccacaggacatccactccccttgggacttcttcagtggagcagtcaagaagtaccccattaacaggatgctcggccggcgccaagttattacagatggcaaggccggtgagtatgtgtggcaaacgtacgaggaagtgtaccagaaggtcatgaggattggatcagccatcagaagcttgggcgtagagccgggagctcactgtggcatatatggatccaactgcccggaatgggttatggccatgcaggcatgcaactgtcaaggaatatgttatgtgccactgtatgacaccctcggagcgaatgctgttgaattcatcatggaccatgctgagatatccattgcctttgtccaggagagcaagatcaaatcaatactagcagtagtccctaagtgcacagcccaccttagagccattgttagttttggagattttgcaagtgagatgaaaatggaagctgaaaaattgggtgtctcttgcttttcctgggaagagttttcttcaatgggaaaacaagactacaaacttcccaataaatgtaaggatgatatttgtacgatcatgtataccagcggaacaactggagatcccaaaggtgtgataatcacaaacagggctatcattgctggtattatgaccacagaacacctcctcaaagagacagataaagtgatcacagaagaggattcctatttttcctaccttccattagcacatatatttgatcaagtaattgagaactactgtatttctaaaggagcctccatcggattctggcaaggggacattaggtatctgatggaggatgtgcaagtgatgaaaccgacaatattttgtggtgttcctcgtgtttatgatcgtatatatacaggtataaacatgaaaattcagtctggagggatgatagccaaacacctttttcagtatgcatacaactataaacttaccaatatgaagaaagggctgaagcagcatgaagcatcaccatttttcgacaagatagttttcagcaaaattaaggaagggcttggagggcgtatccgtctcatgatagcaggagcagcacctttgccagggcaaatcgaagagttcatgcgggtaaccagctgcagcgttgtagtacaaggatatgggctcactgagagttgtgcaggatgcttcacgtcaatcgccaatgttttctcaatgataggaacagttggccctcctgtcacaacaattgaagcacgactcgagtctgtccctgaaatgggctatgatgcactgtcagatatgccccggggtgagatctgtttgaggggccacaccatgttctctgggtactacaagcgccctggcctcactgaagaagtgttctctgatggctggttccatacaggtgatattggcgagtggcaacccaatggcgcgatgaagatcattgacagaaagaagaacatcttcaagctgtcccagggagagtatgtagcagttgaggtcctggaaagagcatacatgcagtccccccttgtggcatcggtctgggtctatgggaacagctttgagtcattccttgtcgctgtggttgtccctgagaggcaagctctcgaggaatgggcagcagccaacaacaaggccggcgattttgcagagctgtgcattgatcccaaagcaaggagttacattcaggatcagctgaaccaaactggcaagaaacttgggttgagaggctttgagatgttgaaagcagtttacctggagccggtgcctttcagcatcgagaaggacctcatcactccaacttttaagctcaagagaccacagctgctcaaatattacaaggatcgcatcgaccagatgtacaaggatgccaaggaggggagaactgcaccgtga

SEQ ID NO: 622 - protein, 665 aa, Sorghum bicolor
  misc_feature: Ceres ANNOT ID no. 6008784
  misc_feature (82)..(550): Pfam Id: AMP-binding Pfam Desc: AMP-binding enzyme
  misc_feature (1)..(662): NCBI GI: 1617268 NCBI Desc: acyl coa synthetase [brassica napus]
  misc_feature (7)..(660): NCBI GI: 74147576 NCBI Desc: acs-like protein [gossypium hirsutum]
  misc_feature (1)..(655): NCBI GI: 74147588 NCBI Desc: acs-like protein [gossypium hirsutum]
  misc_feature (9)..(659): NCBI GI: 115439199 NCBI Desc: os01g0681200 [oryza sativa (japonica cultivar-group)]
  misc_feature (9)..(660): NCBI GI: 83320523 NCBI Desc: acs1 [ricinus communis]
MSMPETFTVKVGEATPAAGGRPSAGPVYRSIYAKDGLMVLPQDIHSPWDFFSGAVKKYPINRMLGRRQVITDGKAGEYVWQTYEEVYQKVMRIGSAIRSLGVEPGAHCGIYGSNCPEWVMAMQACNCQGICYVPLYDTLGANAVEFIMDHAEISIAFVQESKIKSILAVVPKCTAHLRAIVSFGDFASEMKMEAEKLGVSCFSWEEFSSMGKQDYKLPNKCKDDICTIMYTSGTTGDPKGVIITNRAIIAGIMTTEHLLKETDKVITEEDSYFSYLPLAHIFDQVIENYCISKGASIGFWQGDIRYLMEDVQVMKPTIFCGVPRVYDRIYTGINMKIQSGGMIAKHLFQYAYNYKLTNMKKGLKQHEASPFFDKIVFSKIKEGLGGRIRLMIAGAAPLPGQIEEFMRVTSCSVVVQGYGLTESCAGCFTSIANVFSMIGTVGPPVTTIEARLESVPEMGYDALSDMPRGEICLRGHTMFSGYYKRPGLTEEVFSDGWFHTGDIGEWQPNGAMKIIDRKKNIFKLSQGEYVAVEVLERAYMQSPLVASVWVYGNSFESFLVAVVVPERQALEEWAAANNKAGDFAELCIDPKARSYIQDQLNQTGKKLGLRGFEMLKAVYLEPVPFSIEKDLITPTFKLKRPQLLKYYKDRIDQMYKDAKEGRTAP

SEQ ID NO: 623 - DNA, 1062 bp, Sorghum bicolor
  misc_feature: Ceres ANNOT ID no. 6008876
  misc_feature: Encodes the peptide sequence at SEQ ID NO 624
atggcggcggcccaagcggaggcggaggaggagctgccgctggagctggaggcggtggcggcggtgtacggggaccacgtacgcgtgctccgcgacctcccgccacacctcgtcgtcgacgtgcggccccgcaccgccgatgactcctcgcagcagtttgtggagctttttcttggaattaaagcatcttcacagtatccgaaggaaccaccacatatttatgctgtggaaagtaagggccttgatgaaaatcgacagatatatcttattaccagcatccagagcaaggcaaaagaactttcaaactacccaatgtttgtgacgttgtgtgaggaagctggagagatcctctcgaatatgaatcatccagctggggattgtccattgtgtctgtatcctttagtgggagaggataaggttggatcagagttgccatttatgaagttgatgtcatgctaccactgcttccacagtgactgcattatgagatggtgggaatggctccaacatggtgatgccaacctgaaggagcgtaatactggagacaagcattataatgtgaatcagccaagaggattttgtccagtttgccgcaaggtgttcgatgaaaaggatattgagcatgttcgtgatcttttgggtgacaatacttcccggctggtatcgttaacaggtgacctcggtgaagatgaaactgaattactccattctgaggcagagcaaaacaggagaaaaagaattgagtcaattgttaatctgcagcaagaacgaaacggcctgattgaaccaaagaaagacctcgccatacaaccaggaatgtatgtttctcttcctcccagcacaccagagacagctgaagaagagaatgcggatcccagcaaagacacggctacttcaacctcagaaacagagcatcgtggcctggcaaacaacaccagtagcaataagcccaagaattcaggccatcgaaggagaaacagagctaatgcatcaagaagacagcctcaccctcacggccagtctgctaggcagcagtggcagaggaaagaagcagacacctga

SEQ ID NO: 624 - protein, 353 aa, Sorghum bicolor
  misc_feature: Ceres ANNOT ID no. 6008876
  misc_feature (7)..(117): Pfam Id: RWD Pfam Desc: RWD domain
  misc_feature (127)..(197): Pfam Id: zf-C3HC4 Pfam Desc: Zinc finger, C3HC4 type (RING finger)
  misc_feature (9)..(349): NCBI GI: 30695166 NCBI Desc: rwd domain-containing protein [arabidopsis thaliana]
  misc_feature (1)..(350): NCBI GI: 59858139 NCBI Desc: ring finger protein 25 [bos taurus]
  misc_feature (8)..(338): NCBI GI: 41056245 NCBI Desc: similar to ring finger protein 25 [danio rerio]
  misc_feature (2)..(349): NCBI GI: 10946616 NCBI Desc: ring finger protein 25 [mus musculus]
  misc_feature (2)..(349): NCBI GI: 18490513 NCBI Desc: rnf25 protein [mus musculus]
  misc_feature: The sequence is a functional homolog of SEQ ID NO. 424 in the 11/188,298 US application
  misc_feature: The sequence is a functional homolog of SEQ ID NO. 329 in the 11/188,298 US application
MAAAQAEAEEELPLELEAVAAVYGDHVRVLRDLPPHLVVDVRPRTADDSSQQFVELFLGIKASSQYPKEPPHIYAVESKGLDENRQIYLITSIQSKAKELSNYPMFVTLCEEAGEILSNMNHPAGDCPLCLYPLVGEDKVGSELPFMKLMSCYHCFHSDCIMRWWEWLQHGDANLKERNTGDKHYNVNQPRGFCPVCRKVFDEKDIEHVRDLLGDNTSRLVSLTGDLGEDETELLHSEAEQNRRKRIESIVNLQQERNGLIEPKKDLAIQPGMYVSLPPSTPETAEEENADPSKDTATSTSETEHRGLANNTSSNKPKNSGHRRRNRANASRRQPHPHGQSARQQWQRKEADT

SEQ ID NO: 625 - DNA, 3030 bp, Sorghum bicolor
  misc_feature: Ceres ANNOT ID no. 6008904
  misc_feature: Encodes the peptide sequence at SEQ ID NO 626
atgtcgtccgacatcaggaaatggttcatgaagacgcaggacaagagcggggcggcctctggagccgcagcggcgaagccgtcaggggcggcggcagcggccgagaagaagaagcccgtgctcagcattcccgagaagaagtcggggccgcccgcattgggattcagttttggtcaatgtgttacttgcagcaacgatagggtcacaggggatgtccctgtggtgtcctgtgatcatgatcctcctgctagaaggaagacaagcaagtactttgggtcaaaaggagagaaggaatcagatgttgaaatggcagacgcctctgccggaaagagtgctgacaagagtgcggctaaaagaaaacttcagaaatgcaacaatgaacttaaggaggacagcaagcctttgccagcaaagaaaatgtctaaggatgaagaagatgacgatgacgactttgtggcacctccaaagaagaaaactccagtgaagccaccgccttcaaaaaaggctaaagttgaatctaatgctcaagttgatgacgctgaggatgaggacaggatggatgaagatgccaagaccccctcaaaaggagctggaagaggaaggggaaggggaggaagaggagcaggagcaggagctgccactgggggcagaggtagaggaggaggtgggagaggttttatgaattttggtgagaggaaagatcctcctcacaaaggagaaaaggaggtcccagagggtgcccctgactgtttatctggtctgacatttgtcataagtggtacccttgacagtcttgaacgtgaggaagcaactgatctaattaagcgttatggtggccgtgtgactggctctattagtaaaaagacgagctacttactggctgacgaagacattggtggagttaaatctaacaaagcaaaagatctgggtgtcccattcttgactgaagatggtttatttgatttgatccgaaaatcaaagcctgcaaaggctcctgtagacaaacatcaaagcaacaacagttctgaaaagcttcagaaatcactgacaaagagctctccagctaaagttgaaaaacgagctgaggcaagtgctgtgggaaaaagtattgcttcaaatagtaatgctgcaagtgcctccgctgacaaacaaaagcccaagaatgttgaccgtggttctatgcaatggacagaaaaatatcggccaaaagttccaaatgacatagttggcaatcaatcaatggtcaaacaacttcatgattggttgaaaagttgggatgcactattccttcattctggccaaaagggtaagggaaagaaacaaactgacagtgcagccaaaaaggctgtgttgctgagtggacctcctggtattggtaagactactactgctaaagttgttagtcagatgcttggactgcaggccattgaggtaaatgcgagtgatagccgtggtaaggcagactccaagattgagaagggtgttggggggagtacatcaaattctatcaaagagcttatcagcaacgcgactctgaattatggtgacaatcggtcaaaacatcccaaagctgtactaatcatggatgaagttgacggtatgtctgctggagatagaggtggtgttgctgatcttattgctagcatcaagatatccaagatccctattatctgcatttgtaatgaccgttatagccagaaattgaagagtcttgttaattactgcctgatgctcaacttcagaaaaccaacgaaacaacagatgggtaaaagattgatggaaattgccaaaaaggaaggtattcaagctcaagagaatgcaatggaagagcttgctgaaagagtgcacggagatattcgcatggcactcaaccatttgcagtatatgagcctctcccaatctgtggtcaaatacgatgatataagggagcgacttaacagcagttcaaaggatgaagatatttctccttttactgctgttgacaaactttttggtttcaatggtgggaggttaaggatggatgagagaattgattttggcatgagcgatcctgatttagttcccttgattatccaggaaaattatatcaattatcggcctaacaccatcgggaaggatgaaagtggagttaaaagaatgaatgctctagcccgggctgctgaatctatagcggacggtgatcttgttaatgtacaaataagaagatatcgacagtggcagttgtcgcaagctgcttgttttgcttcatctatagtacctgccgcttggatgcatgggaacagagaaatccttgaagcgggtgagcggaattttaataggtttggtggatggttgggtaagtactcaactactaacaaaaacagaaggctactggaagatgtccacagtcatattcttgcctcccagcaagcaaacttggacagggaggcattgaggttggattatcttactcttattttgagagagctgactgacccactgaaaaaaatgtcaaaggatgaagctgttcaaaaggtggtagagtttatggatacatactctttaagccaggaagacttcgacacgattgtggaagtatccaaatttaagggtcatccaagtcctatggatgggattcaacctgctgttaaaagtgccttgacaaaggcatacaaacaaggaagtagttctcgtgttgttcgagcagcagatctaataaatattccaggcatgaaaaagccattaaagaaacgagtggctgcaatcttggagccagtagaagagagcctgcctgaagaaaatggcgcatcagctgaagatgatgaagatgattcttctgacactgaaaataatgatgaacttgtccctgctaactctacgccgaagctggacctgcaaagtgacaagaagaaaggaattcaagtccagcttgacctgaagagcaatgggaatggctctggtgggaagaaggcgcctgccgccagatcaagagtgactgggtcaggtgggaaggccgcggcgggtggttcagctggtaagaggaagaggtaa

SEQ ID NO: 626 - protein, 1009 aa, Sorghum bicolor
  misc_feature: Ceres ANNOT ID no. 6008904
  misc_feature (723)..(886): Pfam Id: RFC1 Pfam Desc: Replication factor RFC1 C terminal domain
  misc_feature (246)..(323): Pfam Id: BRCT Pfam Desc: BRCA1 C Terminus (BRCT) domain
  misc_feature (449)..(632): Pfam Id: AAA Pfam Desc: ATPase family associated with various cellular activities(AAA)
  misc_feature (1)..(1009): NCBI GI: 30314655 NCBI Desc: replication factor c 110 kda subunit [oryza sativa (japonica cultivar-group)]
  misc_feature (110)..(1009): NCBI GI: 13374860 NCBI Desc: replication factor c large subunit-like protein [arabidopsis thaliana]
  misc_feature (467)..(1009): NCBI GI: 22095163 NCBI Desc: replication factor c large subunit [triticum sp.]
  misc_feature (224)..(965): NCBI GI: 6755306 NCBI Desc: replication factor c 1 [mus musculus]
  misc_feature (224)..(965): NCBI GI: 405112 NCBI Desc: activator 1 large subunit [mus musculus]
MSSDIRKWFMKTQDKSGAASGAAAAKPSGAAAAAEKKKPVLSIPEKKSGPPALGFSFGQCVTCSNDRVTGDVPVVSCDHDPPARRKTSKYFGSKGEKESDVEMADASAGKSADKSAAKRKLQKCNNELKEDSKPLPAKKMSKDEEDDDDDFVAPPKKKTPVKPPPSKKAKVESNAQVDDAEDEDRMDEDAKTPSKGAGRGRGRGGRGAGAGAATGGRGRGGGGRGFMNFGERKDPPHKGEKEVPEGAPDCLSGLTFVISGTLDSLEREEATDLIKRYGGRVTGSISKKTSYLLADEDIGGVKSNKAKDLGVPFLTEDGLFDLIRKSKPAKAPVDKHQSNNSSEKLQKSLTKSSPAKVEKRAEASAVGKSIASNSNAASASADKQKPKNVDRGSMQWTEKYRPKVPNDIVGNQSMVKQLHDWLKSWDALFLHSGQKGKGKKQTDSAAKKAVLLSGPPGIGKTTTAKVVSQMLGLQAIEVNASDSRGKADSKIEKGVGGSTSNSIKELISNATLNYGDNRSKHPKAVLIMDEVDGMSAGDRGGVADLIASIKISKIPIICICNDRYSQKLKSLVNYCLMLNFRKPTKQQMGKRLMEIAKKEGIQAQENAMEELAERVHGDIRMALNHLQYMSLSQSVVKYDDIRERLNSSSKDEDISPFTAVDKLFGFNGGRLRMDERIDFGMSDPDLVPLIIQENYINYRPNTIGKDESGVKRMNALARAAESIADGDLVNVQIRRYRQWQLSQAACFASSIVPAAWMHGNREILEAGERNFNRFGGWLGKYSTTNKNRRLLEDVHSHILASQQANLDREALRLDYLTLILRELTDPLKKMSKDEAVQKVVEFMDTYSLSQEDFDTIVEVSKFKGHPSPMDGIQPAVKSALTKAYKQGSSSRVVRAADLINIPGMKKPLKKRVAAILEPVEESLPEENGASAEDDEDDSSDTENNDELVPANSTPKLDLQSDKKKGIQVQLDLKSNGNGSGGKKAPAARSRVTGSGGKAAAGGSAGKRKR

SEQ ID NO: 627 - DNA, 1194 bp, Sorghum bicolor
  misc_feature: Ceres ANNOT ID no. 6008907
  misc_feature: Encodes the peptide sequence at SEQ ID NO 628
atggcatctgaaactgatgacaaagctaagatggagagtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgtcagagaagttcacaatgcccaatgtgttggcagtctattagcatgaaggatcctaccagtcaggagcttcttgaggcagtagagcgtgagaggaatataagaaccaatcaaactcgaaacacgactatatttcatcatcctgctcttggggattttgagctgcagcatctgcctgttggtaatgatgctgagcttgaagagcgtatattacagcatctagctgctgctgctgcaatgggaagggcacaccatcttggaaggagggaggggcacaggggacgatctggctctcatggtcgtccacagttcctagttttctctacacatccaaattcaccatctgctggcacaatttcttcatcttctgctcatgtggagggagaaaatgattcaaatcctgccacccctagagctagtgagtcatctccacgagctattcgcattggagatgcgggaaaccaaagtcccgggatgcttacctacgatgctgaacaggatgctgtcgtatcttccggaaatagcactcctgtatcgagtcctcggttttttaacaggagacactccactggacagtcaactccagacagggctggaccatcggatattcagtctttctcagactccctgaagtctcgcttaaatgctgtctctatgaagtacaaagaatctattacaaagagtactcgagggtggaaggagagactcttttcacgcaattcgtccgtggcggatcttggttctgaagtgagaagagaagttaatgctggaatcgcgtccgtgtcacggatgatggagcgtctggaaactagaggaaatagcagaacaggtgatagcccgacagcatccacttctgaagttcctcccgctacagaatcaagcaatgaaagggttacagagagcaactctgctgctgctgctgctgctgctggtactactaccactacaagtcccagtgctagcaacaccgcagccccttgtgttgcgacatccggatcaaactag

SEQ ID NO: 628 - protein, 397 aa, Sorghum bicolor
  misc_feature: Ceres ANNOT ID no. 6008907
  misc_feature (33)..(73): Pfam Id: zf-C3HC4 Pfam Desc: Zinc finger, C3HC4 type (RING finger)
  misc_feature (6)..(385): NCBI GI: 87240562 NCBI Desc: zinc finger, ring-type [medicago truncatula]
  misc_feature (14)..(369): NCBI GI: 30688252 NCBI Desc: zinc finger (c3hc4-type ring finger) family protein [arabidopsis thaliana]
  misc_feature (28)..(191): NCBI GI: 121489747 NCBI Desc: ring-h2 zinc finger protein precursor [phillyrea latifolia]
  misc_feature (1)..(114): NCBI GI: 32400766 NCBI Desc: ring-h2 finger protein [triticum aestivum]
  misc_feature (13)..(243): NCBI GI: 30682750 NCBI Desc: zinc finger (c3hc4-type ring finger) family protein [arabidopsis thaliana]
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 424 in the 11/188,298 US application
MASETDDKAKMESLTSAAAFVEGGIQDACDDACSICLEAFCESDPSALTGCKHEFHLQCILEWCQRSSQCPMCWQSISMKDPTSQELLEAVERERNIRTNQTRNTTIFHHPALGDFELQHLPVGNDAELEERILQHLAAAAAMGRAHHLGRREGHRGRSGSHGRPQFLVFSTHPNSPSAGTISSSSAHVEGENDSNPATPRASESSPRAIRIGDAGNQSPGMLTYDAEQDAVVSSGNSTPVSSPRFFNRRHSTGQSTPDRAGPSDIQSFSDSLKSRLNAVSMKYKESITKSTRGWKERLFSRNSSVADLGSEVRREVNAGIASVSRMMERLETRGNSRTGDSPTASTSEVPPATESSNERVTESNSAAAAAAAGTTTTTSPSASNTAAPCVATSGSN

SEQ ID NO: 629 - DNA, 1764 bp, Sorghum bicolor
  misc_feature: Ceres ANNOT ID no. 6008908
  misc_feature: Encodes the peptide sequence at SEQ ID NO 630
  misc_feature: Down-regulated in shoot tissues in response to aminocyclopropane carboxylic treatment
atgccgccgctcgccgcgcgcgtccacgccccgattctcctcgcccccgtcgcacctcaccccgccacgcgcctctgcgcatcaagcgggccccgcggcggcgtcggcgggttcaggaggggcgcgctggcctcggagaagccgcaggcggtggcggtcgcggagaaagccggcggcgaggttggtggaggagagggcgagggcccgtacgacgcgattgtgatcgggtccgggatcggaggcctggtggcggccacgcagctcgcggccaagggcgcgcgggtgctggtcctcgagaagtacctcatccccgggggaagctccgggtactaccgccgcgacgggttcaccttcgacgtcggctcctccgtcatgttcggcttctctgacaagggtaacttgaatttgatcacacaagcattggaagcagttgggcgtaagatggaagttctacctgacccttctacagtccatttccacctacctggtgatctctctgtccttgtgcatagaaagtatgaagacttcatcaacgaactgatcagcaaattccctcacgagaaagaagggatccttaaattctacgatacgtgctggaagatcttcaattcactaaattcgttggagctgaagtctctagaggaacctctttatctttttgggcaattttttcagaagcctctggaatgcttaactctagcttattatttgccacagaatgctggggatattgctcgcaagttcattaaagatcaggagctactctccttcatagatgccgagtgttttattgtgagcacagtcaatgccttacaaacacccatgataaatgcaagcatggtcttgtgcgataggcactttggggggattaattatccagttggtggtgttggtggtattgcaatatccctggcagatggccttgttgaaaagggcagtgaaatccgttacaaggcgaatgtaaccaatgttattcttgaaaatggaaaggctgttggggtgaggttatcaaatgggaaggagttctttgctaaaacggttatatcaaatgccactagatgggacacgtttggaaaactcttgaaagaaaaagaacttccagaagaggagaaaaactttcaaaagaattacgttaaagcaccatcattcctttcaattcatatgggtgtcaaagcgtcagttctgcctgctggcactgactgccaccattttgtacttgaggataattggaataatttggaaaagtcttatggaagcatatttttaagtatccctacagttcttgatccatcattagctcctgaaggacatcatatacttcatgtatttactaccgcaggcatagaagactgggagggtctttctaggaaggagtatgaagagaaaaaagaggaggtagccaatgagattataagaaggcttgaaaagaagttgtttcctggtcttcaagattcaatagtcctcaaagaggtaggctcaccaaaaactcaccgaagatttcttgctcgaaatgatggtacatatggaccaatgccacggggtaaaccgaagggcttactggctatgcctttcaatactacttcaatagacggcctttactgtgttggtgatagctgttttcccgggcaaggtgtcatagctgtagcattctcagggatcatgtgtgctcaccgagttgctgcagatattggactagagcaaaaatctccggttctagatgctggtcttcttgggctactcaggtggttcagaacacttgcatag

SEQ ID NO: 630 - protein, 587 aa, Sorghum bicolor
  misc_feature: Ceres ANNOT ID no. 6008908
  misc_feature (79)..(560): Pfam Id: Amino_oxidase Pfam Desc: Flavin containing amine oxidoreductase
  misc_feature (71)..(558): Pfam Id: DAO Pfam Desc: FAD dependent oxidoreductase
  misc_feature (61)..(587): NCBI GI: 90101585 NCBI Desc: carotenoid isomerase, chloroplast precursor (crtiso)
  misc_feature (48)..(587): NCBI GI: 75282667 NCBI Desc: carotenoid isomerase 1, chloroplast precursor (crtiso1) (ocrtiso22)
  misc_feature (48)..(587): NCBI GI: 62526627 NCBI Desc: carotenoid isomerase [oncidium cv. 'gower ramsey']
  misc_feature (24)..(587): NCBI GI: 19550437 NCBI Desc: carotenoid isomerase [lycopersicon esculentum]
  misc_feature (53)..(587): NCBI GI: 87299427 NCBI Desc: carotenoid isomerase [chrysanthemum x morifolium]
  misc_feature: Down-regulated in shoot tissues in response to aminocyclopropane carboxylic treatment
MPPLAARVHAPILLAPVAPHPATRLCASSGPRGGVGGFRRGALASEKPQAVAVAEKAGGEVGGGEGEGPYDAIVIGSGIGGLVAATQLAAKGARVLVLEKYLIPGGSSGYYRRDGFTFDVGSSVMFGFSDKGNLNLITQALEAVGRKMEVLPDPSTVHFHLPGDLSVLVHRKYEDFINELISKFPHEKEGILKFYDTCWKIFNSLNSLELKSLEEPLYLFGQFFQKPLECLTLAYYLPQNAGDIARKFIKDQELLSFIDAECFIVSTVNALQTPMINASMVLCDRHFGGINYPVGGVGGIAISLADGLVEKGSEIRYKANVTNVILENGKAVGVRLSNGKEFFAKTVISNATRWDTFGKLLKEKELPEEEKNFQKNYVKAPSFLSIHMGVKASVLPAGTDCHHFVLEDNWNNLEKSYGSIFLSIPTVLDPSLAPEGHHILHVFTTAGIEDWEGLSRKEYEEKKEEVANEIIRRLEKKLFPGLQDSIVLKEVGSPKTHRRFLARNDGTYGPMPRGKPKGLLAMPFNTTSIDGLYCVGDSCFPGQGVIAVAFSGIMCAHRVAADIGLEQKSPVLDAGLLGLLRWFRTLA

SEQ ID NO: 631 - DNA, 3351 bp, Sorghum bicolor
  misc_feature: Ceres ANNOT ID no. 6008968
  misc_feature: Encodes the peptide sequence at SEQ ID NO 632
  misc_feature: Up-regulated in root tissues in response to salicylic acid treatment
  misc_feature: Down-regulated in shoot tissues in response to salicylic acid treatment
atggtgactcctcccactgtcgagcatgaggacgaggagatgctcgtgcccgcccaggaggtggccgccgccgacaccgacgcagcacagcccatggaagtggtggcacagactgaggtggtgagcacggcggagagccagcctgtggaagatccgcagacatcgcggttcacatggacaattgagaacttcaccaggttcaatgggaagaagcactattcagaggtttttgtcgttggcggattcaaatggcgtgtgctgattttccccaaggggaacaatgtggaccatttctcaatgtacttggatgttgctgactcagccaacctcccgtatggttggagccgctatgctcagtttagtcttgctgttgtaaaccagatccagccgaagtatacgatacgcaaagatacccaacatcaatttaatgctcgtgagagtgattggggtttcacatcttttatgcctttgagtgacctctatgatgcaagtagaggttaccttgtgaatgatactgttgttgtggaggccgaggttgctgtccgcagaatggttgactattggacatatgactcaaaaaaggaaactggttatgtgggtctgaaaaaccaaggagctacctgttatatgaactcccttctacaaacactataccatataccgtacttcaggaaggctgtgtatcatatgccaaccactgaaaatgacatgccatcaggaagtattcctttggcactgcagagccttttctacaagctccagtacagtgacagtagtgtagctacaaaagagctgaccaaatcttttggatgggacacatatgattctttcatgcagcatgatgtacaagagctcaacagagttctctctgagaaacttgaggacaaaatgaagggaactgtcgtagaaggaacgattgagcaattatttgaaggtcaccacatcaattacattgagtgtataaatgttgagtataaatctaaccgcaaggagtccttttatgatcttcaacttgacgtcaaaggttgtcgtgacatttactcgtcatttgataaatatgttgaagttgaacgcctagagggtgataacaagtatcacgcagagaatcatggtttacaggatgcgaagaagggcgttcttttccttgattttccccctgttttgcaactccagctgaagcgctttgagtatgattatatgagagacaccatggttaagattaatgatcgctatgagttccctctgcaacttgatctggatagagatgatggcaaataccttgctccagatgcagatcgaagtacaagaaacctttacactcttcacagtgttcttgttcatagcggtggggtacatggtggtcactactatgcattcatacggccaactctatccgagcaatggtataaatttgatgatgagcgtgtaacaaaagaagatgctaagaaggctcttgaagagcaatatgggggtgaggaagagttgccccaaataaaccctggtttcaacaatgctccatttaaattcacgaagtattcaaacgcgtatatgcttgtttatattcgtgaaagtgacaaggagaaaattatgtgtactgttgatgaaaaagacattgctgagcatttaagggtaaggttgaaaaaagaacaagaagagaaagaacacaaaaagaaagaaaaagctgaagctcatctttataccataattaaggtagctcgagatgaggatttgaaggaacaaattggaaaggatatgtattttgatttggtggaccatgaaaaagtccgtaatttccgtatacagaaacaaatgccttttagttctttcaaggaggaagttgccaaggaatatggcatccctgtgcagtttcagcgcttctggttgtgggccaagaggcaaaaccatacataccgccctaatcgtccattgacccttcatgaggaaacacaatctgtggggcaactgagggaggtatcaaataaggcacacaatgctgagttaaagctgtttttggaagtagaagttgggctggatttgcggcctctccctcctcctgagaagggcaaggaagatattcttcttttcttcaaactctacaacccggaaaaggaagaacttcgttttatgggtaggcttttcgtgaaggccttgggcaaaccttcagaaatactggcaaaactaaacgaaatggctggattttcccctgaccaagaaattgagctttatgaggaaattaagtttgagccaaacgtgatgtgcgaaattattgacaagaagctcacttttcgttctagtcagcttgaagatggggacattgtctgtttccaaaaatcaccaggagcagaatatgatgcacaagtgcgatatccagatgttccttcatttttggagtatgtccataataggcaggttgtgcatttccggtctttggagaaaccaaaggatgatgatttttctttggaattgtcaaagcttcatacctatgatgatgttgttgagagagttgctcgccaacttgaattggatgatccagcgaaaattcggcttacatcccacaattgctactctcagcaacctaaaccacaacctgtcaaatatcgagtggagcatctgttggacatgctcatccattataatcagacgtctgacatcttgtattatgaagtgttggatataccactgccagaattgcagttcctaaaaaccctgaaagtcgcatttcaccatcctacgaaggatgaggttgttattcatagcatcaggcttccaaaaaatagcaccattgctgatgtaataaatgacttgaaaactaaggttgaactgtccagtcctaatgctgaactacgtgtgctagaagtcttttaccacaagatctataagatctttccactacaagagaagatagagaatataaatgatcaatattggacactacgtgccgaggagattccagaagaggagaaaaatataggtccaaatgatcggctaattcatgtttatcacttcatgaaagatattaatcagactcagcaaattcagaacttcggagaccctttctttctgcttattcatgaaggtgagactttagcagaagtcaagaagcgcatacagagtaaactgcaagtctctgctgatgaattttccaagtggaaatttgcgtttatatcgatgaatcggccagactacctccaggattcagatgttatatctactcgctttcagaggagagaggtctatggagcttgggagcaatatcttgggatggagcacactgatactgcaccaaaaagggcttatacagtgaatcagaaccgtcactcatacgagaagccagtcaaaatttacaattga

SEQ ID NO: 632 - protein, 1116 aa, Sorghum bicolor
  misc_feature: Ceres ANNOT ID no. 6008968
  misc_feature (196)..(520): Pfam Id: UCH Pfam Desc: Ubiquitin carboxyl-terminal hydrolase
  misc_feature (61)..(181): Pfam Id: MATH Pfam Desc: MATH domain
  misc_feature (1)..(1116): NCBI GI: 18415260 NCBI Desc: ubiquitin-specific protease 12 (ubp12) [arabidopsis thaliana]
  misc_feature (1)..(1116): NCBI GI: 11993471 NCBI Desc: ubiquitin-specific protease 12 [arabidopsis thaliana]
  misc_feature (1)..(1116): NCBI GI: 10178116 NCBI Desc: ubiquitin carboxyl-terminal hydrolase [arabidopsis thaliana]
  misc_feature (345)..(1114): NCBI GI: 115470711 NCBI Desc: os07g0163800 [oryza sativa (japonica cultivar-group)]
  misc_feature (463)..(1116): NCBI GI: 115485971 NCBI Desc: os11g0573000 [oryza sativa (japonica cultivar-group)]
  misc_feature: Useful for making plants with modulated cold sensitivity
  misc_feature: Useful for making plants with modulated nitrogen use efficiency
  misc_feature: Functional homolog of the protein sequence given in SEQ ID NO 13118
  misc_feature: Up-regulated in root tissues in response to salicylic acid treatment
  misc_feature: Down-regulated in shoot tissues in response to salicylic acid treatment
MVTPPTVEHEDEEMLVPAQEVAAADTDAAQPMEVVAQTEVVSTAESQPVEDPQTSRFTWTIENFTRFNGKKHYSEVFVVGGFKWRVLIFPKGNNVDHFSMYLDVADSANLPYGWSRYAQFSLAVVNQIQPKYTIRKDTQHQFNARESDWGFTSFMPLSDLYDASRGYLVNDTVVVEAEVAVRRMVDYWTYDSKKETGYVGLKNQGATCYMNSLLQTLYHIPYFRKAVYHMPTTENDMPSGSIPLALQSLFYKLQYSDSSVATKELTKSFGWDTYDSFMQHDVQELNRVLSEKLEDKMKGTVVEGTIEQLFEGHHINYIECINVEYKSNRKESFYDLQLDVKGCRDIYSSFDKYVEVERLEGDNKYHAENHGLQDAKKGVLFLDFPPVLQLQLKRFEYDYMRDTMVKINDRYEFPLQLDLDRDDGKYLAPDADRSTRNLYTLHSVLVHSGGVHGGHYYAFIRPTLSEQWYKFDDERVTKEDAKKALEEQYGGEEELPQINPGFNNAPFKFTKYSNAYMLVYIRESDKEKIMCTVDEKDIAEHLRVRLKKEQEEKEHKKKEKAEAHLYTIIKVARDEDLKEQIGKDMYFDLVDHEKVRNFRIQKQMPFSSFKEEVAKEYGIPVQFQRFWLWAKRQNHTYRPNRPLTLHEETQSVGQLREVSNKAHNAELKLFLEVEVGLDLRPLPPPEKGKEDILLFFKLYNPEKEELRFMGRLFVKALGKPSEILAKLNEMAGFSPDQEIELYEEIKFEPNVMCEIIDKKLTFRSSQLEDGDIVCFQKSPGAEYDAQVRYPDVPSFLEYVHNRQVVHFRSLEKPKDDDFSLELSKLHTYDDVVERVARQLELDDPAKIRLTSHNCYSQQPKPQPVKYRVEHLLDMLIHYNQTSDILYYEVLDIPLPELQFLKTLKVAFHHPTKDEVVIHSIRLPKNSTIADVINDLKTKVELSSPNAELRVLEVFYHKIYKIFPLQEKIENINDQYWTLRAEEIPEEEKNIGPNDRLIHVYHFMKDINQTQQIQNFGDPFFLLIHEGETLAEVKKRIQSKLQVSADEFSKWKFAFISMNRPDYLQDSDVISTRFQRREVYGAWEQYLGMEHTDTAPKRAYTVNQNRHSYEKPVKIYN

SEQ ID NO: 633 - DNA, 1215 bp, Sorghum bicolor
  misc_feature: Ceres ANNOT ID no. 6008996
  misc_feature: Encodes the peptide sequence at SEQ ID NO 634
atggggagcgcaccgccggcggccaccgtccaggagatgaggcgtgcgcagcgcgcggatgggccggccgccgtgctcgccatcggcacggcgaaccctccgagcatcatgccccaggacgattaccccgactactacttccgcgtcaccaacagcgagcacctcacggacctcaaggccaagctcagccggatctgcaaccacaacaagtccggcatcaggcagcgctacctgcacctcaacgaggagctgctggccgccaacccgggcttcatcgaccccaagcggccgtccctggacgagcgcgtggagatggcctccgccgccgtcccggagctggccgcgaaagccgccgccaaggccatcgcggagtggggccgcccggccaccgacatcacccacctcatcttcagcacctactccggcgcgcgtgccccgagcggcgaccgccgcctggcctccctcctgggcctccgccccacggtgtcccgcaccatcctcagcctccacggctgctacggcggggggagggcgctccagctcgccaaggagctcgccgagaacaaccgcggcgcgcgcgtcctcgtcgcctgctctgagctcacgctcatcgccttctacgggcccgagggaggctgcgtcgacaacatcatcggccagaccttgttcggtgacggcgccggcgccgtcatcgtcggcgccgaccccgtcggcgcccctgccgagcgcccgctgttcgagatggtgttcgcgtcgcagaccacgataccggagaccgaggacgccatctccatgcagtacagcaaatgcggcatggagtaccacctctccagccgggtgccccgcgtgctggggtccaacgtcgaacgctgccttgttgacacgttccgcacgctcggcgtcagcgtcgcatggaacgaccttttctgggcgatccatcccggcggccgtgccatcctggacaacatcgaggaagtgctccgtctggaggacgggaaactggcggcgagtcgccatgtgctcagcgagtttggcaacatgagtggcaccacggtgatcttcgtgctcgatgagttgcgccgccgtcgggcagcagcggccaagcagggagggcaagcgccggagtggggagtgatgatggcttttggaccgggaatcacagttgagaccatggtgctccacgccccaagcaacctggaactggagggaaattga

SEQ ID NO: 634 - protein, 404 aa, Sorghum bicolor
  misc_feature: Ceres ANNOT ID no. 6008996
  misc_feature (8)..(236): Pfam Id: Chal_sti_synt_N Pfam Desc: Chalcone and stilbene synthases, N-terminal domain
  misc_feature (247)..(397): Pfam Id: Chal_sti_synt_C Pfam Desc: Chalcone and stilbene synthases, C-terminal domain
  misc_feature (296)..(395): Pfam Id: ACP_syn_III_C Pfam Desc: 3-Oxoacyl-[acyl-carrier-protein (ACP)] synthase III C terminal
  misc_feature (1)..(398): NCBI GI: 115472461 NCBI Desc: os07g0525900 [oryza sativa (japonica cultivar-group)]
  misc_feature (9)..(398): NCBI GI: 5732950 NCBI Desc: chalcone synthase [lilium hybrid cv. 'acapulco']
  misc_feature (9)..(398): NCBI GI: 86604613 NCBI Desc: chalcon synthase [lilium speciosum]
  misc_feature (7)..(395): NCBI GI: 67942380 NCBI Desc: chalcone synthase [phalaenopsis hybrid cultivar]
  misc_feature (7)..(395): NCBI GI: 2253119 NCBI Desc: chalcone synthase [bromheadia finlaysoniana]
  misc_feature (7)..(395): SWISSPROT Homolog: EC 2.3.1.74 Chalcone synthase 8
  misc_feature (8)..(395): SWISSPROT Homolog: EC 2.3.1.95 Stilbene synthase 1
  misc_feature (7)..(399): SWISSPROT Homolog: EC 2.3.1.156 Phloroisovalerophenone synthase
  misc_feature: The sequence is a functional homolog of SEQ ID NO 2 in US patent 7202397
MGSAPPAATVQEMRRAQRADGPAAVLAIGTANPPSIMPQDDYPDYYFRVTNSEHLTDLKAKLSRICNHNKSGIRQRYLHLNEELLAANPGFIDPKRPSLDERVEMASAAVPELAAKAAAKAIAEWGRPATDITHLIFSTYSGARAPSGDRRLASLLGLRPTVSRTILSLHGCYGGGRALQLAKELAENNRGARVLVACSELTLIAFYGPEGGCVDNIIGQTLFGDGAGAVIVGADPVGAPAERPLFEMVFASQTTIPETEDAISMQYSKCGMEYHLSSRVPRVLGSNVERCLVDTFRTLGVSVAWNDLFWAIHPGGRAILDNIEEVLRLEDGKLAASRHVLSEFGNMSGTTVIFVLDELRRRRAAAAKQGGQAPEWGVMMAFGPGITVETMVLHAPSNLELEGN

SEQ ID NO: 635 - DNA, 1215 bp, Sorghum bicolor; identical to SEQ ID NO: 633
  misc_feature: Ceres ANNOT ID no. 6009000
  misc_feature: Encodes the peptide sequence at SEQ ID NO 636

SEQ ID NO: 636 - protein, 404 aa, Sorghum bicolor; identical to SEQ ID NO: 634
  misc_feature: Ceres ANNOT ID no. 6009000
  misc_feature (8)..(236): Pfam Id: Chal_sti_synt_N Pfam Desc: Chalcone and stilbene synthases, N-terminal domain
  misc_feature (247)..(397): Pfam Id: Chal_sti_synt_C Pfam Desc: Chalcone and stilbene synthases, C-terminal domain
  misc_feature (296)..(395): Pfam Id: ACP_syn_III_C Pfam Desc: 3-Oxoacyl-[acyl-carrier-protein (ACP)] synthase III C terminal
  misc_feature (1)..(398): NCBI GI: 115472461 NCBI Desc: os07g0525900 [oryza sativa (japonica cultivar-group)]
  misc_feature (9)..(398): NCBI GI: 5732950 NCBI Desc: chalcone synthase [lilium hybrid cv. 'acapulco']
  misc_feature (9)..(398): NCBI GI: 86604613 NCBI Desc: chalcon synthase [lilium speciosum]
  misc_feature (7)..(395): NCBI GI: 67942380 NCBI Desc: chalcone synthase [phalaenopsis hybrid cultivar]
  misc_feature (7)..(395): NCBI GI: 2253119 NCBI Desc: chalcone synthase [bromheadia finlaysoniana]
  misc_feature (7)..(395): SWISSPROT Homolog: EC 2.3.1.74 Chalcone synthase 8
  misc_feature (8)..(395): SWISSPROT Homolog: EC 2.3.1.95 Stilbene synthase 1
  misc_feature (7)..(399): SWISSPROT Homolog: EC 2.3.1.156 Phloroisovalerophenone synthase
  misc_feature: The sequence is a functional homolog of SEQ ID NO 2 in US patent 7202397

SEQ ID NO: 637 - DNA, 2205 bp, Sorghum bicolor
  misc_feature: Ceres ANNOT ID no. 6009005
  misc_feature: Encodes the peptide sequence at SEQ ID NO 638
atgggggaatcgcagagtagccaggatgcttccaggttcagagctttgggcaacggtgtctccggtgctgggcaggggagtgctggtgacagggagctccacaatgggagcattgcttctcaggctgccagggcttatccgaatggtgggagatcattggtttctgagtttgggttgtatgatatgggcgttggaaacaatcagcattttggtttctctcacagtggtaatctgtatgatgagcagtccttggcatttgcttttgagggcatgagtttcagttcccgcacaactgatgcgccttccagtcatcgcaatgtgccgctgacaaatggatactatccaactggacgtgtggatggtacactgaaccagtaccatgcacctgcaacactccaagatgattcactgcatctacagttcagtgtgcaacatgccatgcagcacactgatgttgaacaccaagaacaatctcacagatttccactgcagctggggaaattttcaagaagctctgggcacagctttgatagcaatctgggtgttccttgctacccatcaactgcatcagcttcacccttccaccaaatgtggcaatctcaaatgtacacaccccatgatcagactcttggctcaaacttcatgtggcagaaaaatatgggtgcacaaccatactctattatgcaacagagttatgtctgtccacaattgcaacaagtttctgggtttggtgcttctcgacataggagcaatgagcagtctgcagtttccccccctgcgaagggcccatcctcatcttacattggaacaccaaatgttcattggctggaaaatgggtattcttacctaaatggtgcagcttttcagaaaagaagaaatagcggcggtctgaataatacatttgcagacagcttcccaagtacatcttacactggcagttcatgtggcagtggggattttcgccattttcaacgggctgaaaaggttttgaatccatatggaccgcatcaccagcaagctgataacctcactcatccatatggcgtaggtttctcacaccatcaaatatctgataaactcaacacagcaagttacccggaaaggatcctaatgaggcccgacgttggaaattcagtaaacgattttgatttctctccctatgctcacttgctgaactcaccattcttgtcctccaaatctgagacatataaatctattgatgaagcgatgggaagagtatgcatcttgtcaaaggatcaagacgcctgtcgctttctgcaaaaagtattaacagaaggcacccaagaggacattgataaaatattttctgaaataattgaaaatgttggtgaacttatggtggatccaactgctcactatttggtgcagaagattcttgaagtgtgcaccaatgaccaaaggacatatttgattcgtgaaatcactaaagcacccatatcgcttcataaagcttcttgcaatatgcatgggactcgtgtagtgcagaaggttatagaaactatgaatacctctgaccaagtgtcaatggtggtgtccaccttaaatactggaatcatgcgtttaatgacagattcttatgggaatcatgttgcactccattgcctggagaaattgttacctgaacacaaggcattccttcttgagactgccacatcacgctatcttcaactagcaagagatcgtcatggctgttgtgtcctccagaaatgtattgagaattcaagtgatgaacagagaaacaacttgttgtgcaagattacatccagtgcccttgtactttcagaagaccagtatgggaactatgttattcagtttattctgaccctcaacattgaatgggcaacaaccagaatagtggatgagctggcaggtcactttggaaatctatccatgcagaagtgtggttcccatgttgtggagcactgcctgaagctaccacggccgatctgtgataggatcatcaacgaactcatgcatgatcctaaattgctgcatatcattcttgatcagtatgggaactttgtgattcagacagcacttaaacagtgccagggtgaacagcatgctgcttttgttgaaactatcagaccgcacactgctgtactgcaaagtaacatgtatgggaagagggttctctcaaggacatgcttgaagaacaagaattgtcgatatggcttctattaa

SEQ ID NO: 638 - protein, 734 aa, Sorghum bicolor
  misc_feature: Ceres ANNOT ID no. 6009005
  misc_feature (444)..(478): Pfam Id: PUF Pfam Desc: Pumilio-family RNA binding repeat
  misc_feature (556)..(590): Pfam Id: PUF Pfam Desc: Pumilio-family RNA binding repeat
  misc_feature (592)..(626): Pfam Id: PUF Pfam Desc: Pumilio-family RNA binding repeat
  misc_feature (396)..(720): NCBI GI: 22327888 NCBI Desc: pumilio/puf rna-binding domain-containing protein [arabidopsis thaliana]
  misc_feature (408)..(725): NCBI GI: 22330712 NCBI Desc: pumilio/puf rna-binding domain-containing protein [arabidopsis thaliana]
  misc_feature (246)..(726): NCBI GI: 9454526 NCBI Desc: contains similarity to rna binding protein pufa from dictyostelium discoideum gi5106561 and contains multiple pumilio-family rna binding pf00806 domains. [arabidopsis
  misc_feature (246)..(726): NCBI GI: 9454526 (continued) thaliana]
  misc_feature (246)..(726): NCBI GI: 15219849 NCBI Desc: pumilio/puf rna-binding domain-containing protein [arabidopsis thaliana]
  misc_feature (396)..(725): NCBI GI: 15220217 NCBI Desc: pumilio/puf rna-binding domain-containing protein [arabidopsis thaliana]
MGESQSSQDASRFRALGNGVSGAGQGSAGDRELHNGSIASQAARAYPNGGRSLVSEFGLYDMGVGNNQHFGFSHSGNLYDEQSLAFAFEGMSFSSRTTDAPSSHRNVPLTNGYYPTGRVDGTLNQYHAPATLQDDSLHLQFSVQHAMQHTDVEHQEQSHRFPLQLGKFSRSSGHSFDSNLGVPCYPSTASASPFHQMWQSQMYTPHDQTLGSNFMWQKNMGAQPYSIMQQSYVCPQLQQVSGFGASRHRSNEQSAVSPPAKGPSSSYIGTPNVHWLENGYSYLNGAAFQKRRNSGGLNNTFADSFPSTSYTGSSCGSGDFRHFQRAEKVLNPYGPHHQQADNLTHPYGVGFSHHQISDKLNTASYPERILMRPDVGNSVNDFDFSPYAHLLNSPFLSSKSETYKSIDEAMGRVCILSKDQDACRFLQKVLTEGTQEDIDKIFSEIIENVGELMVDPTAHYLVQKILEVCTNDQRTYLIREITKAPISLHKASCNMHGTRVVQKVIETMNTSDQVSMVVSTLNTGIMRLMTDSYGNHVALHCLEKLLPEHKAFLLETATSRYLQLARDRHGCCVLQKCIENSSDEQRNNLLCKITSSALVLSEDQYGNYVIQFILTLNIEWATTRIVDELAGHFGNLSMQKCGSHVVEHCLKLPRPICDRIINELMHDPKLLHIILDQYGNFVIQTALKQCQGEQHAAFVETIRPHTAVLQSNMYGKRVLSRTCLKNKNCRYGFY

SEQ ID NO: 639 - DNA, 2475 bp, Sorghum bicolor
  misc_feature: Ceres ANNOT ID no. 6009046
  misc_feature: Encodes the peptide sequence at SEQ ID NO 640
atggccgcggcggcggcggggggcgtcgagggagccggcggcggggagtgccacgcggcgcaggtggtgggcgcggacggcgagatggacgcggcggcgacggagcggttcgccgccgccgcggggctccaggggcgcggcctctcctacgccgtcgtctctatcctcgggccccagggcagcgggaaaagcaccttgctcaaccacgtcttcgggacaagcttcagggaaatggatgccttgaaaggaaggcaccagaccaccaagggcatttggatcgccaaggctgttgggatcgagcccttcactgttgtgctggacctcgaggggaccgacgggagggagcgagggcaggatgatacagctttcgagaagcagagtgctctgtttgctcttgcagtttcagacattgttatgataaatttgtggtgtcatgacattgggcgagaacatgctgctaacaggcctcttttgagaacagtatttcaggtcttgatgcgtttattcagccctcgcaagacgacactgctacttgttatccgcgataaaacaaagactccactagagtacctgacacaagctctcaaggaggatattgagaagatatgggagtctgttcagaaaccagaagcttacaaggaagcagcgcttagtgatttcttcaatgtggaggtcactgctctatcgagttatgaagagaaagaagaactatttaaggagcaggttggacaactaaggcagaggttttatcattcaattgcaccaggtggtcttgcagctgatagaagaggtgtggtaccttcttcaggcttctgtctcagtgcactgcagatttggaaagtaatacgtgaaaataaggacctcaaccttcctgctcacaaggtcatggttgctactgttcgatgtgaggagattgcaaatgaaaagctcaaatactttttgtccgatgagggttggttggagctagatgcagctgtaaaatctggtctgccaccaagcttcggaacgaggctcaatgctattctcgactcttatctatcagagtatgacatggaaaccatgtattttgatgaaggtgtaagagctgctaagcggcaacaattagaatcttcaatgctagatcacacatatcctgctatcgagagagtaatggagcacctgcatcttgtgactcttaacaaattcaaaagtgatctggaacaatcattaaggaacacagagggatttgcagaatcagttcgtcagtgttctcaagcttcaatggaagagtttgatgctggaataagagatacagcagttaaacatgtgcagtgggatgcttcaaaagctaggaataaactgcaagaacatatacaagttcatgtagaatctattaggaacgtaaaattggcagaactgaaagctaactatgagaagaagctgtcagacgcaattgctgggcctgtacaatccatactggaaactggcgagagagactcctgggcatgcattaggagactatataggcgtgagactgaaaatgctgctcttgcattttcagcttccctatctgagtttgacctagagcagacaatttctagtaagatggtctcggacttgagggaacatgcaagaagcgtagtagaaatgaaagctagagaagaagctggaaacgttctgatgcgcatgaaagaaaggtttttcactgtgttgagccatgatagggatttgatgccaaggacatggatgggagatgaggatatccgttcaatcactagagaagcacgcttaggggctttaagactcatgtctgtaaaggcagctatacggttagatgataaaccagacaaaatagaacgggcactgactactgctcttttggatggcggacccctttcccacaagaagagcatagaatttgcttctgatccacttgcttcaagcacgtgggaagaggtttcaccaaaggatacactgattacgccagtgcagtgtaagtccatctggaggcaattcaaagcagagacagagtattctgttgcgcaagcaatgactatgcaggaagcacataggcgtagcaagagctggttgccacctgcatggactattttgcttctggcaatactaggctacaacgaatttatgtttcttcttaggaatccgttgtaccttctagggctctttgttgcctttgtgttgtcatatgccatatggctgcaatatgacatcactgcttattttcgtcatggcacgttatctgctcttcttacgattttatcaagactactccccacgatcatggacgttatgatgcaaataatcaatatgacccacagacacaagcattccccacatccatctcgccgcccccaacctatccatgctcagagcttcatgaaccagacgtggcgacaggctcaagggcagtaccagtctcctgactcgccatcctcatcttcctcgtctgtggactcgaatagcggcgatgactcttga

SEQ ID NO: 640 - protein, 824 aa, Sorghum bicolor
  misc_feature: Ceres ANNOT ID no. 6009046
  misc_feature (56)..(799): Pfam Id: RHD3 Pfam Desc: Root hair defective 3 GTP-binding protein (RHD3)
  misc_feature (11)..(824): NCBI GI: 9759601 NCBI Desc: gtp-binding protein-like; root hair defective 3 protein-like [arabidopsis thaliana]
  misc_feature (19)..(811): NCBI GI: 77557026 NCBI Desc: root hair defective 3 gtp-binding protein [oryza sativa (japonica cultivar-group)]
  misc_feature (17)..(823): NCBI GI: 115437816 NCBI Desc: os01g0575000 [oryza sativa (japonica cultivar-group)]
  misc_feature (56)..(766): NCBI GI: 15219333 NCBI Desc: root hair defective 3 gtp-binding (rhd3) family protein [arabidopsis thaliana]
  misc_feature (17)..(813): NCBI GI: 47934042 NCBI Desc: root hair defective 3 gtp-binding protein [triticum aestivum]
MAAAAAGGVEGAGGGECHAAQVVGADGEMDAAATERFAAAAGLQGRGLSYAVVSILGPQGSGKSTLLNHVFGTSFREMDALKGRHQTTKGIWIAKAVGIEPFTVVLDLEGTDGRERGQDDTAFEKQSALFALAVSDIVMINLWCHDIGREHAANRPLLRTVFQVLMRLFSPRKTTLLLVIRDKTKTPLEYLTQALKEDIEKIWESVQKPEAYKEAALSDFFNVEVTALSSYEEKEELFKEQVGQLRQRFYHSIAPGGLAADRRGVVPSSGFCLSALQIWKVIRENKDLNLPAHKVMVATVRCEEIANEKLKYFLSDEGWLELDAAVKSGLPPSFGTRLNAILDSYLSEYDMETMYFDEGVRAAKRQQLESSMLDHTYPAIERVMEHLHLVTLNKFKSDLEQSLRNTEGFAESVRQCSQASMEEFDAGIRDTAVKHVQWDASKARNKLQEHIQVHVESIRNVKLAELKANYEKKLSDAIAGPVQSILETGERDSWACIRRLYRRETENAALAFSASLSEFDLEQTISSKMVSDLREHARSVVEMKAREEAGNVLMRMKERFFTVLSHDRDLMPRTWMGDEDIRSITREARLGALRLMSVKAAIRLDDKPDKIERALTTALLDGGPLSHKKSIEFASDPLASSTWEEVSPKDTLITPVQCKSIWRQFKAETEYSVAQAMTMQEAHRRSKSWLPPAWTILLLAILGYNEFMFLLRNPLYLLGLFVAFVLSYAIWLQYDITAYFRHGTLSALLTILSRLLPTIMDVMMQIINMTHRHKHSPHPSRRPQPIHAQSFMNQTWRQAQGQYQSPDSPSSSSSSVDSNSGDDS

SEQ ID NO: 641 - DNA, 402 bp, Sorghum bicolor
  misc_feature: Ceres ANNOT ID no. 6009119
  misc_feature: Encodes the peptide sequence at SEQ ID NO 642
atggccgggaagggagggaaggggctgatcgccgcgaagattgcggccggcatggacaaggagaagaagccgccgatcacccgctccgcgcgcgccggcctccagttccccgtcggacgcatccaccgccagctgaaagaaaggtcgcaggcgagcgggcgggtgggagcaacggcggccgtgtacgcggcagcgatcctggagtacctgacggccgaggtcctggagctggccgggaacgcgagcaaggacctcaagatgaagcgcatcagcccccggcacctgcagctggcgatccgcggggacgaggagctggacacgctgatcaagggcaccatcgccggcggcggcgtcatcccccacatccacaagtccctcatcaacaagggtgtcaaggagtga

SEQ ID NO: 642 - protein, 133 aa, Sorghum bicolor
  misc_feature: Ceres ANNOT ID no. 6009119
  misc_feature (28)..(102): Pfam Id: Histone Pfam Desc: Core histone H2A/H2B/H3/H4
  misc_feature (1)..(133): NCBI GI: 75297915 NCBI Desc: probable histone h2a variant 3
  misc_feature (1)..(133): NCBI GI: 21592838 NCBI Desc: histone h2a.f/z [arabidopsis thaliana]
  misc_feature (1)..(133): NCBI GI: 75299926 NCBI Desc: probable histone h2a variant 1
  misc_feature (1)..(133): NCBI GI: 6319146 NCBI Desc: h2a protein [oryza sativa]
  misc_feature (6)..(133): NCBI GI: 92898817 NCBI Desc: histone-fold [medicago truncatula]
MAGKGGKGLIAAKIAAGMDKEKKPPITRSARAGLQFPVGRIHRQLKERSQASGRVGATAAVYAAAILEYLTAEVLELAGNASKDLKMKRISPRHLQLAIRGDEELDTLIKGTIAGGGVIPHIHKSLINKGVKE

SEQ ID NO: 643 - DNA, 1116 bp, Sorghum bicolor
  misc_feature: Ceres ANNOT ID no. 6009120
  misc_feature: Encodes the peptide sequence at SEQ ID NO 644
atggcactcaacaaggagtacacctacgcggagctggagaaggagccatactggccgttcgagaagctgcggatctccatcactggtgctggtgggttcattgcctcccacatcgcgcgccgcctcaagagcgagggccactacatcatcgcctctgactggaagaagaacgagcacatgtccgaggacatgttctgccacgagttccacctcgtcgacctaagggtgatggacaactgcctcaaggtcaccacgggggttgaccatgtgttcaacctcgcggctgatatgggtgggatggggttcatccagtccaaccactctgtgatcatgtacaacaacaccatgatcagctttaacatgcttgaggctgctagaattaacggtgtcaagaggttcttttatgcatcaagtgcctgcatctaccctgaatttaagcagttggaaactgtagttagcttaaaggagtcagatgcttggcctgctgagcctcaagatgcttatggcttggaaaaacttgctactgaggaactgtgcaagcactatacaaaggattttggcattgagtgccgggtcggtcgctttcacaacatatatggtccctttggaacatggaagggtggaagggagaaggcgcctgctgctttctgcagaaaggctttaacctccactgggcactttgagatgtggggcgatggcctgcaaaccagatccttcacatttattgatgaatgtgttgaaggtgtccttaggttaacaaagtctgacttccgtgagcctgtaaacattggaagtgacgaaatggtgagcatgaacgagatggcagaaatagtcctgagctttgagaacaagcagctgcccatccaccacattcctgggccggagggtgtgcgtgggcgcaactcggacaacacactcattaaggagaagcttggctgggctccgactatgaggctgaaggatgggctgaggatcacctacttctggatcaaggagcagcttgagaaggagaaggctgagggcatggatctgtcggtatacggatcatccaaggtcgtgcagacccaggccccggttcagcttggctcccttcgtgccgctgatggcaaggagtga

SEQ ID NO: 644 - protein, 371 aa, Sorghum bicolor
  misc_feature: Ceres ANNOT ID no. 6009120
  misc_feature (25)..(264): Pfam Id: Epimerase Pfam Desc: NAD dependent epimerase/dehydratase family
  misc_feature (1)..(371): NCBI GI: 94717590 NCBI Desc: gdp-mannose 3,5-epimerase 2 (gdp-man 3,5-epimerase 2)
  misc_feature (7)..(371): NCBI GI: 80973462 NCBI Desc: gdp-d-mannose-3',5'-epimerase [malpighia glabra]
  misc_feature (7)..(371): NCBI GI: 73919692 NCBI Desc: gdp-mannose 3,5-epimerase (gdp-man 3,5-epimerase)
  misc_feature (7)..(371): NCBI GI: 83754655 NCBI Desc: chain b, gdp-mannose-3', 5' -epimerase (arabidopsis thaliana), with gdp-alpha-d-mannose and gdp-beta-l-galactose bound in the active site.
  misc_feature (7)..(371): NCBI GI: 83754651 NCBI Desc: chain b, gdp-mannose-3', 5' -epimerase (arabidopsis thaliana), k178r, with gdp-beta-l-gulose and gdp-4-keto-beta-l-gulose bound in active site.
  misc_feature (1)..(371): SWISSPROT Homolog: EC 5.1.3.18 GDP-mannose 3,5-epimerase 2
MALNKEYTYAELEKEPYWPFEKLRISITGAGGFIASHIARRLKSEGHYIIASDWKKNEHMSEDMFCHEFHLVDLRVMDNCLKVTTGVDHVFNLAADMGGMGFIQSNHSVIMYNNTMISFNMLEAARINGVKRFFYASSACIYPEFKQLETVVSLKESDAWPAEPQDAYGLEKLATEELCKHYTKDFGIECRVGRFHNIYGPFGTWKGGREKAPAAFCRKALTSTGHFEMWGDGLQTRSFTFIDECVEGVLRLTKSDFREPVNIGSDEMVSMNEMAEIVLSFENKQLPIHHIPGPEGVRGRNSDNTLIKEKLGWAPTMRLKDGLRITYFWIKEQLEKEKAEGMDLSVYGSSKVVQTQAPVQLGSLRAADGKE

SEQ ID NO: 645 - DNA, 1191 bp, Sorghum bicolor
  misc_feature: Ceres ANNOT ID no. 6009125
  misc_feature: Encodes the peptide sequence at SEQ ID NO 646
atggcggcccccaggaaggtcctcatgctctgcggcgactacatggaggacttcgaggccgccgtcccgctctacgccctctccgccctcggcatcaccgtcgactgcgccgcgcccggcaagcgccccggcgactcctgcctcaccgccgtccacgacttcctcggcttcgagctctacacggagctcacgggccaccgcttcacgataaccgccgacttcgcggcggcggcggcggacccgtctcgctacgacgcgctggtcatcccgggcgggcggttcacggagcagctgagcgcggacgcggccgtcgtggacctcgtcgcggcgttcgcggcgctgcggaggcctctggtgctcacctgccacagccagctcctgctcgccgcggccggcgggctcagcggcggcacgcgctgcacggcgttcttcagcttgcgccccgtcgtggagctggcggggggcgcgtgggtcgacccggatcccttcgagctctgcgtcgccgacggccacgtgctctccgccatcgggtggcccgcgcacgcccagatcctcgccaagctcctcgacgccttgggcgcccacgtcgtcgccgccgacgccgggcgcggtggccagcgcgtcctcatcctctgcgccgactacgtcgacgactacgaggcgaacgtgccgttccgggcgctggcgggcgtgggctgccgtgtcgaatccgcgtgcccgaccaagcgcaagggcgagaccgtcgtgacggcgatctacgacgccgccggcacgccggcggtcacggtgagcgaggagaggcggggccacaacttcgtggtgacggcggactgggcggacgccagcgccgacgacttcgactgcgtcgtcatccccggcggccgcgcgccggagctgctggtgacgcacgacagggcggtggcgctcgtgaaggagttcgcggacaagggcaaggtggtggccagcatcggccatggccacctgctcctcgcagcggcggggctgctcaggggcaggaagtgcgccagcggggtgcccatgcgggtcgtctcgaggctggcgggcgccgaggccgtggaggccgcggcggccgtcgttgatgggaggctcgtgacggcggcgagctggacggacctcgcgcagttcgtggctcgcgtcattgacctcctcggcatctccgtctccttctga

SEQ ID NO: 646 - protein, 396 aa, Sorghum bicolor
  misc_feature: Ceres ANNOT ID no. 6009125
  misc_feature (33)..(193): Pfam Id: DJ-1_PfpI Pfam Desc: DJ-1/PfpI family
  misc_feature (248)..(391): Pfam Id: DJ-1_PfpI Pfam Desc: DJ-1/PfpI family
  misc_feature (2)..(396): NCBI GI: 19699347 NCBI Desc: at2g38860/t7f6.3 [arabidopsis thaliana]
  misc_feature (3)..(396): NCBI GI: 90265250 NCBI Desc: h0624f09.11 [oryza sativa (indica cultivar-group)]
  misc_feature (3)..(396): NCBI GI: 70663940 NCBI Desc: osjnbb0004a17.4 [oryza sativa (japonica cultivar-group)]
  misc_feature (3)..(198): NCBI GI: 46579408 NCBI Desc: thij/pfpi family protein [desulfovibrio vulgaris subsp. vulgaris str. hildenborough]
  misc_feature (3)..(198): NCBI GI: 120603037 NCBI Desc: intracellular protease, pfpi family [desulfovibrio vulgaris subsp. vulgaris dp4]
MAAPRKVLMLCGDYMEDFEAAVPLYALSALGITVDCAAPGKRPGDSCLTAVHDFLGFELYTELTGHRFTITADFAAAAADPSRYDALVIPGGRFTEQLSADAAVVDLVAAFAALRRPLVLTCHSQLLLAAAGGLSGGTRCTAFFSLRPVVELAGGAWVDPDPFELCVADGHVLSAIGWPAHAQILAKLLDALGAHVVAADAGRGGQRVLILCADYVDDYEANVPFRALAGVGCRVESACPTKRKGETVVTAIYDAAGTPAVTVSEERRGHNFVVTADWADASADDFDCVVIPGGRAPELLVTHDRAVALVKEFADKGKVVASIGHGHLLLAAAGLLRGRKCASGVPMRVVSRLAGAEAVEAAAAVVDGRLVTAASWTDLAQFVARVIDLLGISVSF

SEQ ID NO: 647 - DNA, 1632 bp, Sorghum bicolor
  misc_feature: Ceres ANNOT ID no. 6009133
  misc_feature: Encodes the peptide sequence at SEQ ID NO 648
atgtggacagcggcaggcgggaggggttcgtccgcggccgctgctgtgctgcgggtgctgctgatcgcgaccgcctgcggcctcgtcttcgcgctcctccacctcccgctccccgatggcggcgcccgccccgccggccccggtgaggagcgccgcggcgttggtgggggcggtggggcccgcctgtcggcgcagcaggggaggattcgagaggccaggaggctgagtgtcgtcaccgaagagatagaagggcaaactgatgaagttgcagcggaagaagacgaaaggatatctaaatctcccccggacactaaagaaaagatatggatgatgcaagatcagctaatcatggccaaggcatacctgcatttcgcttctccccaaggtagtgtacattttgttcgagagctgagattgaggataaaagagatcgaaagggcaataagccactcaagtggaggtacccgtgtacctgggagtgtgttgcaaaaaatgaaggcgatggagctgaccctttccaaggctcagaggatctacccacgttgctgtcagatgacagcaaagctacgtgcaatggtgcataacagtgaagaattggtcagagcacaccaaagtgaatcttcattcctcgagcaggttgctgtgaggacattatccaaaggccatcactgcctagcaatgcaacttactgcagaatacttttcattagatcccagtaaacgtgaattccctaaaagagagagcattcagttggatggttattatcattatgcaatattctcagacaatgtgcttgcaagtgctgtggttgtcaactctacaattgctgcatcaaaggaccctggaaggataatattacatattgtaactgacgcattgaattatcctgcaatgatgatgtggtttctaagaaacccaccaactccagcagcaatccaagtcaaaagcctagatgatttgaaatggttgcctggtgatttcagttccagattcaagctgaagggtgtccgagatccaagatacacttctgcacttaaccacttgcgtttttatttgccagaagtgtttccctctttgggcaaggttgtactcttggaccatgatgtggtagtccagaatgacttaactggactatgggatctggatatgaagggtaaagtaattggtgctgttgagacatgcacttcaagtgaaggttaccatcgattggatagcctggttgacttttctaatccaagcatctttgacaaagttgacccaaaggcctgtgcatttgcatttgggatgaacatatttgacctgaatgaatggcgcaaacaggatttgactacaacttatcataaatggtttcaactgggcaaaattcagaagttatggaagccaggaagcttgccactgggtcagcttaccttttacaacagaacactgcctctggatcaccgatggcatgtctttgggcttggccatgatttcagcattggaagaaatgaacttgagagtgcctctgtcatccactacagtgggaaactcaaaccctggctggagatttctatcccaaagtacagagactactggaacaggtacctcaactatgataatccacacttgcagcagtgcaacattcacggatag

SEQ ID NO: 648 - protein, 543 aa, Sorghum bicolor
  misc_feature: Ceres ANNOT ID no. 6009133
  misc_feature (224)..(517): Pfam Id: Glyco_transf_8 Pfam Desc: Glycosyl transferase family 8
  misc_feature (140)..(542): NCBI GI: 115486095 NCBI Desc: os11g0592300 [oryza sativa (japonica cultivar-group)]
  misc_feature (337)..(542): NCBI GI: 124360882 NCBI Desc: glycosyl transferase, family 8 [medicago truncatula]
  misc_feature (307)..(542): NCBI GI: 52077295 NCBI Desc: glycosyltransferase family-like [oryza sativa (japonica cultivar-group)]
  misc_feature (301)..(542): NCBI GI: 86439693 NCBI Desc: glycosyl transferase-like protein [triticum aestivum]
  misc_feature (337)..(541): NCBI GI: 52077221 NCBI Desc: glycosyl transferase family 8 protein-like [oryza sativa (japonica cultivar-group)]
  misc_feature: Useful for making plants with altered cell wall content and/or composition
  misc_feature: Functional homolog of the protein sequence encoded by LOCUS at1g06780
  misc_feature: Functional homolog of the protein sequence encoded by LOCUS at2g30575
  misc_feature: Functional homolog of the protein sequence encoded by LOCUS at5g47780
  misc_feature: Useful for making plants with altered carbohydrate content
  misc_feature: Functional homolog of the protein sequence given in SEQ ID NO 13956
  misc_feature: Useful for making plants with altered cell wall content and/or composition
  misc_feature: Functional homolog of the protein sequence given in SEQ ID NO 13957
MWTAAGGRGSSAAAAVLRVLLIATACGLVFALLHLPLPDGGARPAGPGEERRGVGGGGGARLSAQQGRIREARRLSVVTEEIEGQTDEVAAEEDERISKSPPDTKEKIWMMQDQLIMAKAYLHFASPQGSVHFVRELRLRIKEIERAISHSSGGTRVPGSVLQKMKAMELTLSKAQRIYPRCCQMTAKLRAMVHNSEELVRAHQSESSFLEQVAVRTLSKGHHCLAMQLTAEYFSLDPSKREFPKRESIQLDGYYHYAIFSDNVLASAVVVNSTIAASKDPGRIILHIVTDALNYPAMMMWFLRNPPTPAAIQVKSLDDLKWLPGDFSSRFKLKGVRDPRYTSALNHLRFYLPEVFPSLGKVVLLDHDVVVQNDLTGLWDLDMKGKVIGAVETCTSSEGYHRLDSLVDFSNPSIFDKVDPKACAFAFGMNIFDLNEWRKQDLTTTYHKWFQLGKIQKLWKPGSLPLGQLTFYNRTLPLDHRWHVFGLGHDFSIGRNELESASVIHYSGKLKPWLEISIPKYRDYWNRYLNYDNPHLQQCNIHG

SEQ ID NO: 649 - DNA, 2697 bp, Sorghum bicolor
  misc_feature: Ceres ANNOT ID no. 6009134
  misc_feature: Encodes the peptide sequence at SEQ ID NO 650
atggccgcggcggccatggcgtcctccgccccggcgtgccaccacctccgccacccgccacgcctccgcctcctcctcccgctctccacctccgccccgtacccgtggctctccgcctggtcgcacccgggccagcgcagccgcagccgcctccgcgcgccgccgccgcccgcgctggacctccgcccggagccgtccccgtcgtccgactccgacgacgaggacgctgtgggcaccagccgttcctccggccgctccaccatgtccctcatcctcagccgcctccgccgcgccggctactcccccgccgaggacccccgcgccgccgcggcctcctcgcaccacccgccaagggggtcggtcgaggacgtgttccgcgccgacgacggcgtgctccccaacgcgcgcggcgggttcgacgccgccgacgaggagctgggggatgctcgcttcccgtgggagcgccccatgccgccgcccgaggccgcgccgccgcgcgccacgcgctcgccgacgtggatggcggagctgacgctccccgctgcggagctcaggcggctgcggcacgctgctatcaggatcaagtccaggaccaaggtgggcggggctggggtcacgcgtgagatcgtggagaagattaaggagaaatggaagacggaggaggtggtcagggtcaaggtctccggcacgccggcgctcaatatgcgcctcttccatgagattctcgagagaaaaacaggagggttagtaatatggagatcagggacttctgtttctctgtacaggggagtagattatgatgaaccagaaaccactaaggggtcaaagaagaattcacagtctctttctatgaagtccccaattaaagggtctcctaatcctcccttgccaccaactgagaaagcaaacagtgtacaagatagaaatggacctttagtttctaatgctgggaaagaggaaatagttgtacaagcaccagaaatcaagtatgaagatgaaattgacaaactgttggatgaacttggcccaagatacactgactggcctggatccgacccattaccagtagatgcagatttacttcctgcaaccgtgccaggttacaagcctcctttcagagttctgccatatggtgtccggccatctcttagccgaatggatactaccaatttacgccgtcttgcccggggactgcctcctcactttgctcttggacgaagcagacaactccaaggcttagctaatgctatggtaaagttgtgggagaaaagttctattgctaaagttgctttgaagagaggagtacagcttaccaccagtgagaggatggctgaagatatcaaaaaattaacaggtggcgtgatgctttcaagaaacaatgaatttatagtcttctacagagggaaggatttcttgtcctcagaacttgcagaggtgctgctagagagggaaagattagcaaagtcacttcaagatgaagaggaagcacggcgaaaggcagcgtcttatttttcttcaagtgctgagaaatatgtacagcctactgtagctggtactctaggagagactctggaggctaactctaaatatggaactaaacttgatgagaatcatgaggacaaaatggcaagaactgttgaagctgcaaggcatgctgacctcgtaagaaagctagagtggaagctctcacttgcacagaaaaagatggagaaagctgaaagggtactaggaaaggttgagacagctctgaggccaactgaagattccagacctgaaacaataactgatgaagagaggttcatgtttcggaaacttggtctaaggatgaaggcatttctgctccttggcagaagaggagtttttgacggcacaattgagaacatgcacttgcactggaagtacagggagctggtgaagatactagtgaaagcaaagtcttttgcagacgtgaagaggatagcactttcacttgaagccgagagcgggggaattttagtttcagttgacaaagtctccaaaggctacgccattgttgtgttcagagggaagaactacagacgcccttcttcgctcagacctagaaatctcttgtcaaagcggaaggctttggccagatccatcgagcttcagagacatcaggccctgagtcgtcattttgcaaagctaaacagaaaggtggcgcagcttaaagcggagctgatggaagacgtgaaggaccaaggagacgaggagctgtacgccaagctggatgccgcgtactcaagcgacgaggaagacatggaggatgaggatgacgatgaggcctacctcgagcgcttcgacaatgaggtcgccggtgctaccgccgaggacggcagcgagtccgtggacgacgaggccgattaccctgactcagatgacgaagctggtgattactcggacgaagacgacgatggcgaggacgaccaggaggcttttggctatgacgacggagatgaggcggctgccggagtctctaacgctgacttttgcgccggcgaagtaaggttcggttcttctgatagaggagaccacgggttggaaggtgctgcctcgtgtggggaatgggatgggaaatgtaatgacgaggcaagtgacggtgggcagcactcgcacacggagaaggagcagccacctgaactggcgagctctcgtactggcggtgctagtgctagctag

SEQ ID NO: 650 - protein, 898 aa, Sorghum bicolor
  misc_feature: Ceres ANNOT ID no. 6009134
  misc_feature (179)..(262): Pfam Id: CRS1_YhbY Pfam Desc: CRS1 / YhbY domain
  misc_feature (383)..(467): Pfam Id: CRS1_YhbY Pfam Desc: CRS1 / YhbY domain
  misc_feature (594)..(681): Pfam Id: CRS1_YhbY Pfam Desc: CRS1 / YhbY domain
  misc_feature (1)..(830): NCBI GI: 115486097 NCBI Desc: os11g0592400 [oryza sativa (japonica cultivar-group)]
  misc_feature (263)..(733): NCBI GI: 116310121 NCBI Desc: osigba0130p02.2 [oryza sativa (indica cultivar-group)]
  misc_feature (330)..(733): NCBI GI: 9837550 NCBI Desc: crs1 [zea mays]
  misc_feature (406)..(733): NCBI GI: 21741981 NCBI Desc: osjnba0060p14.12 [oryza sativa (japonica cultivar-group)]
  misc_feature (330)..(464): NCBI GI: 9837552 NCBI Desc: crs1 [zea mays]
MAAAAMASSAPACHHLRHPPRLRLLLPLSTSAPYPWLSAWSHPGQRSRSRLRAPPPPALDLRPEPSPSSDSDDEDAVGTSRSSGRSTMSLILSRLRRAGYSPAEDPRAAAASSHHPPRGSVEDVFRADDGVLPNARGGFDAADEELGDARFPWERPMPPPEAAPPRATRSPTWMAELTLPAAELRRLRHAAIRIKSRTKVGGAGVTREIVEKIKEKWKTEEVVRVKVSGTPALNMRLFHEILERKTGGLVIWRSGTSVSLYRGVDYDEPETTKGSKKNSQSLSMKSPIKGSPNPPLPPTEKANSVQDRNGPLVSNAGKEEIVVQAPEIKYEDEIDKLLDELGPRYTDWPGSDPLPVDADLLPATVPGYKPPFRVLPYGVRPSLSRMDTTNLRRLARGLPPHFALGRSRQLQGLANAMVKLWEKSSIAKVALKRGVQLTTSERMAEDIKKLTGGVMLSRNNEFIVFYRGKDFLSSELAEVLLERERLAKSLQDEEEARRKAASYFSSSAEKYVQPTVAGTLGETLEANSKYGTKLDENHEDKMARTVEAARHADLVRKLEWKLSLAQKKMEKAERVLGKVETALRPTEDSRPETITDEERFMFRKLGLRMKAFLLLGRRGVFDGTIENMHLHWKYRELVKILVKAKSFADVKRIALSLEAESGGILVSVDKVSKGYAIVVFRGKNYRRPSSLRPRNLLSKRKALARSIELQRHQALSRHFAKLNRKVAQLKAELMEDVKDQGDEELYAKLDAAYSSDEEDMEDEDDDEAYLERFDNEVAGATAEDGSESVDDEADYPDSDDEAGDYSDEDDDGEDDQEAFGYDDGDEAAAGVSNADFCAGEVRFGSSDRGDHGLEGAASCGEWDGKCNDEASDGGQHSHTEKEQPPELASSRTGGASAS

SEQ ID NO: 651 - DNA, 1671 bp, Sorghum bicolor
  misc_feature: Ceres ANNOT ID no. 6009148
  misc_feature: Encodes the peptide sequence at SEQ ID NO 652
atgagcgccgccgcctgcctcttcgccgccgccaccgcatccctttccctcccctcgacctccgcccccacttcttcggggcgacgctccgtccggagccccactgcgctcctccgctgctccctgactcgccgccgtgggcagccggtccgggtccgggcactcgacgagcggctgctcgaggccgcgccggcggagaccgaagaggctcaaaccggcgttgatgtaggggatggaggcggggtcgctgagggtgatggagttggagcagaggaggagctggagctggagcagcagcggccgtcgccgagggctttcatggagagcaggcggcagcggcaggaagaggaggaggccgcggcggggcaagaccggttcaggctaatcaacggcaaagagatatttcaagagaaggcttatctggttggtgttgagtgcaaacggacaggagggaacctcttcggcatagtggagtctcttaaggagctggagcagttggctgataccgcgggccttgtggtagtcggctcaacctatcagaagctttctaccccaaatccaaggacttacattggttcaggaaaggtttctgaaatcaggagtgcaattcaagcccttgatgttgagactgtaattttcgatgatgagttatcccctggacaactacgtaacttggaaaagtcatttggtgggagtgtccgagtctgtgatcgaactgctcttattcttgatatttttaatcaaagggcagcaacacatgaagctgctttacaggtcaccttggcacagatggaatatcaacttcctaggttgacaaaaatgtggagtcaccttgaacggcaggctggaggtcaagttaagggtatgggtgagaagcaaattgaagttgacaagcgcatcttgagaactcaaataggtgccttgaggaaagaattggaatctgttcggaaacaccgaaagctgtaccgcaaccgtcgccaatcagttcctattcctgttgtttctctggtagggtatacaaatgctggaaaaagtacactcctgaaccgcttaactggagctgatgtacttgcagaggataagttatttgccacgttagacccaactacaagaagggtcttgatgaagaatgggactgagttccttctaactgacactgtcggattcattcagaagttacccactatgctggtagcagcatttagagcaacactagaagagatatcagaatcatcagtcatagttcatcttgtggacattagccatccattagctcaacaacagatagatgctgttgaaagagtattgaaggagttggatgtagagtcaatccccaaattaattgtgtggaataagattgacaatacggatgaaccattgagagtaaaagaagaagctcagaaacaaggaataatctgcatatcagccatgaatggtgatggtttggaagaattctgcaatgcagttcaagcaaagttgaaagactcgatggttcccatagaagctattgttccatatgacaaaggagatctcctaaatgacatacataaggttggaatggtcgaaaaaatggagtacaaggaaaatgggacatttgtaaaagctcatgtgcctctgccccttgcaagacttctcacacctctacgacagcaggtggtggccacagtgtga

SEQ ID NO: 652 - protein, 556 aa, Sorghum bicolor
  misc_feature: Ceres ANNOT ID no. 6009148
  misc_feature (332)..(454): Pfam Id: MMR_HSR1 Pfam Desc: GTPase of unknown function
  misc_feature (329)..(495): Pfam Id: GTP_EFTU Pfam Desc: Elongation factor Tu GTP binding domain
  misc_feature (334)..(453): Pfam Id: Dynamin_N Pfam Desc: Dynamin family
  misc_feature (92)..(555): NCBI GI: 9758365 NCBI Desc: gtp binding protein-like [arabidopsis thaliana]
  misc_feature (136)..(554): NCBI GI: 106889877 NCBI Desc: small gtp-binding protein domain [roseiflexus sp. rs-1]
  misc_feature (136)..(554): NCBI GI: 118062710 NCBI Desc: small gtp-binding protein domain [roseiflexus castenholzii dsm 13941]
  misc_feature (127)..(551): NCBI GI: 121533669 NCBI Desc: small gtp-binding protein [thermosinus carboxydivorans nor1]
  misc_feature (136)..(549): NCBI GI: 113941325 NCBI Desc: small gtp-binding protein domain [herpetosiphon aurantiacus atcc 23779]
MSAAACLFAAATASLSLPSTSAPTSSGRRSVRSPTALLRCSLTRRRGQPVRVRALDERLLEAAPAETEEAQTGVDVGDGGGVAEGDGVGAEEELELEQQRPSPRAFMESRRQRQEEEEAAAGQDRFRLINGKEIFQEKAYLVGVECKRTGGNLFGIVESLKELEQLADTAGLVVVGSTYQKLSTPNPRTYIGSGKVSEIRSAIQALDVETVIFDDELSPGQLRNLEKSFGGSVRVCDRTALILDIFNQRAATHEAALQVTLAQMEYQLPRLTKMWSHLERQAGGQVKGMGEKQIEVDKRILRTQIGALRKELESVRKHRKLYRNRRQSVPIPVVSLVGYTNAGKSTLLNRLTGADVLAEDKLFATLDPTTRRVLMKNGTEFLLTDTVGFIQKLPTMLVAAFRATLEEISESSVIVHLVDISHPLAQQQIDAVERVLKELDVESIPKLIVWNKIDNTDEPLRVKEEAQKQGIICISAMNGDGLEEFCNAVQAKLKDSMVPIEAIVPYDKGDLLNDIHKVGMVEKMEYKENGTFVKAHVPLPLARLLTPLRQQVVATV

SEQ ID NO: 653 - DNA, 1671 bp, Sorghum bicolor; identical to SEQ ID NO: 651
  misc_feature: Ceres ANNOT ID no. 6009152
  misc_feature: Encodes the peptide sequence at SEQ ID NO 654

SEQ ID NO: 654 - protein, 556 aa, Sorghum bicolor; identical to SEQ ID NO: 652
  misc_feature: Ceres ANNOT ID no. 6009152
  misc_feature (332)..(454): Pfam Id: MMR_HSR1 Pfam Desc: GTPase of unknown function
  misc_feature (329)..(495): Pfam Id: GTP_EFTU Pfam Desc: Elongation factor Tu GTP binding domain
  misc_feature (334)..(453): Pfam Id: Dynamin_N Pfam Desc: Dynamin family
  misc_feature (92)..(555): NCBI GI: 9758365 NCBI Desc: gtp binding protein-like [arabidopsis thaliana]
  misc_feature (136)..(554): NCBI GI: 106889877 NCBI Desc: small gtp-binding protein domain [roseiflexus sp. rs-1]
  misc_feature (136)..(554): NCBI GI: 118062710 NCBI Desc: small gtp-binding protein domain [roseiflexus castenholzii dsm 13941]
  misc_feature (127)..(551): NCBI GI: 121533669 NCBI Desc: small gtp-binding protein [thermosinus carboxydivorans nor1]
  misc_feature (136)..(549): NCBI GI: 113941325 NCBI Desc: small gtp-binding protein domain [herpetosiphon aurantiacus atcc 23779]

SEQ ID NO: 655 - DNA, 591 bp, Sorghum bicolor
  misc_feature: Ceres ANNOT ID no. 6009285
  misc_feature: Encodes the peptide sequence at SEQ ID NO 656
atggagaattcatcgtgcgctgcagcatgccattttctggtcctgcaagaggcatgtgttatcaacctcttcctcaaattcctcacctgctggtccgtctcagtgttccagattcacctcccctgctcatgcaaatgctgcaactgcaaccatagctcttctgagaaggtgacacagacaccggttattaccacagacaaagaagtaatagagagaaggaaaaaagatcaagataataagacggccctgacacaagaagatatcaagacggtaatgataagcataggttttaatttggatcaagagaacagcatggccattggcaatgtttctatacctcggattttcgacgacgacgagccaagcttgcaggaggtacgggaggcatttttggtgtttgatcataataatgatgggtacttcgacgcatcggatttgcagcgagtgctcaagagtctaggactaggggaaggtgtagggatggatgattgcgagcagatgatcgccaagtatgacatgaacaaggacaggagaatagatgtttctgagtttaccaaggttttggagtctggcattaatttgctaaactaa

SEQ ID NO: 656 - protein, 196 aa, Sorghum bicolor
  misc_feature: Ceres ANNOT ID no. 6009285
  misc_feature (125)..(153): Pfam Id: efhand Pfam Desc: EF hand
  misc_feature (163)..(191): Pfam Id: efhand Pfam Desc: EF hand
  misc_feature (20)..(190): NCBI GI: 20466131 NCBI Desc: at5g39670/mij24_140 [arabidopsis thaliana]
  misc_feature (83)..(190): NCBI GI: 92871538 NCBI Desc: calcium-binding ef-hand [medicago truncatula]
  misc_feature (107)..(193): NCBI GI: 48095044 NCBI Desc: similar to cg11638-pa [apis mellifera]
  misc_feature (124)..(188): NCBI GI: 116129660 NCBI Desc: ensangp00000002998 [anopheles gambiae str. pest]
  misc_feature (54)..(188): NCBI GI: 126275046 NCBI Desc: calmodulin [pichia stipitis cbs 6054]
MENSSCAAACHFLVLQEACVINLFLKFLTCWSVSVFQIHLPCSCKCCNCNHSSSEKVTQTPVITTDKEVIERRKKDQDNKTALTQEDIKTVMISIGFNLDQENSMAIGNVSIPRIFDDDEPSLQEVREAFLVFDHNNDGYFDASDLQRVLKSLGLGEGVGMDDCEQMIAKYDMNKDRRIDVSEFTKVLESGINLLN

SEQ ID NO: 657 - DNA, 855 bp, Sorghum bicolor
  misc_feature: Ceres ANNOT ID no. 6009287
  misc_feature: Encodes the peptide sequence at SEQ ID NO 658
atggccggcgatgaccatgttgtggttgatgtggacggcttagcgaaatccaaggaggccgaggttactaagaaaccgtctgaggttgcaaacagtccagctgcggctgctgcatctccgtcagctgttgttgacttggtccatgacgaggaggagggcggtggggaggaggagccgctcatccaggctgcagagtgccgcatatgccaggaggaagatagtgtcaagaatctcgagaaaccctgtgcttgcagcggcagcctcaagtatgctcacagagcttgcgtgcaacgctggtgcaatgagaaaggagacactacttgtgaaatttgccatgaggaatacaagcctggttacactgcgccccctcgtcctcagccagatgagacaaccatagacatcgacggtgatttgattatggatttgcgtgacccaagaattctcgctgtagcagctgcccaacgtcgtcttcttgaggcggagtatgatggttatgctactacagatgctagtggtgctgcattctgccgttcagctgcacttattttaatggcgctgttgcttctacgacatgcattgtccatctcagacaacgaaggaaatgatgatgatgcttctaccatgttctcactttttctgctgcgagctgctgggtttctgctgccgtgctacatcatggcatggatattcagtattttgcatcgcaggcgacaaagacaggaggaggctgcactggctgcagcagaggtggccttcatcctacagtcagccagggggcgcgccctccagtttgccatcgctccagactcccccgccaccccgcagcacgagccagcaccgcagcaacagcaatag

SEQ ID NO: 658 - protein, 284 aa, Sorghum bicolor
  misc_feature: Ceres ANNOT ID no. 6009287
  misc_feature (66)..(111): Pfam Id: zf-C3HC4 Pfam Desc: Zinc finger, C3HC4 type (RING finger)
  misc_feature (5)..(280): NCBI GI: 42408883 NCBI Desc: zinc finger protein-like [oryza sativa (japonica cultivar-group)]
  misc_feature (5)..(240): NCBI GI: 30692888 NCBI Desc: zinc finger (c3hc4-type ring finger) family protein [arabidopsis thaliana]
  misc_feature (6)..(260): NCBI GI: 15223693 NCBI Desc: zinc finger (c3hc4-type ring finger) family protein [arabidopsis thaliana]
  misc_feature (6)..(260): NCBI GI: 7262667 NCBI Desc: contains similarity to pit1 from arabidopsis thaliana gbaf130849
  misc_feature (5)..(211): NCBI GI: 30692886 NCBI Desc: zinc finger (c3hc4-type ring finger) family protein [arabidopsis thaliana]
  misc_feature: Useful for making plants with altered Lignin content
  misc_feature: Functional homolog of the protein sequence given in SEQ ID NO 12907
  misc_feature: Useful for making plants with altered lignin content
  misc_feature: Functional homolog of the protein sequence given in SEQ ID NO 12907
MAGDDHVVVDVDGLAKSKEAEVTKKPSEVANSPAAAAASPSAVVDLVHDEEEGGGEEEPLIQAAECRICQEEDSVKNLEKPCACSGSLKYAHRACVQRWCNEKGDTTCEICHEEYKPGYTAPPRPQPDETTIDIDGDLIMDLRDPRILAVAAAQRRLLEAEYDGYATTDASGAAFCRSAALILMALLLLRHALSISDNEGNDDDASTMFSLFLLRAAGFLLPCYIMAWIFSILHRRRQRQEEAALAAAEVAFILQSARGRALQFAIAPDSPATPQHEPAPQQQQ

SEQ ID NO: 659 - DNA, 891 bp, Sorghum bicolor
  misc_feature: Ceres ANNOT ID no. 6009315
  misc_feature: Encodes the peptide sequence at SEQ ID NO 660
atggcgttccgccaccggcgtccgtgcagcctcctcctagtcctcgtccccctgctggcactggcagtcgggtcggtggccgacggcctcggcgacgtgaccgtcttctggggccggaacaaggacgagggcacgctgcgcgaggcctgcgacacgggcgcctacaccacggtcctcatctccttcctccgcaccttcggccacggcaggtactcgctcgacctctccggccacccgctcgccggcgtcggcgacgacatcaagcactgccagtccaagggcatcctcgtgctcctctccatcggcgggcccggctacggcggcggcagctactccctcccgtccgcgcagtcagcggccgacgtcgccgcgtacctgtgggacgcctacctcggcggcaactccaacaccggggtccgccgcccgttcggcgacgcggccctggacggcgtcgacttctacatcgaccagggcggcgcggcacactacgacgagctcgccaagctcctctacgcctacaacaagaactaccgcggccggctcggcgtcacgctgacggccacggtgcggtgcgcgtaccgggacccgcgcatggcggcggcgctcgccacggggctcttctcccgcgtccacgtccggctgtacggcggcgacgccaggtgcaccgattccggcaggtacgccatggagaagtgggcggcggagtacccgggcagccgggtgttcgtcggggtgtcggcggaggacaaacatggtgatacgtccaccggagacctcaaggacctctactatggtatcctgcagttcgtcgagaagctgcccaactatggaggactcatgatctggaacaggtactacgacaagaagaaccacttcatcagccaaagctaa

SEQ ID NO: 660 - protein, 296 aa, Sorghum bicolor
  misc_feature: Ceres ANNOT ID no. 6009315
  misc_feature (31)..(287): Pfam Id: Glyco_hydro_18 Pfam Desc: Glycosyl hydrolases family 18
  misc_feature (18)..(295): NCBI GI: 62733213 NCBI Desc: glycosyl hydrolases family 18 [oryza sativa (japonica cultivar-group)]
  misc_feature (18)..(295): NCBI GI: 73622089 NCBI Desc: xylanase inhibitor protein 2 precursor (class iii chitinase homolog h)
  misc_feature (8)..(294): NCBI GI: 115462837 NCBI Desc: os05g0247500 [oryza sativa (japonica cultivar-group)]
  misc_feature (10)..(292): NCBI GI: 77552683 NCBI Desc: chitinase iii c00481 [oryza sativa (japonica cultivar-group)]
  misc_feature (1)..(292): NCBI GI: 2696225 NCBI Desc: chitinase [oryza sativa (japonica cultivar-group)]
  misc_feature: Useful for making plants with altered cell wall content and/or composition
  misc_feature: Functional homolog of the protein sequence encoded by LOCUS at5g24090
MAFRHRRPCSLLLVLVPLLALAVGSVADGLGDVTVFWGRNKDEGTLREACDTGAYTTVLISFLRTFGHGRYSLDLSGHPLAGVGDDIKHCQSKGILVLLSIGGPGYGGGSYSLPSAQSAADVAAYLWDAYLGGNSNTGVRRPFGDAALDGVDFYIDQGGAAHYDELAKLLYAYNKNYRGRLGVTLTATVRCAYRDPRMAAALATGLFSRVHVRLYGGDARCTDSGRYAMEKWAAEYPGSRVFVGVSAEDKHGDTSTGDLKDLYYGILQFVEKLPNYGGLMIWNRYYDKKNHFISQS

SEQ ID NO: 661 - DNA, 909 bp, Sorghum bicolor
  misc_feature: Ceres ANNOT ID no. 6009327
  misc_feature: Encodes the peptide sequence at SEQ ID NO 662
atggcgttcacacggcgtccgtccatcctcctccccctagcactcgccctcctctccctgctggcatccggccgcacgctggcggccaccggcccgggcgacatcgccgtgttctggggccggaacaaggccgagggcacgctgcgcgaggcctgcgacaccggcacctacaccaccgtcatcatctccttcctccgcggcttcggcggccacggcgcctacacgctcgacctctcgggccacccgctcgccggcgtcggcgacgacgtcaagcactgccagtccaaaggcatcctcgtgctcctctccatcgccgcggccggcgccgccgccaactactccctcccgtccgctcaatccgcggccgacctcgccgcgtacctgtgggacgcctacctcggcggctcccgccccggactacgccgcccgttcggcgacgacgcggcgctggacggcgtcgacttctacatcgaccagtcgacctccggcgaccacgaccactacgacgagctggcgaggcgcctgtacgcctacaacagccgctaccaccgcggccggctcggcgtcacgctgacggcgacggtgcggtgcgcgtacccggaccggccgggcgtgcaggcggcgctcgcgacggggctcttctcgcgcgtccacgtccggctctacggcgacctcaagtgcacctggtccgacagggaggcgtgggagaagtgggcggcggcgtacccggccagccgcgcgttcgtcggcgtcgtggcgtcgccggaggcggacaaggacgcgtacatgttccagaaggacctgtattacaacgtgctgcagttcgcgcagaaggtgcccaactatggaggactgatgatctgggataggtactacgacaagatgaaccactacatcagcagcagctaa

SEQ ID NO: 662 - protein, 302 aa, Sorghum bicolor
  misc_feature: Ceres ANNOT ID no. 6009327
  misc_feature (33)..(293): Pfam Id: Glyco_hydro_18 Pfam Desc: Glycosyl hydrolases family 18
  misc_feature (10)..(298): NCBI GI: 62733213 NCBI Desc: glycosyl hydrolases family 18 [oryza sativa (japonica cultivar-group)]
  misc_feature (10)..(298): NCBI GI: 73622089 NCBI Desc: xylanase inhibitor protein 2 precursor (class iii chitinase homolog h)
  misc_feature (10)..(300): NCBI GI: 115462837 NCBI Desc: os05g0247500 [oryza sativa (japonica cultivar-group)]
  misc_feature (10)..(298): NCBI GI: 62733216 NCBI Desc: glycosyl hydrolases family 18 [oryza sativa (japonica cultivar-group)]
  misc_feature (1)..(298): NCBI GI: 2696225 NCBI Desc: chitinase [oryza sativa (japonica cultivar-group)]
  misc_feature: Useful for making plants with altered cell wall content and/or composition
  misc_feature: Functional homolog of the protein sequence encoded by LOCUS at5g24090
MAFTRRPSILLPLALALLSLLASGRTLAATGPGDIAVFWGRNKAEGTLREACDTGTYTTVIISFLRGFGGHGAYTLDLSGHPLAGVGDDVKHCQSKGILVLLSIAAAGAAANYSLPSAQSAADLAAYLWDAYLGGSRPGLRRPFGDDAALDGVDFYIDQSTSGDHDHYDELARRLYAYNSRYHRGRLGVTLTATVRCAYPDRPGVQAALATGLFSRVHVRLYGDLKCTWSDREAWEKWAAAYPASRAFVGVVASPEADKDAYMFQKDLYYNVLQFAQKVPNYGGLMIWDRYYDKMNHYISSS

SEQ ID NO: 663 - DNA, 381 bp, Sorghum bicolor
  misc_feature: Ceres ANNOT ID no. 6009332
  misc_feature: Encodes the peptide sequence at SEQ ID NO 664
atgggcggatacaaagagtattcctggtattcccaggaatacccaactttttttatacacttcttggtatatatatatatatatgtatatatatatatatatatatatatatatatatatatatatatatatatatatatatatatatatatatatatatatatatatatatatatatatatatatatatatatatatctctctatatatatatatatatatatatatatatatatacacatatatatatatatatatatatatatatatatatatatatatatatatatatatatatatatatatatatatatatatatgtatatatatatatatatatatataatattacacctaattatttatctcctgaccacataa

SEQ ID NO: 664 - protein, 126 aa, Sorghum bicolor
  misc_feature: Ceres ANNOT ID no. 6009332
  misc_feature (10)..(113): NCBI GI: 116117738 NCBI Desc: ensangp00000030067 [anopheles gambiae str. pest]
  misc_feature (17)..(124): NCBI GI: 114329887 NCBI Desc: ymf77 [tetrahymena paravorax]
  misc_feature (6)..(124): NCBI GI: 51342335 NCBI Desc: mpxv-wrair169 [monkeypox virus]
  misc_feature (6)..(121): NCBI GI: 68449468 NCBI Desc: serine protease inhibitor-like spi-1 protein [monkeypox virus]
  misc_feature (17)..(121): NCBI GI: 68449667 NCBI Desc: serine protease inhibitor-like spi-1 protein [monkeypox virus]
MGGYKEYSWYSQEYPTFFIHFLVYIYIYVYIYIYIYIYIYIYIYIYIYIYIYIYIYIYIYIYIYIYLSIYIYIYIYIYIHIYIYIYIYIYIYIYIYIYIYIYIYIYMYIYIYIYIILHLIIYLLTT

SEQ ID NO: 665 - DNA, 1341 bp, Sorghum bicolor
  misc_feature: Ceres ANNOT ID no. 6009336
  misc_feature: Encodes the peptide sequence at SEQ ID NO 666
atgttgggggagcagcgcatgatactggccttggaatcagctagctcatcaagctctgcccctgatttgagtttgaccctctctggagagcttccttctgtgagtagcaggaactgtgtgattcagagcctgcaggtggggtgggcgcagaagggaggtgggcaggtggtggagggtctggtgaattgttacagcaagaagaagaagaagaataataagatcggcggtggtggttcgtggactcctgcagccaaatcctgggcttctgagatggagggtgctgacgagagtggtgaagttgaagtcaacacggccgagctcatcggtgtgattggccgggagttggcgatttcatgcctgctccgtcttccccggtcttactactatgatgtggcatgtgttaatcggtctttctactcccttgtgaggtccggggagctttacaggctgaggcgggaggctgggattgtcgagcagatgatctactgctcgtgcaatgttctcgagtgggaaggatttgatccgtgccgccaacggtggttcagcatcccttccatgcctcccatagagtgcttcacccttgcagataaggagtccctggctgtgggcaccaatatcctcgtctttgggaggagggtggaagcccatgttgtgctgagttacagccttctgactaactcttggacgacaggagagatgatgaacacaccgaggtgcttgtttggctcggcaagctttggtgagaaggcgattgtagctggtggttttggtgagaatggtgcgttgagctctgctgagctttatgattctgagatgcggacatggaccactctcccaagcatgaacagggcacggcagatgtgctctggtttcttcatggatgacaagttctatgtcattggtgggaaagctgagaaacacaatgaggtcctcagttgtgctgaggagtttgatttggagaacggcacctggcggctgatcccagacatggcacagggccttaatggtggaagcggtgctcctcctcttgttgctgttgtgaataatgaactttatgctgctgactatgcaacgaaggaggttagaaaatacgacaaggaaaataatgcctggatcactcttggactgttacctgggaggtatacatcagttcatggctggggcattgctttccgtagttgtgggaatatgctcattgtaattggtgcaatgagtgttggtggtggtggggtgattgaaatttgttcctgggtacccaataatgagccgccagattggaagatcattggcacccgccgttccggaagctttgtgtacaattgtgctgtgatgagttgttga

SEQ ID NO: 666 - protein, 446 aa, Sorghum bicolor
  misc_feature: Ceres ANNOT ID no. 6009336
  misc_feature (237)..(282): Pfam Id: Kelch_1 Pfam Desc: Kelch motif
  misc_feature (284)..(331): Pfam Id: Kelch_1 Pfam Desc: Kelch motif
  misc_feature (90)..(446): NCBI GI: 46390943 NCBI Desc: kelch repeat-containing f-box-like [oryza sativa (japonica cultivar-group)]
  misc_feature (92)..(446): NCBI GI: 4262182
  misc_feature (111)..(446): NCBI GI: 92899179 NCBI Desc: cyclin-like f-box [medicago truncatula]
  misc_feature (114)..(446): NCBI GI: 38344328 NCBI Desc: osjnba0058k23.10 [oryza sativa (japonica cultivar-group)]
  misc_feature (114)..(446): NCBI GI: 90399335 NCBI Desc: h0313f03.20 [oryza sativa (indica cultivar-group)]
  misc_feature: The sequence is a functional homolog of SEQ ID NO. 315 in the 11/188,298 US application
  misc_feature: The sequence is a functional homolog of SEQ ID NO. 440 in the 11/188,298 US application
MLGEQRMILALESASSSSSAPDLSLTLSGELPSVSSRNCVIQSLQVGWAQKGGGQVVEGLVNCYSKKKKKNNKIGGGGSWTPAAKSWASEMEGADESGEVEVNTAELIGVIGRELAISCLLRLPRSYYYDVACVNRSFYSLVRSGELYRLRREAGIVEQMIYCSCNVLEWEGFDPCRQRWFSIPSMPPIECFTLADKESLAVGTNILVFGRRVEAHVVLSYSLLTNSWTTGEMMNTPRCLFGSASFGEKAIVAGGFGENGALSSAELYDSEMRTWTTLPSMNRARQMCSGFFMDDKFYVIGGKAEKHNEVLSCAEEFDLENGTWRLIPDMAQGLNGGSGAPPLVAVVNNELYAADYATKEVRKYDKENNAWITLGLLPGRYTSVHGWGIAFRSCGNMLIVIGAMSVGGGGVIEICSWVPNNEPPDWKIIGTRRSGSFVYNCAVMSC

SEQ ID NO: 667 - DNA, 702 bp, Sorghum bicolor
  misc_feature: Ceres ANNOT ID no. 6009340
  misc_feature: Encodes the peptide sequence at SEQ ID NO 668
atggcggtgctactccgccgcgccgcggccgccgcagcggcggtcctcgtcgtcgcggccgtctgcgcggacggcgcctccacgttctactcctccgaccccaacctcgggtccgcccgcgtcgtcttccagacaaattatggtgacatcgagtttggcttctttcctcatgttgcacctaagactgtcgaacacattttcaaacttgtgcggcttggatgctacaacacaaatcacttcttcagggttgacaagggtttcgttgcacaagttgctgatgttatgtcaggtcgaactgcccctatgaatgcagagcagaaaagagaagcagagaaaacaatcgttggtgaatttagtagtgtcaagcatgtcaggggaatcctctccatgggaaggcactccgatccagacagcgctggctcttccttttctatccttctgggcaattcaccacaccttgatggccagtatgctgtattcgggagggtcactaaaggtgacgatacattaagtaaactagagaggcttccaacccggagagaagggatttttgtaatgccgatcgagcgtatcgacatcctatcaacttactattatgatattgatgtagagagctgtgaagcagaaaaaactattcttcggaggagactttctgaatcagcatcagaagttgaaagatggagaagaaaatgctttgcttaa

SEQ ID NO: 668 - protein, 233 aa, Sorghum bicolor
  misc_feature: Ceres ANNOT ID no. 6009340
  misc_feature (40)..(199): Pfam Id: Pro_isomerase Pfam Desc: Cyclophilin type peptidyl-prolyl cis-trans isomerase/CLD
  misc_feature (41)..(226): NCBI GI: 4262183
  misc_feature (4)..(195): NCBI GI: 118727991 NCBI Desc: peptidyl-prolyl cis-trans isomerase, cyclophilin type [clostridium cellulolyticum h10]
  misc_feature (47)..(178): NCBI GI: 82746592 NCBI Desc: probable peptidyl-prolyl cis-trans isomerase b [clostridium beijerincki ncimb 8052]
  misc_feature (46)..(210): NCBI GI: 110683934 NCBI Desc: peptidyl-prolyl cis-trans isomerase, cyclophilin-type [clostridium perfringens sm101]
  misc_feature (46)..(210): NCBI GI: 110673368 NCBI Desc: peptidyl-prolyl cis-trans isomerase, cyclophilin-type [clostridium perfringens atcc 13124]
MAVLLRRAAAAAAAVLVVAAVCADGASTFYSSDPNLGSARVVFQTNYGDIEFGFFPHVAPKTVEHIFKLVRLGCYNTNHFFRVDKGFVAQVADVMSGRTAPMNAEQKREAEKTIVGEFSSVKHVRGILSMGRHSDPDSAGSSFSILLGNSPHLDGQYAVFGRVTKGDDTLSKLERLPTRREGIFVMPIERIDILSTYYYDIDVESCEAEKTILRRRLSESASEVERWRRKCFA

SEQ ID NO: 669 - DNA, 1194 bp, Sorghum bicolor
  misc_feature: Ceres ANNOT ID no. 6009346
  misc_feature: Encodes the peptide sequence at SEQ ID NO 670
atggagcttgaggatgccttcaagaagcgcgcccgcgcaagtggtgtcgtcggcggatcctcggccggcagcccggaccggctgagctctctgccggactgcctcctccatagtccataccatcatgcggtgcagacatgcgtgctgtccacacggtggaggcacctctggcgctctgtcccgtgcctcgacatcgactttgatgagttcaagaaaaagttggattcattccggctgcatagtgatggaaacagagcaccggagtttggaaaaagagtggcagcaggatggctccgtcgcgccatgaaatactgcactcctgatcgtgccaatcatcagggattgagctctggttcctggcgcctcaaaaggttgcatctctgccatgtacttcttgatgatagttttcttaatcatgttagttctgtgtgccactctttggaggatttggagctggacgactgcagttgtaaaattcagtcaatcacctcccactcgctgaagaccctggttctaaaaaaatgccaatggcgaaatctttctgagattatatcgcccacactgaagacattggttatcgatggcggctcaaatactgatgcctgtgtgcttgttatcttggcccctgttcttgcatatctgcatctggttatgcatgttgccctctttcgtggtggtgtttcattaaacgagatgccatccgttgccaaggcattgattcatctacacggtcacaaacatggttttgtcagaagtaaaattggtggtgatcaattcaaatttctctgtagcatatctaattcgacaaatttagaattgtcgggctttgggacattggtgcttggtaaggaacctagattccaagaattcaagaacctgaggaacttattgttggacgactgtgatctcagtgatgacttcaggacattggtgttctttcttcggagttctcctattcttgagaaactcactttgcggtgctgcaagttcccaaaatattctagcaaaaagaaaggaatgcccatactcaagaaaacctcatcttctgaggtccgttgtctggatttgctgtgtgagaacctcaaggttgaaatcatatataaggatggctatggaccccaccatatcagtcttctgcagcttgttttggtgaatctgttgaagaacaacattaaactgaccagagttatttag

SEQ ID NO: 670 - protein, 397 aa, Sorghum bicolor
  misc_feature: Ceres ANNOT ID no. 6009346
  misc_feature (139)..(396): NCBI GI: 115458548 NCBI Desc: os04g0440300 [oryza sativa (japonica cultivar-group)]
  misc_feature (1)..(396): NCBI GI: 39545661 NCBI Desc: oj000114_01.16 [oryza sativa (japonica cultivar-group)]
  misc_feature (261)..(396): NCBI GI: 38346571 NCBI Desc: osjnba0064d20.2 [oryza sativa (japonica cultivar-group)]
  misc_feature (26)..(71): NCBI GI: 38345014 NCBI Desc: osjnba0052o21.17 [oryza sativa (japonica cultivar-group)]
  misc_feature (166)..(376): NCBI GI: 38347058 NCBI Desc: osjnba0060p14.14 [oryza sativa (japonica cultivar-group)]
MELEDAFKKRARASGVVGGSSAGSPDRLSSLPDCLLHSPYHHAVQTCVLSTRWRHLWRSVPCLDIDFDEFKKKLDSFRLHSDGNRAPEFGKRVAAGWLRRAMKYCTPDRANHQGLSSGSWRLKRLHLCHVLLDDSFLNHVSSVCHSLEDLELDDCSCKIQSITSHSLKTLVLKKCQWRNLSEIISPTLKTLVIDGGSNTDACVLVILAPVLAYLHLVMHVALFRGGVSLNEMPSVAKALIHLHGHKHGFVRSKIGGDQFKFLCSISNSTNLELSGFGTLVLGKEPRFQEFKNLRNLLLDDCDLSDDFRTLVFFLRSSPILEKLTLRCCKFPKYSSKKKGMPILKKTSSSEVRCLDLLCENLKVEIIYKDGYGPHHISLLQLVLVNLLKNNIKLTRVI

SEQ ID NO: 671 - DNA, 2112 bp, Sorghum bicolor
  misc_feature: Ceres ANNOT ID no. 6009361
  misc_feature: Encodes the peptide sequence at SEQ ID NO 672
atggccgccatggacctcctctccggcaagctcgtacgctccctccgcctccattcctcactcctcccctccgctccttcctcctcccgcgccgtccccacatcccgccgtctccgccgccgccgccatgcgcccctacactgccgccttaccacgtcctcctccccttccaccaccacaaccaccgaggtggaacaggacggcaaaagccaggacctttcctccctcctcacctcctccgacccctccgcccccgccggcgccgggaccaagaagaagcggtcgggcggcagcagcagcggcgcgtctagcatcccgtcgggggtgcggctggaggggatcaccaagtcctacaagggcgtgacggtgctcaaggacgtgtcctgggaggtgcagcgcggcgagaaagtggggctcgtgggcgtgaacggcgcgggcaagacgacgcagctgcgcatcatcgcggggctcgagcagcccgacggcggcgccgtcgtcaaggccaaggacaacatgaagatcgcgttcctcagccaggagttcgaggtctccgcgtcccgcaccgtcagggaggagttcttcagcgccttcggggaggagatggaggtcaagcgccggctcgagcaggtgcaggcggcgctcgagggcgccaccgaggacatggacctcatgggccgcctcctcgatgagctcgacctgctgcagcgccgctcccaggacgtcgacctcgacatggtggacgtcaaggtgcagaagctcatgccagagctcggattcttgcctgaggacgccgaccgcctcgtcgcctccttcagtggtgggtggaaaatgaggatgtctcttggcaagatacttcttcaggaccctgatttgcttttgcttgatgagcctacgaatcatgtcgatttggacactgttgagtggctggagagctatcttaagacacaggaggtgccgatggtcattatatctcatgacagggcgtttcttgatcagttgtgtacaaagatagtggaaactgaatttggtgtgtccaagacatacaagggtaactattcagagtacattctagcgaaggcagtagcagtgcaggcacagtatgctgcgtgggagaagcagcagaaggagattgagcagacaaaggagctgataaacagacttggtgctggagttaatgcagggcgtgcttccagtgagcagaagaaattggagaagcttgaaaaggaagggttgattgagaaacctttccaaaggaagcagctaaagatcagattccctgagcgtggaagaagtgggagaactgtgttggcaataaacaatcttcaatttggatttgaggataagactttgttcaacaatgctaatcttatagtagagagaggtgaaaagatagctattattgggcccaatggttgtggaaagagcacattgcttaaacttattttggggatggagaagccacaaggtggtgaggtgcttcttggggaccataatgtgttgccgaactatttcgagcagaatcaggcagaagctcttgatttagagaagactgtgctagacactgtatcagaagctgcagaggattggacacttgatgatatcaaaggtctccttggccgttgtaactttagggatgacatgctggatagaaaagttcagtttttaagtggtggagagaaggcaaggcttgcattttgcaagttcatggtgactccatctactttactcatcttggatgaaccgacaaaccatcttgatatcccatcaaaagaaatgcttgaggaggcaatatcagaatatacaggtaccgtaataacagtttctcatgaccggtactttataaaacaaattgtgaacagagtcattgaagtgaaagatcaaactatccaagactatcaaggagattacaattattaccttgaaaggaaccttgaagctagagaaagggaacttgcccgcgaggaagagctcgaggagaaggcccccaaagtaaaagctaagtccaaaatgtccaaggcagagaaagccgtcagaaagaagcagaagatgcaggccttccaacaaagcaaacaaaaatcaaagtcgcttaaaaactcaaagaggtggaattga

SEQ ID NO: 672 - protein, 703 aa, Sorghum bicolor
  misc_feature: Ceres ANNOT ID no. 6009361
  misc_feature (134)..(343): Pfam Id: ABC_tran Pfam Desc: ABC transporter
  misc_feature (461)..(627): Pfam Id: ABC_tran Pfam Desc: ABC transporter
  misc_feature (1)..(703): NCBI GI: 49073110 NCBI Desc: abcf-type protein [zea mays]
  misc_feature (50)..(703): NCBI GI: 8843748 NCBI Desc: abc transporter protein 1-like [arabidopsis thaliana]
  misc_feature (50)..(703): NCBI GI: 23308219 NCBI Desc: at5g64840/mxk3_6 [arabidopsis thaliana]
  misc_feature (12)..(703): NCBI GI: 71834735 NCBI Desc: 80c09_14 [brassica rapa subsp. pekinensis]
  misc_feature (91)..(703): NCBI GI: 22326697 NCBI Desc: abc transporter family protein [arabidopsis thaliana]
MAAMDLLSGKLVRSLRLHSSLLPSAPSSSRAVPTSRRLRRRRHAPLHCRLTTSSSPSTTTTTEVEQDGKSQDLSSLLTSSDPSAPAGAGTKKKRSGGSSSGASSIPSGVRLEGITKSYKGVTVLKDVSWEVQRGEKVGLVGVNGAGKTTQLRIIAGLEQPDGGAVVKAKDNMKIAFLSQEFEVSASRTVREEFFSAFGEEMEVKRRLEQVQAALEGATEDMDLMGRLLDELDLLQRRSQDVDLDMVDVKVQKLMPELGFLPEDADRLVASFSGGWKMRMSLGKILLQDPDLLLLDEPTNHVDLDTVEWLESYLKTQEVPMVIISHDRAFLDQLCTKIVETEFGVSKTYKGNYSEYILAKAVAVQAQYAAWEKQQKEIEQTKELINRLGAGVNAGRASSEQKKLEKLEKEGLIEKPFQRKQLKIRFPERGRSGRTVLAINNLQFGFEDKTLFNNANLIVERGEKIAIIGPNGCGKSTLLKLILGMEKPQGGEVLLGDHNVLPNYFEQNQAEALDLEKTVLDTVSEAAEDWTLDDIKGLLGRCNFRDDMLDRKVQFLSGGEKARLAFCKFMVTPSTLLILDEPTNHLDIPSKEMLEEAISEYTGTVITVSHDRYFIKQIVNRVIEVKDQTIQDYQGDYNYYLERNLEARERELAREEELEEKAPKVKAKSKMSKAEKAVRKKQKMQAFQQSKQKSKSLKNSKRWN

SEQ ID NO: 673 - DNA, 768 bp, Sorghum bicolor
  misc_feature: Ceres ANNOT ID no. 6009371
  misc_feature: Encodes the peptide sequence at SEQ ID NO 674
atggcacgcaagaaggtgaatctccagtggatctccaacaatgctactggacgtgcaacatacaagagatgctacaagtccctggtaaaaaaggctagtgagctcaccacactctgtggcactaacatgtgtgtggtggtgtatggtgatggcaaggctcagccggaggtgtggccctccgatgaagaggccaagaaactcctcaagaaattcaaggacatgccaaatgttggcagcttgaagaagacacagagccaggcggagttcctccaaagtcgcacattcaagctccatgagcagacaagcaagttggatcaagagaatcgtgagcgtgagaccttggtcatcttgcatgacagcttggatggacgtcgtccaggcctcgttggcaccagcaaggatgagctcattagccttggggagattgtggagatgaagatgaccaaagctaaagcacggatccagcagcttgtcggcaggcagggatccctcccagatccattccaggtgatgccaccagtttcatcctcattgcagacacaagcttcttcctacacctacaacgagatgcaaatcacggcaccactagaggaacacctgcagcagcaggactggcctcttgcaagccagctggcgccaaactatggggagctcggctctgcgctctatgatggctttgtaggcagcagcagggaccccagtggaagtgggtgccaaatgatgcagccttacaatctgggtttttcctcaggactcccatggtcatag

SEQ ID NO: 674 - protein, 255 aa, Sorghum bicolor
  misc_feature: Ceres ANNOT ID no. 6009371
  misc_feature (9)..(60): Pfam Id: SRF-TF Pfam Desc: SRF-type transcription factor (DNA-binding and dimerisationdomain)
  misc_feature (21)..(151): NCBI GI: 108709427 NCBI Desc: srf-type transcription factor family protein [oryza sativa (japonica cultivar-group)]
  misc_feature (1)..(176): NCBI GI: 32402456 NCBI Desc: mads-box protein agl35 [arabidopsis thaliana]
  misc_feature (1)..(157): NCBI GI: 92898301 NCBI Desc: transcription factor, mads-box [medicago truncatula]
  misc_feature (1)..(165): NCBI GI: 116309208 NCBI Desc: osigba0139j17.10 [oryza sativa (indica cultivar-group)]
  misc_feature (1)..(182): NCBI GI: 140069709 NCBI Desc: transcription factor, mads-box [medicago truncatula]
  misc_feature: Useful for making plants with altered Lignin content
  misc_feature: Functional homolog of the protein sequence given in SEQ ID NO 13329
  misc_feature: The sequence is a functional homolog of SEQ ID NO. 359 in the 11/188,298 US application
  misc_feature: The sequence is a functional homolog of SEQ ID NO. 518 in the 11/188,298 US application
  misc_feature: The sequence is a functional homolog of SEQ ID NO. 420 in the 11/188,298 US application
  misc_feature: The sequence is a functional homolog of SEQ ID NO. 491 in the 11/188,298 US application
  misc_feature: The sequence is a functional homolog of SEQ ID NO. 273 in the 11/188,298 US application
  misc_feature: The sequence is a functional homolog of SEQ ID NO. 361 in the 11/188,298 US application
MARKKVNLQWISNNATGRATYKRCYKSLVKKASELTTLCGTNMCVVVYGDGKAQPEVWPSDEEAKKLLKKFKDMPNVGSLKKTQSQAEFLQSRTFKLHEQTSKLDQENRERETLVILHDSLDGRRPGLVGTSKDELISLGEIVEMKMTKAKARIQQLVGRQGSLPDPFQVMPPVSSSLQTQASSYTYNEMQITAPLEEHLQQQDWPLASQLAPNYGELGSALYDGFVGSSRDPSGSGCQMMQPYNLGFSSGLPWS

SEQ ID NO: 675 - DNA, 768 bp, Sorghum bicolor
  misc_feature: Ceres ANNOT ID no. 6009379
  misc_feature: Encodes the peptide sequence at SEQ ID NO 676
atggcacgcaagaaggtgaatctccagtggatctccaacaatgctactcgacgtgcaacatacaagagatgctacaagtctcttgcaaaaaaggctagtgagctcaccacactctgtggcactaacatgtgtgtggtggtgtatggtgatggcaaggctcagccggaggtgtggccctccgatgaagaggccaagaaactcctcaagaaatttaaggacatgccaaatcttggcagcttgaagaagacacagagccaggcggagttcctccaaagtcgcacgttcaagctccatgagcagacaagcaagttggatcaagagaatcgtgagcgtgagaccttgggcctcttgcatgaccgcttggatggacgtcgtccaggcctcgttggcaccagcaaggatgagctcattagccttggggagattgtggagatcaagatgaccaaagctaaagcacggatccaacagcttgtcggtaggcagggatccctcccagatccattccaggtgatgccaccagtttcatcctcattgcagacacaagcttcttcctacacctacaacaagatgcaaatcacggcgccactagaggaacacctgcagcagcaggactggccgcttgcaagccagctggcaccaaactatggggagctcggctctgcgctctatgatggctttgtaggcagcagcagggaccccagtggaagtgggtgcccaatgatgcagccttacaatctgggtttttcctcaggactcccaaggccatag

SEQ ID NO: 676 - protein, 255 aa, Sorghum bicolor
  misc_feature: Ceres ANNOT ID no. 6009379
  misc_feature (9)..(60): Pfam Id: SRF-TF Pfam Desc: SRF-type transcription factor (DNA-binding and dimerisationdomain)
  misc_feature (1)..(176): NCBI GI: 32402456 NCBI Desc: mads-box protein agl35 [arabidopsis thaliana]
  misc_feature (1)..(165): NCBI GI: 116309208 NCBI Desc: osigba0139j17.10 [oryza sativa (indica cultivar-group)]
  misc_feature (21)..(151): NCBI GI: 108709427 NCBI Desc: srf-type transcription factor family protein [oryza sativa (japonica cultivar-group)]
  misc_feature (1)..(157): NCBI GI: 92898301 NCBI Desc: transcription factor, mads-box [medicago truncatula]
  misc_feature (1)..(182): NCBI GI: 140069709 NCBI Desc: transcription factor, mads-box [medicago truncatula]
  misc_feature: The sequence is a functional homolog of SEQ ID NO 1912 in the 10/374,780US patent application
  misc_feature: Useful for making plants with altered Lignin content
  misc_feature: Useful for making plants with modulated growth and phenotype characteristics
  misc_feature: Functional homolog of the protein sequence given in SEQ ID NO 13329
  misc_feature: The sequence is a functional homolog of SEQ ID NO 1912 in the 20060162006 US patent application
  misc_feature: The sequence is a functional homolog of SEQ ID NO. 420 in the 11/188,298 US application
  misc_feature: The sequence is a functional homolog of SEQ ID NO. 359 in the 11/188,298 US application
  misc_feature: The sequence is a functional homolog of SEQ ID NO. 518 in the 11/188,298 US application
  misc_feature: The sequence is a functional homolog of SEQ ID NO. 491 in the 11/188,298 US application
  misc_feature: The sequence is a functional homolog of SEQ ID NO. 273 in the 11/188,298 US application
  misc_feature: The sequence is a functional homolog of SEQ ID NO. 361 in the 11/188,298 US application
MARKKVNLQWISNNATRRATYKRCYKSLAKKASELTTLCGTNMCVVVYGDGKAQPEVWPSDEEAKKLLKKFKDMPNLGSLKKTQSQAEFLQSRTFKLHEQTSKLDQENRERETLGLLHDRLDGRRPGLVGTSKDELISLGEIVEIKMTKAKARIQQLVGRQGSLPDPFQVMPPVSSSLQTQASSYTYNKMQITAPLEEHLQQQDWPLASQLAPNYGELGSALYDGFVGSSRDPSGSGCPMMQPYNLGFSSGLPRP

SEQ ID NO: 677 - DNA, 801 bp, Sorghum bicolor
  misc_feature: Ceres ANNOT ID no. 6009380
  misc_feature: Encodes the peptide sequence at SEQ ID NO 678
atggtacgcaagaaggtgaatctccagtggatctccaacaatgctactcgacgtgccacatacaagagacgctaccagtccctggtaaaaaaggctagtgagctcaccacactttgtggcactaacatgtgtgtggtggtgtatgctgatagcaaggctcagccggatgtgtcgccctccgatgaagaggccaaaaaactcctcaagaaattcaaggacatgccaaatgtcgacagcttgaagaagacacagagccaggcggagttcctccaaagacgcacgttcaagctccatgaggagacaagcaagttggatcaagagaatcgtgagcgtgagaccttggtcctcttgcatgatagcttggatggacatcgtccaggcctcgttggcaccaccaaggacgagctcctaagccttaaggagattgtggagatgaagatgaacaaagccaaagcacggatcgagcagcttgtcggcggaaaggaagctctcccagatccatttcaggtgatgctaccagtttcatcctcatcgcagacacaagcttcttcctacacctacaatgagatgcaaatcatggtgccactagaggaacaccagatgcagaaggattggccgcttgcaagcctgctggaggcaaactatggggagctcggcactgcactctatgatggctttgtaggcagcagcagggacaccagcggaagtggattccaaatgatgcagcccgtggccacagtagtgcatggaactaaattttccaactgtgcgtggccagctcttgacatatacatactatga

SEQ ID NO: 678 - protein, 266 aa, Sorghum bicolor
  misc_feature: Ceres ANNOT ID no. 6009380
  misc_feature (9)..(59): Pfam Id: SRF-TF Pfam Desc: SRF-type transcription factor (DNA-binding and dimerisationdomain)
  misc_feature (21)..(151): NCBI GI: 108709427 NCBI Desc: srf-type transcription factor family protein [oryza sativa (japonica cultivar-group)]
  misc_feature (1)..(207): NCBI GI: 32402456 NCBI Desc: mads-box protein agl35 [arabidopsis thaliana]
  misc_feature (1)..(157): NCBI GI: 92898301 NCBI Desc: transcription factor, mads-box [medicago truncatula]
  misc_feature (1)..(182): NCBI GI: 140069709 NCBI Desc: transcription factor, mads-box [medicago truncatula]
  misc_feature (1)..(207): NCBI GI: 32402466 NCBI Desc: mads-box protein agl45-i [arabidopsis thaliana]
  misc_feature: Useful for making plants with altered Lignin content
  misc_feature: Functional homolog of the protein sequence given in SEQ ID NO 13329
  misc_feature: The sequence is a functional homolog of SEQ ID NO. 359 in the 11/188,298 US application
  misc_feature: The sequence is a functional homolog of SEQ ID NO. 420 in the 11/188,298 US application
  misc_feature: The sequence is a functional homolog of SEQ ID NO. 518 in the 11/188,298 US application
  misc_feature: The sequence is a functional homolog of SEQ ID NO. 273 in the 11/188,298 US application
  misc_feature: The sequence is a functional homolog of SEQ ID NO. 361 in the 11/188,298 US application
  misc_feature: The sequence is a functional homolog of SEQ ID NO. 491 in the 11/188,298 US application
  misc_feature: The sequence is a functional homolog of SEQ ID NO. 377 in the 11/188,298 US application
  misc_feature: The sequence is a functional homolog of SEQ ID NO. 302 in the 11/188,298 US application
MVRKKVNLQWISNNATRRATYKRRYQSLVKKASELTTLCGTNMCVVVYADSKAQPDVSPSDEEAKKLLKKFKDMPNVDSLKKTQSQAEFLQRRTFKLHEETSKLDQENRERETLVLLHDSLDGHRPGLVGTTKDELLSLKEIVEMKMNKAKARIEQLVGGKEALPDPFQVMLPVSSSSQTQASSYTYNEMQIMVPLEEHQMQKDWPLASLLEANYGELGTALYDGFVGSSRDTSGSGFQMMQPVATVVHGTKFSNCAWPALDIYIL

SEQ ID NO: 679 - DNA, 951 bp, Sorghum bicolor
  misc_feature: Ceres ANNOT ID no. 6009396
  misc_feature: Encodes the peptide sequence at SEQ ID NO 680
atggaggagaaggcgtcgtcgccgctgatcccgccgccgtcggagatcgacctggaggcgggcggcggcggggagcagctgcagtgccggatctgcctcgagaccgacgggagggacttcatcgcgccctgcaagtgcaaggggacgtccaagtacgtgcaccgcgactgcctcgatcactggagggcggtaaaggagggatttgcattttcccattgtaccacctgcaaggctccatattacttgagggttcattcccacactgacaggaaatggcgaacactgaagtttcgtttctttgttactagagatatattattcatctttgctctagtccagattgtcatctctgcattggcatatttggtacattttattgatgggtaccagcaatattggttaaggacagcctggggttttgataatgaagttagtttttattatatatgtggtgcattattgttttttgctttgttgggactatcgggatgcttcataacctgttatgaccgaagagtacgaaatgacttggctcagccttgtcgagaattatgtctttgttgctgtcagccagggatgtgtgcagattgccatctacctggcacgctttgcatgtggactgactgcactacctgcttcgaaggctgtgctactacagccggcgagtgtggtggttgcttgggaggtgctggggaagccgggctaccgctgctcctcatcatgggggttattgtgctcgggcttttcactgtcatcggcatattctacagtgtcctggtcgcgacaatggtcggccagcggatctggcagcgacattatcacattcttgccaaacgaatgctaactaaggagtatgtcgtagaggacgttgatggcgagcgcacagactggtgtcccccgccactacctgcggagcacatcagccagctgaagtccctggggcttctataa

SEQ ID NO: 680 - protein, 316 aa, Sorghum bicolor
  misc_feature: Ceres ANNOT ID no. 6009396
  misc_feature (29)..(76): Pfam Id: zf-C3HC4 Pfam Desc: Zinc finger, C3HC4 type (RING finger)
  misc_feature (2)..(203): NCBI GI: 40253895 NCBI Desc: zinc finger (c3hc4-type ring finger) protein -like [oryza sativa (japonica cultivar-group)]
  misc_feature (7)..(189): NCBI GI: 53791481 NCBI Desc: zinc finger (c3hc4-type ring finger) protein -like [oryza sativa (japonica cultivar-group)]
  misc_feature (28)..(166): NCBI GI: 41052575 NCBI Desc: zinc finger (c3hc4-type ring finger) protein-like [oryza sativa (japonica cultivar-group)]
  misc_feature (17)..(203): NCBI GI: 140040744 NCBI Desc: zinc finger, ring-type [medicago truncatula]
  misc_feature (28)..(87): NCBI GI: 66358532 NCBI Desc: ssm4 like ring finger protein [cryptosporidium parvum]
MEEKASSPLIPPPSEIDLEAGGGGEQLQCRICLETDGRDFIAPCKCKGTSKYVHRDCLDHWRAVKEGFAFSHCTTCKAPYYLRVHSHTDRKWRTLKFRFFVTRDILFIFALVQIVISALAYLVHFIDGYQQYWLRTAWGFDNEVSFYYICGALLFFALLGLSGCFITCYDRRVRNDLAQPCRELCLCCCQPGMCADCHLPGTLCMWTDCTTCFEGCATTAGECGGCLGGAGEAGLPLLLIMGVIVLGLFTVIGIFYSVLVATMVGQRIWQRHYHILAKRMLTKEYVVEDVDGERTDWCPPPLPAEHISQLKSLGLL

SEQ ID NO: 681 - DNA, 2112 bp, Sorghum bicolor
  misc_feature: Ceres ANNOT ID no. 6009398
  misc_feature: Encodes the peptide sequence at SEQ ID NO 682
atgggttcttctccttccaaagccactggagaggatgcccttgttctgtgcaaggatcggatgcgccatatcagacaaaccattgactcaagggatgcactgtcagcagcgcacttatcttacacacaatccctccgcactgtgggtactgcactgcggcggtatgctgagtctgagatctcaccagaatcatcactctccatttcagaagtggataagtcaccatcgcattcctctatggcatctccctcgccttcgcgtgcagtagagaatcttgcctctccagcacatcgagcaagtcccttgactactcagccctcaacaagaatccattgcatgaaagcagcagcaaccgctcctttgacctttgtgatagatccatctgctgctgaatttgtggggcatgaatctccagtctcagcttttgtcccgcccccgccaccattgcctccagaattgtgtacgtcatgggacttctttgatcccattgatgctgctagtagctcttcctccaacaatgagaatggagtaaccttgaacttcagtagattgaagggtctaagagagtcacgggtagctgaagtagttccattgaaagaaggtgaagaagaaatcatgtctgaaagaaagcatacagagcttcctgatgataatgcaccatctaagcaggaaagagaaccaaagcaaggtgggactaggaaaccaagtcagttggtggatacttcaaccaaagctacttctgagcaggttgctgcaaaattggaggaaagcgaaatggaaaaagaattatgtgcggaggcagaggatccttcagagttcatcactcatcgagccaaagattttgtgtcgagcatgaaggacattgaaacccggtttatgcgtgcagctgaagcaggaaatgaggttccagaatgttctccaggcaagctacctactgcccgatttgtgtcagcacttcgagtgtgctgcaatcgtgatgttattctcaaccaggaaactgcgcagcatgtctcaaaggttgtcacatggaagcgttctgtctcatctctttcatcatcatctaagagtgcacttatgacatcgataattaaagatgatgtggatgacagtaatagtgattttgttgaggaattcgccatggtatctggaagccactcttctactttggacaggctacacgcatgggagagaaaactatatgatgaaatcaaggccagtgaaaatgttagaaacgcctatgatgagaaatgtaacctcctccggcgtcaatttgcacgaggcctaaatgcgcagctgattgataagactagagctgttgtgaaggatctccattccagggtatctgttgcgattcaagctgttgatgcaatctctaaaagaattgagaagataagggatgaagaactgcagccacaacttgtcgagctaattcaagggctaatcagaatgtggaaattgatgctggaatgtcaccacaaacagttcatcacgatcacattggcataccatgtgaaaaactcaaccccagtgcatcaaggcgagcaccgccgccaggcggcaatgcatctgtgcaatgagatggacagcttctcctccagcttcagaaactgggtcactgctcacaaatcgtatgttgaggccctcaatgcatggctgcagaagtgcctcctgcagccaccccaggaccgccggaggcgtaagcgcaaggtctccttccctccccgtcaggccgtctcccctcccatatttgtcctctgcagggactggcttgccatgacagaatctcttcctgctgacgaggtatgcaagtccctcaaagatgtgatgcagctcctccgtgactcgtttgagcaccaggatgagcagaacaagcccagaagtgagtcgcaggagtgtgggatgctggagaacaacagcgaaccagaggcggcgaagagtgggagtgggagtgtagcgtcagctgaagggctgcagtcgagactaacagcagttcttgaccgcctgacaaagttctcggaggcatcactgaagtgctacgaggagctcaagcagaactatgagatggcttgtgatgattacaagagagttggaccaaatgctccacatgcttaa

SEQ ID NO: 682 - protein, 703 aa, Sorghum bicolor
  misc_feature: Ceres ANNOT ID no. 6009398
  misc_feature (5)..(700): NCBI GI: 115462359 NCBI Desc: os05g0172300 [oryza sativa (japonica cultivar-group)]
  misc_feature (1)..(630): NCBI GI: 49388784 NCBI Desc: leucine zipper protein-like [oryza sativa (japonica cultivar-group)]
  misc_feature (194)..(660): NCBI GI: 115480455 NCBI Desc: os09g0542500 [oryza sativa (japonica cultivar-group)]
  misc_feature (1)..(695): NCBI GI: 115474171 NCBI Desc: os07g0686500 [oryza sativa (japonica cultivar-group)]
  misc_feature (254)..(473): NCBI GI: 113367272 NCBI Desc: bzip transcription factor bzip114 [glycine max]
  misc_feature: The sequence is a functional homolog of SEQ ID NO 1526 in the 11/479,226US patent application
  misc_feature: Useful for making plants with modulated growth and phenotype characteristics
  misc_feature: The sequence is a functional homolog of SEQ ID NO 1526 in the 20070022495 US patent application
MGSSPSKATGEDALVLCKDRMRHIRQTIDSRDALSAAHLSYTQSLRTVGTALRRYAESEISPESSLSISEVDKSPSHSSMASPSPSRAVENLASPAHRASPLTTQPSTRIHCMKAAATAPLTFVIDPSAAEFVGHESPVSAFVPPPPPLPPELCTSWDFFDPIDAASSSSSNNENGVTLNFSRLKGLRESRVAEVVPLKEGEEEIMSERKHTELPDDNAPSKQEREPKQGGTRKPSQLVDTSTKATSEQVAAKLEESEMEKELCAEAEDPSEFITHRAKDFVSSMKDIETRFMRAAEAGNEVPECSPGKLPTARFVSALRVCCNRDVILNQETAQHVSKVVTWKRSVSSLSSSSKSALMTSIIKDDVDDSNSDFVEEFAMVSGSHSSTLDRLHAWERKLYDEIKASENVRNAYDEKCNLLRRQFARGLNAQLIDKTRAVVKDLHSRVSVAIQAVDAISKRIEKIRDEELQPQLVELIQGLIRMWKLMLECHHKQFITITLAYHVKNSTPVHQGEHRRQAAMHLCNEMDSFSSSFRNWVTAHKSYVEALNAWLQKCLLQPPQDRRRRKRKVSFPPRQAVSPPIFVLCRDWLAMTESLPADEVCKSLKDVMQLLRDSFEHQDEQNKPRSESQECGMLENNSEPEAAKSGSGSVASAEGLQSRLTAVLDRLTKFSEASLKCYEELKQNYEMACDDYKRVGPNAPHA

SEQ ID NO: 683 - DNA, 753 bp, Sorghum bicolor
  misc_feature: Ceres ANNOT ID no. 6009436
  misc_feature: Encodes the peptide sequence at SEQ ID NO 684
atggaggagcgggagaagctcgtgtgcctggccaagctcgccgagcaggcggagcgatacgacgatatggtggaattcatgaagaatcttgctaggatggatgtggacatgagtgctgaagaaaggcatttgttctcagttggtttcaagaacactatcggggcaaagagagcatcgtggagaatcatttgttcacatgagcaaaaggtcacaactgatcgtcagactggtgtgatgatagatgcctataagaagatagtagaagatgaactaaggaaggtttgcaatgaagtattgtcagtcatcgctattcactgccttcccttggccaatacgagtgaaaatgtcgtattcttttataagatgaaaggtgactactaccgatacttggctgaatttagcagtggaactgaaaagaaagctgcctctgaccagtcacttatggcctatcagcatgccatggttgtcgcctccagtgagctctcacctgcccaccagatccggcttggtcttgctctcaatttgtcggtcttcttttatgagataatgaactctcatgagagagcttgccaagtggcaaaacaagcattcaatgaggctcttactgagataaattctggtgaaggggtttacaaggatagcacacttatgatgcagcttctgaaggacaacttagcattgtggacatcagaactaaccggaggtgaagcatccaaggataatgatgtcgacatggagaggcagttgtcataa

SEQ ID NO: 684 - protein, 250 aa, Sorghum bicolor
  misc_feature: Ceres ANNOT ID no. 6009436
  misc_feature (4)..(236): Pfam Id: 14-3-3 Pfam Desc: 14-3-3 protein
  misc_feature (2)..(242): NCBI GI: 15637114 NCBI Desc: 14-3-3 family protein [lycopersicon esculentum]
  misc_feature (2)..(242): NCBI GI: 42491252 NCBI Desc: 14-3-3 protein [nicotiana tabacum]
  misc_feature (2)..(246): NCBI GI: 89212810 NCBI Desc: 14-3-3-like protein [gossypium hirsutum]
  misc_feature (2)..(242): NCBI GI: 3925703 NCBI Desc: 14-3-3 protein [lycopersicon esculentum]
  misc_feature (1)..(242): NCBI GI: 21593173 NCBI Desc: 14-3-3 protein gf14epsilon (grf10) [arabidopsis thaliana]
  misc_feature: The sequence is a functional homolog of SEQ ID NO 793 in the 11/479,226US patent application
  misc_feature: Useful for making plants with modulated growth and phenotype characteristics
  misc_feature: The sequence is a functional homolog of SEQ ID NO 793 in the 20070022495 US patent application
  misc_feature: The sequence is a functional homolog of SEQ ID NO 793 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 801 in the 11/479,226 US patent application
  misc_feature: Useful for making plants with modulated drought sensitivity
  misc_feature: Functional homolog of the protein sequence given in SEQ ID NO 13373
  misc_feature: Useful for making plants with modulated water use efficiency
  misc_feature: Functional homolog of the protein sequence given in SEQ ID NO 13942
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO. 275 in the 11/188,298 US application
MEEREKLVCLAKLAEQAERYDDMVEFMKNLARMDVDMSAEERHLFSVGFKNTIGAKRASWRIICSHEQKVTTDRQTGVMIDAYKKIVEDELRKVCNEVLSVIAIHCLPLANTSENVVFFYKMKGDYYRYLAEFSSGTEKKAASDQSLMAYQHAMVVASSELSPAHQIRLGLALNLSVFFYEIMNSHERACQVAKQAFNEALTEINSGEGVYKDSTLMMQLLKDNLALWTSELTGGEASKDNDVDMERQLS

SEQ ID NO: 685 - DNA, 1209 bp, Sorghum bicolor
  misc_feature: Ceres ANNOT ID no. 6009481
  misc_feature: Encodes the peptide sequence at SEQ ID NO 686
atggcgactcgcggcggcggcggtagccagtcctacggcttcccgatctactgcgccgcctggctcccgctcgcccacatcctcaagcccgaccctcccgccgccgaggcggacgcggacgcggacgcggatgctgcctcctcctccccctcctctcccccgccccctatggctgtcctcgggggcggcggcggggagggccggagcggggtgccgaacaagctcgtggtggcggccctcgccgccggggaagaggccgccgcgccggccgccctttcccccgagacggtgcttgaggtgaagacccaagaggaggtgccgtacagaatggctgtacacccgcgcggcgatggcgtgttctgcgctttccccaacggctgcaggttgtaccgatgggaatcacaggaaggagagggaccacagaacctggccttggagccagaccaggaagctttagcggagctgaaagatgttggtttgcagttggccgtatccttcagtggagaaggttcaatacttgccattggtggtgaggatgggcatttaagagtcttcaagtggcctgctatggggtctgttctcacagaaactgatactaaaacatcgattaaggatcttaccatcagttccgatgagaagtttcttgctgtgaataggagcagcgggccatgtagagtttgggatctgcagtcatctgaagttgtagccagtctgtcaagagaagcaggggaaatatttggattctgcagattctgtaataagactgacaacagtcatgtcctatttataacagtgatgcaaggtgattatggaaaaatagtatcttggaatactacctcatggacgagaatcggttcaaagaaaataactcgtgaggccatttcagcttttgctgtgtcacccaacggcgctcttcttggaattggaacaattgaaggaagcatcatcatactgagctcaaaagacatgcggacacttgtaacagttaaaaaggctcatcttggtattgttactacactggccttctcccaggattcaagaacattgctgtcaacttcctttgactcttctgcaagggtgacatctgttgggtccccgaagagtaatggaacaagcatatggcccatgctactagttattattcttgcaattttggtgtactactgtatgcagcacaaagaagacatcttggcaatgttgccgcgttga

SEQ ID NO: 686 - protein, 402 aa, Sorghum bicolor
  misc_feature: Ceres ANNOT ID no. 6009481
  misc_feature (324)..(362): Pfam Id: WD40 Pfam Desc: WD domain, G-beta repeat
  misc_feature (10)..(393): NCBI GI: 166878 NCBI Desc: st12p protein
  misc_feature (38)..(363): NCBI GI: 8777388 NCBI Desc: protein transport protein sec12p-like [arabidopsis thaliana]
  misc_feature (67)..(395): NCBI GI: 34394605 NCBI Desc: transducin / wd-40 repeat protein-like [oryza sativa (japonica cultivar-group)]
  misc_feature (133)..(386): NCBI GI: 116283530 NCBI Desc: preb protein [homo sapiens]
  misc_feature (133)..(386): NCBI GI: 119621033 NCBI Desc: prolactin regulatory element binding, isoform cra_c [homo sapiens]
  misc_feature: The sequence is a functional homolog of SEQ ID NO. 502 in the 11/188,298 US application
MATRGGGGSQSYGFPIYCAAWLPLAHILKPDPPAAEADADADADAASSSPSSPPPPMAVLGGGGGEGRSGVPNKLVVAALAAGEEAAAPAALSPETVLEVKTQEEVPYRMAVHPRGDGVFCAFPNGCRLYRWESQEGEGPQNLALEPDQEALAELKDVGLQLAVSFSGEGSILAIGGEDGHLRVFKWPAMGSVLTETDTKTSIKDLTISSDEKFLAVNRSSGPCRVWDLQSSEVVASLSREAGEIFGFCRFCNKTDNSHVLFITVMQGDYGKIVSWNTTSWTRIGSKKITREAISAFAVSPNGALLGIGTIEGSIIILSSKDMRTLVTVKKAHLGIVTTLAFSQDSRTLLSTSFDSSARVTSVGSPKSNGTSIWPMLLVIILAILVYYCMQHKEDILAMLPR

SEQ ID NO: 687 - DNA, 1545 bp, Sorghum bicolor
  misc_feature: Ceres ANNOT ID no. 6009482
  misc_feature: Encodes the peptide sequence at SEQ ID NO 688
atgctgacctgcggccgcttcatctcctcctccgctgctaccagcaccgcatccttctcgccgtttcggactctcacccgctccctccttcgccgccccgctccccgcctcctctcctctgcctccgccgccgccgccgccgccaccgccgtcgaacccgacaccaaaggcggcggtggcgcgggaggtgctgctgctgcggtgaggccgcagtggaaggcggcgattgatttcaaatggatccgggataacagggacgccgtggccgacaatatccggagccggaactccaccgccaatctggacctcgtcctcgagctctacgaccaatacctcgcactgcagaaggaggttgaacggctccgagctgaaagaaatgcagttgctaacaagatgaaagggaaactagacccatctgtacgccaagcccttgtcgaagaaggtaagaacctgaaagaggggcttatagcacttgaggaggatcttgttcagctgacagataagcttcaacttgaagctcaaagtattcctaacactacccatcccgatgttcctgttgggggtgaggaaagctctgtcctcaggaaagaggtaggcagtcagaggagctttaattttacaatcaaagatcatcttcagctggggaaggaacttgatttgtttgactttgatgcagcagccgaggtcagtggttcgaagttctactacttaaagaatgaagctgttttgttggagatggccctagtgaattgggctatttcagaggtctccaagaagggtttcacaccactcataactccagagattgtaagatcatctgttgttgagaaatgtggcttccagccaagggctcaaaacactcaggtctactcaattgaggacagtgatcagtgtctcataggcactgctgaaattcctgttggaggcatccacatggactcaatacttgctgaatctgctttgcctttaaaatatgtagcatattcacactgttttcgcacggaagctggtgcagcaggtgctgccactaggggcctctatcgggtacatcaatttagcaaggttgaaatgttcatattctgtcggccagatgaaagtgacaaattgcatgaagaacttattacaatcgaagaggatctttatgcatcactcggactccatttcaaaactctggatatggcaaccggggatctgggcgcaccagcctaccgaaaatttgacatcgaggcatggatgccaggcctagagcgatacggtgagatctccagtgcatcaaattgtacagactaccaaagtaggcgacttggcatccgttaccgtccatcaccctcggagcctccgtcaacgaacaccaagaaagggaagggagctggctcaggccctacacagtttgttcacacgctcaacgcaacagcagtggcggtgcctcgtctgatagtctgcattctagagaattttcagcaggacgatgggtcgattgtggttccagagccactaagaccctatatgggtggacttgaggtgatctccccaaaattcgagtga

SEQ ID NO: 688 - protein, 514 aa, Sorghum bicolor
  misc_feature: Ceres ANNOT ID no. 6009482
  misc_feature (244)..(415): Pfam Id: tRNA-synt_2b Pfam Desc: tRNA synthetase class II core domain (G, H, P, S and T)
  misc_feature (75)..(180): Pfam Id: Seryl_tRNA_N Pfam Desc: Seryl-tRNA synthetase N-terminal domain
  misc_feature (23)..(514): NCBI GI: 3355717 NCBI Desc: seryl-trna synthetase [zea mays]
  misc_feature (14)..(512): NCBI GI: 144923671 NCBI Desc: trna synthetase, class ii (g, h, p and s) [medicago truncatula]
  misc_feature (14)..(512): NCBI GI: 16226853 NCBI Desc: at1g11870/f12f1_29 [arabidopsis thaliana]
  misc_feature (14)..(512): NCBI GI: 3157938 NCBI Desc: similar to seryl-trna synthetase gbu10400 from s cerevisiae. est gbn96627 comes from this gene. [arabidopsis thaliana]
  misc_feature (76)..(504): NCBI GI: 67461817 NCBI Desc: seryl-trna synthetase (serine--trna ligase) (serrs)
MLTCGRFISSSAATSTASFSPFRTLTRSLLRRPAPRLLSSASAAAAAATAVEPDTKGGGGAGGAAAAVRPQWKAAIDFKWIRDNRDAVADNIRSRNSTANLDLVLELYDQYLALQKEVERLRAERNAVANKMKGKLDPSVRQALVEEGKNLKEGLIALEEDLVQLTDKLQLEAQSIPNTTHPDVPVGGEESSVLRKEVGSQRSFNFTIKDHLQLGKELDLFDFDAAAEVSGSKFYYLKNEAVLLEMALVNWAISEVSKKGFTPLITPEIVRSSVVEKCGFQPRAQNTQVYSIEDSDQCLIGTAEIPVGGIHMDSILAESALPLKYVAYSHCFRTEAGAAGAATRGLYRVHQFSKVEMFIFCRPDESDKLHEELITIEEDLYASLGLHFKTLDMATGDLGAPAYRKFDIEAWMPGLERYGEISSASNCTDYQSRRLGIRYRPSPSEPPSTNTKKGKGAGSGPTQFVHTLNATAVAVPRLIVCILENFQQDDGSIVVPEPLRPYMGGLEVISPKFE

SEQ ID NO: 689 - DNA, 687 bp, Sorghum bicolor
  misc_feature: Ceres ANNOT ID no. 6009483
  misc_feature: Encodes the peptide sequence at SEQ ID NO 690
atggctgccaagatatttgccctccttgcactccttgctctcacggtgagtgctacaagtgcgttcatcattccgcagtgctcaccagttactgctgttgggtatgaacacccagttgtgcaggcctatcggctacaacaagtgctcgcggcgagcatcttacaacaatcaattgcccaattgcaacagcaatcctcggctcacctactagtacagaccattgtagcgcaactacaacaacaacagttcctaccagcgctcagtcaactagctattccaaaccctgccacctacttgcagctgcaacagctacttcctacaaacccactggctgcggtgaatgccattgcatacctacaacaacaacaacagttacaacagtccgtggtgaaccctatcgcctactttcaacagcaacagctacttccattcaaccaactagctgtgtcgaacgccgctgcatacctacaacagccacagtcacttccatttgctcagtcggctgttgcaaccgctgccacctaccaccagcaacaacagctgctacaggttaacccattggcactggctaacccattggcggccaccttcctacagcaacaacaattgctgccattcaaccagatgtctttcatgaacccttccttgttgtggcagcaacccatcattggaggtgccatcttctag

SEQ ID NO: 690 - protein, 228 aa, Sorghum bicolor
  misc_feature: Ceres ANNOT ID no. 6009483
  misc_feature (1)..(228): Pfam Id: Zein Pfam Desc: Zein seed storage protein
  misc_feature (1)..(223): NCBI GI: 22208485 NCBI Desc: alpha kafirin [sorghum bicolor]
  misc_feature (1)..(223): NCBI GI: 22208488 NCBI Desc: alpha kafirin [sorghum bicolor]
  misc_feature (1)..(223): NCBI GI: 22208489 NCBI Desc: alpha kafirin [sorghum bicolor]
  misc_feature (1)..(223): NCBI GI: 22208484 NCBI Desc: alpha kafirin [sorghum bicolor]
  misc_feature (1)..(223): NCBI GI: 22208482 NCBI Desc: alpha kafirin [sorghum bicolor]
MAAKIFALLALLALTVSATSAFIIPQCSPVTAVGYEHPVVQAYRLQQVLAASILQQSIAQLQQQSSAHLLVQTIVAQLQQQQFLPALSQLAIPNPATYLQLQQLLPTNPLAAVNAIAYLQQQQQLQQSVVNPIAYFQQQQLLPFNQLAVSNAAAYLQQPQSLPFAQSAVATAATYHQQQQLLQVNPLALANPLAATFLQQQQLLPFNQMSFMNPSLLWQQPIIGGAIF

SEQ ID NO: 691 - DNA, 711 bp, Sorghum bicolor
  misc_feature: Ceres ANNOT ID no. 6009484
  misc_feature: Encodes the peptide sequence at SEQ ID NO 692
atggctgccaagatatttgccctccttgcactccttgctctcttagtgagtgctacaactgcgttcatcattccgcagtgctcaccgattactgctacggggtatgaacacccagttgtgcaggcctatcggctacaacaggtgctcgcggcgagcatcttacaacaaccaattgcccaattgcaacagcaatcctcggctcacctactagaacagaccattgtagcgcaacgacaacaacgacagttcctaccagtgctcagtcaactagctattccgaaccctaccgcctacttgcagctgcaacaactacttcctacaaacccattggctgcgtcgaatgccattgcatacctaccacaacaacaacagttacaacagatcctgccagcgctcagtcaactagtcgtggcaaaccctgccgcctacttacaacagcaacagctacttccattcaaccaactagctgtgccgaacaccgctgcatacctgcaacagccacaaccgcttccatttgcccagtcggctgttgcaaccgctgccacctaccaccagcaacagcagctgctaccggttaacccattggcactggctaacccattggctgccgccttcctgcagcaacaacaattgctgccattcaaccagatgtcttttaagaacccttccttgttgtggcagcaacccatcgttggaggtgccatcttctag

SEQ ID NO: 692 - protein, 236 aa, Sorghum bicolor
  misc_feature: Ceres ANNOT ID no. 6009484
  misc_feature (1)..(236): Pfam Id: Zein Pfam Desc: Zein seed storage protein
  misc_feature (1)..(236): NCBI GI: 22585 NCBI Desc: alpha-coixin 27 kda [coix lacryma-jobi]
  misc_feature (6)..(236): NCBI GI: 22583 NCBI Desc: alpha-coixin 27 kda [coix lacryma-jobi]
  misc_feature (1)..(236): NCBI GI: 22220 NCBI Desc: 22 kd zein [zea mays]
  misc_feature (1)..(236): NCBI GI: 100940 NCBI Desc: zein za1 - maize
  misc_feature (1)..(231): NCBI GI: 22208485 NCBI Desc: alpha kafirin [sorghum bicolor]
MAAKIFALLALLALLVSATTAFIIPQCSPITATGYEHPVVQAYRLQQVLAASILQQPIAQLQQQSSAHLLEQTIVAQRQQRQFLPVLSQLAIPNPTAYLQLQQLLPTNPLAASNAIAYLPQQQQLQQILPALSQLVVANPAAYLQQQQLLPFNQLAVPNTAAYLQQPQPLPFAQSAVATAATYHQQQQLLPVNPLALANPLAAAFLQQQQLLPFNQMSFKNPSLLWQQPIVGGAIF

SEQ ID NO: 693 - DNA, 711 bp, Sorghum bicolor
  misc_feature: Ceres ANNOT ID no. 6009485
  misc_feature: Encodes the peptide sequence at SEQ ID NO 694
atggctcccaagatatttgccctccttgcactccttgctctcctagtgagtgctacaagtgcgttcatcattccgcagtgctcaccggttactgctgcggggtatgaacacccaattgtgcaggcctatcggcaacaacaggtgctcacggcgagcatcttacaacaaccaattgtccaattgcaacagcaatcctcggctcaactactagtacagaccattgtagcgcaactacaacaacaacagttcctaccagcgtttagtcaactagctattccaaaccctaccgcctacttgcagctgcaacaactacttcctacaaacccattggctgcgtcgaatgccattgcatacctaccacaacaacaacagttacaacagatcctgccagcgctcagtcaactagtcgtggcaaaccctgccgcctacttacaacagcaacagctacttccattcaaccaactagctgtgccgaacaccgctgcatacctgcaacagccacaaccgcttccatttgcccagtcggctgttgcaaccgctgccacctaccaccagcaacagcagctgctaccggttaacccattggcactggctaacccattggctgccgccttcctgcagcaacaacaattgctgccattcaaccagatgtcttttaagaacccttccttgttgtggcagcaacccatcgttggaggtgccatcttctag

SEQ ID NO: 694 - protein, 236 aa, Sorghum bicolor
  misc_feature: Ceres ANNOT ID no. 6009485
  misc_feature (1)..(236): Pfam Id: Zein Pfam Desc: Zein seed storage protein
  misc_feature (1)..(236): NCBI GI: 22585 NCBI Desc: alpha-coixin 27 kda [coix lacryma-jobi]
  misc_feature (6)..(236): NCBI GI: 22583 NCBI Desc: alpha-coixin 27 kda [coix lacryma-jobi]
  misc_feature (1)..(236): NCBI GI: 22220 NCBI Desc: 22 kd zein [zea mays]
  misc_feature (1)..(236): NCBI GI: 100940 NCBI Desc: zein za1 - maize
  misc_feature (1)..(231): NCBI GI: 22208485 NCBI Desc: alpha kafirin [sorghum bicolor]
MAPKIFALLALLALLVSATSAFIIPQCSPVTAAGYEHPIVQAYRQQQVLTASILQQPIVQLQQQSSAQLLVQTIVAQLQQQQFLPAFSQLAIPNPTAYLQLQQLLPTNPLAASNAIAYLPQQQQLQQILPALSQLVVANPAAYLQQQQLLPFNQLAVPNTAAYLQQPQPLPFAQSAVATAATYHQQQQLLPVNPLALANPLAAAFLQQQQLLPFNQMSFKNPSLLWQQPIVGGAIF

SEQ ID NO: 695 - DNA, 804 bp, Sorghum bicolor
  misc_feature: Ceres ANNOT ID no. 6009491
  misc_feature: Encodes the peptide sequence at SEQ ID NO 696
atggcggccaagatattttccctcgttatgctccttgctctttttgcaagtgctgctaccgcgacctatatcccgcaaccgcactgctcacaaatttctatagctgcccctcatcccgcatacctcccaccagtgtgcgcaaacccaatgctacaaccctatgggctccaacaggcaatcgcagcaagcatcttacagtcatcacccttgttcatccaacaaccatcggccctattgcagcagttgtccttggtgaatttgttggcacaaagcatcagggcacaacaactgcagcaactggtgctaccttcgatccaccaagtaacggtggcaaaccttgctgcgtactcccagcaacagcagtttattccattcagccaactggctgcagtgaaccccgctgcctatttgcagctgcaacaactacaacaattcagccagctagctgctgcgagccctgccgccttctggccacaacaacagctgctgccgttctacccgcagggtgtggctaacgccgccaccctcttacaactacaacagttgctcccattcaaccaactagctgcagtgaaccctgctgcctatttgcagctacaactactactacaattcagccagctaggtgctgtgagtcctgccaccttctggccacaacaacagctactgcgattctacccgcagggtgtggctaatgccgccaccctctttcaacaacaacagttgttgccattcatccagcttgctctggcgaacccagcaacgtcctgccaacaacccttcattggtggtgccctcttttag

SEQ ID NO: 696 - protein, 267 aa, Sorghum bicolor
  misc_feature: Ceres ANNOT ID no. 6009491
  misc_feature (1)..(267): Pfam Id: Zein Pfam Desc: Zein seed storage protein
  misc_feature (1)..(267): NCBI GI: 168693 NCBI Desc: zein
  misc_feature (1)..(267): NCBI GI: 4388702 NCBI Desc: zein [zea mays]
  misc_feature (1)..(239): NCBI GI: 22446 NCBI Desc: 19 kda zein [zea mays]
  misc_feature (1)..(239): NCBI GI: 22534 NCBI Desc: zein [zea mays]
  misc_feature (1)..(239): NCBI GI: 16305125 NCBI Desc: 19kd alpha zein b1 [zea mays]
  misc_feature: Useful for making plants with modulated nitrogen use efficiency
  misc_feature: Functional homolog of the protein sequence given in SEQ ID NO 13286
  misc_feature: Useful for making plants with modulated nitrogen use efficiency
  misc_feature: Functional homolog of the protein sequence given in SEQ ID NO 13286
MAAKIFSLVMLLALFASAATATYIPQPHCSQISIAAPHPAYLPPVCANPMLQPYGLQQAIAASILQSSPLFIQQPSALLQQLSLVNLLAQSIRAQQLQQLVLPSIHQVTVANLAAYSQQQQFIPFSQLAAVNPAAYLQLQQLQQFSQLAAASPAAFWPQQQLLPFYPQGVANAATLLQLQQLLPFNQLAAVNPAAYLQLQLLLQFSQLGAVSPATFWPQQQLLRFYPQGVANAATLFQQQQLLPFIQLALANPATSCQQPFIGGALF

SEQ ID NO: 697 - DNA, 867 bp, Sorghum bicolor
  misc_feature: Ceres ANNOT ID no. 6009498
  misc_feature: Encodes the peptide sequence at SEQ ID NO 698
atggctgccaagatattttccctccttttgctccttgctctttcagtgagcgctacaactgcgtttgttattccacaatgctcactggctcctaccaatgctattttttcacagttacttccaccagtttctgttgcagcgtacgaacacccagttgtaagggcatataggctgcagcaggcgctcgcggcgagcatcttacaacaaccaattgctcaattgcaacaacaatcctcagctcatctaatagtagagaccattgcagcgcagctgcagcaacaacagttcctaccagctcttaatcaactagctatagcgaaccctgctgcctacttgcaacgacgacaactattttctctaaatccattggctgcaacgaatgccgttgcttacctacaacaacaacagctgcaacagttcctaccatcactcaatcaactagcactggcaatccctgccgcctacttgcaacaacaacagctgcttcctctaaacccattggctgcagcgaactctgttgcataccttcaacaacaacagctgcaacagttcctgccagcattcagtcaactagcattggcaaaccctactgcctacttccagcaactacttccattcaaccaacccgctgtggcaaacatcgctgcctacctgcaacaacaacagccgcatctatttaaccagttcactgttacaaatgctgcagcctactaccagcaacagcagcacctgccagttaacccagtggctaacccattggctgccgccttcctacagcagcaacaatggctgccattcaaccagatgtctttggtgaaccctgccttctcatggcagcaacccatcattggaggtgccatcttctag

SEQ ID NO: 698 - protein, 288 aa, Sorghum bicolor
  misc_feature: Ceres ANNOT ID no. 6009498
  misc_feature (1)..(288): Pfam Id: Zein Pfam Desc: Zein seed storage protein
  misc_feature (1)..(288): NCBI GI: 16305138 NCBI Desc: 22kd alpha zein 4 [zea mays]
  misc_feature (1)..(261): NCBI GI: 22208488 NCBI Desc: alpha kafirin [sorghum bicolor]
  misc_feature (1)..(261): NCBI GI: 22208485 NCBI Desc: alpha kafirin [sorghum bicolor]
  misc_feature (1)..(261): NCBI GI: 22208489 NCBI Desc: alpha kafirin [sorghum bicolor]
  misc_feature (1)..(261): NCBI GI: 22208482 NCBI Desc: alpha kafirin [sorghum bicolor]
MAAKIFSLLLLLALSVSATTAFVIPQCSLAPTNAIFSQLLPPVSVAAYEHPVVRAYRLQQALAASILQQPIAQLQQQSSAHLIVETIAAQLQQQQFLPALNQLAIANPAAYLQRRQLFSLNPLAATNAVAYLQQQQLQQFLPSLNQLALAIPAAYLQQQQLLPLNPLAAANSVAYLQQQQLQQFLPAFSQLALANPTAYFQQLLPFNQPAVANIAAYLQQQQPHLFNQFTVTNAAAYYQQQQHLPVNPVANPLAAAFLQQQQWLPFNQMSLVNPAFSWQQPIIGGAIF

SEQ ID NO: 699 - DNA, 867 bp, Sorghum bicolor
  misc_feature: Ceres ANNOT ID no. 6009501
  misc_feature: Encodes the peptide sequence at SEQ ID NO 700
atggctgccaagatattttccatccttttgctccttgctctttcagtgagcgctacaactgcgttcattattccgcagtgctcactggctcctaccaatgctatttcacagttactcccaccagtttctgttgcagcgtacgaacacccagttgtaagggcatataggctacaacaggcactcacggcgagcatattacaacaaccaattgctcaattgcaacaacaatcctcagctcatctaatagtacagaccattgcagcgcagctgcagcaacaacagttcctacaagctcttaatcaactagctatagcgaaccctgtcgcctacttgcaacaacagctatttcctctaaacccattggctgcaacgaatgccgttgcatacctgcagcaacaacagctgcaacagttcctaccagcactcaatcaactagcactagcagtccctgccacatacttgcaacagcaacagctgcttcctctaaacccatttgctacaacgaactctgttgcataccttcaacaacaacagctgcaacagcttttgccagcattcagtcaactagcattggcaaaccctgccgcctacttccagcaactacttccattcaaccaacccgctgtggcaaacatcgctgcctacctgcaacaacaacaaccgcatctatttaaccagttcgctgttacaaacgctgcagcctactaccagcaacagcagcgcctgacagttaacccattggcagtggctaacccattggctgccgccttcctacaacaacaacaatggctgccattcaaccagatgtctttggtgaaccctgccttgtcattgcagcaacccatctttggaggtgacatcttctaa

SEQ ID NO: 700 - protein, 288 aa, Sorghum bicolor
  misc_feature: Ceres ANNOT ID no. 6009501
  misc_feature (1)..(288): Pfam Id: Zein Pfam Desc: Zein seed storage protein
  misc_feature (1)..(261): NCBI GI: 22208488 NCBI Desc: alpha kafirin [sorghum bicolor]
  misc_feature (1)..(261): NCBI GI: 22208485 NCBI Desc: alpha kafirin [sorghum bicolor]
  misc_feature (1)..(261): NCBI GI: 22208489 NCBI Desc: alpha kafirin [sorghum bicolor]
  misc_feature (1)..(261): NCBI GI: 22208482 NCBI Desc: alpha kafirin [sorghum bicolor]
  misc_feature (1)..(261): NCBI GI: 22208484 NCBI Desc: alpha kafirin [sorghum bicolor]
MAAKIFSILLLLALSVSATTAFIIPQCSLAPTNAISQLLPPVSVAAYEHPVVRAYRLQQALTASILQQPIAQLQQQSSAHLIVQTIAAQLQQQQFLQALNQLAIANPVAYLQQQLFPLNPLAATNAVAYLQQQQLQQFLPALNQLALAVPATYLQQQQLLPLNPFATTNSVAYLQQQQLQQLLPAFSQLALANPAAYFQQLLPFNQPAVANIAAYLQQQQPHLFNQFAVTNAAAYYQQQQRLTVNPLAVANPLAAAFLQQQQWLPFNQMSLVNPALSLQQPIFGGDIF

SEQ ID NO: 701 - DNA, 1122 bp, Sorghum bicolor
  misc_feature: Ceres ANNOT ID no. 6009540
  misc_feature: Encodes the peptide sequence at SEQ ID NO 702
atggcagaccagcagcaaccccaacagaaggggatgaacacagtccatgccggtggccttgacctacctccaggattccgcttccacccaagtgactatgagattgttagccactacctaacaaacaaggtgcgcaacatggacttgacctacaccgccttcgaagaggtcgacctaaaaaagactgagccatggaacctcccaattaaagcaaaatggggtgagaaagagtggtacttcttctacctaaaggaccgcaagtactcaacagggttgagggcgaaccgagccacaaaggctggttattggaaagcaacaggcaaagacaaggaggtctacaacaccatagaaggggtggtggtgttggtcggcatgaagaagacacttgtcttctataagggcaaggctcccaggggtgataaaaccaactgggtgatgcatgagtataggctcgaaggcagcaacagcctctctagccccgcatctacatccaactctgccgacaacgtcgtgacaaccatgaaagcttcagcttcagctttcaaggttgtggatgagtgggtggtctgtcgtgtgtttgaaaagaccattgggatcaagaagacgactgcaccggcataccaagtggccatggatggtgctgagattgatcagcggaacatcaacccgaccatccccatccccatgccagtgcagctaccactgtccatgtccatgcccatgcaatttcccagcctgccagacttcactatggatttgatgcccccctgctaccccaacactagtgcagagatgtcgcctatggtaggtattggtggaggacttcagatcaacgatgccctatttgataattcgatagccgcactaccacagatgaacttttacaaccagatgggcatggaagcaacagctgaccaaatggacatgggggtagtagctgaccaaatgggcaaaggaggaggctttgatgttgctatgctagagagtaggccatcctcaatggtgttggagagggatgagcaggctaatgccactgagatctcatcaatgttgtctatgactggcctagggtcagtgaccaccaccatagagatgaacgacacatggaagtacaagtactga

SEQ ID NO: 702 - protein, 373 aa, Sorghum bicolor
  misc_feature: Ceres ANNOT ID no. 6009540
  misc_feature (22)..(152): Pfam Id: NAM Pfam Desc: No apical meristem (NAM) protein
  misc_feature (1)..(373): NCBI GI: 32527660 NCBI Desc: nam-related protein 1 [zea mays]
  misc_feature (20)..(165): NCBI GI: 62546191 NCBI Desc: nac5 protein [glycine max]
  misc_feature (20)..(165): NCBI GI: 22597158 NCBI Desc: no apical meristem-like protein [glycine max]
  misc_feature (20)..(165): NCBI GI: 30102618 NCBI Desc: at5g07680 [arabidopsis thaliana]
  misc_feature (20)..(165): NCBI GI: 21593288 NCBI Desc: nam (no apical meristem)-like protein [arabidopsis thaliana]
  misc_feature: The sequence is a functional homolog of SEQ ID NO 151 in the 11/479,226US patent application
  misc_feature: The sequence is a functional homolog of SEQ ID NO 32 in the 10/412,699US patent application
  misc_feature: The sequence is a functional homolog of SEQ ID NO 326 in the 10/412,699US patent application
  misc_feature: The sequence is a functional homolog of SEQ ID NO 760 in the 11/479,226US patent application
  misc_feature: Useful for making plants with altered terpenoid content
  misc_feature: Useful for making plants with modulated growth and phenotype characteristics
  misc_feature: Functional homolog of the protein sequence given in SEQ ID NO 13140
  misc_feature: The sequence is a functional homolog of SEQ ID NO 32 in the 20040045049 US patent application
  misc_feature: The sequence is a functional homolog of SEQ ID NO 326 in the 20040045049 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MADQQQPQQKGMNTVHAGGLDLPPGFRFHPSDYEIVSHYLTNKVRNMDLTYTAFEEVDLKKTEPWNLPIKAKWGEKEWYFFYLKDRKYSTGLRANRATKAGYWKATGKDKEVYNTIEGVVVLVGMKKTLVFYKGKAPRGDKTNWVMHEYRLEGSNSLSSPASTSNSADNVVTTMKASASAFKVVDEWVVCRVFEKTIGIKKTTAPAYQVAMDGAEIDQRNINPTIPIPMPVQLPLSMSMPMQFPSLPDFTMDLMPPCYPNTSAEMSPMVGIGGGLQINDALFDNSIAALPQMNFYNQMGMEATADQMDMGVVADQMGKGGGFDVAMLESRPSSMVLERDEQANATEISSMLSMTGLGSVTTTIEMNDTWKYKY

SEQ ID NO: 703 - DNA, 816 bp, Sorghum bicolor
  misc_feature: Ceres ANNOT ID no. 6009557
  misc_feature: Encodes the peptide sequence at SEQ ID NO 704
atggctaccaaactatttgccctccttgcgctccttgctctttcagtgagcgctacaactgcggttattattccgcagtgctcatttgctcctaatgctattactccacagttcctcccatcagttactccttttgggtacgaacacccagctgtgcaggcctacaggctacagcaggcacttgcggcgagcatcttacaacaaccaattgcccaattgcaagagcaatcctcagcgcatctaaccgtacagaccatcgcagcacagcagcagcagcaacaactcttccagccagcattcagtccactagccatggcaaaccctactgcctacttgcaacagcagctgcttgcatccaacccacttgttctggctaatgctgctgcataccagcaacaacaacagctgcaacaggttctatcagggctcactcaactagccgtggtgaactctgccgcctacctgcaacaacaacagctacttgcatccaacccaccagctgcggtcaatgccgctatatacctacaacaacaacagcttcaacagatcctaccagcgctcagtcaactaaccatggcgaaccctgtcgcctacttgcaacagcaacagccgctttcattcaaccaactcactgtggcgaacaccgccgcatacctgcaacaacaacagttgcttccagttaacccactggtagttgctaatccattggttgccgcattcttgcagcagcaacaatcgtcgccattcaaccagatatctttgattaaccctgccttaccgtggcagcaacccatcattggaggtggcatcttctag

SEQ ID NO: 704 - protein, 271 aa, Sorghum bicolor
  misc_feature: Ceres ANNOT ID no. 6009557
  misc_feature (1)..(271): Pfam Id: Zein Pfam Desc: Zein seed storage protein
  misc_feature (1)..(271): NCBI GI: 22208488 NCBI Desc: alpha kafirin [sorghum bicolor]
  misc_feature (1)..(270): NCBI GI: 22208489 NCBI Desc: alpha kafirin [sorghum bicolor]
  misc_feature (1)..(271): NCBI GI: 22208485 NCBI Desc: alpha kafirin [sorghum bicolor]
  misc_feature (1)..(271): NCBI GI: 22208482 NCBI Desc: alpha kafirin [sorghum bicolor]
  misc_feature (1)..(271): NCBI GI: 22208484 NCBI Desc: alpha kafirin [sorghum bicolor]
MATKLFALLALLALSVSATTAVIIPQCSFAPNAITPQFLPSVTPFGYEHPAVQAYRLQQALAASILQQPIAQLQEQSSAHLTVQTIAAQQQQQQLFQPAFSPLAMANPTAYLQQQLLASNPLVLANAAAYQQQQQLQQVLSGLTQLAVVNSAAYLQQQQLLASNPPAAVNAAIYLQQQQLQQILPALSQLTMANPVAYLQQQQPLSFNQLTVANTAAYLQQQQLLPVNPLVVANPLVAAFLQQQQSSPFNQISLINPALPWQQPIIGGGIF

SEQ ID NO: 705 - DNA, 1005 bp, Sorghum bicolor
  misc_feature: Ceres ANNOT ID no. 6009559
  misc_feature: Encodes the peptide sequence at SEQ ID NO 706
atgcccaccaccggcggtggtgggggcagctccgcctccgataagggcggctccgcatcttcgtcctcggcgtcgctccccacgccaccaccctgcgagagcaccgtcgcctggcctctccctctcaacggacttgacatcccgggagacgacacgccatcgtcgcaaccagctgccactgcgagcaagaagaaaaggagaggggcacgagcagttggccctgacaaaaatggtggtggattgcgccaatttagcatgagagttcgtgagaaagtcgaaagcaaagggagaacaacctataatgaggtggcagatgaactcgttgctgagtttttagaccccaaaactaatattgacactctagatcatgataatccctccgcgcaacaatatgatgagaaaaatattcgaagaagagtttatgatgcactaaatgtcctaaaggctatggacattatatctaaggataaaaaggaaatacagtggaaaggcttgcccaagacaagtatgaatgatattgaagaattgaagaaagaggtcacaggactaaaagatcggattaagaagaaaaatgaatatctgcaggaattagaagaacaatatgtatgtctccaaaacttgggtcgacgaaataagcagctatatgagttgggtgttgctccatctcgtacactggccttgccatttatactacttcagacacgtcatggtgcaaatgtacaagtggagctgtcagaagatgagcagactgtgcatgttgactttgatagcgctccatatgagttacgggatgaatcctttgtaatgaaagcaatgggattatgtggcaaacaagaaaatgattgtacccaagctcctgttgcgaatggaggtgagtgctcaagtacaccgaacaatcattgggatcaaacaccgcagccaccatcagggccaagaggagttagggtaccaaatgcacctcctattccagggatactaaaagggcctgtcaagcatgaacactaa

SEQ ID NO: 706 - protein, 334 aa, Sorghum bicolor
  misc_feature: Ceres ANNOT ID no. 6009559
  misc_feature (171)..(333): Pfam Id: DP Pfam Desc: Transcription factor DP
  misc_feature (76)..(164): Pfam Id: E2F_TDP Pfam Desc: E2F/DP family winged-helix DNA-binding domain
  misc_feature (5)..(334): NCBI GI: 32187097 NCBI Desc: dp1 [populus tremula x populus tremuloides]
  misc_feature (9)..(311): NCBI GI: 7378623 NCBI Desc: transcription factor-like protein [arabidopsis thaliana]
  misc_feature (52)..(328): NCBI GI: 89741408 NCBI Desc: dp1 [chlamydomonas reinhardtii]
  misc_feature (68)..(280): NCBI GI: 7413636 NCBI Desc: dp-2 transcription factor-like [arabidopsis thaliana]
  misc_feature (55)..(283): NCBI GI: 24653311 NCBI Desc: cg4654-pb, isoform b [drosophila melanogaster]
  misc_feature: The sequence is a functional homolog of SEQ ID NO 1550 in the 10/666,642US patent application
  misc_feature: The sequence is a functional homolog of SEQ ID NO 610 in the 10/666,642US patent application
  misc_feature: Useful for making plants with modulated growth and phenotype characteristics
  misc_feature: The sequence is a functional homolog of SEQ ID NO 1550 in the 20070033671 US patent application
  misc_feature: The sequence is a functional homolog of SEQ ID NO 1550 in the 10/666,642 US patent application
  misc_feature: The sequence is a functional homolog of SEQ ID NO 610 in the 10/666,642 US patent application
  misc_feature: The sequence is a functional homolog of SEQ ID NO. 416 in the 11/188,298 US application
MPTTGGGGGSSASDKGGSASSSSASLPTPPPCESTVAWPLPLNGLDIPGDDTPSSQPAATASKKKRRGARAVGPDKNGGGLRQFSMRVREKVESKGRTTYNEVADELVAEFLDPKTNIDTLDHDNPSAQQYDEKNIRRRVYDALNVLKAMDIISKDKKEIQWKGLPKTSMNDIEELKKEVTGLKDRIKKKNEYLQELEEQYVCLQNLGRRNKQLYELGVAPSRTLALPFILLQTRHGANVQVELSEDEQTVHVDFDSAPYELRDESFVMKAMGLCGKQENDCTQAPVANGGECSSTPNNHWDQTPQPPSGPRGVRVPNAPPIPGILKGPVKHEH

SEQ ID NO: 707 - DNA, 1026 bp, Sorghum bicolor
  misc_feature: Ceres ANNOT ID no. 6009581
  misc_feature: Encodes the peptide sequence at SEQ ID NO 708
atgtacacaccatgcgtccaatcccctccccagtccacacgtacacttgcgtacgtacgctccgctgctagtcccttaattagcttcactggaggcctgcgtccagccagccagccgctcccgacgacgacaccgatgatggcctccgcggcggtgccggcggccacaggaggcctgaaggaggacatcgcggggctatacgacgagtcgtcgggggtgtgggaacgcatctgcggcgagcacctgcaccacggcttctacgaaccggccggcgacgccacggcggtgcggcccgacgtccgccgcgcccagatccgcaccatcgacgaggcgctcgcattcgccgccgtcccagatgatctagagaagaggcccaaaacaatagtcgacgtaggatgtggcattggaggcagctcaaggtacttggccagaaaatacggagcacaatgtacgggcatcacgttgagccctgttcaagctgagagaggaaatgctcttactgccgtttccctccaagttgctgatgctctagaacaaccctttcctgatggaatgtttgatcttgtatggtccatggagagtggtgagcacatgccggataaaagaaagtttgttagtgagctagcgcgtgtcgcagctcctggagggacaataatcatcgtgacatgctgccataggaacctcaatccgtctgaaacttccctgaaacccgatgaacagagactcctaaagaggatatctgatgcatactgtcttgccgactggttcctaccttcagactatgtcagcattgctaagtcactgtctctcgaggatatcaggacagctgactggtcggagaacgtggtcccgttttggcccgctgtgataaaactgtcattgtcatggaagggcctgacctctgcgttaacatgtggatggaagacgatcaatggggcgatggggatactactgctgatccaaggctacaggaaggggctcatcaaattcacagtcatcacctgccgcaagcctggaccaccatag

SEQ ID NO: 708 - protein, 341 aa, Sorghum bicolor
  misc_feature: Ceres ANNOT ID no. 6009581
  misc_feature (129)..(220): Pfam Id: Methyltransf_11 Pfam Desc: Methyltransferase domain
  misc_feature (129)..(218): Pfam Id: Methyltransf_12 Pfam Desc: Methyltransferase domain
  misc_feature (54)..(337): Pfam Id: CMAS Pfam Desc: Cyclopropane-fatty-acyl-phospholipid synthase
  misc_feature (11)..(339): NCBI GI: 91694291 NCBI Desc: gamma-tocopherol methyltransferase [zea mays]
  misc_feature (46)..(338): NCBI GI: 91694289 NCBI Desc: gamma-tocopherol methyltransferase [oryza sativa]
  misc_feature (46)..(338): NCBI GI: 113537375 NCBI Desc: os02g0701600 [oryza sativa (japonica cultivar-group)]
  misc_feature (20)..(338): NCBI GI: 72256521 NCBI Desc: gamma tocopherol methyltransferase [triticum aestivum]
  misc_feature (59)..(338): NCBI GI: 80971659 NCBI Desc: gamma-tocopherol methyltransferase [helianthus annuus]
  misc_feature (10)..(338): SWISSPROT Homolog: EC 2.1.1.95 Tocopherol O-methyltransferase, chloroplast precursor
  misc_feature: Useful for making plants with modulated nitrogen use efficiency
  misc_feature: Functional homolog of the protein sequence given in SEQ ID NO 13084
  misc_feature: The sequence is a functional homolog of SEQ ID NO 22 in US patent 7226745
  misc_feature: The sequence is a functional homolog of SEQ ID NO 36 in US patent 7244877
  misc_feature: Useful for making plants with modulated nitrogen use efficiency
  misc_feature: Functional homolog of the protein sequence given in SEQ ID NO 13084
MYTPCVQSPPQSTRTLAYVRSAASPLISFTGGLRPASQPLPTTTPMMASAAVPAATGGLKEDIAGLYDESSGVWERICGEHLHHGFYEPAGDATAVRPDVRRAQIRTIDEALAFAAVPDDLEKRPKTIVDVGCGIGGSSRYLARKYGAQCTGITLSPVQAERGNALTAVSLQVADALEQPFPDGMFDLVWSMESGEHMPDKRKFVSELARVAAPGGTIIIVTCCHRNLNPSETSLKPDEQRLLKRISDAYCLADWFLPSDYVSIAKSLSLEDIRTADWSENVVPFWPAVIKLSLSWKGLTSALTCGWKTINGAMGILLLIQGYRKGLIKFTVITCRKPGPP

SEQ ID NO: 709 - DNA, 654 bp, Sorghum bicolor; identical to SEQ ID NO: 31
  misc_feature: Ceres ANNOT ID no. 6009661
  misc_feature: Encodes the peptide sequence at SEQ ID NO 710

SEQ ID NO: 710 - protein, 217 aa, Sorghum bicolor; identical to SEQ ID NO: 32
  misc_feature: Ceres ANNOT ID no. 6009661
  misc_feature (167)..(207): Pfam Id: zf-C3HC4 Pfam Desc: Zinc finger, C3HC4 type (RING finger)
  misc_feature (1)..(216): NCBI GI: 92885424 NCBI Desc: zinc finger, ring-type; ringv [medicago truncatula]
  misc_feature (1)..(216): NCBI GI: 57900128 NCBI Desc: zinc finger (c3hc4-type ring finger) protein-like [oryza sativa (japonica cultivar-group)]
  misc_feature (50)..(216): NCBI GI: 23505815 NCBI Desc: at5g41350/myc6_6 [arabidopsis thaliana]
  misc_feature (162)..(215): NCBI GI: 42572783 NCBI Desc: zinc finger (c3hc4-type ring finger) family protein [arabidopsis thaliana]
  misc_feature (162)..(215): NCBI GI: 21593116 NCBI Desc: ring-h2 finger protein rhb1a [arabidopsis thaliana]
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 329 in the 11/188,298 US application
  misc_feature: The sequence is a functional homolog of SEQ ID NO. 350 in the 11/188,298 US application
  misc_feature: The sequence is a functional homolog of SEQ ID NO. 468 in the 11/188,298 US application

SEQ ID NO: 711 - DNA, 936 bp, Sorghum bicolor
  misc_feature: Ceres ANNOT ID no. 6009674
  misc_feature: Encodes the peptide sequence at SEQ ID NO 712
atgctcgcgagggctcctccacggccgtgctccaccgccggcgccgttaatgcttccggcgacgagcacagcacgaggacgtggaggcccgttgttggcggcgctggcctcgccagcggaccaccaagagccgccgccggtggcgtcaggctcgtcgcggtgaggcacgggaggacgacgacgacgacgacgatcgtggctgcggccgccggcgagaggcgggcagccgggccggggacggagccggtgacggcggtggtggctgctcctaatgggtcgtcgtcggccgtcgcaggtatcagcaccctcttgacatcgactgtggggaaatcgacaaatatcctgtggcatgattgtcccattgggcagaacgagagacagaatttgctgaaccagaagggttgtgttgtgtggatcactggtctaagtggttcaggaaaaagcacgctcgcatgtgcgctgagccgtgagttgcacattagaggccatctgacatacgtcctcgacggcgataatctcaggcatgggttgaaccgggacctcagcttcaaagcagaagatcgtgctgaaaacatacgcagagtaggggaagtagcaaagctattcgcagatgctggcctgatctgcattgctagcttgatatcaccttacagaagtgatcgaagtgcatgtcgcagtttactaccaaagtcttcgtttatagaggtcttcctaaacgctccactggaagtatgcgaagcgagagatccaaaaggcctgtacaagcttgcacgtgctggcagaatcaaaggttttactggcattgatgatccttacgaagcaccatccgattgtgagattgtgatccattgtaaagttggggactgcccttcacctaaatcaatggctgatcaagttgtgtcatatcttgagacgaatggtttcctccatgactag

SEQ ID NO: 712 - protein, 311 aa, Sorghum bicolor
  misc_feature: Ceres ANNOT ID no. 6009674
  misc_feature (133)..(289): Pfam Id: APS_kinase Pfam Desc: Adenylylsulphate kinase
  misc_feature (95)..(311): NCBI GI: 6563285 NCBI Desc: adenosine-5'-phosphosulfate kinase [zea mays]
  misc_feature (108)..(309): NCBI GI: 92880848 NCBI Desc: adenylylsulfate kinase [medicago truncatula]
  misc_feature (99)..(309): NCBI GI: 2832300 NCBI Desc: adenosine-5'-phosphosulfate-kinase [catharanthus roseus]
  misc_feature (109)..(309): NCBI GI: 9757873 NCBI Desc: adenylylsulfate kinase-like protein [arabidopsis thaliana]
  misc_feature (109)..(309): NCBI GI: 21537248 NCBI Desc: adenylylsulfate kinase-like protein [arabidopsis thaliana]
  misc_feature (99)..(309): SWISSPROT Homolog: EC 2.7.1.25 Adenylyl-sulfate kinase, chloroplast precursor
  misc_feature: The plant is abnormally small.
  misc_feature: Useful for making plants with modulated biomass
  misc_feature: Useful for making plants with modulated heat sensitivity
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13501
  misc_feature: Useful for making plants with modulated biomass
  misc_feature: Useful for making plants with modulated heat sensitivity
  misc_feature: Functional homolog of the protein sequence given in SEQ ID NO 13501
MLARAPPRPCSTAGAVNASGDEHSTRTWRPVVGGAGLASGPPRAAAGGVRLVAVRHGRTTTTTTIVAAAAGERRAAGPGTEPVTAVVAAPNGSSSAVAGISTLLTSTVGKSTNILWHDCPIGQNERQNLLNQKGCVVWITGLSGSGKSTLACALSRELHIRGHLTYVLDGDNLRHGLNRDLSFKAEDRAENIRRVGEVAKLFADAGLICIASLISPYRSDRSACRSLLPKSSFIEVFLNAPLEVCEARDPKGLYKLARAGRIKGFTGIDDPYEAPSDCEIVIHCKVGDCPSPKSMADQVVSYLETNGFLHD

SEQ ID NO: 713 - DNA, 1446 bp, Sorghum bicolor
  misc_feature: Ceres ANNOT ID no. 6009692
  misc_feature: Encodes the peptide sequence at SEQ ID NO 714
atggcgcatgacggcatcgccgatgatggcgccgccacgccgctgctctcgtcgtcgtccgcgaagtccggcaagccacgctggaacatgtacgccttcgcctgcgccactctcgcctccatgaccaccatcctcatgggctacaatctcgccctgatgagcggcgcgcagctgttcatccgggaggacctgggcctctccgacgcgcagatcgaggtgctcgcggggtccttcaacgtgttcatgctcctgtccatcctcgccgccggctgggcggccgacctcctcggccgccgcggcactctcgtgctggccaacgtcttcctcatggccggcgcgctcgccatgtcgctgggcggcagctactccgcgctcatggccgcgcgctgcatcaccagcctcggctctgggttctccgtcgttgtcacctccgtctacaacgccgagatatcgccggcgtccatgcgcggcttcctctcctccttccttgacatgttcatcaccatcggtttacttctgagctacgtgtccaactacgccttcgccggcttgccggtgcacctcggctggcgaatcatgtacgccgtcggcgtggttccgccggtgctgctcgccatgggcgtgctcgccatgccagagtcaccacggtggctcgcgatgcgcgggcgcgacgccgacgcgcgcgcggtgctcgtgcgcacctcggacaccccggccgaggccgacctgcgcctcgacgagatcaagcacgccgtcaatgagagtgacagcaatggaggcaacgtgtggaaggagctgctcatccggccgtcgtcggcgagcgtgcggcggatcgtggtgtgcgtggtcggcgtgaacttcttccagcaagcgtcgggcatcgacgcgctcgtgctctacagcccgctggtgttccgcaaggccggcatgtcgtccaacaaggccatcctcggcgccactgtggccgccggcgtcgtcaagacgtgcttcgtcctggtggccacgctcttctcggaccgcctcggccggcggccgctcctcctcgccagcacggtgggcgtggcggcgttcatggcgtcgctgggcgtgacgctctgtgttggtgtgatgtcgtcggccgcgagcatggtggccagcgtcgtgtcggtgctggcgttcatggcggcgttctccgtcgggttcgggccgctggcgggcacgtacagcgccgagatcatgccgctgcgcctgcgcgcgcagggtgccagccttggcaacgcggtgaaccggctgacgtccgcgctggtgagcatgacgttcatctcgctcgcggacgcgatcaccatgcctgggtgcttcttcctgtacgccggtgtgggaaccgccgcgtgcgcgttcgcctacgcgcggatgccggagaccaagggacggagtcttgaggacatgcacgtgctctttgcaaaatga

SEQ ID NO: 714 - protein, 481 aa, Sorghum bicolor
  misc_feature: Ceres ANNOT ID no. 6009692
  misc_feature (35)..(479): Pfam Id: Sugar_tr Pfam Desc: Sugar (and other) transporter
  misc_feature (39)..(430): Pfam Id: MFS_1 Pfam Desc: Major Facilitator Superfamily
  misc_feature (6)..(481): NCBI GI: 77552119 NCBI Desc: sorbitol transporter [oryza sativa (japonica cultivar-group)]
  misc_feature (9)..(481): NCBI GI: 77552122 NCBI Desc: sorbitol transporter [oryza sativa (japonica cultivar-group)]
  misc_feature (9)..(481): NCBI GI: 115486381 NCBI Desc: os11g0637400 [oryza sativa (japonica cultivar-group)]
  misc_feature (6)..(479): NCBI GI: 77556319 NCBI Desc: sorbitol transporter [oryza sativa (japonica cultivar-group)]
  misc_feature (25)..(481): NCBI GI: 51849627 NCBI Desc: sorbitol transporter [malus x domestica]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
MAHDGIADDGAATPLLSSSSAKSGKPRWNMYAFACATLASMTTILMGYNLALMSGAQLFIREDLGLSDAQIEVLAGSFNVFMLLSILAAGWAADLLGRRGTLVLANVFLMAGALAMSLGGSYSALMAARCITSLGSGFSVVVTSVYNAEISPASMRGFLSSFLDMFITIGLLLSYVSNYAFAGLPVHLGWRIMYAVGVVPPVLLAMGVLAMPESPRWLAMRGRDADARAVLVRTSDTPAEADLRLDEIKHAVNESDSNGGNVWKELLIRPSSASVRRIVVCVVGVNFFQQASGIDALVLYSPLVFRKAGMSSNKAILGATVAAGVVKTCFVLVATLFSDRLGRRPLLLASTVGVAAFMASLGVTLCVGVMSSAASMVASVVSVLAFMAAFSVGFGPLAGTYSAEIMPLRLRAQGASLGNAVNRLTSALVSMTFISLADAITMPGCFFLYAGVGTAACAFAYARMPETKGRSLEDMHVLFAK

SEQ ID NO: 715 - DNA, 207 bp, Sorghum bicolor
  misc_feature: Ceres ANNOT ID no. 6009714
  misc_feature: Encodes the peptide sequence at SEQ ID NO 716
atgactacttcaaggcgccttgctgacaggaagactgccaagttccagaagaacatcaccaggaggggttccgtccctgagaccactgttaagaagggaaatgactaccctgttggccctgtagtgctcgggttcttcatctttgtcgtcattggatcatcgttgtttcagattatcaggacggcgaccagcggtgggatggcttaa

SEQ ID NO: 716 - protein, 68 aa, Sorghum bicolor
  misc_feature: Ceres ANNOT ID no. 6009714
  misc_feature (1)..(64): Pfam Id: RAMP4 Pfam Desc: Ribosome associated membrane protein RAMP4
  misc_feature (1)..(68): NCBI GI: 115488784 NCBI Desc: os12g0514100 [oryza sativa (japonica cultivar-group)]
  misc_feature (1)..(68): NCBI GI: 47834194 NCBI Desc: membrane protein [brassica juncea]
  misc_feature (2)..(68): NCBI GI: 9802529 NCBI Desc: f17l21.12 [arabidopsis thaliana]
  misc_feature (2)..(55): NCBI GI: 115486381 NCBI Desc: os11g0637400 [oryza sativa (japonica cultivar-group)]
  misc_feature (1)..(51): NCBI GI: 77552122 NCBI Desc: sorbitol transporter [oryza sativa (japonica cultivar-group)]
  misc_feature: Useful for making plants with modulated nitrogen use efficiency
  misc_feature: GREAT-hit functional homolog of the protein sequence given in SEQ ID NO 13037
  misc_feature: Useful for making plants with modulated nitrogen use efficiency
  misc_feature: Functional homolog of the protein sequence given in SEQ ID NO 13037
MTTSRRLADRKTAKFQKNITRRGSVPETTVKKGNDYPVGPVVLGFFIFVVIGSSLFQIIRTATSGGMA

SEQ ID NO: 717 - DNA, 378 bp, Sorghum bicolor
  misc_feature: Ceres ANNOT ID no. 6009717
  misc_feature: Encodes the peptide sequence at SEQ ID NO 718
atgagccgggggcggtcgccggagccgctggatttcttcatctggactgtggaggatgtagggttatggttggaggaaataaatcttggaagctatcgacaggcttttgaagagaatggcgtcaatggagagtatctagaaagcctgtcgatgttcactactgaacagattcttcgatttataagacggtgtcatatgaaacggggagattttatcaccctctgtaaagagttgagacgcatcaaagttgcctgcctgaaaggggagcaggaagtccgcaggccgtggtgggcgccatcatgcctgtcagttgtgttcgtgcgggtggccaagaggaaccggcagtcccgcgttgtatccctgaagctggaagcttag

SEQ ID NO: 718 - protein, 125 aa, Sorghum bicolor
  misc_feature: Ceres ANNOT ID no. 6009717
MSRGRSPEPLDFFIWTVEDVGLWLEEINLGSYRQAFEENGVNGEYLESLSMFTTEQILRFIRRCHMKRGDFITLCKELRRIKVACLKGEQEVRRPWWAPSCLSVVFVRVAKRNRQSRVVSLKLEA

SEQ ID NO: 719 - DNA, 1008 bp, Sorghum bicolor
  misc_feature: Ceres ANNOT ID no. 6009745
  misc_feature: Encodes the peptide sequence at SEQ ID NO 720
atggcagccccaaattctgtagcaacttctattggccagggtcaaaaggtgcctggttttgccaagcttcagggtgaaaattttgtgtacttcatacaaacttattcagtcatcttgggacgcaacactgaaagctatagtgtagactttgatctctcaaaatatgaatgcagaagccaacgagtttcacgttgccatgcatgtatattctatgactttaaactccgccattttgtcattgaagtcattggaagaaaaggatgcaccattcggggggtctcttatctcccaggtagtgtccctattaaattgaattctcaggacctccttgagattgctggcataaaattctactttctcctaccatctcgctccatctttgacactattgcttctcgggatactacttcattgcctccacaatcttcatcccttttgcaccctgctgattaccatgggcatccaagtgctaatgattgtagccatagcaatggtgagaatggtgtcaaaataaccaatgacaggaaaggaaacttggagaaacaaaactggagtttttctggagaattggatatatctaactgcaatggcatcagtaatgctgacctagttggaacacttgatggggtcagcaagctagatatacaaagtgcagagaaggacatagatgatcaacagctcctactagaagaagaggaggtagcgacgtgtcttgcagccctgatatctgacctatctggtcctagaaaatgggtgcctatggaaaaactccattcagagctttttgaacgctttggtcagaattggccccatgatagggtcagcaagtacttatcacaaaagggcatgtcaggctcttcaattggagatggtaggccatggtgcagcttgtggacgctattcaagaagtacccggagcattttgtcatgagcactgtgacaagaggacaagcagtatcagagtatgttggcttgtaccatctggtttctttggaaaatgaatcgtga

SEQ ID NO: 720 - protein, 335 aa, Sorghum bicolor
  misc_feature: Ceres ANNOT ID no. 6009745
  misc_feature (37)..(113): Pfam Id: FHA Pfam Desc: FHA domain
  misc_feature (9)..(330): NCBI GI: 115477441 NCBI Desc: os08g0528900 [oryza sativa (japonica cultivar-group)]
  misc_feature (1)..(150): NCBI GI: 115480013 NCBI Desc: os09g0505200 [oryza sativa (japonica cultivar-group)]
  misc_feature (19)..(126): NCBI GI: 15705932 NCBI Desc: transcriptional activator fha1 [nicotiana tabacum]
  misc_feature (200)..(328): NCBI GI: 115485445 NCBI Desc: os11g0463600 [oryza sativa (japonica cultivar-group)]
  misc_feature (16)..(158): NCBI GI: 19115184 NCBI Desc: similar to n-term of yeast fhli transcriptional activator of the forkhead/hnf3 family [schizosaccharomyces pombe]
  misc_feature: Useful for making plants with altered alkaloid content
  misc_feature: Functional homolog of the protein sequence given in SEQ ID NO 13321
  misc_feature: The sequence is a functional homolog of SEQ ID NO. 380 in the 11/188,298 US application
MAAPNSVATSIGQGQKVPGFAKLQGENFVYFIQTYSVILGRNTESYSVDFDLSKYECRSQRVSRCHACIFYDFKLRHFVIEVIGRKGCTIRGVSYLPGSVPIKLNSQDLLEIAGIKFYFLLPSRSIFDTIASRDTTSLPPQSSSLLHPADYHGHPSANDCSHSNGENGVKITNDRKGNLEKQNWSFSGELDISNCNGISNADLVGTLDGVSKLDIQSAEKDIDDQQLLLEEEEVATCLAALISDLSGPRKWVPMEKLHSELFERFGQNWPHDRVSKYLSQKGMSGSSIGDGRPWCSLWTLFKKYPEHFVMSTVTRGQAVSEYVGLYHLVSLENES

SEQ ID NO: 721 - DNA, 3249 bp, Sorghum bicolor
  misc_feature: Ceres ANNOT ID no. 6009764
  misc_feature: Encodes the peptide sequence at SEQ ID NO 722
atggaggtggacccctcgccttcgccgcgctcgtccaggccgctgccgcctccgccgctggcaccgacgccgagctacttcgacccggagtcctccggccgccgggaggagtaccgccgctacagaaagagattgtcttcttcaaatgtctctcctctgccgggaagctcactctccaagtcctctggaccaagactgttatacgatggagaaagcatcccaaggcggcctaatgctggtttactccttgaggatataaagcaggaagccgccgattattccaacatggaaagcttggatggatcgatactgtacagttcagcgaaaaggacatctcttgatggtggttctgcatcagccgcagcatacagttcgggcaggcaagcagtgaggcaggcgctgaaacccgtcaaactggaggacgatatctatgtgccgcatgaaggagaaacgtcttttacaatgtttgcaactctccttgattctgcgaaccaaggtttgatgcccgtcccagatgtaattcaacaatttgagaggacatgtcgaaatgcttctgagtcaatcagatctgctgccactggaaagcttcggatggtggacgataaacttatgcagcaaaaggcacaacttttactggacgaagctgcttcctggtcacttctttggcacctctatggcaaaggacatgaggagctttctggagagctgttggtgccgccaattacatcccatcaggaggcttgccgctttgttgcagcagaccttacagcgcaactgtgtctgcggatcatactttggcttgaaggtcttgcttctgaagctcttgatttggagaagaaggtgagaggacctcatgttggttcatacctaccaagttctggtgtttggcaccgtacacagaggtacctaaaaagaaataataatgattctactatagtgaagcatgtggattttgatgctccaactcgtgaaggagcccaacttcttcctgatgacaagaagcaagatgaattgcttctagaagatatatggactcttttaagagcaggaagattagaagaggcatctgagttgtgccgttctgctggccaggcatggagagctgccactctttgtccttttggtggcatagatatgttcccttccctggacgcattgcacaagaatggaaagtacagaacactacaagccattgaattagaaagtggtgttgggcggcagtggcgtctttggaaatgggcatcgtattgtgcttcagagaaaattgctgagcaagatggaggccgttatgagatggctgtatacgctttacagtgcagtaacttaaagcgtatcttgccaatctgtactgactgggagtcagcttgttgggcaatggcaagatcctggctagatgttcaagtggatctagaattatctcagtaccaaacaagtagaccggatgaaaagcagcttgacgatgacatgaatggagcccaaagttcagttggtccagaaagttggccataccatgttcttgatcagcaacctcgtgacttaactgctcttctgcagaaactccactcaagtgaccttgttcatgaaactgtgtctcgagcatgccgcgagcagcatcgacaaattcagatgaatctcatgagtgggcatatatctcatcttcttgaccttctatggtcatggttatcacctgctgaagagaaccatagtaatactgcaaggccccttgatgaccctgagatgatacgcttcggggcacatattgttcttgtgctgaggcaccttttcagtgatgaaatggacgatgagttggatgaaaaactggttactgttggtgatctcatcatcaacatgtacgtgaggtatttgttctcagaggatcaagaggagttggttggagtatatgcctctcagcttcaacatgacctttgcattaatttgtttgtggaaatgatggaactaaggttaaatagcagtttgcatactatgtacaagctcttcctttctgctgtggagtatcttccattctcatctgatgatgcatccaaggcttgttttgaagagatcattgagagagtgctttcaagatctcgacaaacaaaacccagtaagtatgatgaggatttctctgatgttgcacatcaacatcatctgcaatcacttcaaaaggcaatggttattcagtggctttgcttcacaccaccatcctcgattccagactttcaaatgatcactgggaagcttctgatacgggcattggtgcatagggagttttccctgatatcaatgaggagagtccctgagctaccagcagggccacacaagttgcttgccattttagctgaaccgttaaagcaaaaagaaaatttaatttcactggaagatccggaggtatctgataacttactggagtttgaagattggcatgaatattactcccttgatgcaacttaccgcagttggcttaaaattgagatgaagaatgctgctgtttctcctgagatgctttcggcagaggaaaaggatcaagctgttgctgcagcgaaagaaacactggacttggcattcttgttactatgcagggatgaaagaccatggttgtatgctgtcgagagcagtccatttgaatcctcagaggttattttccttgagctgcatgcttctgcaatgctctgcctaccttctggagaatgtatgttaccagatgcaacatcatgcacagctttgacaagtgcactatattcaactgttagtgaagatgatgtgctgcatcgccagttgaaggtgtcttctagagatccatgctgtattgaagttgctcttcgctgcttagcggcagaaggtgatggatatgggcttcatgaagccaacaatggtggtcttcttgccgcagtcatggctgctggctttaaaggtgaactcagtcgattccaacctggagtttcaatggcaatttcacggcttgatgcttggtattctgatgggagtggctctgtggagagcactgctgcttacataattcgagggctgtgtcggagatgctgccttcctgaaacaattctaagatctatgcaggcatgtattgcactctccgcagctggcgattctctagataactgtgacaaactaattgagttagttggttcagccgagtctggaatgatgcatttgttcagccagcagcagttgcagagggaatgtttcatatgtacaatggagcttgaggaggatcagttaccttctgatggctaa

SEQ ID NO: 722 - protein, 1082 aa, Sorghum bicolor
  misc_feature: Ceres ANNOT ID no. 6009764
  misc_feature (203)..(1028): Pfam Id: Nup84_Nup100 Pfam Desc: Nuclear pore protein 84 / 107
  misc_feature (23)..(1078): NCBI GI: 30102514 NCBI Desc: at3g14120/mag2_7 [arabidopsis thaliana]
  misc_feature (47)..(488): NCBI GI: 116487854 NCBI Desc: zgc:152723 [danio rerio]
  misc_feature (111)..(492): NCBI GI: 119617600 NCBI Desc: nucleoporin 107kda, isoform cra_a [homo sapiens]
  misc_feature (111)..(492): NCBI GI: 27694092 NCBI Desc: nuclear pore complex protein [homo sapiens]
  misc_feature (111)..(485): NCBI GI: 62185779 NCBI Desc: nup107 protein [mus musculus]
MEVDPSPSPRSSRPLPPPPLAPTPSYFDPESSGRREEYRRYRKRLSSSNVSPLPGSSLSKSSGPRLLYDGESIPRRPNAGLLLEDIKQEAADYSNMESLDGSILYSSAKRTSLDGGSASAAAYSSGRQAVRQALKPVKLEDDIYVPHEGETSFTMFATLLDSANQGLMPVPDVIQQFERTCRNASESIRSAATGKLRMVDDKLMQQKAQLLLDEAASWSLLWHLYGKGHEELSGELLVPPITSHQEACRFVAADLTAQLCLRIILWLEGLASEALDLEKKVRGPHVGSYLPSSGVWHRTQRYLKRNNNDSTIVKHVDFDAPTREGAQLLPDDKKQDELLLEDIWTLLRAGRLEEASELCRSAGQAWRAATLCPFGGIDMFPSLDALHKNGKYRTLQAIELESGVGRQWRLWKWASYCASEKIAEQDGGRYEMAVYALQCSNLKRILPICTDWESACWAMARSWLDVQVDLELSQYQTSRPDEKQLDDDMNGAQSSVGPESWPYHVLDQQPRDLTALLQKLHSSDLVHETVSRACREQHRQIQMNLMSGHISHLLDLLWSWLSPAEENHSNTARPLDDPEMIRFGAHIVLVLRHLFSDEMDDELDEKLVTVGDLIINMYVRYLFSEDQEELVGVYASQLQHDLCINLFVEMMELRLNSSLHTMYKLFLSAVEYLPFSSDDASKACFEEIIERVLSRSRQTKPSKYDEDFSDVAHQHHLQSLQKAMVIQWLCFTPPSSIPDFQMITGKLLIRALVHREFSLISMRRVPELPAGPHKLLAILAEPLKQKENLISLEDPEVSDNLLEFEDWHEYYSLDATYRSWLKIEMKNAAVSPEMLSAEEKDQAVAAAKETLDLAFLLLCRDERPWLYAVESSPFESSEVIFLELHASAMLCLPSGECMLPDATSCTALTSALYSTVSEDDVLHRQLKVSSRDPCCIEVALRCLAAEGDGYGLHEANNGGLLAAVMAAGFKGELSRFQPGVSMAISRLDAWYSDGSGSVESTAAYIIRGLCRRCCLPETILRSMQACIALSAAGDSLDNCDKLIELVGSAESGMMHLFSQQQLQRECFICTMELEEDQLPSDG

SEQ ID NO: 723 - DNA, 3381 bp, Sorghum bicolor
  misc_feature: Ceres ANNOT ID no. 6009789
  misc_feature: Encodes the peptide sequence at SEQ ID NO 724
atggaggagacgctcgcctcgctccgccgcccgaagcgccgcggccgcccgccgcggccgcgggaggagtaccacgcggcggacttcgaggatgtcgccgacgcggaagggctcgcgccgccccagtccaagcgcaagcgcgcggcatccgccgccgccgctgcgtccctggaggaccagccactcatcgatattatcaaacataatggcaggctgatcagccatgctgtcaaaaggttggttgaggactacgaatcgaagaaaaatttggtgacgtttcagattttaacaatgctatttgaggcttgtggagccaagcatgagatttatcctgactaccttcgcgagtctgatgtggatgacattgtggtgtctcttgttgacctagccaggaaaggtctggtggaagataattacaactcaaagcataaggatctcaaaaacttcaaagagaatctggtttgtttttgggatagcttagttcttgaatgtcagaatggcccgttgtttgatgacctcttgttccaaaaaatcaaagactatgtggttgctctgtcatgtgctcctccaagggtatatcgccaagtagcttcattgactgggctccagcttgtaacgtcattcatatctgttgctaagactctcagcggacaacgtgagaccactcaaaggcagctgaatgcagagaagaagaagcaaagtgatggaccacttattgaatctctcaacaatagattagcccttactcatgcaaacattacatacttggaggaattgatgcggaagatattcagcgggttattcatgcaccgttatcgtgatgttgatcctgagatcaggatgtcctgtatcagatctctaggtatttgggttgtctcttatccatcactctttttgcaagatatatatttgaagtatcttgggtggacactaaatgataagaatgctggagttaggaggacttctgttcttgccttgcaaagtctttatgaagtggatgataacataccttctctgggtctctttactgagaggttttacaccaggatgatccagcttgctgatgatattgatgtttcagtagctgtgtcagctatagggttgatcaagcaattgctgaggcatcaactgttgagtgatgatgatttgggcccactatatgatcttcttattgatgagcctccaatgattaggcgtgcgattggtgagttagtttatgatcacctaatagcacaaaacatcaagacctctcatcccggagctagagatggggaaaatgaaccttctgaggtccatattggtcgaatgctgcaaatccttagggaattttcagatgacccagtactcagttcatacgtcattgatgatatttgggatgacatgaaggcgatgaaagattggaggtgtatagtttctgttcttcttgatgaaaatcctgcaattgagcttactgacatggatggaacaaatctagttcgcatgctgcgagaatctgcaaggaaggctgttggggaaagaatagttcctgcagtggataacagaaagttgtactacaataaaggccaaaaggaaatattggaaaatagcaggcgtgaaataacaactgccttattgacaaggtatccacagcttttaagaaaattcatatctgacaaagctaagatatcgcccctagttgatatgatgactcttttgaaacttgagttgtattcatacaaaaggcaagagaagcatttcaagacagccatagatctcatcgcagatgctttctttaaacatggtgagaagggcccactgagatcttgcatcaaggcaattcttttctgttgcaccgagtgccaggctgatcttaaagattatgctgaaaataaacttaagaatcttgaagatgagttagtcttgaaagtcagaactgcaatcaaggaagtagaggcaggtgatgatgaatactccctcttggttaatttgaagcggttttatgaacttcagctgtcaaaacctgtcaagaatgatagtttatttgaggatatgtaccgaatcctcgctcatcttagggatatggataatgaggtgaaaagctttctcctcctcaatatgtatcttcaagtagcttggtgccttcaagcaattgatggtgaaaacccatctgaaacatgtattgatgaacttttatcaaagcaaagcacactttttgatcaactctactattatttagtggtactgcccacttatcagaaagaggggaggagcaccactgtactttcatgcagagtctgcatcattactgcggagatgtggtgcttgtttaagaagtcaaaatattcttcgacgagactagagagtttgggttatctcccacagtcagatatggttcagaagttctggaaactatgtgaacaacagctcaatatatcagatgaaactgaagatgaagatgcaaatgaagaatatattgaagacacaaacagggatgctgtcatgattgcagctgcaaagctagtgctcgctgatacagtatcaaaggattatcttggtccagagattgtttctcactatgtatctcacggagcaagtacaacagagataatcaaacatctaattacttctctaaagaaaaacacaaactttgacatgggagctctattttttgaggctctgaaaagggcatatgaacgttacatggcccatgttcatgagggagaaaaccaaatcctgactggcaagtcttattcggaatgtcaagatcttgctagtcatcttgcagggtcctatgttggggccgctcgcattaaaaacaagtcagatatcctgaagattatccaagatggtgtttcttttgcttttgtcgatcttccaaatcaattgtcgttccttgaggctgctcttctgccatttgtttctaaacttcagtcgtcagatattccagatattctggcagatgtagagaagaggactcaagataccaatatggttggagatcaaggtgcttggcgcccatattttacattcgtagaacacctacgtgataaacatgcgaagaatgaggttttgcatgaggaagaggaaaaacctgtgaggcgacggggccgtccgagaaaggttagagatgtgccagatgtaccagatctacgtagtggtcgggatgtacgtgggaagaaactttttagagatgacgggcacaattctagtggcgaggagtctatcagtgcatctgaccatcagggtcacggtgaagatgacgacagcgacggcgatgcagatcagcccttaatcaacacgattaggtcttccgctgccaagctacgatccttgaagattgctcaacagggaacaagcagccacaaaggggtctctggcccatcaggtaggtacgacaaataa

SEQ ID NO: 724 - protein, 1126 aa, Sorghum bicolor
  misc_feature: Ceres ANNOT ID no. 6009789
  misc_feature (136)..(251): Pfam Id: STAG Pfam Desc: STAG domain
  misc_feature (134)..(1122): NCBI GI: 34761154 NCBI Desc: scc3 [oryza sativa (japonica cultivar-group)]
  misc_feature (77)..(1037): NCBI GI: 6114601 NCBI Desc: stromal antigen 3, (stag3) [homo sapiens]
  misc_feature (77)..(1037): NCBI GI: 119596974 NCBI Desc: hcg2024106, isoform cra_a [homo sapiens]
  misc_feature (77)..(1037): NCBI GI: 119596977 NCBI Desc: hcg2024106, isoform cra_c [homo sapiens]
  misc_feature (1)..(948): NCBI GI: 2204213 NCBI Desc: nuclear protein sa-1 [homo sapiens]
MEETLASLRRPKRRGRPPRPREEYHAADFEDVADAEGLAPPQSKRKRAASAAAAASLEDQPLIDIIKHNGRLISHAVKRLVEDYESKKNLVTFQILTMLFEACGAKHEIYPDYLRESDVDDIVVSLVDLARKGLVEDNYNSKHKDLKNFKENLVCFWDSLVLECQNGPLFDDLLFQKIKDYVVALSCAPPRVYRQVASLTGLQLVTSFISVAKTLSGQRETTQRQLNAEKKKQSDGPLIESLNNRLALTHANITYLEELMRKIFSGLFMHRYRDVDPEIRMSCIRSLGIWVVSYPSLFLQDIYLKYLGWTLNDKNAGVRRTSVLALQSLYEVDDNIPSLGLFTERFYTRMIQLADDIDVSVAVSAIGLIKQLLRHQLLSDDDLGPLYDLLIDEPPMIRRAIGELVYDHLIAQNIKTSHPGARDGENEPSEVHIGRMLQILREFSDDPVLSSYVIDDIWDDMKAMKDWRCIVSVLLDENPAIELTDMDGTNLVRMLRESARKAVGERIVPAVDNRKLYYNKGQKEILENSRREITTALLTRYPQLLRKFISDKAKISPLVDMMTLLKLELYSYKRQEKHFKTAIDLIADAFFKHGEKGPLRSCIKAILFCCTECQADLKDYAENKLKNLEDELVLKVRTAIKEVEAGDDEYSLLVNLKRFYELQLSKPVKNDSLFEDMYRILAHLRDMDNEVKSFLLLNMYLQVAWCLQAIDGENPSETCIDELLSKQSTLFDQLYYYLVVLPTYQKEGRSTTVLSCRVCIITAEMWCLFKKSKYSSTRLESLGYLPQSDMVQKFWKLCEQQLNISDETEDEDANEEYIEDTNRDAVMIAAAKLVLADTVSKDYLGPEIVSHYVSHGASTTEIIKHLITSLKKNTNFDMGALFFEALKRAYERYMAHVHEGENQILTGKSYSECQDLASHLAGSYVGAARIKNKSDILKIIQDGVSFAFVDLPNQLSFLEAALLPFVSKLQSSDIPDILADVEKRTQDTNMVGDQGAWRPYFTFVEHLRDKHAKNEVLHEEEEKPVRRRGRPRKVRDVPDVPDLRSGRDVRGKKLFRDDGHNSSGEESISASDHQGHGEDDDSDGDADQPLINTIRSSAAKLRSLKIAQQGTSSHKGVSGPSGRYDK

SEQ ID NO: 725 - DNA, 1626 bp, Sorghum bicolor
  misc_feature: Ceres ANNOT ID no. 6009790
  misc_feature: Encodes the peptide sequence at SEQ ID NO 726
atggggctgatggcgctgggcgacccgccggcggactacgcgtccatcgcggcggtggggctgttcgtggcgctcatgtgcgtctgcatcatcgtcggccacctcctcgaggagaaccgatggatgaacgagtccatcaccgcgctcttcatcgggctgggaactggagcggtgatcctgttcgcgtccagcgggaagcactcgcgcgtgctccagttcagcgaggacctcttctttatttacctgctgccgcccatcatatttaatgcagggttccaagtgaagaagaaacagttctttcgaaacttcattactattacactgtttggtgcagttggcaccttgatctcttttactgtaatatcccttggtgctctaggactagtatcaaggcttaatattggcgcacttgagcttggggactatctcgcacttggggcaatattctcggccacagactcggtgtgcaccttgcaggtgttaagccaagatgagacacccttcttgtacagcctcgtgtttggtgaaggtgttgtcaatgacgcaacttctgttgtgttgttcaatgcaatccagaactttgatcttggaaatatcagtggtgccaaattacttaactttattggcagtttcctttatctatttggcaccagcaccattcttggagtagcttctggacttcttagtgcttatatcatcaagaagttgtactttggcaggcactcaaccgatcgtgaagtttccattatgatgctaatggcttatttatcttacatgctagccgaattgcttgatttgagtggcattctcacagtgttcttctgcggtatcgtaatgtcccactatacctggcacaatgtaacagaaagttccagggtcacaaccaaacatgcctttgcaacattgtcatttatcgccgagacttttctgtttctctatgttggcatggatgcattggatatagagaagtggaagattgtcagtcaaacttacagcccagtaaaatctgttgctttgagctccactattttagccttggtgctggtttcaagagctgctttcgttttcccattatcatttctatcaaatttgaccaaaaaaactccaaatggaaagatatcttttaggcagcaggttattgtttggtgggcgggtctcatgagaggtgctgtgtccattgcgttggcttacaataagttcacaagatcaggccatactcagcaacctagcaatgctatcatgatcacaagcacaatcactgttgttcttttcagcacaattgtctttgggctactgaccaaaccgctgatcaggctcttgatcccaccaaggcacctatccagggaagccagcgccctttctgaaccatccagcccaaagtctttctttgagcagctggccacgaacagccctggtctccctgatattgagaacggcataagcctacgccgcccgacaagcctccgtttgctcctagcgagcccggcacggtcggtccactattactggcgcaagtttgacgacggtttcatgcggccggtttttggcggccgtggcttcgtccccttccaccctggttcaccgactgagagcagtgtgccgctgcttgctggcaatgggaactga

SEQ ID NO: 726 - protein, 541 aa, Sorghum bicolor
  misc_feature: Ceres ANNOT ID no. 6009790
  misc_feature (19)..(439): Pfam Id: Na_H_Exchanger Pfam Desc: Sodium/hydrogen exchanger family
  misc_feature (1)..(541): NCBI GI: 27948863 NCBI Desc: na+/h+ antiporter [hordeum brevisubulatum]
  misc_feature (1)..(541): NCBI GI: 42495693 NCBI Desc: na+/h+ antiporter precursor [triticum aestivum]
  misc_feature (1)..(541): NCBI GI: 82621225 NCBI Desc: vacuolar na+/h+ antiporter [hordeum brevisubulatum]
  misc_feature (1)..(537): NCBI GI: 61381322 NCBI Desc: na+/h+ antiporter [schedonorus arundinaceus]
  misc_feature (1)..(541): NCBI GI: 77552321 NCBI Desc: sodium/hydrogen exchanger 3 [oryza sativa (japonica cultivar-group)]
  misc_feature: Useful for making plants with modulated drought sensitivity
  misc_feature: Functional homolog of the protein sequence given in SEQ ID NO 13374
  misc_feature: The sequence is a functional homolog of SEQ ID NO 2 in US patent 7250560
  misc_feature: Useful for making plants with modulated water use efficiency
  misc_feature: Functional homolog of the protein sequence given in SEQ ID NO 13934
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7250560
  misc_feature: The sequence is a functional homolog of SEQ ID NO 4 in US patent 7256326
  misc_feature: The sequence is a functional homolog of SEQ ID NO. 319 in the 11/188,298 US application
MGLMALGDPPADYASIAAVGLFVALMCVCIIVGHLLEENRWMNESITALFIGLGTGAVILFASSGKHSRVLQFSEDLFFIYLLPPIIFNAGFQVKKKQFFRNFITITLFGAVGTLISFTVISLGALGLVSRLNIGALELGDYLALGAIFSATDSVCTLQVLSQDETPFLYSLVFGEGVVNDATSVVLFNAIQNFDLGNISGAKLLNFIGSFLYLFGTSTILGVASGLLSAYIIKKLYFGRHSTDREVSIMMLMAYLSYMLAELLDLSGILTVFFCGIVMSHYTWHNVTESSRVTTKHAFATLSFIAETFLFLYVGMDALDIEKWKIVSQTYSPVKSVALSSTILALVLVSRAAFVFPLSFLSNLTKKTPNGKISFRQQVIVWWAGLMRGAVSIALAYNKFTRSGHTQQPSNAIMITSTITVVLFSTIVFGLLTKPLIRLLIPPRHLSREASALSEPSSPKSFFEQLATNSPGLPDIENGISLRRPTSLRLLLASPARSVHYYWRKFDDGFMRPVFGGRGFVPFHPGSPTESSVPLLAGNGN

SEQ ID NO: 727 - DNA, 732 bp, Sorghum bicolor
  misc_feature: Ceres ANNOT ID no. 6009819
  misc_feature: Encodes the peptide sequence at SEQ ID NO 728
atggcggccgctagcgggagcaggcaacagaggtggagcctcgccggcgcgacggcgctggtcaccggcggcagcaaggggatcgggcacgcagtcgtcgaagagctggccgggttcggcgcgagggtgcacacgtgcgcccggaacgcggcagacctcgaggagtcccggcgccggtgggctgagaaggggctcgtcgtcaccgtctccgtctgcgacgtctccgtgccggctgacagggagaagctcatggacacggtcaagtcgaccttcgacggcaagctcgacatcctggtgaataacgccgggcaggcgttcttcaaggcggcggcggagtgcacggcggaggactactcacatgtgatggcgaccaacttggagtcaagcttccatctgtgccagctcgcgcaccctctcctcgtcggatcatccatcgccggaggaggaagcgtcgtccatatctcctccatcgcgcaagctacctgggtgtcccagggctcgcgctctactgcatctccaaagcttacaaggagcctggctgccgagtggtccccggacaagattcgtgtgaactgtgttgccccaggcgctatcatgactgatatggtcaaacagagggctggcgaggtagaggaggtggcgtccgttgtgtcgtttctgtgtatgccggcgtcttcctatatcactggccaggtcatttgcatcgacggtggccggaccataagtggctag

SEQ ID NO: 728 - protein, 243 aa, Sorghum bicolor
  misc_feature: Ceres ANNOT ID no. 6009819
  misc_feature (17)..(184): Pfam Id: adh_short Pfam Desc: short chain dehydrogenase
  misc_feature (17)..(160): Pfam Id: KR Pfam Desc: KR domain
  misc_feature (2)..(243): NCBI GI: 77552265 NCBI Desc: oxidoreductase, short chain dehydrogenase/reductase family [oryza sativa (japonica cultivar-group)]
  misc_feature (9)..(217): NCBI GI: 13311189 NCBI Desc: tropinone reductase i [solanum tuberosum]
  misc_feature (7)..(217): NCBI GI: 1717752 NCBI Desc: tropinone reductase-i (tr-i) (tropine dehydrogenase)
  misc_feature (7)..(205): NCBI GI: 38707448 NCBI Desc: short chain alcohol dehydrogenase-like protein [daucus carota]
  misc_feature (11)..(217): NCBI GI: 1651197 NCBI Desc: tropinone reductase-i [hyoscyamus niger]
  misc_feature: The sequence is a functional homolog of SEQ ID NO. 389 in the 11/188,298 US application
MAAASGSRQQRWSLAGATALVTGGSKGIGHAVVEELAGFGARVHTCARNAADLEESRRRWAEKGLVVTVSVCDVSVPADREKLMDTVKSTFDGKLDILVNNAGQAFFKAAAECTAEDYSHVMATNLESSFHLCQLAHPLLVGSSIAGGGSVVHISSIAQATWVSQGSRSTASPKLTRSLAAEWSPDKIRVNCVAPGAIMTDMVKQRAGEVEEVASVVSFLCMPASSYITGQVICIDGGRTISG

SEQ ID NO: 729 - DNA, 801 bp, Sorghum bicolor
  misc_feature: Ceres ANNOT ID no. 6009821
  misc_feature: Encodes the peptide sequence at SEQ ID NO 730
atggtggctgtgggcatgagcagggcggagcggtggaacctcgccggcgcgacggcgctcgtcaccggcggcagcaagggcatagggcacgcgatcgtggaggagctagcggggttcggcgcccgggtgcacacgtgctcacgcaacgcggcggagctggaggagtgccggcggcggtgggaggagaaggggctgcaggtcaccgtctccgtctgcgacgtgtccgtgcgcggcgaccgcgaggacctcatggccaccgtgggtgccaccttcggcggcaggctcgacatcctcgtgaacaacgccgggcagtcgctgttcaagcacacggtggagtgcaccggcgaggactacgcgcggatcatggcgaccaacctcgagtcgtgcttccacctctgccagctcgcgcacccgctgctgcgtgccaccggcggcggcggcggcggcggcggcagtgtcgtccacatctcctccatcgccggcttcatcgggctaccggcgctcgccgtctactccatgaccaagggcgccatgaaccagctcacacgcagcctcgccgccgagtgggccggcgatggcatccgtgtcaactgcgtcgcaccggggggcatcaagacagacatcagcagtgataagacgatagacccggagctggtgaagaaggagatggcgcggctgcccatggggaggatcggcgagccggaggaggtggcgtccttggtggcattcctctgcatgccggcggcgtcctacatgaccggccaagtcatctgcattgacggcggccgcaccatagcttag

SEQ ID NO: 730 - protein, 266 aa, Sorghum bicolor
  misc_feature: Ceres ANNOT ID no. 6009821
  misc_feature (17)..(190): Pfam Id: adh_short Pfam Desc: short chain dehydrogenase
  misc_feature (17)..(207): Pfam Id: KR Pfam Desc: KR domain
  misc_feature (3)..(265): NCBI GI: 77552265 NCBI Desc: oxidoreductase, short chain dehydrogenase/reductase family [oryza sativa (japonica cultivar-group)]
  misc_feature (7)..(255): NCBI GI: 115442027 NCBI Desc: os01g0931000 [oryza sativa (japonica cultivar-group)]
  misc_feature (8)..(265): NCBI GI: 8778545 NCBI Desc: f22g5.20 [arabidopsis thaliana]
  misc_feature (6)..(265): NCBI GI: 21536785 NCBI Desc: short chain alcohol dehydrogenase-like [arabidopsis thaliana]
  misc_feature (10)..(265): NCBI GI: 42569437 NCBI Desc: short-chain dehydrogenase/reductase (sdr) family protein [arabidopsis thaliana]
  misc_feature (11)..(264): SWISSPROT Homolog: EC 1.1.1.206 Tropinone reductase 1
  misc_feature (9)..(262): SWISSPROT Homolog: EC 1.1.1.236 Tropinone reductase 2
  misc_feature: The sequence is a functional homolog of SEQ ID NO. 389 in the 11/188,298 US application
  misc_feature: The sequence is a functional homolog of SEQ ID NO. 453 in the 11/188,298 US application
MVAVGMSRAERWNLAGATALVTGGSKGIGHAIVEELAGFGARVHTCSRNAAELEECRRRWEEKGLQVTVSVCDVSVRGDREDLMATVGATFGGRLDILVNNAGQSLFKHTVECTGEDYARIMATNLESCFHLCQLAHPLLRATGGGGGGGGSVVHISSIAGFIGLPALAVYSMTKGAMNQLTRSLAAEWAGDGIRVNCVAPGGIKTDISSDKTIDPELVKKEMARLPMGRIGEPEEVASLVAFLCMPAASYMTGQVICIDGGRTIA

SEQ ID NO: 731 - DNA, 1089 bp, Sorghum bicolor
  misc_feature: Ceres ANNOT ID no. 6009836
  misc_feature: Encodes the peptide sequence at SEQ ID NO 732
  misc_feature: Up-regulated in root tissues in response to salicylic acid treatment
atggcatggctggggcggacggtgaagcttctgctgctgctggtggtcgcggtgcttgtggcctccgcttcttcccccaccgctgcggcggtggcggcggggcaggaggaggaaagagtgatcaggctgaagcaaagtgatgatggttattcctacaatcatacgcttgctcatattcttgtcgaatacgcatctgcagtgtacacttctgacttaacatcacttctcttatggacctgtccaaggtgcaaaggccacacaaagggttttgaggtgatagagatcatagtagatgtggagaactgcttacaggcatttgttggagttgcgcctgaccctcgatcaataatcattgcatttagaggcactcaacagcacagtatctcaaattggatcgaagatcttttctggaagcagcttgatgtgacataccctggcatgccggatgctatggtccatcatgggttttatactgcatattataatacaactatgcggtatgagatcctgaagtctattaaatgggcaagaaaaacatatggagatctacccataaatgttgtgggacattccatgggaggggctttagcttcgttttgtgcccttgatctatctgttaaatttggaccaaaggcggttgagctcatgactttcggacagccccggataggcaatcctgcttttgctgtatactttggtgaacaagtcccaagaacaatccgtgtgacccatcagaatgatattgtgccgcatttaccaccgtattattattacctaggtgaatggacataccaccactttgctagagaggtttggcttcatgagagcatagatggaaatgtagttactagaaatgagacggtatgtgatgattctggtgaggacccaacctgtagcaggtcggtctatgggatgagcgtagcagatcatcttgagtactacggtgtcacactacatgctgattcaaggggaacctgtcaatttgtgattggtgcagccaactcagtttacagctacgttcgtgaagttgatggatccatcatcttgtcaagatatccagaagaaccacaagctctagaatctatgtga

SEQ ID NO: 732 - protein, 362 aa, Sorghum bicolor
  misc_feature: Ceres ANNOT ID no. 6009836
  misc_feature (117)..(257): Pfam Id: Lipase_3 Pfam Desc: Lipase (class 3)
  misc_feature (14)..(362): NCBI GI: 77552336 NCBI Desc: triacylglycerol lipase [oryza sativa (japonica cultivar-group)]
  misc_feature (39)..(351): NCBI GI: 15238889 NCBI Desc: lipase class 3 family protein [arabidopsis thaliana]
  misc_feature (40)..(351): NCBI GI: 50198977 NCBI Desc: at5g18630 [arabidopsis thaliana]
  misc_feature (39)..(359): NCBI GI: 21425569 NCBI Desc: triacylglycerol lipase [triticum aestivum]
  misc_feature (39)..(355): NCBI GI: 21425571 NCBI Desc: triacylglycerol lipase [triticum aestivum]
  misc_feature: Up-regulated in root tissues in response to salicylic acid treatment
MAWLGRTVKLLLLLVVAVLVASASSPTAAAVAAGQEEERVIRLKQSDDGYSYNHTLAHILVEYASAVYTSDLTSLLLWTCPRCKGHTKGFEVIEIIVDVENCLQAFVGVAPDPRSIIIAFRGTQQHSISNWIEDLFWKQLDVTYPGMPDAMVHHGFYTAYYNTTMRYEILKSIKWARKTYGDLPINVVGHSMGGALASFCALDLSVKFGPKAVELMTFGQPRIGNPAFAVYFGEQVPRTIRVTHQNDIVPHLPPYYYYLGEWTYHHFAREVWLHESIDGNVVTRNETVCDDSGEDPTCSRSVYGMSVADHLEYYGVTLHADSRGTCQFVIGAANSVYSYVREVDGSIILSRYPEEPQALESM

SEQ ID NO: 733 - DNA, 312 bp, Sorghum bicolor
  misc_feature: Ceres ANNOT ID no. 6009837
  misc_feature: Encodes the peptide sequence at SEQ ID NO 734
atggagcacgtggcgaggctggcgtcggagcgcgcggtggtggtgttcacggcgagcaactgcagcatgggcgacgtcgtgacgtcgctgctgagcagcctgggcgtgaacgcggcggtgcacgacctggacagggacccccggggcatggagatgcagcgggagctggccaggaggctcggcgccggcgccaccgtgccggcggtgttcgtgggcggcgacctcgtcggcgggaccagcagggtcatggcgctgcacctctccggcgagctcgtgcccatgctcaggaacgccggcgcgctctggttgtag

SEQ ID NO: 734 - protein, 103 aa, Sorghum bicolor
  misc_feature: Ceres ANNOT ID no. 6009837
  misc_feature (13)..(76): Pfam Id: Glutaredoxin Pfam Desc: Glutaredoxin
  misc_feature (1)..(103): NCBI GI: 119370624 NCBI Desc: glutaredoxin-c10
  misc_feature (2)..(103): NCBI GI: 77552368 NCBI Desc: glutaredoxin [oryza sativa (japonica cultivar-group)]
  misc_feature (2)..(103): NCBI GI: 119370627 NCBI Desc: glutaredoxin-c13
  misc_feature (2)..(103): NCBI GI: 77552326 NCBI Desc: glutaredoxin [oryza sativa (japonica cultivar-group)]
  misc_feature (1)..(103): NCBI GI: 119370629 NCBI Desc: glutaredoxin-c15
  misc_feature: The sequence is a functional homolog of SEQ ID NO. 382 in the 11/188,298 US application
MEHVARLASERAVVVFTASNCSMGDVVTSLLSSLGVNAAVHDLDRDPRGMEMQRELARRLGAGATVPAVFVGGDLVGGTSRVMALHLSGELVPMLRNAGALWL

SEQ ID NO: 735 - DNA, 474 bp, Sorghum bicolor
  misc_feature: Ceres ANNOT ID no. 6009841
  misc_feature: Encodes the peptide sequence at SEQ ID NO 736
atggcggcatgcccagcacacaacaacacaagaaaccacatcgatcagccaaccattaatttccaagctaacaacgaaacccagaacccttccaggcagcgccacagccataatcagcaacctgatcaaaagctgccagtgccaatggaccgtatggcgaagctggcgtcggagcgcgcggtggtggtgttcacggcgagcaactgcagcatgggcgacgtcgtggcgtcgctcctgaacagcctgggcgtgaacgcggccgtgcacgacctggacagggacccccggggccaggagatggagcgggagctcgccagcaggctcggcgccggcgccggcgggcgcggaagccccgctgtgccggcggtgttcgtgggcggccacctcgtcggcgggaccagcagggtcatggcgttgcacctcgccggcgagctcgtgcccatgctcaagagcgccggcgcgctctggctatag

SEQ ID NO: 736 - protein, 157 aa, Sorghum bicolor
  misc_feature: Ceres ANNOT ID no. 6009841
  misc_feature (61)..(130): Pfam Id: Glutaredoxin Pfam Desc: Glutaredoxin
  misc_feature (49)..(157): NCBI GI: 119370624 NCBI Desc: glutaredoxin-c10
  misc_feature (50)..(157): NCBI GI: 77552326 NCBI Desc: glutaredoxin [oryza sativa (japonica cultivar-group)]
  misc_feature (50)..(157): NCBI GI: 77552368 NCBI Desc: glutaredoxin [oryza sativa (japonica cultivar-group)]
  misc_feature (50)..(157): NCBI GI: 119370627 NCBI Desc: glutaredoxin-c13
  misc_feature (49)..(157): NCBI GI: 119370629 NCBI Desc: glutaredoxin-c15
  misc_feature: The sequence is a functional homolog of SEQ ID NO. 382 in the 11/188,298 US application
MAACPAHNNTRNHIDQPTINFQANNETQNPSRQRHSHNQQPDQKLPVPMDRMAKLASERAVVVFTASNCSMGDVVASLLNSLGVNAAVHDLDRDPRGQEMERELASRLGAGAGGRGSPAVPAVFVGGHLVGGTSRVMALHLAGELVPMLKSAGALWL

SEQ ID NO: 737 - DNA, 2067 bp, Sorghum bicolor
  misc_feature: Ceres ANNOT ID no. 6009843
  misc_feature: Encodes the peptide sequence at SEQ ID NO 738
atgcccaagatgtttggtttctctcggcgacggatgaagttggggaggttgaagggtcatctacatgatcatttccatgcctctcgaagcccctctcggaccaccaagcgtttcagtcaccccaatggagaggatccattgactacctcagtgagtggtcgtcccgatgaccattcttggcgctgctcatccgatacttttgatatcaatggtcgtgcttttgagagctcagagaactgggcagtgctgtcaacagagggcgacaaaccagttcctcgttttgatcatgcagcagccatggtagggagcaaaatggtagtatttggtggcgattctggtcaatgtttgctagatgatactaagatattgagtttagacaagcttacctgggattctgttgctcctaaagttcgaccatcatcaaatggacgttctctgaagttgagaccatgcaaaggtcattgtctggttccatggggaaagaatgttattcttgtgggagggaaaagtgatcaaccttctgacaagatatcagtatggaccttcaatacagagagtgaactctggtcacatatggaagcgaagggtgacattccggtgtctcgaagcggccatacggttattagagcaggtcctgttttaattctcttcggaggtgaggatgccaaagggaagaaactacatgaccttcatatgtttgatctgaagtcattaacttggcttcctctgaattataagggtgctggaccttctccaagatcaaatcatgtagctgccctttatgatgatagaattctattgatttttggaggtcagtcgaagtccaagaccctgaatgatattcatgctctagactttgaaacaatggtatggtcaagggtcaaaacccatggtcatcatccatcacctcgagcaggatgctgcggggctctttgtgggactaaatggtatattgcagggggtggaagcaagaaaaaacggcatcctgaaacatgggtttttgatgttctcgaatccaaatggtctgtttgtgtagtgcctcctagttcctcaatcactacaaagaaaggtttcagcatggttccattatactacagggacaagattgtgcttgttgcttttggagggaacaaaaaggaaccatctgataaggttgaagtactagtggtgctgcaaaacgagcactgtttcagttggcgatccgcacctgaggtggaacccttactgtatgacgactctcctccaagctcaagggaacttgctgaccatctcaacaactgcgctcctctgtattctactagctccgcagcgaggagcagtcttgcaaccacagcggaaaactcttctgggagaaaatccctccccgattcactgctacagaattcaaatctcgggagctcatcgctccgcaggcagtttcgtcaggaagaggactgcagcctggcccaaaaactgcagaaaccaatcgacgacgacaagtacaaggacgccgacgactgctctgaactacccacaatcgcaaaccaaaaaccacgcaacgacacacgccagtccccagatgctgttgatgctaaagcgaggaggctgggcaggagctcgtcagacatcaacaacaaccatcaggacacgaggataaccacgctgatcaggaggaacatggcgctggaagagcaactctcagccgcgctcgcgagcaaggacgaagcggagaagaacctctccctggtcatcgacagcaaggatgagctggagaagaggttggccgagaaggacagggaggtcgaggcgctgaaggagaaggcaaccgggctagaactggcacaggaggagtccaacaacctctccaacaccgtccatgccgacaacgtgcggctggagcgcgaagtggccttcctaaaggccgtcatggacgagacccagaagctggaattgcactcgactcgcggagttcttgcaggagaacgcgcaagggcatttcagcttcaggttgaagtgttccatctgaagcaacgcttgcagacgatggagggaaggtcacctacaccacgaaagcctcagaatcagtag

SEQ ID NO: 738 - protein, 688 aa, Sorghum bicolor
  misc_feature: Ceres ANNOT ID no. 6009843
  misc_feature (92)..(137): Pfam Id: Kelch_2 Pfam Desc: Kelch motif
  misc_feature (252)..(298): Pfam Id: Kelch_2 Pfam Desc: Kelch motif
  misc_feature (369)..(370): Pfam Id: DNA_pol_B_2 Pfam Desc: DNA polymerase type B, organellar and viral
  misc_feature (1)..(685): NCBI GI: 77556542 NCBI Desc: rangap1 interacting protein [oryza sativa (japonica cultivar-group)]
  misc_feature (157)..(687): NCBI GI: 115486499 NCBI Desc: os11g0657000 [oryza sativa (japonica cultivar-group)]
  misc_feature (4)..(478): NCBI GI: 21950739 NCBI Desc: rangap1 interacting protein [arabidopsis thaliana]
  misc_feature (4)..(478): NCBI GI: 30686896 NCBI Desc: kelch repeat-containing protein [arabidopsis thaliana]
  misc_feature (80)..(388): NCBI GI: 42572263 NCBI Desc: acyl-coa binding family protein [arabidopsis thaliana]
  misc_feature: The sequence is a functional homolog of SEQ ID NO. 354 in the 11/188,298 US application
MPKMFGFSRRRMKLGRLKGHLHDHFHASRSPSRTTKRFSHPNGEDPLTTSVSGRPDDHSWRCSSDTFDINGRAFESSENWAVLSTEGDKPVPRFDHAAAMVGSKMVVFGGDSGQCLLDDTKILSLDKLTWDSVAPKVRPSSNGRSLKLRPCKGHCLVPWGKNVILVGGKSDQPSDKISVWTFNTESELWSHMEAKGDIPVSRSGHTVIRAGPVLILFGGEDAKGKKLHDLHMFDLKSLTWLPLNYKGAGPSPRSNHVAALYDDRILLIFGGQSKSKTLNDIHALDFETMVWSRVKTHGHHPSPRAGCCGALCGTKWYIAGGGSKKKRHPETWVFDVLESKWSVCVVPPSSSITTKKGFSMVPLYYRDKIVLVAFGGNKKEPSDKVEVLVVLQNEHCFSWRSAPEVEPLLYDDSPPSSRELADHLNNCAPLYSTSSAARSSLATTAENSSGRKSLPDSLLQNSNLGSSSLRRQFRQEEDCSLAQKLQKPIDDDKYKDADDCSELPTIANQKPRNDTRQSPDAVDAKARRLGRSSSDINNNHQDTRITTLIRRNMALEEQLSAALASKDEAEKNLSLVIDSKDELEKRLAEKDREVEALKEKATGLELAQEESNNLSNTVHADNVRLEREVAFLKAVMDETQKLELHSTRGVLAGERARAFQLQVEVFHLKQRLQTMEGRSPTPRKPQNQ

SEQ ID NO: 739 - DNA, 1239 bp, Sorghum bicolor
  misc_feature: Ceres ANNOT ID no. 6009844
  misc_feature: Encodes the peptide sequence at SEQ ID NO 740
atggaggccttcctcgccggtctcttcagggcgcctccacgcgccgtccccggccctcggggcacgcctctctccggccttcctctctttcacggcaggcgccgcaggcggccgtcctcgtccgtggtctgcatggcggagccctatctgattgccaagctggattctgcggagaaggcctggaaagaaatgtcggttaggttggcagatccggacattgtctcagatccaagcgaataccaaaaactcgcgcagtctgtttctgaactggatcaggtcgtgaccacatacaggcaattcaaggattgtgagaggcagcttgaagagacaaaagctctggaaaaagagaacgaagatgaccctgatatgtcagagatgataacttctgagctggaggctctatctaaccagcttgcagagcttgaagaaaaattgaagttactactgcttcccagtgatcctctagattcacgcaacatcttacttgaagtaagagcaggtgctggtggtgacgaagctggaatttgggctggtgaccttgtacgcatgtatcagaaatactgtgagcgcaacaattggaagtttaagccagtttcttgctcagaagcagacatgggtggatacaagacatatgtgatggaggtgaaggggaaacaagtctatagtaaattgaagtttgagtcaggtgtacaccgtgttcagcgtgttcccctgacagagactatgggtcgtgttcatacgtcaacagcaactgtagctattatgccagaggctgatgaagttgatgtggttattgatccaaaagatattgagcttaaaacagcacgatctggtggagctggagggcagaatgttaacaaggtggagacggctgttgatcttattcacaagcctacaggaataaggatattctgtactgaagagagatcacagctacagaacaaagagcgggcatttcaattgttgagagcaaaactttacgagataaaattaagggagcaacaagagtcaataagaaaccagaggaaaatgcaggttggtactggtgctcgatctgagaagataaggacatacaattacaaggataacagagtgacagaccatcgattaaagatgaactatgaactgaccggcttccttttaggagacatcgaatcggctgttcagtcttgtgctacactggagcagcaggagctcttggaggaaatggccagttccgtgggcgcagtgaacgtatga

SEQ ID NO: 740 - protein, 412 aa, Sorghum bicolor
  misc_feature: Ceres ANNOT ID no. 6009844
  misc_feature (256)..(369): Pfam Id: RF-1 Pfam Desc: Peptidyl-tRNA hydrolase domain
  misc_feature (112)..(227): Pfam Id: PCRF Pfam Desc: PCRF domain
  misc_feature (1)..(412): NCBI GI: 77552370 NCBI Desc: peptide chain release factor 1 [oryza sativa (japonica cultivar-group)]
  misc_feature (14)..(409): NCBI GI: 7573420 NCBI Desc: translation releasing factor rf-1-like protein [arabidopsis thaliana]
  misc_feature (45)..(406): NCBI GI: 119484803 NCBI Desc: peptide chain release factor 1 [lyngbya sp. pcc 8106]
  misc_feature (45)..(406): NCBI GI: 67923568 NCBI Desc: peptide chain release factor 1 [crocosphaera watsonii wh 8501]
  misc_feature (45)..(406): NCBI GI: 126658019 NCBI Desc: peptide chain release factor 1 [cyanothece sp. ccy0110]
MEAFLAGLFRAPPRAVPGPRGTPLSGLPLFHGRRRRRPSSSVVCMAEPYLIAKLDSAEKAWKEMSVRLADPDIVSDPSEYQKLAQSVSELDQVVTTYRQFKDCERQLEETKALEKENEDDPDMSEMITSELEALSNQLAELEEKLKLLLLPSDPLDSRNILLEVRAGAGGDEAGIWAGDLVRMYQKYCERNNWKFKPVSCSEADMGGYKTYVMEVKGKQVYSKLKFESGVHRVQRVPLTETMGRVHTSTATVAIMPEADEVDVVIDPKDIELKTARSGGAGGQNVNKVETAVDLIHKPTGIRIFCTEERSQLQNKERAFQLLRAKLYEIKLREQQESIRNQRKMQVGTGARSEKIRTYNYKDNRVTDHRLKMNYELTGFLLGDIESAVQSCATLEQQELLEEMASSVGAVNV

SEQ ID NO: 741 - DNA, 1347 bp, Sorghum bicolor
  misc_feature: Ceres ANNOT ID no. 6009856
  misc_feature: Encodes the peptide sequence at SEQ ID NO 742
atgcaggtcgtcctggcattggtggtggtggtgctggccgccacgaccgcgcgcggcgagctgcgggaccaggcgccgccggggtcgcgcccgcacagcgtcaccatcaccgagttcggcgccgtcggggacggcaggacgctcaacacggtcccgttccagaacgccgtcttctacgtccgctccttcgctgacaagggcggcgcgcagctgtacgtgcccaggggccgctggctcaccggcagcttcaacctcaccagccacctcaccatctacctggagcaaggcgccgtcatcgtcggcgcaaaggattcatcacaatggccgattgtggaacctttaccatcttatggccaagggactgaccttcctggtcctagacatcgaagcttgataaatggatacaacttaaccgatgttgtcataaccgggaacaatggagttattgatggtcagggcttagtatggtggcagtggctgctctcccatgagctgaaccatagccgtcctcatcttttggagtttctttattctgaagatatcgtgatctcaaacttgacattcttaaattcaccagcctggagcatacatccggtgtactgcagtaatgtaaaggtccacaatgtgacgattgagacctcactggatgctccactgactgatggcatagttccagattcatgttcaaatttatgtattgaagacagcaccataagtgttagccatgaagcaatttcactgaaaagcggatgggacaagtatggtatttcctttgggaggcctacgtctgacattcatataagcagagtggatctgctatcatcttctggagctgctcttgcatttgggagtgagatgtccggtggcatctcagatattcatgttaaccacctacgaatccatgattcctacaaaggtatttctttcaagacttcaccaggccgtgggggttacatagaggaggtgatcatctctgaggtacaaatggaaaatgtacatgttggcattgagttcactggtaactgctcaacccacccagatgacagtttcgacctgtctgacctcccgacgatcgatcaagtcaccatgaagaacatggtcggcacaaacatctcagttgctggagttttgtcaggaatcgataatgccccattcacagctatctgcctttccaatctcaatttctccatggctgctgatactggttcaagttcctggtcttgttccaatgtttctggctactccgaggcggtctttcctgaaccttgcacagagctccgtgatccatcctccagtccttccatctgcttctccctttctagctacagtgccattgcagcagcataa

SEQ ID NO: 742 - protein, 448 aa, Sorghum bicolor
  misc_feature: Ceres ANNOT ID no. 6009856
  misc_feature (66)..(423): Pfam Id: Glyco_hydro_28 Pfam Desc: Glycosyl hydrolases family 28
  misc_feature (27)..(448): NCBI GI: 115489012 NCBI Desc: os12g0554800 [oryza sativa (japonica cultivar-group)]
  misc_feature (4)..(448): NCBI GI: 7939578 NCBI Desc: polygalacturonase-like protein [arabidopsis thaliana]
  misc_feature (1)..(446): NCBI GI: 81074755 NCBI Desc: polygalacturonase-like protein-like [solanum tuberosum]
  misc_feature (62)..(427): NCBI GI: 21593399 NCBI Desc: polygalacturonase-like protein [arabidopsis thaliana]
  misc_feature (3)..(428): NCBI GI: 87241007 NCBI Desc: glycoside hydrolase, family 28 [medicago truncatula]
  misc_feature: Useful for making plants with altered cell wall content and/or composition
  misc_feature: Functional homolog of the protein sequence encoded by LOCUS at3g06770
  misc_feature: GREAT-hit functional homolog of the protein sequence encoded by LOCUS at3g16850
  misc_feature: Functional homolog of the protein sequence encoded by LOCUS at5g49215
  misc_feature: Useful for making plants with altered cell wall content and/or composition
  misc_feature: Functional homolog of the protein sequence given in SEQ ID NO 13673
  misc_feature: Useful for making plants with altered carbohydrate content
  misc_feature: Functional homolog of the protein sequence given in SEQ ID NO 13672
  misc_feature: The sequence is a functional homolog of SEQ ID NO. 450 in the 11/188,298 US application
MQVVLALVVVVLAATTARGELRDQAPPGSRPHSVTITEFGAVGDGRTLNTVPFQNAVFYVRSFADKGGAQLYVPRGRWLTGSFNLTSHLTIYLEQGAVIVGAKDSSQWPIVEPLPSYGQGTDLPGPRHRSLINGYNLTDVVITGNNGVIDGQGLVWWQWLLSHELNHSRPHLLEFLYSEDIVISNLTFLNSPAWSIHPVYCSNVKVHNVTIETSLDAPLTDGIVPDSCSNLCIEDSTISVSHEAISLKSGWDKYGISFGRPTSDIHISRVDLLSSSGAALAFGSEMSGGISDIHVNHLRIHDSYKGISFKTSPGRGGYIEEVIISEVQMENVHVGIEFTGNCSTHPDDSFDLSDLPTIDQVTMKNMVGTNISVAGVLSGIDNAPFTAICLSNLNFSMAADTGSSSWSCSNVSGYSEAVFPEPCTELRDPSSSPSICFSLSSYSAIAAA

SEQ ID NO: 743 - DNA, 1725 bp, Sorghum bicolor
  misc_feature: Ceres ANNOT ID no. 6009861
  misc_feature: Encodes the peptide sequence at SEQ ID NO 744
atgggggcgaaacgggtggcgtcggcggcggggacggcggccatagtgtacgtcgcgctgtcggggcgcctctcctcggcgtccggcgacgccgtgacgatcgatgcggcgaggcggcggcggaggagcgcggaggagggagaggaagaggagaggtggccagagcgggcgccggcgagctggagggaggcgttggcggtggcggcgaggacggcggggttcgcgttcgccgagacgctcggcaagtggccgctcgcggacatcgccttcgggatcaaccactacatgcgcatccagggcaatcttcagcatgagtacactggcagtagttctgtgcccctggatggtcctggagtaaggcaggagctgattggacttctcagatacctcagactctgcatgttcttctcaaagaaaccatatgaagtgtttctagagtttggtggttatggacagagtgacattctcataaggaagtcgaagtcacagtttatgaaacctgcattcacggttgtccgcgatggaagtaccaaatccttcctccttttcattcggggagcgaccagcactaaggatcgtctgactgccgctactgctgcagaagttccattccatcattcagtattattacaagatggacgtagatccaatttagtggctggatatgcgcattgtggaatggttgctgccgctcgttggattgcagatcaggcaattccctgcctaaggaaagcagtcgaacaattcccagactacagagtaaagatcattgggcattcaatgggagctggtattgctgcgatattaacatacattctacgcgaggacaataggttatcatcatcctcatgtactgcgtttggaccagcggcttgcatgacctgggacttggctgagtcaggcaaagacttcgttacctctgttgtcaacaaaaacgacattgtgccatctttcagcaaagcttcctctgcgaaccttcgcacagaggttatggcatcatcatgggctccagacctccaagaacaaattcagcaaacaagaatcttgggtttcgtaaatagctctgtgaatttgatgcgatcccacattccctttgtatcgaacgcagggtctgactctgaccacacttctatggatgagttgaacctttcagaaaatgtgtgtgccgctgtacagaagcactctgcactgtcctgctggtcttctgtcgctgttaatacgcaaattctgaagtctctggtgaaccccactcagggcattccagcattgatgtctgcatacagaggaacagagcaaaacactgagaagccaacaactgcaggagaaccagcctcatgctatcctggacaactcaatcatcagagatcagatgctgtggagactgacctagaggagaaagcaacataccaagaacacatggatcagcttctgaaggcctttcgatcatcgcgaatggcctctcaggagccacaccagctgtaccctccgggcagaatcatgcacatggttgagctgccagaaccggaagagctgagcaccggtgagcaatgccaccagaatgaggtagttgccatctatgagacccctcgcagcatgtatggcaagatccggctggcaagaaccatgatcagagaccattacatgccgaggtacatcgagacgatggagatgctgatcgacaagcttgcagaggatgaggatgacactgacaaccggttggactaa

SEQ ID NO: 744 - protein, 574 aa, Sorghum bicolor
  misc_feature: Ceres ANNOT ID no. 6009861
  misc_feature (181)..(323): Pfam Id: Lipase_3 Pfam Desc: Lipase (class 3)
  misc_feature (1)..(568): NCBI GI: 115489010 NCBI Desc: os12g0554500 [oryza sativa (japonica cultivar-group)]
  misc_feature (1)..(369): NCBI GI: 47497398 NCBI Desc: lipase class 3 protein-like [oryza sativa (japonica cultivar-group)]
  misc_feature (1)..(369): NCBI GI: 27764916 NCBI Desc: at3g14070/mag2_2 [arabidopsis thaliana]
  misc_feature (1)..(471): NCBI GI: 22328699 NCBI Desc: lipase class 3 family protein [arabidopsis thaliana]
  misc_feature (1)..(527): NCBI GI: 20805147 NCBI Desc: lipase class 3-like protein [oryza sativa (japonica cultivar-group)]
MGAKRVASAAGTAAIVYVALSGRLSSASGDAVTIDAARRRRRSAEEGEEEERWPERAPASWREALAVAARTAGFAFAETLGKWPLADIAFGINHYMRIQGNLQHEYTGSSSVPLDGPGVRQELIGLLRYLRLCMFFSKKPYEVFLEFGGYGQSDILIRKSKSQFMKPAFTVVRDGSTKSFLLFIRGATSTKDRLTAATAAEVPFHHSVLLQDGRRSNLVAGYAHCGMVAAARWIADQAIPCLRKAVEQFPDYRVKIIGHSMGAGIAAILTYILREDNRLSSSSCTAFGPAACMTWDLAESGKDFVTSVVNKNDIVPSFSKASSANLRTEVMASSWAPDLQEQIQQTRILGFVNSSVNLMRSHIPFVSNAGSDSDHTSMDELNLSENVCAAVQKHSALSCWSSVAVNTQILKSLVNPTQGIPALMSAYRGTEQNTEKPTTAGEPASCYPGQLNHQRSDAVETDLEEKATYQEHMDQLLKAFRSSRMASQEPHQLYPPGRIMHMVELPEPEELSTGEQCHQNEVVAIYETPRSMYGKIRLARTMIRDHYMPRYIETMEMLIDKLAEDEDDTDNRLD

SEQ ID NO: 745 - DNA, 1578 bp, Sorghum bicolor
  misc_feature: Ceres ANNOT ID no. 6009892
  misc_feature: Encodes the peptide sequence at SEQ ID NO 746
atggtggctgctcctccatcgtcgtcgtgtgacagtgacacctacctgctgttccatggcgagactctgctttccaccggcgcccgcgcctccctctacaccgtcgcgctcgcgtactgcttcatcggactgtccgcgatcaccgcccggttcttcaaatccatggagcagatcatgaaacactcccgggaggtggttgtcattgacccgcacaccaaggagcctgttgtcaagcacgagaaggtgtggaactacactgtcgcggacattgctctgcttgcgtttggtaccagtttccctcagatctccctcgccatcatcgacgccatccgaaatctgggtcaactgacagcaggaggtctaggtccaggcacacttgttggttctgcggcatttgatctgtttccaatccatgctgtctgtgtggttatgccaagggcagggtctaagaaaaagatctctgacttgggtgtttggttggttgagctcgtctggtctttctgggcatatatttggctctatgttatcttagaggtgtggacgcctaaagtgatcaccctctgggaggcactgctgacagtcttgcagtatgggttacttctgcttcatgcatatgcacaggataaacggtggccatttgtatccatcccatttgtgagaggtgagaggcctgaagattgggttccaccagaagatgtttctgttgattacgacaactgtgatgacactaatgagacactccctataagtgctaaccggaatgatggcattgtagacgtattctctgcacattcctaccacattgcagagtacagtcgagttccagaaaaggatatggaaggatcatcaacaatggatcaagttgtaaagaacacacaagaagatatatcctggctttctatttggtggcaacaatttgttgatgcttcaatgttggagagccctgagtcaaggaagatgcattccatctgcctgaggttcaccacaatattttggaacttgatcattgcgccttggaaatttttgtttgcttttgtgcccccatacaatattgcacatggctggattgcttttatatgctcactgatcttcataagtggtattgcttatggtgttactaagcttacagatcagataagctgtgtcacaggagtaagtccatatgttattgcattcacagcactggctgctggaacctcatggccagatctagttgccagcaagatagctgctgagcgtcaagtcactgcagactctgcaatagccaacatcacctgcagtaactcggtgaacatatatgttggcattggtgttccgtggttgattgacacagtgtacaacttcttcgtttaccaggagccattgtacatagataatgctgctggtctcagcttctcccttctagtcttctttgcgacatcatttggatgtattacggttttggttctgcgccgcattatactcggtgctgagcttggcggccctaggctatgggcttgggttacatcagtctacttcatgatcctttgggttgtttttgttgttttttcctctctaagagtttcaggagtaatatag

SEQ ID NO: 746 - protein, 525 aa, Sorghum bicolor
  misc_feature: Ceres ANNOT ID no. 6009892
  misc_feature (42)..(204): Pfam Id: Na_Ca_ex Pfam Desc: Sodium/calcium exchanger protein
  misc_feature (363)..(517): Pfam Id: Na_Ca_ex Pfam Desc: Sodium/calcium exchanger protein
  misc_feature (9)..(525): NCBI GI: 77552397 NCBI Desc: magnesium/proton exchanger atmhx [oryza sativa (japonica cultivar-group)]
  misc_feature (10)..(525): NCBI GI: 92878316 NCBI Desc: sodium/calcium exchanger membrane region [medicago truncatula]
  misc_feature (9)..(426): NCBI GI: 77552398 NCBI Desc: magnesium/proton exchanger atmhx [oryza sativa (japonica cultivar-group)]
  misc_feature (276)..(519): NCBI GI: 62637560 NCBI Desc: sodium calcium exchanger [oreochromis mossambicus]
  misc_feature (28)..(220): NCBI GI: 51329996 NCBI Desc: slc8a2 protein [mus musculus]
MVAAPPSSSCDSDTYLLFHGETLLSTGARASLYTVALAYCFIGLSAITARFFKSMEQIMKHSREVVVIDPHTKEPVVKHEKVWNYTVADIALLAFGTSFPQISLAIIDAIRNLGQLTAGGLGPGTLVGSAAFDLFPIHAVCVVMPRAGSKKKISDLGVWLVELVWSFWAYIWLYVILEVWTPKVITLWEALLTVLQYGLLLLHAYAQDKRWPFVSIPFVRGERPEDWVPPEDVSVDYDNCDDTNETLPISANRNDGIVDVFSAHSYHIAEYSRVPEKDMEGSSTMDQVVKNTQEDISWLSIWWQQFVDASMLESPESRKMHSICLRFTTIFWNLIIAPWKFLFAFVPPYNIAHGWIAFICSLIFISGIAYGVTKLTDQISCVTGVSPYVIAFTALAAGTSWPDLVASKIAAERQVTADSAIANITCSNSVNIYVGIGVPWLIDTVYNFFVYQEPLYIDNAAGLSFSLLVFFATSFGCITVLVLRRIILGAELGGPRLWAWVTSVYFMILWVVFVVFSSLRVSGVI

SEQ ID NO: 747 - DNA, 1884 bp, Sorghum bicolor
  misc_feature: Ceres ANNOT ID no. 6009937
  misc_feature: Encodes the peptide sequence at SEQ ID NO 748
atggccaccacaccggaggaattcttcgtcaaggatctcatggagcagccacctgcatccccacctgtcttccctgacgaccttccccagaggcccaataatggtagcagagacggccagcatcatgtccctaacatgatgctctcttgcatctcacgcatgcttatggaggacgacgatggcgataataagctcactgatcaccctgcgctactccaggtgcagcagccctttttgcaaatcctccgctccatttccttcgacgctaacaccgacaacagggaagggcctgatgaaggttttttgcatgaaggccatggtggcgaaagagggattaatttgcccatatccaatggtacttatgtggtgggggcatcgtccttggagtgcatggaagaagccaatatgttcttgctcaaagacaacaacttttcaaaggatgagcaggtgaatcaaatcagggaaagcagcgttattggtagtaggatcaagaaaaggtataacagggatcaccttctagaggaggaggaggaggaggtaagaagtaccagcaaagctatgatgatgatcaaggagccagaggagaaatgtggcaacgagatgcttgagaaaatgatgttacatgtctatgacacatgcatcatcaagggcatggaacgtgtcaccatcaacaacagtggcgcagataaaagaaacaagaagagtaggaggatcaaaacgacgaggaaaaatatggtcgacataggcacattgttgatctcttgtgcacaggcgctggcagtggacgatcacatgagagcgtgtgagcacctgatgcaaatcaagcaacatgcttcggccacaggcgacgccacccaacgcctagctcattgtttcaccaaggggctagaggcacgcataggggccaaagggaggcagatttggcagttgcttatgtcagagcacccctctcttgtggatttcctcaaggcctatgacctttacactaaagtttgttgctttctcaaagtgacattcattttttcaacaatgaccatcatgcaggccatggtgggtaagagcaggttgcatatcgtggattatggtatgcgttatgggttccaatgggcaggcttgctccgcttgctagcaagtagagaaggcggcccgccagaggtgaagttcactgccatagcacgccccaagtctgcatactacccaagtgagcagattgagaaaatagggtgtcggctcaagaaatacgcccatgagcttggcttccctttgttcaagttccacgcaatcatgagaaactgggaggatatttccatcatggacatgcacacagacgatgatgaggtgcttgtcgtgagtgacatgttcagtttcagtatcttgatggaagagagcatattcttcgattctcaaagccctagggatactgtcctcaataacatcaagaagatgaggccagatgtattcatccagagcgtttcaaatcgctcatatggttcctccttcttgtcacggtttcgggagatgctcttctattacatggcattgtttgacatgttggacgcaaccatcccaagggagagtaaatctcgatcggtgctagagcaagtcgtccttggatattatatttttaatgacatttcatgcgaaggcatggacatagtggaacgccctgagaaatatagacaatggcagacaagaaaccaacgggcaggcctaaggcagctgccactagaatcaagcattgtaaaggcagtggaagacgaggtcaggaagcattaccataaagactttatgatatgccaagatggacaatggcttctgcaaggatggatggggcatgtcctcgctgcccacacgacatgggtagcagacgatgcctcttcttga

SEQ ID NO: 748 - protein, 627 aa, Sorghum bicolor
  misc_feature: Ceres ANNOT ID no. 6009937
  misc_feature (223)..(530): Pfam Id: GRAS Pfam Desc: GRAS family transcription factor
  misc_feature (2)..(626): NCBI GI: 115486811 NCBI Desc: os11g0705800 [oryza sativa (japonica cultivar-group)]
  misc_feature (149)..(620): NCBI GI: 125743130 NCBI Desc: scarecrow-like protein 1 [pinus radiata]
  misc_feature (138)..(620): NCBI GI: 32813435 NCBI Desc: scarecrow-like protein [lilium longiflorum]
  misc_feature (169)..(621): NCBI GI: 15222433 NCBI Desc: scarecrow-like transcription factor 14 (scl14) [arabidopsis thaliana]
  misc_feature (141)..(620): NCBI GI: 90970946 NCBI Desc: gras1 [nicotiana tabacum]
  misc_feature: The sequence is a functional homolog of SEQ ID NO 1938 in the 10/412,699US patent application
  misc_feature: The sequence is a functional homolog of SEQ ID NO 2202 in the 10/374,780US patent application
  misc_feature: Useful for making plants with modulated growth and phenotype characteristics
  misc_feature: The sequence is a functional homolog of SEQ ID NO 1938 in the 20040045049 US patent application
MATTPEEFFVKDLMEQPPASPPVFPDDLPQRPNNGSRDGQHHVPNMMLSCISRMLMEDDDGDNKLTDHPALLQVQQPFLQILRSISFDANTDNREGPDEGFLHEGHGGERGINLPISNGTYVVGASSLECMEEANMFLLKDNNFSKDEQVNQIRESSVIGSRIKKRYNRDHLLEEEEEEVRSTSKAMMMIKEPEEKCGNEMLEKMMLHVYDTCIIKGMERVTINNSGADKRNKKSRRIKTTRKNMVDIGTLLISCAQALAVDDHMRACEHLMQIKQHASATGDATQRLAHCFTKGLEARIGAKGRQIWQLLMSEHPSLVDFLKAYDLYTKVCCFLKVTFIFSTMTIMQAMVGKSRLHIVDYGMRYGFQWAGLLRLLASREGGPPEVKFTAIARPKSAYYPSEQIEKIGCRLKKYAHELGFPLFKFHAIMRNWEDISIMDMHTDDDEVLVVSDMFSFSILMEESIFFDSQSPRDTVLNNIKKMRPDVFIQSVSNRSYGSSFLSRFREMLFYYMALFDMLDATIPRESKSRSVLEQVVLGYYIFNDISCEGMDIVERPEKYRQWQTRNQRAGLRQLPLESSIVKAVEDEVRKHYHKDFMICQDGQWLLQGWMGHVLAAHTTWVADDASS

SEQ ID NO: 749 - DNA, 1746 bp, Sorghum bicolor
  misc_feature: Ceres ANNOT ID no. 6009958
  misc_feature: Encodes the peptide sequence at SEQ ID NO 750
atggaccagcgcgcgcggagggcgcgggagagggagcagcgccgcctgctcgacctcgccgtcgagtccggcttcgaccgcgacctcgccgccagctgcctcgcccgcctcctcgaggtctacggggaggatggcctggctttggttactgtcgagaactgtggcaatgatttccttgcgtcgctggctgatgccacacaacctaccgatgactgggacgatctcaaagggattgagaccgaagcatgtggcaacctgaatgatatgatgatgaagaatgtgactgactgtactggaggagttgctatggacaacagtcatacgtccagagagccaaatttgtcctctgatgctctggatcattctgaagatttcgattttgtgactagggctaccaacagatatgagtcaatgactcccacttcaaatagagagatgcctccagctgcatttcatcaaaggagagaagttctgagctatgaacaactttgtggccttgatgatgtcaattttgccaatgttgtcatctttggcaacaaaagctttaggcccctgcagtatgaagcttgcagggctgcaatgaataatcaagactgtttcatacttatgccaactggtggtgggaagagtttgtgttaccagctccctgcaacattgcacccaggtgtcactgttgttgtaagcccactactgtcgctgatccaggatcagattgtggcattaacttacaagtttgcgataccagcagcatttttaaattcccagcaaactcctgctcaggcatctgcagtaatccaagagctaagatatggcacaccatccttcaaacttctgtatgttactcctgaaagaattgctgcgaactattcatttatggagatgttaagaggcttagatcagaggggactgttagcaagatttgtgattgatgaagcacattgtgtaagtcagtgggggcacgatttccgtccagattatcgtggtctagggtgcctcaagcagaactttcctagggtcccaattatggctttaactgcaacagcaactgaatctgtccgtaaggacgtccttagtgccttgaggatccctaatgctgtgatactgaagaggagctttgatagactgaatctcaattatgaggtgattggcaagacgaaaactccccagaagcagctgggtgatctcctgaaagagcgcttcatgaacaaatctggtatcgtgtactgcctctcgaagaacgaatgtgcagacactgccaagtttttgagggagaaatacaagatcaaatgtgcacactaccatgctggcttggcagctcgtcagcgaaccagcgtccaagagaaatggcacagcggggaggttaaagtcatctgcgccaccatagccttcggcatggggatcgacaaacctgatgtgcgttttgttatccacaacacaatgtcaaaatcaatagaaagctactatcaggagtccgggagggcagggagagatgacctcccagcacattgtattgtcttataccagaagaaagacttcagccgtatcgtgtgcatgttgaggaacgctgacaacttcaagagtgagagcttcaaggttgcgatggagcaagctaagaagatgcaaacatactgcgagctgaagaccgagtgtcggagacaggcacttctagagcacttcggcgaacagtacaacaggcaaaggtgcagagacggccctagcccctgcgacaactgcctgaagacatag

SEQ ID NO: 750 - protein, 581 aa, Sorghum bicolor
  misc_feature: Ceres ANNOT ID no. 6009958
  misc_feature (183)..(356): Pfam Id: DEAD Pfam Desc: DEAD/DEAH box helicase
  misc_feature (422)..(498): Pfam Id: Helicase_C Pfam Desc: Helicase conserved C-terminal domain
  misc_feature (19)..(578): NCBI GI: 10944747 NCBI Desc: dna helicase [arabidopsis thaliana]
  misc_feature (168)..(578): NCBI GI: 11121449 NCBI Desc: dna helicase [arabidopsis thaliana]
  misc_feature (168)..(578): NCBI GI: 33589672 NCBI Desc: at1g10930 [arabidopsis thaliana]
  misc_feature (168)..(580): NCBI GI: 92885226 NCBI Desc: atp-requiring dna helicase recq [medicago truncatula]
  misc_feature (173)..(578): NCBI GI: 11121451 NCBI Desc: dna helicase [arabidopsis thaliana]
  misc_feature: Useful for making plants with altered Lignin content
  misc_feature: Useful for making plants with altered terpenoid content
  misc_feature: Functional homolog of the protein sequence given in SEQ ID NO 13152
MDQRARRAREREQRRLLDLAVESGFDRDLAASCLARLLEVYGEDGLALVTVENCGNDFLASLADATQPTDDWDDLKGIETEACGNLNDMMMKNVTDCTGGVAMDNSHTSREPNLSSDALDHSEDFDFVTRATNRYESMTPTSNREMPPAAFHQRREVLSYEQLCGLDDVNFANVVIFGNKSFRPLQYEACRAAMNNQDCFILMPTGGGKSLCYQLPATLHPGVTVVVSPLLSLIQDQIVALTYKFAIPAAFLNSQQTPAQASAVIQELRYGTPSFKLLYVTPERIAANYSFMEMLRGLDQRGLLARFVIDEAHCVSQWGHDFRPDYRGLGCLKQNFPRVPIMALTATATESVRKDVLSALRIPNAVILKRSFDRLNLNYEVIGKTKTPQKQLGDLLKERFMNKSGIVYCLSKNECADTAKFLREKYKIKCAHYHAGLAARQRTSVQEKWHSGEVKVICATIAFGMGIDKPDVRFVIHNTMSKSIESYYQESGRAGRDDLPAHCIVLYQKKDFSRIVCMLRNADNFKSESFKVAMEQAKKMQTYCELKTECRRQALLEHFGEQYNRQRCRDGPSPCDNCLKT

SEQ ID NO: 751 - DNA, 348 bp, Sorghum bicolor
  misc_feature: Ceres ANNOT ID no. 6009977
  misc_feature: Encodes the peptide sequence at SEQ ID NO 752
atgagcaccatgaggttctgccgtgaatgcaacaacatactgtatccaaaggaggacagggcgaacaaggtgcttctctacgcctgcaggaactgcgagcatcaggaggtggcggacagcaactgcgtgtaccggaacgtggtggaccacgacgccggcgagctcacgcaggtgctgtccgaggacgtggcctccgaccccacgctgccacgcaccaagtccgtccgttgcgccgcctgcggccatggcgaggccgtcttcttccaggcgacgacgagaggcgaggacggcatggcgctcttcttcgtttgctgcaaccccagctgcggccaccgatggagggactga

SEQ ID NO: 752 - protein, 115 aa, Sorghum bicolor
  misc_feature: Ceres ANNOT ID no. 6009977
  misc_feature (4)..(58): Pfam Id: RNA_POL_M_15KD Pfam Desc: RNA polymerases M/15 Kd subunit
  misc_feature (1)..(115): NCBI GI: 87240462 NCBI Desc: dna-directed rna polymerase, subunit c11/m/9 [medicago truncatula]
  misc_feature (11)..(115): NCBI GI: 115489060 NCBI Desc: os12g0560400 [oryza sativa (japonica cultivar-group)]
  misc_feature (4)..(115): NCBI GI: 38541317 NCBI Desc: polr2i protein [mus musculus]
  misc_feature (4)..(115): NCBI GI: 5453930 NCBI Desc: dna directed rna polymerase ii polypeptide i [homo sapiens]
  misc_feature (4)..(115): NCBI GI: 46396569 NCBI Desc: dna-directed rna polymerase ii 14.5 kda polypeptide (rpb9) (rpb14.5)
  misc_feature (4)..(115): SWISSPROT Homolog: EC 2.7.7.6 DNA-directed RNA polymerase II subunit I
  misc_feature: Useful for making plants with altered Lignin content
  misc_feature: GREAT-hit functional homolog of the protein sequence given in SEQ ID NO 12917
  misc_feature: Useful for making plants with altered lignin content
  misc_feature: Functional homolog of the protein sequence given in SEQ ID NO 12917
MSTMRFCRECNNILYPKEDRANKVLLYACRNCEHQEVADSNCVYRNVVDHDAGELTQVLSEDVASDPTLPRTKSVRCAACGHGEAVFFQATTRGEDGMALFFVCCNPSCGHRWRD

SEQ ID NO: 753 - DNA, 2340 bp, Sorghum bicolor
  misc_feature: Ceres ANNOT ID no. 6010035
  misc_feature: Encodes the peptide sequence at SEQ ID NO 754
  misc_feature: Up-regulated in shoot tissues in response to salicylic acid treatment
  misc_feature: Up-regulated in root tissues in response to salicylic acid treatment
atggcgtcgatgtcagacagcgagacgacaaaccggggcagcatgtgggaactagatcagaaccttgatcagcccatggacgaggaggccagtcagctgaagaacatgtacagagaaaagaaattttcgtcaattttgttactgcggctcgcatttcaaagcctcggggtagtatttggtgacttgggtacatcaccattgtatgttttctataatatctttccacatggtgttgacgaagatgaggatgtaattggagctctatccttgatcatttacacactcactctcatccctctgatgaagtatgtttttgtcgtcttgcgagctaatgataatggtcaaggtggcacatttgctctttattctctgctgtgccggcatgcaaaggtcagcactatacccaaccaacataagacagacgaagaattaacaacttatagtcggcaaacttatgaggagaattcacttgcagcaaaagtgaagaaatggctagaggggcatgcatataaaaagaactgtcttcttattcttgttctcattggtacctgtaccgccattggagatgggatccttactcctgcaatctcagttctttcagcagcaggtggaataagggttcagaatcagaatatgagtacagatgtggttgtaatcgtcgcagtgatcatattaattggcttattctgcatgcaacactatgggacagataaagttgggtggctctttgcaccattggtgctcctttggtttattctaattgggagcgttgggttagtgaacatacacaaatacaacagttctgttctaaaagcatataacccggtctacaccttccggtattttagacggggcaagtctgagatttggacatctcttggaggggtcatgcttagcatcacagggactgaagcattgtatgctgatctatgtcacttccctgtactggctattcagattgcgttcaccttagtggtgttcccttgccttctactggcgtacactgggcaggctgcctacattattgaccacaaggatcatgtagttgatgccttctaccgctccattccagaggcaatatactggccagccttcatcatagcaactcttgcggcagtagttgcaagtcaagcaaccatatctgccacctactcaataattaagcaagctcttgcactgggctgtttcccccgtgtcaatgttgtgcatacctcaaagaaatttctggggcagatttacatccctgacatcaattgggtacttatgattctttgcattgctgtaactgctggattcaagaatcaaagccagataggaaatgcatatggcactgcagtggtgattgttatgctagttacaacatttctcatgatcccagtgatgctgctggtatggaagagccactggatacttgttgtcatcttccttgtactctccttgacggttgagctcccatacttcacggcctgcataaataaagtggatcaaggtggctgggttccactagtcatcgcaataaccttcttcgtcatcatgtacgtgtggcatttctgcaccgtgaagcgctatgaatttgagatgcacagcaaggtctctatggcttggattctgggactggggccaagccttggccttgtcagggtccctgggataggctttgtgtacacggagctggcaagtggcgtcccgcacatcttctctcatttcatcaccaacctccctgccatccactcagttgttgtcttcgtttgcgtcaagtacctcccggtatatacagtgccagccgaggaacggttcatcatgaagcggattgggccaaagaactaccacatgttccgttgcgtcgcgagatatggatacaaggacatccacaagaaagatgacaactttgagaagatgctcctcgacaggctcctgatatttgtcagactggagagcatgatggatggctactctgactccgaggacttcaccattatggagcagaagctgatcgagaaggctgggggcaacacactgagctccatcggtgacctgagctactcatcacaggactccatcgttccagccaagtcgcccctgacagggaacagcctgacaaggtactcaagccagacattcggcgacgagctggagttcctgaaccggtgcaaggacgcaggcgtcgtgcacatccttgggaacacggtcgtgcaggcgcgcagggactcggggttcgtgaagaaggttgctgtgaattatgtgtatgccttccttaggaagctgtgcagagagaacagtgtgatcttcaatgtcccacatgaaagcctcctgaatgtagggcagatatactatatatga

SEQ ID NO: 754 - protein, 779 aa, Sorghum bicolor
  misc_feature: Ceres ANNOT ID no. 6010035
  misc_feature (49)..(779): Pfam Id: K_trans Pfam Desc: K+ potassium transporter
  misc_feature (1)..(779): NCBI GI: 82592898 NCBI Desc: probable potassium transporter 11 (oshak11)
  misc_feature (1)..(779): NCBI GI: 113565430 NCBI Desc: os04g0613900 [oryza sativa (japonica cultivar-group)]
  misc_feature (186)..(779): NCBI GI: 38568028 NCBI Desc: osjnba0070c17.23 [oryza sativa (japonica cultivar-group)]
  misc_feature (4)..(779): NCBI GI: 79324347 NCBI Desc: kup11; potassium ion transporter [arabidopsis thaliana]
  misc_feature (159)..(779): NCBI GI: 115475283 NCBI Desc: os08g0206400 [oryza sativa (japonica cultivar-group)]
  misc_feature: Up-regulated in shoot tissues in response to salicylic acid treatment
  misc_feature: Up-regulated in root tissues in response to salicylic acid treatment
  misc_feature: The sequence is a functional homolog of SEQ ID NO. 279 in the 11/188,298 US application
MASMSDSETTNRGSMWELDQNLDQPMDEEASQLKNMYREKKFSSILLLRLAFQSLGVVFGDLGTSPLYVFYNIFPHGVDEDEDVIGALSLIIYTLTLIPLMKYVFVVLRANDNGQGGTFALYSLLCRHAKVSTIPNQHKTDEELTTYSRQTYEENSLAAKVKKWLEGHAYKKNCLLILVLIGTCTAIGDGILTPAISVLSAAGGIRVQNQNMSTDVVVIVAVIILIGLFCMQHYGTDKVGWLFAPLVLLWFILIGSVGLVNIHKYNSSVLKAYNPVYTFRYFRRGKSEIWTSLGGVMLSITGTEALYADLCHFPVLAIQIAFTLVVFPCLLLAYTGQAAYIIDHKDHVVDAFYRSIPEAIYWPAFIIATLAAVVASQATISATYSIIKQALALGCFPRVNVVHTSKKFLGQIYIPDINWVLMILCIAVTAGFKNQSQIGNAYGTAVVIVMLVTTFLMIPVMLLVWKSHWILVVIFLVLSLTVELPYFTACINKVDQGGWVPLVIAITFFVIMYVWHFCTVKRYEFEMHSKVSMAWILGLGPSLGLVRVPGIGFVYTELASGVPHIFSHFITNLPAIHSVVVFVCVKYLPVYTVPAEERFIMKRIGPKNYHMFRCVARYGYKDIHKKDDNFEKMLLDRLLIFVRLESMMDGYSDSEDFTIMEQKLIEKAGGNTLSSIGDLSYSSQDSIVPAKSPLTGNSLTRYSSQTFGDELEFLNRCKDAGVVHILGNTVVQARRDSGFVKKVAVNYVYAFLRKLCRENSVIFNVPHESLLNVGQIYYI

SEQ ID NO: 755 - DNA, 1803 bp, Sorghum bicolor
  misc_feature: Ceres ANNOT ID no. 6010036
  misc_feature: Encodes the peptide sequence at SEQ ID NO 756
atgccgctttatctcgtctcctctcccgccgccgccaagctcgccgcaggaggcccacacgcacccccgcaccggcggcgccacctcctcttccgagctccccaccgccccagccgccgcgccccactgctgtcttcggccgctgagcgtccggcagggcgcgccatggctgctgcggagaccggagcgtccacggcgaccgattccaggctcagagctacaggagtgaagcaagcactgatatcattatcagataaaacagacctggctaatcttggaaatggtcttcagcgtttggggttttctattatttccactggtggcacggcatcaagtttggaagcatctggagttaatgttacaaaagttgaagaaattacacactttcctgaaatgcttgatggtagagtaaaaacattgcaccccagtatacatggtggtattcttgcgcgaagagaccaggagcatcatctgaaagcactgaaagagcatggcattggaacatttgatgtggttgtagtgaatttgtacccgttctatgataaggtcacctcaggtgcaatatcttttgaggatggcattgaaaatattgatattggtgggcctacattgatccgagctgctgccaagaatcataaggatgttcttgttgttgttgatcataaagattatcctgctctattggaatatctagaagggaaacaagatgaccctcatttccgtaggacacttgcatggaaagctttccaacatgttgcttcttatgattcagctgtctcagagtggttgtggaagcaatcaaataaagaagatccatttcctcccagctttactgtgcccctcacaatgaagtctacactccgttatggagaaaatcctcatcaaaaggctgccttttatggtgacaagagtctttctctagtaaatgctggtggtattgcaacagcaattcaacaccatggaaaggaaatgtcttacaacaattatttggatgcggatgctgcatggaactgtgtctcggagtttgagagcccgacttgtgttgtggttaagcacacaaatccgtgtggggtagcgtctcgacaggacatccttgaagcatacaggttggctgtgaagggagaccctgtcagcgcatttggcggcatagttgccttcaataggacgatcgatgaggatcttgcaagggaaatccgtgagttcaggagccccacggatggcgagacaaggatgttctacgagattgtggttgcgcctgggtacacagagaagggcctggaggtcctgaaagggaaatccaagacgctgaggatactggaggcgaagaggagcgggaaaggaatgctgtcgctgcgacaggtgactggcggctggttggctcaggagtccgatgatatgaccccggaagacatcaccttcacaaagatgtccgagaggagtcttgaggacagtgagctttcggacgcgaaattcgcgtgcctctgcgtcaagcacgtcaagagcaatgccattgtgatcgccaagaacaattgcatgctgggcatgggcagtggccagccgaaccggcgggaaagcctgaggattgctttcaagaaggcaggagaggaggccaagggagctgctttggccagcgatgcctttttcccgtttgcttggaacgatgcagtggaggaggcgtgccagagcggcatcgcggtgatcgcggagcccggcggcagcatccgggaccaggacgccgtggactgctgcaacaagtacggtgtggccctcgtcttcaccggcatccggcacttcaaacactga

SEQ ID NO: 756 - protein, 600 aa, Sorghum bicolor
  misc_feature: Ceres ANNOT ID no. 6010036
  misc_feature (208)..(533): Pfam Id: AICARFT_IMPCHas Pfam Desc: AICARFT/IMPCHase bienzyme
  misc_feature (88)..(203): Pfam Id: MGS Pfam Desc: MGS-like domain
  misc_feature (57)..(600): NCBI GI: 11878280 NCBI Desc: phosphoribosylaminoimidazolecarboxamide formyltransferase/imp cyclohydrolase [nicotiana tabacum]
  misc_feature (12)..(600): NCBI GI: 28412960 NCBI Desc: aminoimidazolecarboximide ribonucleotide transformylase/inosine monophosphate cyclohydrolase [vigna unguiculata]
  misc_feature (74)..(600): NCBI GI: 140039558 NCBI Desc: aicarft/impchase bienzyme; mgs-like [medicago truncatula]
  misc_feature (78)..(600): NCBI GI: 73749102 NCBI Desc: phosphoribosylaminoimidazolecarboxamide formyltransferase [dehalococcoides sp. cbdb1]
  misc_feature (78)..(600): NCBI GI: 88932938 NCBI Desc: aicarft/impchase bienzyme [dehalococcoides sp. bav1]
MPLYLVSSPAAAKLAAGGPHAPPHRRRHLLFRAPHRPSRRAPLLSSAAERPAGRAMAAAETGASTATDSRLRATGVKQALISLSDKTDLANLGNGLQRLGFSIISTGGTASSLEASGVNVTKVEEITHFPEMLDGRVKTLHPSIHGGILARRDQEHHLKALKEHGIGTFDVVVVNLYPFYDKVTSGAISFEDGIENIDIGGPTLIRAAAKNHKDVLVVVDHKDYPALLEYLEGKQDDPHFRRTLAWKAFQHVASYDSAVSEWLWKQSNKEDPFPPSFTVPLTMKSTLRYGENPHQKAAFYGDKSLSLVNAGGIATAIQHHGKEMSYNNYLDADAAWNCVSEFESPTCVVVKHTNPCGVASRQDILEAYRLAVKGDPVSAFGGIVAFNRTIDEDLAREIREFRSPTDGETRMFYEIVVAPGYTEKGLEVLKGKSKTLRILEAKRSGKGMLSLRQVTGGWLAQESDDMTPEDITFTKMSERSLEDSELSDAKFACLCVKHVKSNAIVIAKNNCMLGMGSGQPNRRESLRIAFKKAGEEAKGAALASDAFFPFAWNDAVEEACQSGIAVIAEPGGSIRDQDAVDCCNKYGVALVFTGIRHFKH

SEQ ID NO: 757 - DNA, 159 bp, Sorghum bicolor
  misc_feature: Ceres ANNOT ID no. 6010037
  misc_feature: Encodes the peptide sequence at SEQ ID NO 758
atggtgacggaggcccgggtgtgcatgggcaagagccagcaccactcgttcccctgcatctccgaccgcctctgcagcaacgagtgcgtcaaggaggagggcggctggaccgccggatactgccacctccgctactgcaggtgccagaaggcatgctaa

SEQ ID NO: 758 - protein, 52 aa, Sorghum bicolor
  misc_feature: Ceres ANNOT ID no. 6010037
  misc_feature (6)..(52): Pfam Id: Gamma-thionin Pfam Desc: Gamma-thionin family
  misc_feature (6)..(52): NCBI GI: 1173436 NCBI Desc: small protein inhibitor of insect alpha-amylases 1 (si alpha-1)
  misc_feature (6)..(52): NCBI GI: 2501197 NCBI Desc: gamma-zeathionin 2
  misc_feature (6)..(52): NCBI GI: 7451437 NCBI Desc: gamma-thionin si-alpha-1 - sorghum
  misc_feature (2)..(52): NCBI GI: 790641 NCBI Desc: gamma-thionin
  misc_feature (6)..(52): NCBI GI: 134486 NCBI Desc: small protein inhibitor of insect alpha-amylases 2 (si alpha-2)
MVTEARVCMGKSQHHSFPCISDRLCSNECVKEEGGWTAGYCHLRYCRCQKAC

SEQ ID NO: 759 - DNA, 1467 bp, Sorghum bicolor
  misc_feature: Ceres ANNOT ID no. 6010042
  misc_feature: Encodes the peptide sequence at SEQ ID NO 760
atgacggagatggtggtggcggctcgggcgccggccccggcggcggggaggtggggcgcggcgccgccgcaggagctactggagaggctcaaggactacggccaggagggcgccttcgccttctgggacgagctcgcgcccgaggagcgcgaccacctcatccgggacattgagagcctagatcttcctaggattgatcggattgtccgatgctcgcttagatcacaaggtgctcctgtaccaacctttgagcctgtgccggagtcaagtgtctccacggtggatgacagaactcctgaggacaaagaaaggtggtggaggaggggcttgagagccatttcagaggggaagttagctgttgttttgttggctggtggccaggggactaggcttggcagttctgaccctaagggatgtttcagtatcgggcttccatctaggaagtcacttttccaactacaagctgaacggattttgtgtattcagaagctggctgctcaatgcactgacgccccaggtagcacagtgccaattcactggtatataatgactagtccctttaccgatgaagcgacccgaaagttctttgaaacccacagatattttggtttagagcctaatcaagtgacatttttccagcagggtactgttccatgtgtatctcatgatggaagatttattatggagacaccatacaaggtagcaaaggctcccgatggcaatggtggagtatatgctgctctaaaatctaaaaggttgctcgatgatatggctgcaaaaggtgttaagtatgtagattgctatggagttgataatgtattggtccgtgttgcagatccaacattcctaggatactttattgacagaggtgcatctgctgctgctaaggttgtcaggaaggcatatccacaagagaaagttggagtatttgttcagcgtggaaagggtggacccctctctgtagttgaatacagtgaaatggatgcagctatgacaactgaaatcaatcaaactactggtcgccttcgttattgctggagcaatgtctgcttgcatatgttcactttggattttctgaaccaagtgacaaacagtcttgaaaaggataccgagaagagaattccttcagtccatgggtacacatcaggcttaaagcttgaacaatttatatttgatgtgttcaactattctccttcgacagctctttttgaggttttgcgtgaggaggaatttgcgccagtgaagaatgctaatggtgcaacttatgacactcctgatagtgccaggttaatgctgcttcggcttcatagccgatgggtggttgctgcaggtggcttcttgactcattctgtgcccttgtatatgacaggagttgaagtttctccgctttgttcttatgctggagagaatctagaagccatatgcagaggaagaacattccatgcaccaagtgagatttcattctag

SEQ ID NO: 760 - protein, 488 aa, Sorghum bicolor
  misc_feature: Ceres ANNOT ID no. 6010042
  misc_feature (61)..(472): Pfam Id: UDPGP Pfam Desc: UTP--glucose-1-phosphate uridylyltransferase
  misc_feature (1)..(488): NCBI GI: 115460514 NCBI Desc: os04g0613700 [oryza sativa (japonica cultivar-group)]
  misc_feature (2)..(487): NCBI GI: 15450739 NCBI Desc: at1g31070/f17f8_1 [arabidopsis thaliana]
  misc_feature (2)..(487): NCBI GI: 9755397 NCBI Desc: f17f8.1 [arabidopsis thaliana]
  misc_feature (171)..(483): NCBI GI: 38568026 NCBI Desc: osjnba0070c17.21 [oryza sativa (japonica cultivar-group)]
  misc_feature (228)..(487): NCBI GI: 19699170 NCBI Desc: at1g31070/f17f8_1 [arabidopsis thaliana]
  misc_feature: The sequence is a functional homolog of SEQ ID NO. 445 in the 11/188,298 US application
MTEMVVAARAPAPAAGRWGAAPPQELLERLKDYGQEGAFAFWDELAPEERDHLIRDIESLDLPRIDRIVRCSLRSQGAPVPTFEPVPESSVSTVDDRTPEDKERWWRRGLRAISEGKLAVVLLAGGQGTRLGSSDPKGCFSIGLPSRKSLFQLQAERILCIQKLAAQCTDAPGSTVPIHWYIMTSPFTDEATRKFFETHRYFGLEPNQVTFFQQGTVPCVSHDGRFIMETPYKVAKAPDGNGGVYAALKSKRLLDDMAAKGVKYVDCYGVDNVLVRVADPTFLGYFIDRGASAAAKVVRKAYPQEKVGVFVQRGKGGPLSVVEYSEMDAAMTTEINQTTGRLRYCWSNVCLHMFTLDFLNQVTNSLEKDTEKRIPSVHGYTSGLKLEQFIFDVFNYSPSTALFEVLREEEFAPVKNANGATYDTPDSARLMLLRLHSRWVVAAGGFLTHSVPLYMTGVEVSPLCSYAGENLEAICRGRTFHAPSEISF

SEQ ID NO: 761 - DNA, 1308 bp, Sorghum bicolor
  misc_feature: Ceres ANNOT ID no. 6010048
  misc_feature: Encodes the peptide sequence at SEQ ID NO 762
atgcgccgcttcctccaagccgtccgcccgctccaaaccctatccctcaacccctctgccggtacccccacccctctccgcctcctctcgtcctcctcggcggccgcgtcctcggactccgactccgccccagccccggtcccggctgccgatgccgacttcgacagcgccgagtacgccctcccgaccccgggccccgccccctcccgaaaaatcaacaacccggtcgccgcgacgaggaagctccggttcgacccctccctccgcgcgcgcgccgacgaggcgctctttggtaaggggatgggcgcggcggccgttgaggaggaggacgaggaccgctcgcgggacgtggcgctcgcgctgctcgatgccgcgatggagccgcccgacgaggatgaagaggatttcggggaggtcaggcaagaagaccagatgtcgctttccgttggcattgtcggcgcgcccaacgccggcaagtcctcgctcacaaataccatggttgggacaaaagtggctgcagtctcccgcaagacaaatactacgactcacgaaattttgggggtgctaacaaaagggaacacacagatatgcttttttgacaccccagggctcatgttagggcaccatggatttccttatagggatgtcacagttcgtgtggagagtgcctggagctcaattaacctctatgatttactaatagtcatgttcgatgtcaataggcatcttactctgcctgattcacgtgtcataaaattaatcaaacgtttgggtatggaggtgaacccaaaccagaggcgtatattgtgcatgaataaggttgacctggtgaaagacaagaaggacctccttaaagttgcaaaagaatttgaagatcttcctggatatgaaaggtacttcatggtatctgggctaaaaggcaagggagtgaaagaccttgtacagtacttgatggaccaggcagtaagaagaccttgggatgaagaaccaactgtaatgactgaagaggtaatgaaaacaatatcattggaggttgtgcgggagaagatgctgcatcacatccaccaagaaatcccctatgtaattgagcatcgtctgatgggttggaaggagctaaaagatggttctcttagggtggaacagcacttcattgcaccaaagcaaagccaacgtcagattcttgttggtaaaaatggctctaagatagggagaatcggtattgaagccaatgaagaactgaggtccatattcaagagagatgtccatctaattctccaagttagagttgcgaaaaggagaaatgcttga

SEQ ID NO: 762 - protein, 435 aa, Sorghum bicolor
  misc_feature: Ceres ANNOT ID no. 6010048
  misc_feature (147)..(275): Pfam Id: MMR_HSR1 Pfam Desc: GTPase of unknown function
  misc_feature (144)..(323): Pfam Id: GTP_EFTU Pfam Desc: Elongation factor Tu GTP binding domain
  misc_feature (148)..(275): Pfam Id: Miro Pfam Desc: Miro-like protein
  misc_feature (49)..(429): NCBI GI: 53850539 NCBI Desc: at1g30960 [arabidopsis thaliana]
  misc_feature (5)..(429): NCBI GI: 3676069 NCBI Desc: erg protein [antirrhinum majus]
  misc_feature (33)..(403): NCBI GI: 3676071 NCBI Desc: erg protein [arabidopsis thaliana]
  misc_feature (149)..(429): NCBI GI: 15888378 NCBI Desc: agr_c_1909p [agrobacterium tumefaciens str. c58]
  misc_feature (149)..(429): NCBI GI: 25294158 NCBI Desc: gtp-binding protein, era family atu1036 [imported] - agrobacterium tumefaciens (strain c58, dupont)
MRRFLQAVRPLQTLSLNPSAGTPTPLRLLSSSSAAASSDSDSAPAPVPAADADFDSAEYALPTPGPAPSRKINNPVAATRKLRFDPSLRARADEALFGKGMGAAAVEEEDEDRSRDVALALLDAAMEPPDEDEEDFGEVRQEDQMSLSVGIVGAPNAGKSSLTNTMVGTKVAAVSRKTNTTTHEILGVLTKGNTQICFFDTPGLMLGHHGFPYRDVTVRVESAWSSINLYDLLIVMFDVNRHLTLPDSRVIKLIKRLGMEVNPNQRRILCMNKVDLVKDKKDLLKVAKEFEDLPGYERYFMVSGLKGKGVKDLVQYLMDQAVRRPWDEEPTVMTEEVMKTISLEVVREKMLHHIHQEIPYVIEHRLMGWKELKDGSLRVEQHFIAPKQSQRQILVGKNGSKIGRIGIEANEELRSIFKRDVHLILQVRVAKRRNA

SEQ ID NO: 763 - DNA, 1335 bp, Sorghum bicolor
  misc_feature: Ceres ANNOT ID no. 6010050
  misc_feature: Encodes the peptide sequence at SEQ ID NO 764
  misc_feature: Up-regulated in shoot tissues in response to methyl jasmonate treatment
  misc_feature: Up-regulated in shoot tissues in response to salicylic acid treatment
atgccatcccacgcggctataaagcgcgcccgcggccccgactcccctcacgaatcatcccatatctcattcccattccccaaacgaaatccgccgcagcccagcgctcctccgatccttcccctctcggtctcggtctcgtctcggcatttccaaatccttgcaacggacgcaggagctcagtgctcctcctcccagatctccgatatcccgatggctcccacggtggcggcggaggcggcggcggccaaggggcagctgcagcacacggggaaggcggtggggctcgccgcgcacgacgcgtccggccacctcgcgccgctcaccatcacccgcaggagcactggagacgatgatgtagcgataaagatcctgttctgtgggatgtgccactctgacctgcacagcatcaagaacgagtggggcaacgccatgtaccccatggtccctggccacgagatcgccggagtggtgacggaggtgggcaagaacgtgacgaggttcaaccccggcgaccgcgtcggcgtgggctgcatggtgaactcgtgccagtcgtgcgacggctgcgccgagggcttcgagaacacctgcggcggcggcatcatcttcacctacaactccgtcgaccgcgacggcaccgtgacctacggcggctactcgagcagcgtcacggtgcacgagcggttcgtggtgcggttccccgacgggatgccgctggaccgcggcgcgccgctgctgtgcgccggcatcaccgtgtacagccccatgaagtaccacggcctgaacaagcccgggaagcacgtcggcgtgctggggctgggcggccttggccacgtcgccgtcaagctcgccaaggcggcgttcgggatgaaggtcaccgtcatcagcacgtcgccggggaagaagcaggaggccatggaccggctcggcgccgacgccttcgtcgtcagtaaggacgccgaggagatgaaggcggcggcgagcaccatggatggcatcatcaacacggtgtccgccaacatccccctggcgccgttcatgagcctgctcaagcccaacggcaagatgatcatggtcggcctgcccaccaaggctctcgagatcccgccgtttgatctcatcatggggaacaagaccctggcggggagctgcatcggcggcatgagggacacgcaggagatgctcgacgtggcggccaagcacggcgtgacggcggacatagagctggtggacgccgactacgtgaacacggccatggagcgcctcgccaaggctgacgtcaggtaccgcttcgtcatcgacatcggcaacaccctcaagaatgcagatcagtga

SEQ ID NO: 764 - protein, 444 aa, Sorghum bicolor
  misc_feature: Ceres ANNOT ID no. 6010050
  misc_feature (117)..(233): Pfam Id: ADH_N Pfam Desc: Alcohol dehydrogenase GroES-like domain
  misc_feature (264)..(400): Pfam Id: ADH_zinc_N Pfam Desc: Zinc-binding dehydrogenase
  misc_feature (72)..(441): NCBI GI: 19849248 NCBI Desc: cinnamyl alcohol dehydrogenase [lolium perenne]
  misc_feature (27)..(442): NCBI GI: 115482132 NCBI Desc: os10g0430200 [oryza sativa (japonica cultivar-group)]
  misc_feature (93)..(374): NCBI GI: 115475644 NCBI Desc: os08g0270400 [oryza sativa (japonica cultivar-group)]
  misc_feature (72)..(441): NCBI GI: 115460496 NCBI Desc: os04g0612700 [oryza sativa (japonica cultivar-group)]
  misc_feature (72)..(324): NCBI GI: 38568021 NCBI Desc: osjnba0070c17.13 [oryza sativa (japonica cultivar-group)]
  misc_feature (82)..(443): SWISSPROT Homolog: EC 1.1.1.255 Mannitol dehydrogenase
  misc_feature (85)..(444): SWISSPROT Homolog: EC 1.1.1.195 Cinnamyl alcohol dehydrogenase 2
  misc_feature (97)..(435): SWISSPROT Homolog: EC 1.1.1.2 NADP-dependent alcohol dehydrogenase C
  misc_feature: Useful for making plants with altered cell wall content and/or composition
  misc_feature: Functional homolog of the protein sequence encoded by LOCUS at2g21730
  misc_feature: GREAT-hit functional homolog of the protein sequence encoded by LOCUS at4g37980
  misc_feature: GREAT-hit functional homolog of the protein sequence encoded by LOCUS at4g37990
  misc_feature: Functional homolog of the protein sequence encoded by LOCUS at4g39330
  misc_feature: The sequence is a functional homolog of SEQ ID NO 2 in US patent 7288696
  misc_feature: Useful for making plants with altered cell wall content and/or composition
  misc_feature: Functional homolog of the protein sequence given in SEQ ID NO 13997
  misc_feature: Up-regulated in shoot tissues in response to methyl jasmonate treatment
  misc_feature: Up-regulated in shoot tissues in response to salicylic acid treatment
  misc_feature: The sequence is a functional homolog of SEQ ID NO. 530 in the 11/188,298 US application
MPSHAAIKRARGPDSPHESSHISFPFPKRNPPQPSAPPILPLSVSVSSRHFQILATDAGAQCSSSQISDIPMAPTVAAEAAAAKGQLQHTGKAVGLAAHDASGHLAPLTITRRSTGDDDVAIKILFCGMCHSDLHSIKNEWGNAMYPMVPGHEIAGVVTEVGKNVTRFNPGDRVGVGCMVNSCQSCDGCAEGFENTCGGGIIFTYNSVDRDGTVTYGGYSSSVTVHERFVVRFPDGMPLDRGAPLLCAGITVYSPMKYHGLNKPGKHVGVLGLGGLGHVAVKLAKAAFGMKVTVISTSPGKKQEAMDRLGADAFVVSKDAEEMKAAASTMDGIINTVSANIPLAPFMSLLKPNGKMIMVGLPTKALEIPPFDLIMGNKTLAGSCIGGMRDTQEMLDVAAKHGVTADIELVDADYVNTAMERLAKADVRYRFVIDIGNTLKNADQ

SEQ ID NO: 765 - DNA, 804 bp, Sorghum bicolor
  misc_feature: Ceres ANNOT ID no. 6010068
  misc_feature: Encodes the peptide sequence at SEQ ID NO 766
atggatccgaagatgacagaggtgacccagatgttcgcccgcttcaaggcggcctacgcccgcaacgacctcgacgcctgcgtgaccctcctctcgcagctcaaggtccatctcaccaaattccccagcctcccgccctcgtttcagcagacaccgaacgctgtggaggagctcaaacttgcaagggacatttatgaacatgctgttgttttgagtgtgaaacttgaggaccaagatgcatttgaacgcgatttttgccagctcaagccttattacatggatacatgtggcataattcccccctcaccagaggagtacccaattttgggactcaatcttctgaggctgttggttcagaatagaattgccgagttccacactgagctggagcttctacctgtcaaggcacttgagcatccttgcattaagcatgcggtagagcttgagcaatccttcatggagggtgcctacaaccgagtgttaagcgctcggcaggctgtgccacatgagacctatgtttacttcatggaccttctcgccaaaacagttagagatgaaatcgctgggtgcagcgaaaaggggtatgattccctatctgtaagtgatgcaaagcaaatgcttatgtttaattctgaccaagatctgcacgagtacatctcagaggagcacccggaatgggagattaagaacggtgccgtcttcttccagaaggcgaaggagtcgcagccttgcaaggagatcccatccttgcagctcatcaaccagacgctcagctacgcgagggagctggagcgtattgtatga

SEQ ID NO: 766 - protein, 267 aa, Sorghum bicolor
  misc_feature: Ceres ANNOT ID no. 6010068
  misc_feature (24)..(209): Pfam Id: SAC3_GANP Pfam Desc: SAC3/GANP/Nin1/mts3/eIF-3 p25 family
  misc_feature (1)..(267): NCBI GI: 34394724 NCBI Desc: 26s proteasome regulatory particle non-atpase subunit12 [oryza sativa (japonica cultivar-group)]
  misc_feature (1)..(267): NCBI GI: 113196591 NCBI Desc: 26s proteasome regulatory particle non-atpase subunit 12 [camellia sinensis]
  misc_feature (1)..(267): NCBI GI: 32700048 NCBI Desc: 26s proteasome subunit rpn12 [arabidopsis thaliana]
  misc_feature (6)..(267): NCBI GI: 28828741 NCBI Desc: similar to oryza sativa (rice). 26s proteasome regulatory particle non-atpase subunit12 [dictyostelium discoideum]
  misc_feature (5)..(267): NCBI GI: 21357229 NCBI Desc: cg4157-pa [drosophila melanogaster]
MDPKMTEVTQMFARFKAAYARNDLDACVTLLSQLKVHLTKFPSLPPSFQQTPNAVEELKLARDIYEHAVVLSVKLEDQDAFERDFCQLKPYYMDTCGIIPPSPEEYPILGLNLLRLLVQNRIAEFHTELELLPVKALEHPCIKHAVELEQSFMEGAYNRVLSARQAVPHETYVYFMDLLAKTVRDEIAGCSEKGYDSLSVSDAKQMLMFNSDQDLHEYISEEHPEWEIKNGAVFFQKAKESQPCKEIPSLQLINQTLSYARELERIV

SEQ ID NO: 767 - DNA, 693 bp, Sorghum bicolor
  misc_feature: Ceres ANNOT ID no. 6010076
  misc_feature: Encodes the peptide sequence at SEQ ID NO 768
atggcggaggcgacggcgtacgaggagcagcggcggaggcaggtggaggcgaacaagcggaagttggaggagctgcagctccaccacctctccgccgccgtcagagaggccgccgccgccgccaagccctcgccggtcaagaagcggaaggcgcgggtgccgcttgacgccgccgacgccgtgatgcagccactacggcggtccggcagagtcgccaacctccccgataagcccgcgtaccgcgaggaggttcctgctttcgcgaggaggattaggaggacgtacggaagaaaggatctggccaaccgggtgtacgcgaccgacgaggcgaggagctacaccatctctaaggcggaggatcttgagcaagagctggactccaggttccccttgttcatcaagcccatgacccggtcccatgtcaccgggggcttctggctgggcctgccgactggtttctgccggaagcacctgcccaagcgcgacgagacgatcaccctggtggatgaggatgatgtcgagtccaacacgctctacctcgcaatgaagaagggcctcagcggtggatggagagggttcgccatccagcacaagctggttgatggagattgcttggtcttccagctgattgagaggactaagttcaaggtctacataattagagcaagttcttactatgaaaatgaggattga

SEQ ID NO: 768 - protein, 230 aa, Sorghum bicolor
  misc_feature: Ceres ANNOT ID no. 6010076
  misc_feature (131)..(225): Pfam Id: B3 Pfam Desc: B3 DNA binding domain
  misc_feature (1)..(230): NCBI GI: 51091016 NCBI Desc: transcriptional factor b3-like [oryza sativa (japonica cultivar-group)]
  misc_feature (92)..(228): NCBI GI: 30694114 NCBI Desc: transcriptional factor b3 family protein [arabidopsis thaliana]
  misc_feature (115)..(221): NCBI GI: 115435514 NCBI Desc: os01g0234100 [oryza sativa (japonica cultivar-group)]
  misc_feature (168)..(217): NCBI GI: 92884626 NCBI Desc: transcriptional factor b3 [medicago truncatula]
  misc_feature (53)..(221): NCBI GI: 20160548 NCBI Desc: p0022f10.13 [oryza sativa (japonica cultivar-group)]
  misc_feature: Useful for making plants with altered terpenoid content
  misc_feature: GREAT-hit functional homolog of the protein sequence given in SEQ ID NO 13124
  misc_feature: Useful for making plants with altered terpenoid content
  misc_feature: Functional homolog of the protein sequence given in SEQ ID NO 13124
  misc_feature: The sequence is a functional homolog of SEQ ID NO. 467 in the 11/188,298 US application
MAEATAYEEQRRRQVEANKRKLEELQLHHLSAAVREAAAAAKPSPVKKRKARVPLDAADAVMQPLRRSGRVANLPDKPAYREEVPAFARRIRRTYGRKDLANRVYATDEARSYTISKAEDLEQELDSRFPLFIKPMTRSHVTGGFWLGLPTGFCRKHLPKRDETITLVDEDDVESNTLYLAMKKGLSGGWRGFAIQHKLVDGDCLVFQLIERTKFKVYIIRASSYYENED

SEQ ID NO: 769 - DNA, 1026 bp, Sorghum bicolor
  misc_feature: Ceres ANNOT ID no. 6010134
  misc_feature: Encodes the peptide sequence at SEQ ID NO 770
atgtcatcctcagatagtccaaaagtgacagaaagaaaagtagacaacgatggacatgatgatgacgataaaggaggtttctttgacaaagttaaggatttcatccaagacgtcggcgaaaagattgaagaagcagtaggcttcggaaagcctactgccgatgttactgggattcacataccccatgtcagcctggagaagatagagcttattgtcgatgtccttattgcgaacccgaaccctgtccccatccctcttgttgacattgaatacctgatcgaaagtgaagaaagaaagctcgtttccggaacaatccctgatgctgggaccatccatgctcatggttcggaaactgtcaaaatcccctttttactaatctatgatgacattaggagcacatacaaggaaatcgagcctggaagcatcatcccttacaaagtcagggtcgttctccacatagatattcctgttattgggaggatttctataccgttagagaaaaatggagagattccagtgccatacaaacctgatgttagcattgacaagatcaagtttgagcagttctcttttgaagaatcgaccgcgatccttcacttgaatttggacaacaaaaatgcctttgacttgggactgaattcaatggattatgaagtgtggcttgctaatgtgagcattgcatcggctgaactgaaagaatctacgaatatcaagaaacaggaaataacaactatgaacttacctatcagcttcaggcctaaggatttcggttctgctatgtgggatatgattaggggaaagggcactggttacaccataaagggacacattgatgtcaacactccttttggacacatgaaaataccaataagcaaagaggggggaacaactcgtctcaagaagggggatgatgatgacgacgacgacaaggtatttgttatctcaaatgttggtttttcattatgggaagcttattaccacccaacttacatgttgtttacaccagctgaccactcagtatgctag

SEQ ID NO: 770 - protein, 341 aa, Sorghum bicolor
  misc_feature: Ceres ANNOT ID no. 6010134
  misc_feature (25)..(180): Pfam Id: LEA_2 Pfam Desc: Late embryogenesis abundant protein
  misc_feature (1)..(313): NCBI GI: 34394536 NCBI Desc: late embryogenesis abundant proteins-like [oryza sativa (japonica cultivar-group)]
  misc_feature (1)..(309): NCBI GI: 56112332 NCBI Desc: salt tolerance protein [sesuvium portulacastrum]
  misc_feature (9)..(310): NCBI GI: 3212877 NCBI Desc: similar to late embryogenesis abundant proteins [arabidopsis thaliana]
  misc_feature (9)..(309): NCBI GI: 21592483 NCBI Desc: similar to late embryogenesis abundant proteins [arabidopsis thaliana]
  misc_feature (54)..(309): NCBI GI: 3264769 NCBI Desc: late embryogenesis-like protein [prunus armeniaca]
  misc_feature: Useful for making plants with altered alkaloid content
  misc_feature: Functional homolog of the protein sequence given in SEQ ID NO 13165
MSSSDSPKVTERKVDNDGHDDDDKGGFFDKVKDFIQDVGEKIEEAVGFGKPTADVTGIHIPHVSLEKIELIVDVLIANPNPVPIPLVDIEYLIESEERKLVSGTIPDAGTIHAHGSETVKIPFLLIYDDIRSTYKEIEPGSIIPYKVRVVLHIDIPVIGRISIPLEKNGEIPVPYKPDVSIDKIKFEQFSFEESTAILHLNLDNKNAFDLGLNSMDYEVWLANVSIASAELKESTNIKKQEITTMNLPISFRPKDFGSAMWDMIRGKGTGYTIKGHIDVNTPFGHMKIPISKEGGTTRLKKGDDDDDDDKVFVISNVGFSLWEAYYHPTYMLFTPADHSVC

SEQ ID NO: 771 - DNA, 672 bp, Sorghum bicolor
  misc_feature: Ceres ANNOT ID no. 6010155
  misc_feature: Encodes the peptide sequence at SEQ ID NO 772
atggctcggcggccggcgtcgtgggagcagggcggcgacgagtacgactacctcttcaaggtggttctcatcggcgactccggcgtgggcaagtccaacctgctctcccgcttcaccaagaacaccttcgccctcgactccaagtccactatcggcgtcgagttcgccacgcgcacgatccaggtggacactaagactataaaagctcaaatttgggacactgctgggcaggagaggtatcgagcaattacaagtgcttactaccgaggagctgtaggggcattgctagtgtatgatgttactaaagtaatgacgtttgagaatgtgaagaggtggctgaaggagctccgagaccatgctgactcgaacatagttgtcatgctcattggcaacaagatcgaccttagacacctgcgttctgtcgcggttgaggatgctgcaagctttgcagagagcgaaggtttgttcttcatcgagacctctgcacttgatgcaacaaacgtcgagaaggctttccagactgttctagctgagatctacagaataatcagcaagaagcccctatcttccgaggagtctggttcagggtctggtaacctcagagaggggcaatccattcaagtgtcagccacaaattctagtgctcttacgtcacggtgctgctcttcttag

SEQ ID NO: 772 - protein, 223 aa, Sorghum bicolor
  misc_feature: Ceres ANNOT ID no. 6010155
  misc_feature (20)..(181): Pfam Id: Ras Pfam Desc: Ras family
  misc_feature (20)..(134): Pfam Id: Miro Pfam Desc: Miro-like protein
  misc_feature (19)..(134): Pfam Id: MMR_HSR1 Pfam Desc: GTPase of unknown function
  misc_feature (8)..(179): Pfam Id: Arf Pfam Desc: ADP-ribosylation factor family
  misc_feature (11)..(223): NCBI GI: 92893896 NCBI Desc: ras gtpase [medicago truncatula]
  misc_feature (13)..(221): NCBI GI: 18376163 NCBI Desc: probable gtp-binding protein drab11 [neurospora crassa]
  misc_feature (13)..(223): NCBI GI: 55250361 NCBI Desc: zgc:103679 [danio rerio]
  misc_feature (13)..(222): NCBI GI: 3025293 NCBI Desc: ras-related protein yptc6
  misc_feature (14)..(223): NCBI GI: 3024528 NCBI Desc: ras-related protein rab2bv
  misc_feature: Useful for making plants with altered Lignin content
  misc_feature: GREAT-hit functional homolog of the protein sequence given in SEQ ID NO 13076
  misc_feature: Useful for making plants with altered lignin content
  misc_feature: Functional homolog of the protein sequence given in SEQ ID NO 13076
  misc_feature: Useful for making plants with altered terpenoid content
  misc_feature: Functional homolog of the protein sequence given in SEQ ID NO 13157
  misc_feature: Useful for making plants with altered alkaloid content
  misc_feature: Functional homolog of the protein sequence given in SEQ ID NO 13220
  misc_feature: The sequence is a functional homolog of SEQ ID NO. 400 in the 11/188,298 US application
MARRPASWEQGGDEYDYLFKVVLIGDSGVGKSNLLSRFTKNTFALDSKSTIGVEFATRTIQVDTKTIKAQIWDTAGQERYRAITSAYYRGAVGALLVYDVTKVMTFENVKRWLKELRDHADSNIVVMLIGNKIDLRHLRSVAVEDAASFAESEGLFFIETSALDATNVEKAFQTVLAEIYRIISKKPLSSEESGSGSGNLREGQSIQVSATNSSALTSRCCSS

SEQ ID NO: 773 - DNA, 1410 bp, Sorghum bicolor
  misc_feature: Ceres ANNOT ID no. 6010196
  misc_feature: Encodes the peptide sequence at SEQ ID NO 774
atggagacatcgctagttacgtatgcatgtctctgtggtgcaacaacactgtccattgggtggctgctacactggatatacaaatggatgaacccaccgtgcagtggggctcttcctcctggttccatgggatttcctattcttggtgagagcatccagttcttcagaaggagctcttccttggacgtcccagacttctacaagataaggctgaaaaggtatggttcgattttcaagacaagcttggttggacagcctgttgtaactgcagatccagaggtcaacaggttcatatttcaacaagaaggcaagttgtttcgaagctggtaccctgaggcagcaaatataattaccggcgaggagaccatcgatggatttcatggccctcctcacaagttcatcagaaactccattaacaaattatttggccttgaatacctgaagcacaaccttcatgaagtggatggtgccataagaaaaacttttgctgaatggtccgcaaaatgtgtcattgatgtgcatgatagcaccccagatgtggctaagatgctgtttagcctcaatccttccgagtcaagagaatggacaaagaattacagtgcattccttcaggggttgatatccttcccactatacttaccaggaacaacattttaccattgcatgcaggggaggagaaatatgcagaaggtaatgtcaaatttgttgagaaagaggctaagcaaacctgaagtgaaacatggtgattttcttgatctaattattgaagagctccagactgagaaaccgacaatagatgacaagtttgctacagatgcattggttgcactcctgtttaccagcttcgtaacactcgcacccatcctcaccttggcgttcaagtttctcagtgacaacccggaagtaatcaaagctcttgaggaggagcatgaagcaattgtgaggaacagatgcgatgcaagttctgggatcacatgggaggagtataagtcactaacattcacaaatatggttgtgaatgagctaacccgaatgagtaatgccacaccaggtgttttcaggaaaacaatgacagacgtgcaagtgaatggttatacaattccatccggttggatggtcatggtatgccccatggcggttcatgtaaaccctgagttttttgaagaccctctcaagtttaacccatggaggtggcaggatgagtccaaacggagcacactactgaagagtttcatgccatttgggataggcatgcggacatgccctgccacagattttagcaagcttttcactgcaattttccttcatgttctggtcacaaagtacagaaaatggaagtgtatgttaaaatattactgcgtttgtatgcaaagtttatattgtacgcggatggtacttgcatggttgtag

SEQ ID NO: 774 - protein, 469 aa, Sorghum bicolor
  misc_feature: Ceres ANNOT ID no. 6010196
  misc_feature (39)..(454): Pfam Id: p450 Pfam Desc: Cytochrome P450
  misc_feature (7)..(445): NCBI GI: 116310272 NCBI Desc: osigba0111l12.4 [oryza sativa (indica cultivar-group)]
  misc_feature (7)..(445): NCBI GI: 47155289 NCBI Desc: cytochrome p450 [oryza sativa]
  misc_feature (7)..(445): NCBI GI: 113565171 NCBI Desc: os04g0570500 [oryza sativa (japonica cultivar-group)]
  misc_feature (7)..(403): NCBI GI: 38567917 NCBI Desc: osjnba0088i22.13 [oryza sativa (japonica cultivar-group)]
  misc_feature (20)..(446): NCBI GI: 56382055 NCBI Desc: cytochrome p450 [oryza sativa (japonica cultivar-group)]
  misc_feature: The sequence is a functional homolog of SEQ ID NO. 500 in the 11/188,298 US application
  misc_feature: The sequence is a functional homolog of SEQ ID NO. 408 in the 11/188,298 US application
  misc_feature: The sequence is a functional homolog of SEQ ID NO. 316 in the 11/188,298 US application
  misc_feature: The sequence is a functional homolog of SEQ ID NO. 432 in the 11/188,298 US application
  misc_feature: The sequence is a functional homolog of SEQ ID NO. 294 in the 11/188,298 US application
  misc_feature: The sequence is a functional homolog of SEQ ID NO. 404 in the 11/188,298 US application
METSLVTYACLCGATTLSIGWLLHWIYKWMNPPCSGALPPGSMGFPILGESIQFFRRSSSLDVPDFYKIRLKRYGSIFKTSLVGQPVVTADPEVNRFIFQQEGKLFRSWYPEAANIITGEETIDGFHGPPHKFIRNSINKLFGLEYLKHNLHEVDGAIRKTFAEWSAKCVIDVHDSTPDVAKMLFSLNPSESREWTKNYSAFLQGLISFPLYLPGTTFYHCMQGRRNMQKVMSNLLRKRLSKPEVKHGDFLDLIIEELQTEKPTIDDKFATDALVALLFTSFVTLAPILTLAFKFLSDNPEVIKALEEEHEAIVRNRCDASSGITWEEYKSLTFTNMVVNELTRMSNATPGVFRKTMTDVQVNGYTIPSGWMVMVCPMAVHVNPEFFEDPLKFNPWRWQDESKRSTLLKSFMPFGIGMRTCPATDFSKLFTAIFLHVLVTKYRKWKCMLKYYCVCMQSLYCTRMVLAWL

SEQ ID NO: 775 - DNA, 2535 bp, Sorghum bicolor
  misc_feature: Ceres ANNOT ID no. 6010422
  misc_feature: Encodes the peptide sequence at SEQ ID NO 776
atggggaagcactcagctgaatctggggttagtatgctgttgcatggagacttggatttacaaataattgaagcaaaatgtctccccaatatggatctcatgacagaaaggatgcgaaaatgctttactgggtatggagcttgcagcactgattgtgggaagtcggagaacgcccacccagacatgaggaagatcattactagtgatccatatgtttcagtttgtctttcaggagctacggtggcacaaactcgagtcattcccaactcggagaaccctaaatgggatgagcacttctatgttcaagttgctcattcagttagcagaattgagtttcttgtaaaggacaacgatgtttttggggcagagcttattggtgtggctacaataccagttgagcacatcacaccaggtgatatggtcggtggttggtttccaatttctggtcagtacagtaatcctatgaagccatctcctgagctgcatttaaatatccagtataagccaatcgacatgaacccactatacaaggatggagttggtgccgatggccctcagagtgttggtgtccctaatgcttatttccctcttaggaagggtggtagggtcacactgtatcaagatgctcatgttcctgacaattttcaacctcagattgagatagatggtgggaggacatatgaacaaaacaaatgctgggaagatatttgtcatgcaatcattgaggctcatcaccttatctacatagtcggctggtccttgtatcaccctgtgaagcttgtaagggagtcaacaaaacctgttcccaatggaaaccctgtcaccattggggaaattttgaagcgcaaagttcaagaaggagtccgtgttatagtgttgctttgggatgacaaaacatcacatgacaaatttctcttaaaaacagatggtctcatgcatacacatgatgaagaagctcgaaaatatttcaggcattcaggtgtccattgtgtgctgtctcctcgctatgctagcaacaaacttagcattttcaagcagcaggttgtaggaactttatttacacaccatcagaaatgtgtcattgtagacacgcaagccacaggaaacaatcgaaaaataactgcttttattggtggtctagacttgtgtgatggcagatatgatacacctgaacacaggcttttcaaggatttagatactattttcaaggacgatttccacaaccccacattccctgttaataagcatggacccagacagccatggcatgatttacattgtaaaatcgagggtcctgctgcatatgatatacttacaaactttgaacagagatggagaaaatctgcaaaatggaaagtcagtgtcagaagagctgtgagttggcatcatgatacattggtaaaaattgataggatgtcatggattgtttcccccactgcagatgaattaaatgcacatgttgttgaagaaaaggatcctgaaaactggcatgtacaggttttccgatcaattgattcaggatctgtaaaaggattcccaaaacttgttcaagaggctgaatcccagaatcttgtctgtgcaaagaatctgcagatagacaaaagcatacacaatgcatatgttaaagcgatcagatctgcgcagcactttgtctatattgaaaatcagtactttattgggtcttcatactactggtctgcacaccgaagtgcaggtgctgagaacctaataccaattgaattggccataaagattgcaagaaagattaaggcaaaggaaaggtttgcagcatacattgttataccgatgtggcccgaaggcaatccgacaactgctgctatgcaggagatactctattggcaggggcataccatgtccatgatgtacaagatcgtcgcagatgctctacgaaaggagggtctacatgaaagccatccacaggagtacctgaacttctattgccttggcaagcgtgaaggttccaatgaagtttcgtcgacaagcaattccaatgagaactctgcactacgtttggcccagaagttcaggaggttcatgatctatgtgcactcaaaagggatgattgttgacgatgagtatgttctcatcggatcagccaacataaaccagaggtccatggatggctcacgggacacagagatcgccatgggtgcgtaccagcctcactacagctgggctggaagcggtagccctccaaaaggacaggcatgtctctcctctgtgtatgggtacaggatgtctctttgggcggagcacctgggcacagtggaggagtgcttccgccggccggagtctgaggagtgcgtgcagctggtgaaccagatggcagatgataactgggcgtcctatgtctcgccgcagatggtggatatgaagggccacctcatgaagtaccccgtgaaggttgaacaggatgggagggtgggaccgctgcctggacaggagagcttccctgatgtcggcggtaaggtgctgggcacgcactcgtcgctccccaatgcgctgacgacgtga

SEQ ID NO: 776 - protein, 844 aa, Sorghum bicolor
  misc_feature: Ceres ANNOT ID no. 6010422
  misc_feature (18)..(129): Pfam Id: C2 Pfam Desc: C2 domain
  misc_feature (351)..(386): Pfam Id: PLDc Pfam Desc: Phospholipase D Active site motif
  misc_feature (685)..(712): Pfam Id: PLDc Pfam Desc: Phospholipase D Active site motif
  misc_feature (1)..(844): NCBI GI: 8699602 NCBI Desc: phospholipase d [oryza sativa (indica cultivar-group)]
  misc_feature (12)..(844): NCBI GI: 92889081 NCBI Desc: c2 [medicago truncatula]
  misc_feature (2)..(843): NCBI GI: 115480465 NCBI Desc: os09g0543100 [oryza sativa (japonica cultivar-group)]
  misc_feature (14)..(844): NCBI GI: 23477711 NCBI Desc: phospholipase d delta isoform [gossypium hirsutum]
  misc_feature (14)..(844): NCBI GI: 22795060 NCBI Desc: phospholipase d delta isoform 1b [gossypium hirsutum]
  misc_feature (66)..(843): SWISSPROT Homolog: EC 3.1.4.4 Phospholipase D beta 1
MGKHSAESGVSMLLHGDLDLQIIEAKCLPNMDLMTERMRKCFTGYGACSTDCGKSENAHPDMRKIITSDPYVSVCLSGATVAQTRVIPNSENPKWDEHFYVQVAHSVSRIEFLVKDNDVFGAELIGVATIPVEHITPGDMVGGWFPISGQYSNPMKPSPELHLNIQYKPIDMNPLYKDGVGADGPQSVGVPNAYFPLRKGGRVTLYQDAHVPDNFQPQIEIDGGRTYEQNKCWEDICHAIIEAHHLIYIVGWSLYHPVKLVRESTKPVPNGNPVTIGEILKRKVQEGVRVIVLLWDDKTSHDKFLLKTDGLMHTHDEEARKYFRHSGVHCVLSPRYASNKLSIFKQQVVGTLFTHHQKCVIVDTQATGNNRKITAFIGGLDLCDGRYDTPEHRLFKDLDTIFKDDFHNPTFPVNKHGPRQPWHDLHCKIEGPAAYDILTNFEQRWRKSAKWKVSVRRAVSWHHDTLVKIDRMSWIVSPTADELNAHVVEEKDPENWHVQVFRSIDSGSVKGFPKLVQEAESQNLVCAKNLQIDKSIHNAYVKAIRSAQHFVYIENQYFIGSSYYWSAHRSAGAENLIPIELAIKIARKIKAKERFAAYIVIPMWPEGNPTTAAMQEILYWQGHTMSMMYKIVADALRKEGLHESHPQEYLNFYCLGKREGSNEVSSTSNSNENSALRLAQKFRRFMIYVHSKGMIVDDEYVLIGSANINQRSMDGSRDTEIAMGAYQPHYSWAGSGSPPKGQACLSSVYGYRMSLWAEHLGTVEECFRRPESEECVQLVNQMADDNWASYVSPQMVDMKGHLMKYPVKVEQDGRVGPLPGQESFPDVGGKVLGTHSSLPNALTT

SEQ ID NO: 777 - DNA, 747 bp, Sorghum bicolor
  misc_feature: Ceres ANNOT ID no. 6010424
  misc_feature: Encodes the peptide sequence at SEQ ID NO 778
atgtccctgtccgtcgccggcgcgcggacctccacctctcccctcccctcttcgttcgccgcctcttcatcccgcccgcgcctcctcgcgcttcctctccaccgccgctcgcacggctccctcgcctcgccgccggccgcgggcaggcggcggctgcggcggctgctcagggtgcgcatggcccggacggagtccaccggcgtaggtatcggcttccgcgcgccggagttcgagctccctgagccactgaccgggaagctctggacgttggatgacttcgagggcaactctgcactgcttgttatgttcatatgcaatcactgcccatttgtgaaacatctgaaaaaggacattgccaagctcacctctttctatgtggagaaaggacttggtgctgttgccatatcgtccaactcagttaggacgcatccccaggatggcccagaacacatggctgaagaagcaaagttgttcaaatatcctttcccatatctttatgatgagtcacaagaagtagctaaggcttttggagcagtctgcacacctgagttttacttattcaaaaaagatgggcgaaggccttttgaacttttctaccatggacagttcgacgattcaagacccagtaacaatgtgccagtaactggaagggatctaagccgtgcaattgactgtgcgctcagtggccaagaactgccctttgtacaaaagccaagcgtcggctgcaacatcaaatggcacccatga

SEQ ID NO: 778 - protein, 248 aa, Sorghum bicolor
  misc_feature: Ceres ANNOT ID no. 6010424
  misc_feature (70)..(200): Pfam Id: AhpC-TSA Pfam Desc: AhpC/TSA family
  misc_feature (69)..(223): Pfam Id: Redoxin Pfam Desc: Redoxin
  misc_feature (128)..(248): NCBI GI: 145361444 NCBI Desc: electron carrier [arabidopsis thaliana]
  misc_feature (60)..(246): NCBI GI: 83643217 NCBI Desc: thiol-disulfide isomerase and thioredoxins [hahella chejuensis kctc 2396]
  misc_feature (60)..(246): NCBI GI: 113477296 NCBI Desc: redoxin [trichodesmium erythraeum ims101]
  misc_feature (60)..(246): NCBI GI: 124004709 NCBI Desc: thioredoxin family protein [microscilla marina atcc 23134]
  misc_feature (60)..(246): NCBI GI: 82621729 NCBI Desc: thiol-disulfide isomerase and thioredoxin [uncultured bacteroidetes bacterium 'sbi2-18 p41a3']
MSLSVAGARTSTSPLPSSFAASSSRPRLLALPLHRRSHGSLASPPAAGRRRLRRLLRVRMARTESTGVGIGFRAPEFELPEPLTGKLWTLDDFEGNSALLVMFICNHCPFVKHLKKDIAKLTSFYVEKGLGAVAISSNSVRTHPQDGPEHMAEEAKLFKYPFPYLYDESQEVAKAFGAVCTPEFYLFKKDGRRPFELFYHGQFDDSRPSNNVPVTGRDLSRAIDCALSGQELPFVQKPSVGCNIKWHP

SEQ ID NO: 779 - DNA, 843 bp, Sorghum bicolor
  misc_feature: Ceres ANNOT ID no. 6010493
  misc_feature: Encodes the peptide sequence at SEQ ID NO 780
atgcaggtgaagcagagcgtcttcgggctctacaagggcacggtggagcgggtgacggccccgcgcaccgcctccgcgttcctcgaaaagggcgtcctctccgtcccagagttcgtcctcgccggcgacaacctcgtcgccaagtttttttttagaaaaggagtgccttgtttaagacgtgccatctcggtcgagggacagtatgatgcagcaggagccgaggtggttgtcgaggatgatcaggacggcgaaggctggcttgcaacacatggggtgcaagcatcaaagcccgaagaggaggaagacatacctgacatggatacatttggcatgggaagatctgatggaataaagtcgtctatcccttcttacttcagcggcggtaaggaggaagaggaggaggaagatatacctgacatggacaactataaagacacacgggcagacaatttggctgctgctgagcgatcatgcattgttgcagaagaaccggaagatgacaacatccttcgtaccagaacatatgatgttagcataacgtatgacaaatactaccaaactccacgtgtctggctgactggatatgatgagtcaagaatgccactaaagcctgatcttgtgtttgaagatatcaaccatcctcacttattggctggaaagcatgcctctgtgcacccatgcagacatgcagctgtgatgaaacacatggtaataaatgagaacgagggagtgcaaccagaagttgacatgtaccttgtcatatttttgaaattcatagccactgtcataccaactatcgagtgtgatagcacaatggtggttgaccttggcagtacaagctga

SEQ ID NO: 780 - protein, 280 aa, Sorghum bicolor
  misc_feature: Ceres ANNOT ID no. 6010493
  misc_feature (167)..(272): Pfam Id: Autophagy_C Pfam Desc: Autophagocytosis associated protein, C-terminal domain
  misc_feature (6)..(139): Pfam Id: Autophagy_N Pfam Desc: Autophagocytosis associated protein, N-terminal domain
  misc_feature (48)..(280): NCBI GI: 18424474 NCBI Desc: autophagy 3 (apg3) [arabidopsis thaliana]
  misc_feature (48)..(280): NCBI GI: 110740691 NCBI Desc: autophagocytosis protein - like [arabidopsis thaliana]
  misc_feature (48)..(280): NCBI GI: 21595613 NCBI Desc: autophagocytosis protein-like [arabidopsis thaliana]
  misc_feature (48)..(276): NCBI GI: 9758466 NCBI Desc: autophagocytosis protein aut1-like [arabidopsis thaliana]
  misc_feature (1)..(280): NCBI GI: 38260612 NCBI Desc: autophagocytosis protein [sisymbrium irio]
MQVKQSVFGLYKGTVERVTAPRTASAFLEKGVLSVPEFVLAGDNLVAKFFFRKGVPCLRRAISVEGQYDAAGAEVVVEDDQDGEGWLATHGVQASKPEEEEDIPDMDTFGMGRSDGIKSSIPSYFSGGKEEEEEEDIPDMDNYKDTRADNLAAAERSCIVAEEPEDDNILRTRTYDVSITYDKYYQTPRVWLTGYDESRMPLKPDLVFEDINHPHLLAGKHASVHPCRHAAVMKHMVINENEGVQPEVDMYLVIFLKFIATVIPTIECDSTMVVDLGSTS

SEQ ID NO: 781 - DNA, 1551 bp, Sorghum bicolor
  misc_feature: Ceres ANNOT ID no. 6010556
  misc_feature: Encodes the peptide sequence at SEQ ID NO 782
atggacgccggcgcgcacgtgcctgcgggagtggtggtcgacatcgaggcgctcgccggaccggccgtagggagcgaggtccccgctgcgccgcctaagggcccagcatggaaaaggttcttgtaccacgttgggccaggctttatggtctgtttggcctaccttgatccaggaaactatcacagatatgagctcctctgggtgaccttgattggcctcatctttgcactaattattcagtcactatctgctaatctcggagtagtgacagggcggcatcttgccgaactatgcaagacggaatatccagcatgggtgagaatctgcctatggctgctggcagagttagctgtgattgctgcagatatcccagaagttatagggacagcttttgctttcaacctcttgttccacatacctttgtgggtgggggttctcatcactggctcaagcacacttctcctccttggaatgcaaaaatatggggttaggaagctggaacttttggttggactattggtgttcgttatggcagcatgcttcttcatagagatgagcatagtgaagcctcctgcaaaagaggtcatttacgggctattcgtccccagcctgagtgggtcgggcgctactggagacactatagcccttcttggagctcttgtcatgccgcacaatctattcttgcactctgccctggtactgtcaaggaacactccctcgtcagtaagaggaatcaaggatgcttgcaggttcttccttcttgaaagtggtgtagcaatgttcgtggcacttctgatcaacatatgtatcatctctgtctctggaactgtctgtaactcgagcaacctctcatcagttgactctgcaaaatgcagtgatatcaccttggactcctcgtccttcctcctcaggaatgtgctaggcaacaacagcgcagttgtgtatggtgtggcactcttggcttgtgggataagctcttccatcactggtacttacgctgggcaatacatcatgcagggtttcttggacatcaagatgaaacagtggctgaggaacctgatgacccgcagcattgccattgtaccaagcttaatcgttgccatcatcggtgggtccagtggtgctggccgtctcatcatcattgcatcgatgatactgtcttttgagctaccatttgctctcatcccacttctcaagttcagcagtagtagcaacacgatgggccaacataagaactccatatatattattggattctcgtggattctcggttctgttatcattgggataaacatctacttcctctgctcaaaatttgttggctggatcctccacaactcactgccaatttatgctaacattctcattggcatcatcgtgttccctcttatgctgctctacatctgtgctgtgatctacctcacgctaaggaaggagaccatcaagttcgtgccttgcggtgagctgcaggccattgagaccgacaaatcaaaggttgccgatgatagcaataacgaggaaaaggagtatgtatcctacaatggcatctag

SEQ ID NO: 782 - protein, 516 aa, Sorghum bicolor
  misc_feature: Ceres ANNOT ID no. 6010556
  misc_feature (55)..(414): Pfam Id: Nramp Pfam Desc: Natural resistance-associated macrophage protein
  misc_feature (12)..(509): NCBI GI: 2231132 NCBI Desc: integral membrane protein [oryza sativa]
  misc_feature (12)..(500): NCBI GI: 115471433 NCBI Desc: os07g0258400 [oryza sativa (japonica cultivar-group)]
  misc_feature (12)..(500): NCBI GI: 34393709 NCBI Desc: rice nramp1 protein(natural-resistance-associated macrophage protein 1) [oryza sativa (japonica cultivar-group)]
  misc_feature (12)..(500): NCBI GI: 90102244 NCBI Desc: metal transporter [oryza sativa (japonica cultivar-group)]
  misc_feature (28)..(481): NCBI GI: 51318208 NCBI Desc: root-specific metal transporter [malus baccata]
MDAGAHVPAGVVVDIEALAGPAVGSEVPAAPPKGPAWKRFLYHVGPGFMVCLAYLDPGNYHRYELLWVTLIGLIFALIIQSLSANLGVVTGRHLAELCKTEYPAWVRICLWLLAELAVIAADIPEVIGTAFAFNLLFHIPLWVGVLITGSSTLLLLGMQKYGVRKLELLVGLLVFVMAACFFIEMSIVKPPAKEVIYGLFVPSLSGSGATGDTIALLGALVMPHNLFLHSALVLSRNTPSSVRGIKDACRFFLLESGVAMFVALLINICIISVSGTVCNSSNLSSVDSAKCSDITLDSSSFLLRNVLGNNSAVVYGVALLACGISSSITGTYAGQYIMQGFLDIKMKQWLRNLMTRSIAIVPSLIVAIIGGSSGAGRLIIIASMILSFELPFALIPLLKFSSSSNTMGQHKNSIYIIGFSWILGSVIIGINIYFLCSKFVGWILHNSLPIYANILIGIIVFPLMLLYICAVIYLTLRKETIKFVPCGELQAIETDKSKVADDSNNEEKEYVSYNGI

SEQ ID NO: 783 - DNA, 3303 bp, Sorghum bicolor
  misc_feature: Ceres ANNOT ID no. 6010570
  misc_feature: Encodes the peptide sequence at SEQ ID NO 784
  misc_feature: Down-regulated in root tissues in response to aminocyclopropane carboxylic treatment
  misc_feature: Down-regulated in shoot tissues in response to salicylic acid treatment
atggaggcgagcgcggggctggtggccggctcgcacaaccggaacgagctggtggtgatccgccgcgagtcaggcggagccgtcggcgggggtgttggagcggcgcggcgggcggaggcgccgtgccagatatgcggggacgaggtcggggtgggcttcgacggggagcccttcgtggcgtgcaacgagtgcgccttcccggtgtgccgcgcctgctacgagtacgagcgccgtgaggggtcgcaggcgtgcccgcagtgccggacacggtacaagcgcctcaaggggtgcccgcgcgtggcgggcgacgaggaggaggacggcgtcgacgacctggagggcgagttcggcctgcagggcggcggccccggcgggcacgaggatgacccgcagtacgtcgcggagtccatgctcagggcgcagatgagctacggccgtggcggcgacgcggcgcaccccaacggcttcggccacgtcgtccccaatgtgccgctcctcaccaacggccagatggttgatgacatcccgccggagcagcacgcgctcgtgccgtcctacatgggcggcggcggcggcgggggcaagaggatccacccgctccccttcgcagatcccaacctcccagtgcaaccgagatccatggacccgtccaaggatctggccgcctacggctacggcagcgtggcctggaaggagaggatggagggctggaagcagaagcaggagcgcctgcagcatgtcaggagcgagggaggcggtgattgggacggcgacgacgcagatctgccactaatggatgaagctcgacagccattgtccagaaaagtcccaatatcatcaagccgaatcaatccctacaggatgattattgttatccggttggtggttttgggtttcttcttccactaccgtgtgatgcatccggcgaaagatgcatttgcattgtggctcatatctgttatctgtgaaatctggtttgccatgtcctggattcttgatcagttcccaaagtggcttccaattgagagagagacctacctggaccgtttgtcactaaggtttgacaaggaaggtcaaccctctcagcttgctcctattgacttctttgtcagtacggttgatccctcaaaggaacctcccttggtcacagcgaacactgtcctttccatcctttctgtggattatccagttgagaaggtctcctgctatgtttctgatgatggtgctgcaatgcttacgtttgaagcattgtctgaaacatctgaatttgcaaagaaatgggttcctttctgcaaaaagtttaatcttgagcctcgtgctcctgagtggtacttccaacagaagatagactacctgaaagacaaggttgccgcttcatttgttagggagaggagggcgatgaagagagaatacgaggaattcaaggtaaggatcaatgccttggttgcaaaagcccaaaaggttcccgaggaaggatggacaatgcaagatggaagcccctggcctggaaacaacgtacgcgaccatcctggaatgattcaggtattccttggccaaagtggtggtcgtgatgtggaaggaaatgagttgcctcgcctcgtttatgtctccagagaaaagaggccaggttataaccatcacaagaaggctggtgccatgaatgcattggtccgtgtctctgctgtcttatcaaatgctccgtacctattgaacttggattgtgatcactacatcaacaatagcaaggccataaaagaggctatgtgtttcatgatggatcctttggtggggaagaaagtgtgctatgtccagttccctcagaggtttgatggtattgaccgtcatgatcgatacgcaaacaggaacgtcgtcttttttgatatcaacatgaaaggtttggacggtattcaaggacccatctatgtgggtactggatgtgttttcagacggcaggcactgtatggttatgatgctcctaaaacgaagaagccaccatcaagaacttgcaactgctggcccaagtggtgtctctcttgctgctgcagtaggaacaagaataaaaagaagactacaaaaccaaagacagagaagaagaaaagactatttttcaagaaagcagaaaacccttctcctgcatatgctttgggtgaaattgaggaaggtgctccaggtgctgacgttgagaaggctggaattgtaaatcaacagaaactagaaaagaaatttgggcagtcatctgtttttgttgcatcaacacttcttgagaatggtgggaccctgaggagtgcaagtccagcttctcttctaaaggaagctatacatgtaatcagctgcggctacgaagacaagactgactgggggaaagagattggctggatttatggatcaattacagaggatatcttgactggatttaagatgcactgccatggttggcggtctatttactgcatcccgaagcggcctgcattcaaaggttctgcacctctgaatctttctgaccggcttcaccaggtccttcgttgggctcttggatctgttgaaattttcttcagcaagcactgcccactttggtacggatatggtggcggcctaaaatttttggaaaggttttcttacatcaactctattgtatacccatggacatccattcctctcttggcttactgtaccttgcctgccatctgtctgctcacggggaaatttatcacaccagagcttaccaatgtcgctagtatctggttcatggcacttttcatctgcattgctgtcaccggcatccttgaaatgagatggagtggtgtggccatcgatgactggtggagaaacgagcagttctgggtcattggaggtgtttccgcacatctcttcgcggtgttccaaggccttctcaaggtcctcgccggtatcgacacgagcttcaccgtcacatcaaaggccggggacgacgaggagttctcagagctgtacacgttcaaatggaccaccctgttgatccctccaaccacgcttctcctgctgaacttcatcggggtcgtggctggaatctcgaacgcgatcaacaacgggtacgagtcatggggtcctctcttcgggaagctcttcttcgcgttctgggtgatcatccatctgtacccgttcctcaagggtctggtgggacggcagaaccggacgccgacgatcgtgatcgtctggtccatcctgctggcctccatcttctcgctcctgtgggtccgcatcgacccgttccttgccaagagcgatggacctcttctggaggagtgtggtctggactgcaactaa

SEQ ID NO: 784 - protein, 1100 aa, Sorghum bicolor
  misc_feature: Ceres ANNOT ID no. 6010570
  misc_feature (271)..(1094): Pfam Id: Cellulose_synt Pfam Desc: Cellulose synthase
  misc_feature (1)..(1100): NCBI GI: 9622888 NCBI Desc: cellulose synthase-8 [zea mays]
  misc_feature (1)..(1100): NCBI GI: 9622886 NCBI Desc: cellulose synthase-7 [zea mays]
  misc_feature (42)..(1100): NCBI GI: 9622884 NCBI Desc: cellulose synthase-6 [zea mays]
  misc_feature (1)..(1100): NCBI GI: 67003917 NCBI Desc: cellulose synthase 6 [eucalyptus grandis]
  misc_feature (1)..(1100): NCBI GI: 37781495 NCBI Desc: cellulose synthase 6 [populus tremuloides]
  misc_feature (1)..(1099): SWISSPROT Homolog: EC 2.4.1.12 Cellulose synthase A catalytic subunit 6 [UDP-forming]
  misc_feature: Useful for making plants with altered cell wall content and/or composition
  misc_feature: GREAT-hit functional homolog of the protein sequence given in SEQ ID NO 13363
  misc_feature: GREAT-hit functional homolog of the protein sequence given in SEQ ID NO 13364
  misc_feature: GREAT-hit functional homolog of the protein sequence given in SEQ ID NO 13365
  misc_feature: GREAT-hit functional homolog of the protein sequence encoded by LOCUS at2g21770
  misc_feature: GREAT-hit functional homolog of the protein sequence encoded by LOCUS at4g39350
  misc_feature: GREAT-hit functional homolog of the protein sequence encoded by LOCUS at5g09870
  misc_feature: GREAT-hit functional homolog of the protein sequence encoded by LOCUS at5g64740
  misc_feature: The sequence is a functional homolog of SEQ ID NO 26 in US patent 7312377
  misc_feature: Useful for making plants with altered cell wall content and/or composition
  misc_feature: Functional homolog of the protein sequence given in SEQ ID NO 13363
  misc_feature: Useful for making plants with modulated biomass
  misc_feature: Functional homolog of the protein sequence given in SEQ ID NO 14005
  misc_feature: Useful for making plants with altered carbohydrate content
  misc_feature: Functional homolog of the protein sequence given in SEQ ID NO 13628
  misc_feature: The sequence is a functional homolog of SEQ ID NO 6 in US patent 7285702
  misc_feature: The sequence is a functional homolog of SEQ ID NO 2 in US patent 7049481
  misc_feature: Useful for making plants with modulated plant growth and development
  misc_feature: Functional homolog of the protein sequence given in SEQ ID NO 13629
  misc_feature: Down-regulated in root tissues in response to aminocyclopropane carboxylic treatment
  misc_feature: Down-regulated in shoot tissues in response to salicylic acid treatment
MEASAGLVAGSHNRNELVVIRRESGGAVGGGVGAARRAEAPCQICGDEVGVGFDGEPFVACNECAFPVCRACYEYERREGSQACPQCRTRYKRLKGCPRVAGDEEEDGVDDLEGEFGLQGGGPGGHEDDPQYVAESMLRAQMSYGRGGDAAHPNGFGHVVPNVPLLTNGQMVDDIPPEQHALVPSYMGGGGGGGKRIHPLPFADPNLPVQPRSMDPSKDLAAYGYGSVAWKERMEGWKQKQERLQHVRSEGGGDWDGDDADLPLMDEARQPLSRKVPISSSRINPYRMIIVIRLVVLGFFFHYRVMHPAKDAFALWLISVICEIWFAMSWILDQFPKWLPIERETYLDRLSLRFDKEGQPSQLAPIDFFVSTVDPSKEPPLVTANTVLSILSVDYPVEKVSCYVSDDGAAMLTFEALSETSEFAKKWVPFCKKFNLEPRAPEWYFQQKIDYLKDKVAASFVRERRAMKREYEEFKVRINALVAKAQKVPEEGWTMQDGSPWPGNNVRDHPGMIQVFLGQSGGRDVEGNELPRLVYVSREKRPGYNHHKKAGAMNALVRVSAVLSNAPYLLNLDCDHYINNSKAIKEAMCFMMDPLVGKKVCYVQFPQRFDGIDRHDRYANRNVVFFDINMKGLDGIQGPIYVGTGCVFRRQALYGYDAPKTKKPPSRTCNCWPKWCLSCCCSRNKNKKKTTKPKTEKKKRLFFKKAENPSPAYALGEIEEGAPGADVEKAGIVNQQKLEKKFGQSSVFVASTLLENGGTLRSASPASLLKEAIHVISCGYEDKTDWGKEIGWIYGSITEDILTGFKMHCHGWRSIYCIPKRPAFKGSAPLNLSDRLHQVLRWALGSVEIFFSKHCPLWYGYGGGLKFLERFSYINSIVYPWTSIPLLAYCTLPAICLLTGKFITPELTNVASIWFMALFICIAVTGILEMRWSGVAIDDWWRNEQFWVIGGVSAHLFAVFQGLLKVLAGIDTSFTVTSKAGDDEEFSELYTFKWTTLLIPPTTLLLLNFIGVVAGISNAINNGYESWGPLFGKLFFAFWVIIHLYPFLKGLVGRQNRTPTIVIVWSILLASIFSLLWVRIDPFLAKSDGPLLEECGLDCN

SEQ ID NO: 785 - DNA, 1158 bp, Sorghum bicolor
  misc_feature: Ceres ANNOT ID no. 6010585
  misc_feature: Encodes the peptide sequence at SEQ ID NO 786
atggcccacggcggcggcggcgggagggcgaaggtgacgccgaacctggcggtggacggcgagggcacgcggacgctcaacctcaccgtgctgcagcgcctcgaccccgccgtcgaggacatcctcatcaccgcggctcacgtcacgctgtacgacttcgacaccgacgtcaaccagtggagccggaaggacgtggaggggtcgctattcgtcgtcaagaggaatgctcaacccagattccagttcattgtcatgaatcgcaggaatacagataatctagttgaagatctcttgggagattttgagtaccaactccaagctccttatataatgtaccgcaatgctgctcaagaagttataggaatttggttttacaactctcaggagtgtcaagaagttgcaaaccttttcaacaggattttgaatgctttctcgaaggtgccaccaaagccgaagattccctctgttcaaagtgaatttgaagagttggaagcagcacctgcattggttgaaggtcctctggaaccgcaaacgtcaagtatcatgtcaactactactcacgttcaagaggatcctttatctgcatttttcagtgcagctgcaaatactggtggcaactctgctgtagctgttgcaaggcaaccaattcaaccttttggtcctactccggtggctacacatgcggcagctagtatcactacagcacaatcgccaggcttgcattatttgcttccttcacaagcctcaacggtttctgggatgcttgctgatgctcatggtggcactggttctataggaaggtccacaagccttgtaaacccatcacttttctcaccattgacgtcttcacagacaacaatgatgcgcagtaatcctgcagtaccaactgctccacctcaacatcctcgtactgctcagcagccgcaaagtgctcccttgcttcagccttttccgttacccacagcttcaccatctccaccatatgggactccattacttcaaccgtttccgccacctaatccgtcgccatctcttgcgtctgcaccagtcttgagcccagcactgtctagagacaaagtcagagatgcattactgagacttgttgagaatgatgaatttgtcgatttagtctaccgcgagatcatgaacagacagtaa

SEQ ID NO: 786 - protein, 385 aa, Sorghum bicolor
  misc_feature: Ceres ANNOT ID no. 6010585
  misc_feature (19)..(141): Pfam Id: DCP1 Pfam Desc: Dcp1-like decapping family
  misc_feature (11)..(383): NCBI GI: 18390886 NCBI Desc: hydroxyproline-rich glycoprotein family protein [arabidopsis thaliana]
  misc_feature (70)..(383): NCBI GI: 6664305 NCBI Desc: t27g7.7 [arabidopsis thaliana]
  misc_feature (11)..(383): NCBI GI: 3169719 NCBI Desc: similar to yeast dcp1 [arabidopsis thaliana]
  misc_feature (75)..(351): NCBI GI: 115456457 NCBI Desc: os03g0837000 [oryza sativa (japonica cultivar-group)]
  misc_feature (20)..(140): NCBI GI: 40548403 NCBI Desc: decapping enzyme dcp1b [homo sapiens]
MAHGGGGGRAKVTPNLAVDGEGTRTLNLTVLQRLDPAVEDILITAAHVTLYDFDTDVNQWSRKDVEGSLFVVKRNAQPRFQFIVMNRRNTDNLVEDLLGDFEYQLQAPYIMYRNAAQEVIGIWFYNSQECQEVANLFNRILNAFSKVPPKPKIPSVQSEFEELEAAPALVEGPLEPQTSSIMSTTTHVQEDPLSAFFSAAANTGGNSAVAVARQPIQPFGPTPVATHAAASITTAQSPGLHYLLPSQASTVSGMLADAHGGTGSIGRSTSLVNPSLFSPLTSSQTTMMRSNPAVPTAPPQHPRTAQQPQSAPLLQPFPLPTASPSPPYGTPLLQPFPPPNPSPSLASAPVLSPALSRDKVRDALLRLVENDEFVDLVYREIMNRQ

SEQ ID NO: 787 - DNA, 1326 bp, Sorghum bicolor
  misc_feature: Ceres ANNOT ID no. 6010599
  misc_feature: Encodes the peptide sequence at SEQ ID NO 788
atggccgccgccgccaccgccaccgccaccgccgtctcttcctccactttccccctcctcctcctactaccgctcctgctctgctcctgctcgcacctcaccctcgcctcggcagaagaggcggcgccggcgtcggcggcggcggagctcctgggagaggcgcgcgcgccggggttcgcggagtggctgcgcggcgtgcggcggcgcatccacgagcggcccgagctggccttccaggagcaccggacaagcgagctcgtgcgggccgagctcgacgccatcggcgtcccctacacgtggcccgtcgcccagaccggcgtcgtggccaccatcgtcggcgccgccgccgccgacggccccgtcgtcgcgctccgggccgacatggacgcgctccccgtgcaggagttggtggattgggaacacaagagccaggaaagtgggaaaatgcatgcttgcggacatgatgcacacacaacaatgcttctgggggctgctaggatacttcaagatcgcaagaatgacctaaagccggcagaggagggtcagggtggtgcatattatgtgttacaggaaggtgttcttgacgatgtgtcagccatatttggcttgcatgttgacccagcccttcctgtaggtgttgtttcatctaggccaggaccctttgcagcaacatcaggtcgattcctagcaacggttactggtaaaggtgggcatgctgcaatgccccatgattccatcgaccctgttgtagctgcagccactactatcgtcagccttcaacaaattatcgctcgggaaatagatcccctgcagggtgcagttgtatccatcacttttatgaaaggaggagaagcttacaatgttattccagagtctgtggcctttggtggcaccttgaggagcatgacaaatgaaggtttatcatatctcaagaagaggatcaaagagatcgtagaaggacagtcactggtacatcattgcactgcctctgtggacttcatggaggacacgatgaggacatatccggctgtgatcaatgatgaaaggatgtatgctcacgcaaaggaagtggctgagagcctccttggggacaagaacgtcaagcttggtccccaggtaatgggtgcagaggatttcgggttctatgcgcagagaatggcgggcgccttcttcaccattggagttggcaacaaaagcaccatggagacaatccattccactcactcaccctactttgtgatcgatgaggatgtgcttcccatcggagctgcgttccatgccggtgtggcaattgaatatgtgaagaagaatcatgcatcaatctaa

SEQ ID NO: 788 - protein, 441 aa, Sorghum bicolor
  misc_feature: Ceres ANNOT ID no. 6010599
  misc_feature (123)..(432): Pfam Id: Peptidase_M20 Pfam Desc: Peptidase family M20/M25/M40
  misc_feature (222)..(326): Pfam Id: M20_dimer Pfam Desc: Peptidase dimerisation domain
  misc_feature (21)..(437): NCBI GI: 92878648 NCBI Desc: peptidase m20 [medicago truncatula]
  misc_feature (45)..(437): NCBI GI: 6728974 NCBI Desc: iaa-amino acid hydrolase (ilr1) [arabidopsis thaliana]
  misc_feature (45)..(437): NCBI GI: 21554648 NCBI Desc: iaa-amino acid hydrolase (ilr1) [arabidopsis thaliana]
  misc_feature (45)..(437): NCBI GI: 18652314 NCBI Desc: iaa-amino acid hydrolase [arabidopsis suecica]
  misc_feature (45)..(437): NCBI GI: 887785 NCBI Desc: ilr1
MAAAATATATAVSSSTFPLLLLLPLLLCSCSHLTLASAEEAAPASAAAELLGEARAPGFAEWLRGVRRRIHERPELAFQEHRTSELVRAELDAIGVPYTWPVAQTGVVATIVGAAAADGPVVALRADMDALPVQELVDWEHKSQESGKMHACGHDAHTTMLLGAARILQDRKNDLKPAEEGQGGAYYVLQEGVLDDVSAIFGLHVDPALPVGVVSSRPGPFAATSGRFLATVTGKGGHAAMPHDSIDPVVAAATTIVSLQQIIAREIDPLQGAVVSITFMKGGEAYNVIPESVAFGGTLRSMTNEGLSYLKKRIKEIVEGQSLVHHCTASVDFMEDTMRTYPAVINDERMYAHAKEVAESLLGDKNVKLGPQVMGAEDFGFYAQRMAGAFFTIGVGNKSTMETIHSTHSPYFVIDEDVLPIGAAFHAGVAIEYVKKNHASI

SEQ ID NO: 789 - DNA, 354 bp, Sorghum bicolor
  misc_feature: Ceres ANNOT ID no. 6010603
  misc_feature: Encodes the peptide sequence at SEQ ID NO 790
atgaatacgaggccgttggtgctcgtcttccttctgctcgtgctcgtcatcacgtcgcagttcgagtggaagcagcagatcggggaggccgcggacgccaacccggccgccgcccgccgccggcagcagctgctcgccagggaggacgctgtcaaggaaaagattatattatctcaggagaaaaatattcaacagcttaaccagcttatcgagagccttcagcgccagctactgcactgtcgcggtagcaataacactgtccatgctgttactgctgctgctgctgctgctgccgccacagaagtaagtgaagtcgagggacatgagatcatcgaagatgagaatagacgatga

SEQ ID NO: 790 - protein, 117 aa, Sorghum bicolor
  misc_feature: Ceres ANNOT ID no. 6010603
  misc_feature: Useful for making plants with modulated nitrogen use efficiency
  misc_feature: Functional homolog of the protein sequence given in SEQ ID NO 13040
MNTRPLVLVFLLLVLVITSQFEWKQQIGEAADANPAAARRRQQLLAREDAVKEKIILSQEKNIQQLNQLIESLQRQLLHCRGSNNTVHAVTAAAAAAAATEVSEVEGHEIIEDENRR

SEQ ID NO: 791 - DNA, 1005 bp, Sorghum bicolor
  misc_feature: Ceres ANNOT ID no. 6010610
  misc_feature: Encodes the peptide sequence at SEQ ID NO 792
atggacggcggcgcgtcggagctgcgcgaggcccaccgcctgacgggccacggcgaccgcgtgtgggcgctcgcctggaaccccgccccgggccccggctccggccccgtcctcgcctcctgcagcggcgacaagaccgtccggatctggaagcgcgcccccgacggcgcctggcagtgctcggatgtgctggaagacacgcacaaccgcacggtgaggtcctgcgcctggtcccccaacgggaagatgctggccacgggaagcttcgacgccaccacagcggggcatgagaacgaggtgaagagcgtgtcgtggagcccgtccgggtcgctgctcgcaacgtgcagccgggacaagacggcgtggatatgggaggtgctgccagggaacgagttcgagtgtgcctcggtgctgacgggccacacgcaggacgtcaagatggtgcagtggcacccggtcctcgacattttggtctccgtcagctatgataataccatcagggtctgggctgatgacggagacgacgagtggcactgtgtgcagacattaactgaagccaataactgtggtcattcatcaacagtgtgggcattatcctttaactttaaaggtgataggatggtcacatgcagtgatgaccaaacgttaaagatatgggacaccagcgctgatttgtctcaaccaaaaactggcgaaggccatgaatcttggcaacacctttctactctcacaggatatcatggacgaacgattttttcagcccattggtcaagcgaggatattatagctagtggtgcgggtgacgatgcaatctgcctttttactgaggagaagagtaccatggttgagaggccctcatacagattaatattaaagaaagagaaggcacatgttatggacataaactctgtgcgatggtgtcctcaggacccaaggttattggcatccgcgagcgatgatggcatggtgaaattgtgggaactgagagggaatgtactggattga

SEQ ID NO: 792 - protein, 334 aa, Sorghum bicolor
  misc_feature: Ceres ANNOT ID no. 6010610
  misc_feature (8)..(51): Pfam Id: WD40 Pfam Desc: WD domain, G-beta repeat
  misc_feature (87)..(125): Pfam Id: WD40 Pfam Desc: WD domain, G-beta repeat
  misc_feature (132)..(170): Pfam Id: WD40 Pfam Desc: WD domain, G-beta repeat
  misc_feature (182)..(220): Pfam Id: WD40 Pfam Desc: WD domain, G-beta repeat
  misc_feature (288)..(327): Pfam Id: WD40 Pfam Desc: WD domain, G-beta repeat
  misc_feature (58)..(328): NCBI GI: 140062223 NCBI Desc: wd40-like [medicago truncatula]
  misc_feature (57)..(308): NCBI GI: 79323100 NCBI Desc: emb1345; nucleotide binding [arabidopsis thaliana]
  misc_feature (8)..(308): NCBI GI: 22329107 NCBI Desc: transducin family protein / wd-40 repeat family protein [arabidopsis thaliana]
  misc_feature (4)..(327): NCBI GI: 28279952 NCBI Desc: zgc:55911 protein [danio rerio]
  misc_feature (12)..(328): NCBI GI: 125807283 NCBI Desc: ga11817-pa [drosophila pseudoobscura]
  misc_feature: The sequence is a functional homolog of SEQ ID NO. 502 in the 11/188,298 US application
  misc_feature: The sequence is a functional homolog of SEQ ID NO. 485 in the 11/188,298 US application
MDGGASELREAHRLTGHGDRVWALAWNPAPGPGSGPVLASCSGDKTVRIWKRAPDGAWQCSDVLEDTHNRTVRSCAWSPNGKMLATGSFDATTAGHENEVKSVSWSPSGSLLATCSRDKTAWIWEVLPGNEFECASVLTGHTQDVKMVQWHPVLDILVSVSYDNTIRVWADDGDDEWHCVQTLTEANNCGHSSTVWALSFNFKGDRMVTCSDDQTLKIWDTSADLSQPKTGEGHESWQHLSTLTGYHGRTIFSAHWSSEDIIASGAGDDAICLFTEEKSTMVERPSYRLILKKEKAHVMDINSVRWCPQDPRLLASASDDGMVKLWELRGNVLD

SEQ ID NO: 793 - DNA, 582 bp, Sorghum bicolor
  misc_feature: Ceres ANNOT ID no. 6010656
  misc_feature: Encodes the peptide sequence at SEQ ID NO 794
atggcgccgccgccgcggacgtcggcgccggtcatcaacatcatcatcgccgccggtgtcgtcctcctctccttgctcgccgcagcattcacggcggctgcggctgcggcgcctggcagtgatgagacgacgacatgcgcgccgtcgctgcagcggctgctgtcgtgcctggacttcatcgagcaccggtcggacgaggtaccgacgccgtgctgcatccaggtgaggcgcacggtggcggagcagccgtgctgcctcatgcacgtcgtgcgcggcgacgccgccaggctcatcggcggccccgagtacgacaacacccgcgccgtggtcaacgtcaccgccgcgtgcctcggcggcgacgacgcatccgtcctcatgtccatcacccgcaactgctcaggcaagccgctcccgccgctgacacctgagtttacgttcactaccgccgaggtgccgccgccatcgtcgtcgtcgtcgtcagtaacaatgtatgcgggctcgtcggcttggacctcattgttgctaggtcgtcttgttgttccggccgtcgtctatggagccgttggtgttctggaaatttag

SEQ ID NO: 794 - protein, 193 aa, Sorghum bicolor
  misc_feature: Ceres ANNOT ID no. 6010656
  misc_feature (16)..(169): NCBI GI: 50509338 NCBI Desc: protease inhibitor-like protein [oryza sativa (japonica cultivar-group)]
  misc_feature (44)..(163): NCBI GI: 38347146 NCBI Desc: osjnba0039g19.6 [oryza sativa (japonica cultivar-group)]
  misc_feature (8)..(190): NCBI GI: 25553602 NCBI Desc: protease inhibitor-like protein [oryza sativa (japonica cultivar-group)]
MAPPPRTSAPVINIIIAAGVVLLSLLAAAFTAAAAAAPGSDETTTCAPSLQRLLSCLDFIEHRSDEVPTPCCIQVRRTVAEQPCCLMHVVRGDAARLIGGPEYDNTRAVVNVTAACLGGDDASVLMSITRNCSGKPLPPLTPEFTFTTAEVPPPSSSSSSVTMYAGSSAWTSLLLGRLVVPAVVYGAVGVLEI

SEQ ID NO: 795 - DNA, 1329 bp, Sorghum bicolor
  misc_feature: Ceres ANNOT ID no. 6010661
  misc_feature: Encodes the peptide sequence at SEQ ID NO 796
atggcgcgctgctccgtcgccgtcgcgaaaccgttctgcgccaccaccgcgactccccgtctctctcgtcgcggccggcggctctccgcgaacgccgccaccccggccatgcccaccaataaggcagggttgccggctctaagcaaaccggccaaaccaacgccgccgcctcttctctcgcgtccgatgctccccgtccccaccaacaccgccactgacaccaccagcagcgacaaggattgcaccaagaaaccaccgccggaagctacggactcgcatccgtgctcgtccggcgccggcgacgtgctccgcctgatggacgcgctgggcatcccgcccgacgaggacatctacatatctctcctcagggagtgcgccgacgcagcggaggtggcctccgtgcacgcgcacatgaccgcgtgttgcgcctccgatgcacttccgtcgccggtcgccaaccgggtgctgctctcatacgccgcgtgtggggatatcgaagctgcacgccgggtgttcgacggaatgcctgacaggaacggcatggcgtgggcgaccatggtgtccgcctactcggacggttgcttccaccatgaagcaatgcgtctgttcgcccacatgtgccacaggacgctggtcctggatggcgattgctgctcccatgccattctggccgtgctgcggtcatgtattcgtgcaggcgaactacggctcggcgagcaggtacacgctctcgtcatcaagaaaggcaggattcttggcgacattggtagctcgctagtgcagctatactgcgagagcagcggtcttcacagaagcgcgcgacgagttctcgtgatgatgatgcagcaccactgtcaggaaccagtccctgaggcggcctggacgagcctgatcacatgctgccaccgagacggccagctgagtgaggccatcgacgtcttcagggacatggcgtcctccggcgttccaaggagcagcttctccctgtcgagcatcctcgcggtgttcgcagagtcacagaaccaagggtgctgctgcgggcagcaggtgcacgccgacgccatcaagcgtggcgtggacacgaaccagttcgttggctctgggctggtgcacatgtacgcaaagcaagggtggctggcagatgccgtcagggcgttcggggcgatcggtggcaagcctgacaccgcctgctggagcgccctggccttggcgtatgctcgcggcggacggtacagagaagccaccagagtcatgtatcagatgaaagctgccgggatgactccttcgcaagagatggccgatgcggttaggttggcctgtttcagatga

SEQ ID NO: 796 - protein, 442 aa, Sorghum bicolor
  misc_feature: Ceres ANNOT ID no. 6010661
  misc_feature (292)..(326): Pfam Id: PPR Pfam Desc: PPR repeat
  misc_feature (396)..(430): Pfam Id: PPR Pfam Desc: PPR repeat
  misc_feature (35)..(440): NCBI GI: 92894078 NCBI Desc: pentatricopeptide repeat [medicago truncatula]
  misc_feature (106)..(440): NCBI GI: 115465661 NCBI Desc: os05g0581300 [oryza sativa (japonica cultivar-group)]
  misc_feature (83)..(428): NCBI GI: 38606535 NCBI Desc: osjnba0016o02.23 [oryza sativa (japonica cultivar-group)]
  misc_feature (83)..(428): NCBI GI: 116310014 NCBI Desc: osigba0124n08.1 [oryza sativa (indica cultivar-group)]
  misc_feature (104)..(428): NCBI GI: 38344148 NCBI Desc: osjnba0041a02.15 [oryza sativa (japonica cultivar-group)]
MARCSVAVAKPFCATTATPRLSRRGRRLSANAATPAMPTNKAGLPALSKPAKPTPPPLLSRPMLPVPTNTATDTTSSDKDCTKKPPPEATDSHPCSSGAGDVLRLMDALGIPPDEDIYISLLRECADAAEVASVHAHMTACCASDALPSPVANRVLLSYAACGDIEAARRVFDGMPDRNGMAWATMVSAYSDGCFHHEAMRLFAHMCHRTLVLDGDCCSHAILAVLRSCIRAGELRLGEQVHALVIKKGRILGDIGSSLVQLYCESSGLHRSARRVLVMMMQHHCQEPVPEAAWTSLITCCHRDGQLSEAIDVFRDMASSGVPRSSFSLSSILAVFAESQNQGCCCGQQVHADAIKRGVDTNQFVGSGLVHMYAKQGWLADAVRAFGAIGGKPDTACWSALALAYARGGRYREATRVMYQMKAAGMTPSQEMADAVRLACFR

SEQ ID NO: 797 - DNA, 243 bp, Sorghum bicolor
  misc_feature: Ceres ANNOT ID no. 6010672
  misc_feature: Encodes the peptide sequence at SEQ ID NO 798
atggccgcgggtgctgcgccgaccaatttgcagaaggagcagatgtttggattggcggagaaagagatggagtatagggttgaccttttcaatcggcttacacatacatgttttgacaagtgcatcgagaagaggcacaaggatgctgagctcaatatgggagagaacagctgcattgaccgatgtgtttctaagtattggcaggaaagtttgtttctgtgttcttggtccattccgtattga

SEQ ID NO: 798 - protein, 80 aa, Sorghum bicolor
  misc_feature: Ceres ANNOT ID no. 6010672
  misc_feature (14)..(80): Pfam Id: zf-Tim10_DDP Pfam Desc: Tim10/DDP family zinc finger
  misc_feature (1)..(68): NCBI GI: 115456309 NCBI Desc: os03g0825400 [oryza sativa (japonica cultivar-group)]
  misc_feature (9)..(68): NCBI GI: 38175439 NCBI Desc: small zinc finger-like protein [oryza sativa (japonica cultivar-group)]
  misc_feature (3)..(68): NCBI GI: 5107180 NCBI Desc: small zinc finger-like protein [lycopersicon esculentum]
  misc_feature (5)..(68): NCBI GI: 5107088 NCBI Desc: small zinc finger-like protein [pinus taeda]
  misc_feature (11)..(68): NCBI GI: 145344697 NCBI Desc: mpt family transporter: inner membrane translocase (import) tim10 [ostreococcus lucimarinus cce9901]
MAAGAAPTNLQKEQMFGLAEKEMEYRVDLFNRLTHTCFDKCIEKRHKDAELNMGENSCIDRCVSKYWQESLFLCSWSIPY

SEQ ID NO: 799 - DNA, 822 bp, Sorghum bicolor
  misc_feature: Ceres ANNOT ID no. 6010689
  misc_feature: Encodes the peptide sequence at SEQ ID NO 800
atgacgggctcaatggatctcccggccaagggcgggttcagcttcgacctgtgccgccgcaacaacatgctggagaagaacgggctcaagctccccggattcaggaagaccgggacaaccatcgtcggcctcgtctttcaggatggagttgttcttggggcagacacaagggcaactgaggggcctatagttgctgataagaattgtgagaagatccactttatggcaccaaacatctattgctgtggagcaggaactgctgctgacactgaggctgttacagacatggtcagctcgcagctacagctgcaccgttatgcaacaggccgcgaatctagagtcgtaactgctcttacactgctgaagtcacacctctttaggtatcaaggccatgtcagtgctgcccttgttcttggtggagtggattgtactggaccacatcttcatactgtttatccacatggctccactgatactcttccttttgccacgatgggttctggatcccttgctgcgatgtcagtgtttgaatcgaagtacaaagaaggcctcactagggaagagggaatacaactggtgtcggacgcaatatgtgcaggtatcttcaatgacttgggtagtggaagcaatgtggatgtctgtgtgataaccaaggggaagacagaatacttgagaaaccaccagttgccgaatcccagaacatatgctagttcaaagggatatagcttctccaaggggcagactgaggtactgtcaacaaagatcacacctcttaagcagaaggttgaggtcactgagggtggtgatgctatggaggagtga

SEQ ID NO: 800 - protein, 273 aa, Sorghum bicolor
  misc_feature: Ceres ANNOT ID no. 6010689
  misc_feature (35)..(216): Pfam Id: Proteasome Pfam Desc: Proteasome A-type and B-type
  misc_feature (1)..(273): NCBI GI: 124359794 NCBI Desc: peptidase t1a, proteasome beta-subunit [medicago truncatula]
  misc_feature (4)..(273): NCBI GI: 30023762 NCBI Desc: at3g27430 [arabidopsis thaliana]
  misc_feature (4)..(273): NCBI GI: 2511578 NCBI Desc: multicatalytic endopeptidase [arabidopsis thaliana]
  misc_feature (4)..(273): NCBI GI: 9758084 NCBI Desc: 20s proteasome beta subunit pbb2 [arabidopsis thaliana]
  misc_feature (4)..(273): NCBI GI: 21387013 NCBI Desc: 20s proteasome beta subunit pbb2 [arabidopsis thaliana]
  misc_feature (4)..(273): SWISSPROT Homolog: EC 3.4.25.1 Proteasome subunit beta type 7-A precursor
  misc_feature: The sequence is a functional homolog of SEQ ID NO. 409 in the 11/188,298 US application
MTGSMDLPAKGGFSFDLCRRNNMLEKNGLKLPGFRKTGTTIVGLVFQDGVVLGADTRATEGPIVADKNCEKIHFMAPNIYCCGAGTAADTEAVTDMVSSQLQLHRYATGRESRVVTALTLLKSHLFRYQGHVSAALVLGGVDCTGPHLHTVYPHGSTDTLPFATMGSGSLAAMSVFESKYKEGLTREEGIQLVSDAICAGIFNDLGSGSNVDVCVITKGKTEYLRNHQLPNPRTYASSKGYSFSKGQTEVLSTKITPLKQKVEVTEGGDAMEE

SEQ ID NO: 801 - DNA, 1344 bp, Sorghum bicolor
  misc_feature: Ceres ANNOT ID no. 6010739
  misc_feature: Encodes the peptide sequence at SEQ ID NO 802
atggtgctggatctcaatgccgagtcgccgacggccggctcggcctcggccacctcgagctccagcggcgtcttccggttcgacctgctcggagggacacccgacgaggagggttgctcgccctcgccgcccgttgtgacgcgccagctcttccccttgccgtcgtacccggacgctgctgcagctcccaccgccgcctcgaacgggtcgccgccgccgccgcaggcggcagggccatgggcgcgccgcgcagcggatctcgtggcgccggcgctgggacagggacagggacagggggcggtggttatgcctgcgccttcgtcgccgcccgcggctgtgtctccagccgccgggaagaagagccgacgggggcccaggtcgcggagctcgcagtacaggggcgtcaccttctacaggaggaccggccgctgggagtcacacatctgggcctatgatcgtgctgcaatcaagttcagaggccttgacgcagacatcaatttccagttgaaggactatgaggatgatttgaagcagatgaagaattggaccaaggaggaatttgttcacatactccgacggcaaagcactgggtttgccagggggagctcaaagtaccgcggtgtgacactgcacaagtgtggtcggtgggaagctcggatgggtcagcttctgggaaagaagtacatctaccttgggctgtttgacagtgaaatcgaagcagcaagagcgtatgacagggcagccattcgcttcaacggaccggatgctgttactaacttcgattctagttcctatgatggagatgtcccacttccaacggcaatcgagaaagatgtggttgatggggacatccttgatctgaatttgaggatttcacaacctaatgtgcatgatctcaaaagtgatggtaccctgactggttttggattaggttgtaattctcctgaagcttcaagctccattgtttctcagccaataagccctcagtggcctgtgcatcctcacagcacaccgatgcaactccagcatccacatctgtatgcgtctccttgtccaggcttctttgtgaacctcagggaggcgcctatggaggaggagaaacgggcagagcgggcgggtcccgagccggcgttcccctcttgggcatggcaaacgcagggctcccctgccccgtttctccctgccactgctactgcagcatcatcaggattctctacagccgccaccaccaccggcgtggacgcggccacagccgcccgcagcgtgccgccgtccttgtccggtggcccccggcagttgttctccggctaccagctccagctccgcttccccccaaccgcctga

SEQ ID NO: 802 - protein, 447 aa, Sorghum bicolor
  misc_feature: Ceres ANNOT ID no. 6010739
  misc_feature (203)..(254): Pfam Id: AP2 Pfam Desc: AP2 domain
  misc_feature (1)..(430): NCBI GI: 18476518 NCBI Desc: apetala2-like protein [hordeum vulgare]
  misc_feature (1)..(408): NCBI GI: 53830033 NCBI Desc: floral homeotic protein [triticum urartu]
  misc_feature (1)..(408): NCBI GI: 53801434 NCBI Desc: floral homeotic protein [triticum monococcum]
  misc_feature (1)..(408): NCBI GI: 53830037 NCBI Desc: floral homeotic protein [triticum aestivum subsp. spelta]
  misc_feature (1)..(408): NCBI GI: 53830021 NCBI Desc: floral homeotic protein [triticum aestivum subsp. spelta]
  misc_feature: The sequence is a functional homolog of SEQ ID NO 467 in the 10/374,780US patent application
  misc_feature: Useful for making plants with altered alkaloid content
  misc_feature: Useful for making plants with modulated biomass
  misc_feature: Useful for making plants with modulated growth and phenotype characteristics
  misc_feature: Useful for making plants with modulated seed size
  misc_feature: Useful for making plants with modulated nitrogen use efficiency
  misc_feature: Functional homolog of the protein sequence given in SEQ ID NO 13222
  misc_feature: Functional homolog of the protein sequence given in SEQ ID NO 13414
  misc_feature: Functional homolog of the protein sequence given in SEQ ID NO 13481
  misc_feature: The sequence is a functional homolog of SEQ ID NO 467 in the 20060162006 US patent application
  misc_feature: Useful for biocontainment applications
  misc_feature: Functional homolog of the protein sequence given in SEQ ID NO 14008
  misc_feature: Useful for making plants with modulated biomass
  misc_feature: Functional homolog of the protein sequence given in SEQ ID NO 13414
  misc_feature: The sequence is a functional homolog of SEQ ID NO. 274 in the 11/188,298 US application
MVLDLNAESPTAGSASATSSSSGVFRFDLLGGTPDEEGCSPSPPVVTRQLFPLPSYPDAAAAPTAASNGSPPPPQAAGPWARRAADLVAPALGQGQGQGAVVMPAPSSPPAAVSPAAGKKSRRGPRSRSSQYRGVTFYRRTGRWESHIWAYDRAAIKFRGLDADINFQLKDYEDDLKQMKNWTKEEFVHILRRQSTGFARGSSKYRGVTLHKCGRWEARMGQLLGKKYIYLGLFDSEIEAARAYDRAAIRFNGPDAVTNFDSSSYDGDVPLPTAIEKDVVDGDILDLNLRISQPNVHDLKSDGTLTGFGLGCNSPEASSSIVSQPISPQWPVHPHSTPMQLQHPHLYASPCPGFFVNLREAPMEEEKRAERAGPEPAFPSWAWQTQGSPAPFLPATATAASSGFSTAATTTGVDAATAARSVPPSLSGGPRQLFSGYQLQLRFPPTA

SEQ ID NO: 803 - DNA, 729 bp, Sorghum bicolor
  misc_feature: Ceres ANNOT ID no. 6010741
  misc_feature: Encodes the peptide sequence at SEQ ID NO 804
atggccggccccgtctcctcagcgccccggaccgtcgaggacatctacaaggactacaccggccgccgcgccggcctcgtccgcgctctcacctccgatgtggacgagttctacagcatgtgcgacccagagaaggagaacctgtgcctgtacggtcacccgaacggcggctgggaggtgtccctgccggtggaggaagtgccgccggagatgcccgagccggcgctcgggatcaacttcgccagggacggcatgaagcgccgcgactggctctcgctcgtcgccgtgcactccgacgcctgggtcgtctccgtcgcattcttcttcgccgccaaactcaacgccaacgagaggaagcgcttattcaacatgattaatgaacatccatctgtgtatgaaacaatgactgaacggaagggaagggagaataagcctggtgttgataacagcagcaaatctaggcactcaacaaagcgatcaaatgatggcaagacaaagaactcaagagtggcagttgtcgaagatgggtatggggatgatgatgaacacagtgaaaccctttgcgggtcctgcagtggtctctacaactcaagcgagttctggattggatgcgacatttgcgagcggtggttccacggcaaatgcgtgaggataactccagcgaaagcggaacagataaagcactacaagtgtcctgattgcagctacaagaaaagcggcaggcaataa

SEQ ID NO: 804 - protein, 242 aa, Sorghum bicolor
  misc_feature: Ceres ANNOT ID no. 6010741
  misc_feature (187)..(237): Pfam Id: PHD Pfam Desc: PHD-finger
  misc_feature (5)..(238): NCBI GI: 116563481 NCBI Desc: phd4 [medicago truncatula]
  misc_feature (6)..(242): NCBI GI: 21536795 NCBI Desc: nucleic acid binding protein-like [arabidopsis thaliana]
  misc_feature (6)..(239): NCBI GI: 45387429 NCBI Desc: nucleic acid-binding protein [lycopersicon esculentum]
  misc_feature (9)..(238): NCBI GI: 115394658 NCBI Desc: phd6 [glycine max]
  misc_feature (9)..(239): NCBI GI: 115394654 NCBI Desc: phd4 [glycine max]
  misc_feature: Useful for making plants with altered Lignin content
  misc_feature: Useful for making plants with modulated biomass
  misc_feature: Useful for making plants with modulated drought sensitivity
  misc_feature: Useful for making plants with modulated flowering time
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13472
  misc_feature: GREAT-hit functional homolog of the protein sequence given in SEQ ID NO 13473
  misc_feature: Useful for making plants with altered lignin content
  misc_feature: Useful for making plants with modulated flowering time
  misc_feature: Functional homolog of the protein sequence given in SEQ ID NO 13473
  misc_feature: The sequence is a functional homolog of SEQ ID NO. 482 in the 11/188,298 US application
MAGPVSSAPRTVEDIYKDYTGRRAGLVRALTSDVDEFYSMCDPEKENLCLYGHPNGGWEVSLPVEEVPPEMPEPALGINFARDGMKRRDWLSLVAVHSDAWVVSVAFFFAAKLNANERKRLFNMINEHPSVYETMTERKGRENKPGVDNSSKSRHSTKRSNDGKTKNSRVAVVEDGYGDDDEHSETLCGSCSGLYNSSEFWIGCDICERWFHGKCVRITPAKAEQIKHYKCPDCSYKKSGRQ

SEQ ID NO: 805 - DNA, 1293 bp, Sorghum bicolor
  misc_feature: Ceres ANNOT ID no. 6010749
  misc_feature: Encodes the peptide sequence at SEQ ID NO 806
atggcgggggccaaggcggctgcgggcggctcggcggcgccgctgctgccggcgcaggcgggggaagggagctcagcaagaggcgcgggcggaggggccacgtcggcgcagacgctggggaacgtggtggtctccatcgtgggcaccggcgtgctcggcctcccctacgccttccgcgccgccggctgggtcgccggctccctcggcgtcgccgccgccggctccgccacgctctactgcatgttgctactcgtggactgcagggataaactcgcagaggaggaaactgaagagtgctgtcatggtcattacacatatggggatttgggtgacaggtgcttcgggacgataggtcgatgcttgacagaaatcctcgtccttgtttcgcaggctggtggttctgtggcatacctaatattcattggccaaaatctacattccacattcagccagttgatgtcaccagctggcttcatctttgctatcctcctgcctctgcagatagcactctccttcatccgttcactgtcttccctttctccattcagtatatttgcagatgtgtgcaatgtccttgcgatggcaattgttatcaaagaggatcttcagctttttgaccatcccttttcacatagaagtgcttttaatggactttgggcagtaccattcacctttggtgttgcagtcttctgtttcgaaggattcagcatgacccttgcgctagaagcgtcaatggcagagcggagaaagttccgctgggtactttctcaagcagttgctgccattataaccgtgtatgtctgttttggagtgtgtgggtacttggcctatggcgaggccacaaaagacatcataacacttaatcttccaaacaattggtcgtctgctgcagttaaggttggcctatgtattgcactggcattcactttcccagtgatgatgcacccaatccacgagatcgttgagacaagattcagatccaacggatgctttcagaagctctgccgcaataatgttggtggcgccgagtggataggcttgcactcaagccgtatcctcgtggtgacggtcctgactgtggtggcatctttcatccctgcctttgggtccttcatctcatttgtcgggagcaccatgtgcgcgcttctctccttcgtgctgcccgctctcttccatctcagcattgtaggctcgtcgatacccttgtggaggcgggtgctggactacgccatccttctatttggtctggcttttgccggatgtggtcttgtcactgctctctccccgcattga

SEQ ID NO: 806 - protein, 430 aa, Sorghum bicolor
  misc_feature: Ceres ANNOT ID no. 6010749
  misc_feature (31)..(428): Pfam Id: Aa_trans Pfam Desc: Transmembrane amino acid transporter protein
  misc_feature (69)..(430): NCBI GI: 115471269 NCBI Desc: os07g0231400 [oryza sativa (japonica cultivar-group)]
  misc_feature (6)..(422): NCBI GI: 2576363 NCBI Desc: amino acid transport protein
  misc_feature (12)..(428): NCBI GI: 38345408 NCBI Desc: osjnba0017b10.14 [oryza sativa (japonica cultivar-group)]
  misc_feature (19)..(428): NCBI GI: 30688867 NCBI Desc: amino acid transporter family protein [arabidopsis thaliana]
  misc_feature (10)..(427): NCBI GI: 10177114 NCBI Desc: amino acid transporter protein-like [arabidopsis thaliana]
  misc_feature: The sequence is a functional homolog of SEQ ID NO. 438 in the 11/188,298 US application
  misc_feature: The sequence is a functional homolog of SEQ ID NO. 313 in the 11/188,298 US application
MAGAKAAAGGSAAPLLPAQAGEGSSARGAGGGATSAQTLGNVVVSIVGTGVLGLPYAFRAAGWVAGSLGVAAAGSATLYCMLLLVDCRDKLAEEETEECCHGHYTYGDLGDRCFGTIGRCLTEILVLVSQAGGSVAYLIFIGQNLHSTFSQLMSPAGFIFAILLPLQIALSFIRSLSSLSPFSIFADVCNVLAMAIVIKEDLQLFDHPFSHRSAFNGLWAVPFTFGVAVFCFEGFSMTLALEASMAERRKFRWVLSQAVAAIITVYVCFGVCGYLAYGEATKDIITLNLPNNWSSAAVKVGLCIALAFTFPVMMHPIHEIVETRFRSNGCFQKLCRNNVGGAEWIGLHSSRILVVTVLTVVASFIPAFGSFISFVGSTMCALLSFVLPALFHLSIVGSSIPLWRRVLDYAILLFGLAFAGCGLVTALSPH

SEQ ID NO: 807 - DNA, 846 bp, Sorghum bicolor
  misc_feature: Ceres ANNOT ID no. 6010789
  misc_feature: Encodes the peptide sequence at SEQ ID NO 808
atgtcaggcctgtacagccagggcttctcccctgcaagaaccctctccccccagattaggagcaaccccgacgctgacagccagtacttggccgagcttctcgcggagcatcagaagctggggcccttcatgcaggtgctgcccatatgcagccggttgctcaaccaagaaatcatgcgggtatcaagcatggttcatgaccatggatttagtgatcttgacaggcgccggtttagaagccctagtcctatgtcttcaccaattgttcggcctaatctacatggcaatggatttggtccttggaatgggatgcaccaagagagattgggccttcctcctcctggaacaagtatggattggcaaggagcaccaccaagtcctggctcttatattgtcaagaagatcgtacgcttggaagttcctgtcgactcttaccctaatttcaactttgtggggcgcattctaggcccaaggggtaattctctaaagcgagtcgaagcatcaactggctgccgtgtttttattagaggaaagggttccatcaaagacacagaaaaggaggagaagcttaaaggaaaacctggctatgaacatctgaatgagccactgcatatattgatcgaggctgagttaccagcaaatgtcattgatacaagactgagacaggcacaagaagttatggaagaattgctaaagccggtggaagagtcacaagatttctacaagaggcaacagctgagggaattggctatgctaaactcaactctgagagaagatagccctcatcctggaagtgtctcccctttcagtaacggtggcatgaaacgcgcgaaaccaagccagtag

SEQ ID NO: 808 - protein, 281 aa, Sorghum bicolor
  misc_feature: Ceres ANNOT ID no. 6010789
  misc_feature (3)..(280): NCBI GI: 24060154 NCBI Desc: kh domain-like protein [oryza sativa (japonica cultivar-group)]
  misc_feature (1)..(278): NCBI GI: 115464523 NCBI Desc: os05g0481500 [oryza sativa (japonica cultivar-group)]
  misc_feature (4)..(234): NCBI GI: 92867398 NCBI Desc: facilitated glucose transporter; kh, type 1 [medicago truncatula]
  misc_feature (28)..(278): NCBI GI: 92893883 NCBI Desc: kh [medicago truncatula]
  misc_feature (16)..(278): NCBI GI: 19310523 NCBI Desc: at1g09660/f21m12_5 [arabidopsis thaliana]
MSGLYSQGFSPARTLSPQIRSNPDADSQYLAELLAEHQKLGPFMQVLPICSRLLNQEIMRVSSMVHDHGFSDLDRRRFRSPSPMSSPIVRPNLHGNGFGPWNGMHQERLGLPPPGTSMDWQGAPPSPGSYIVKKIVRLEVPVDSYPNFNFVGRILGPRGNSLKRVEASTGCRVFIRGKGSIKDTEKEEKLKGKPGYEHLNEPLHILIEAELPANVIDTRLRQAQEVMEELLKPVEESQDFYKRQQLRELAMLNSTLREDSPHPGSVSPFSNGGMKRAKPSQ

SEQ ID NO: 809 - DNA, 1320 bp, Sorghum bicolor
  misc_feature: Ceres ANNOT ID no. 6010873
  misc_feature: Encodes the peptide sequence at SEQ ID NO 810
  misc_feature: Down-regulated in shoot tissues in response to salicylic acid treatment
atggcggagcacgacctcacggcgctgatggcggcgcagctggaccgccacctggtgttcccgctgctggagttcctccaggagcggcagctctactcggagccggagatcctcgaggccaagatccgcctcctcagcggcacgaatatggtagactatgccatggatatccacaagtccctccacggcaccgacgacgtccccgaggacatggtcaagcgccgcgccgaggtcgtctccaggctcaggtcgctcgaggaggccgccgccccgctcgtcgccttcctccagaacccgcagctcgtgcaggagctcaggcccgacaaacagtacaacatccacatgctccaggagcgataccagattggtcctgaccagattgaagctctgtatcagtatgccaaatttcagttcgagtgtggtaactactcaggggctgctgattacctataccagtatcgtgctttgtgcacaaacagtgagcggagtgtgagtgctctctggggaaagctggcagcagaaatcttgatgcagaactgggatgtggctttggaggaacttaatcgcttgaaggaaataattgattcaaagaacttctcatcacctctgaatcagctccagaacaggatatggctgatgcattgggctctgttcatcttctttaaccatgaaaatggtagaaatgggattattgatctgttcttccaggacaggtacttgaatgctatacagacaaatgcacaccatcttctgagatatctagctactgcagttgttgtcaacaaaaggagaaggaatatgcttaaagagttgattaaggtcattcagcaggagcagcatacctacaaggatcccataactgaatttctggaatgcttatatgtcaactatgattttgatggtgctcaacagaaacttatggagtgtgagcaggttatactgaatgatcctttcctgggcaagcgcatagaagagggcaattttgtcactgttcctttgagagatgagttccttgaaaatgctcgtctgtttattttcgagacatactgccgtattcatcggtgcattgatatcagcatgctttcccagaagctgaacatgagctatgatgaggccgagttgtggataatgaacttggttaggagctcaaaactggatgccaggatcgattcagtgtcaggaactcttatcatgacaaccaatcacgtcaatgtccatgagcagattattgagaacttgaagggcctcaacatgcggacctacatgctggcaaagaacatcgtggagccagctcaagcagctcagcaggcaactcgttga

SEQ ID NO: 810 - protein, 439 aa, Sorghum bicolor
  misc_feature: Ceres ANNOT ID no. 6010873
  misc_feature (284)..(400): Pfam Id: PCI Pfam Desc: PCI domain
  misc_feature (1)..(439): NCBI GI: 117380764 NCBI Desc: eukaryotic initiation factor 3e [oryza sativa (indica cultivar-group)]
  misc_feature (1)..(439): NCBI GI: 117380755 NCBI Desc: eukaryotic initiation factor 3e [oryza sativa (japonica cultivar-group)]
  misc_feature (4)..(439): NCBI GI: 7689381 NCBI Desc: eif3e [arabidopsis thaliana]
  misc_feature (1)..(427): NCBI GI: 60654157 NCBI Desc: eukaryotic translation initiation factor 3 subunit 6 48kda [synthetic construct]
  misc_feature (1)..(427): NCBI GI: 4503521 NCBI Desc: murine mammary tumor integration site 6 (oncogene homolog) [homo sapiens]
  misc_feature: Down-regulated in shoot tissues in response to salicylic acid treatment
MAEHDLTALMAAQLDRHLVFPLLEFLQERQLYSEPEILEAKIRLLSGTNMVDYAMDIHKSLHGTDDVPEDMVKRRAEVVSRLRSLEEAAAPLVAFLQNPQLVQELRPDKQYNIHMLQERYQIGPDQIEALYQYAKFQFECGNYSGAADYLYQYRALCTNSERSVSALWGKLAAEILMQNWDVALEELNRLKEIIDSKNFSSPLNQLQNRIWLMHWALFIFFNHENGRNGIIDLFFQDRYLNAIQTNAHHLLRYLATAVVVNKRRRNMLKELIKVIQQEQHTYKDPITEFLECLYVNYDFDGAQQKLMECEQVILNDPFLGKRIEEGNFVTVPLRDEFLENARLFIFETYCRIHRCIDISMLSQKLNMSYDEAELWIMNLVRSSKLDARIDSVSGTLIMTTNHVNVHEQIIENLKGLNMRTYMLAKNIVEPAQAAQQATR

SEQ ID NO: 811 - DNA, 531 bp, Sorghum bicolor
  misc_feature: Ceres ANNOT ID no. 6010891
  misc_feature: Encodes the peptide sequence at SEQ ID NO 812
atgtgcgatctggtggcccgcacgggccggcacctgcagcgctacgagaacggccgtcgccttgtggccgggtgcataccattcagatatagagatattaatgatgaagcttctgatgatgaacaaaagaaacttgttgaagttctcatgatcagctcccaaagtggaccaggtcttctatttccaaagggaggctgggagaatgatgaaactgttgaagaggcagctgcaagggaagctatcgaagaagctggagttcgaggagatttagtgcaactgttgggcttctatgatttcaagagcaagcaacccgaagctatgtgcagagctgcaatctttgccctgcacgtgaaggaagagctagcctcctggccagaacagaacacccggcagaggagctggctcactgttcctgaggcggcagagcagagtcgttacccatggatgcaggaagcccttgtgacaggcttctctgcctggcttgagaactggagaaatggtggtggccgtgtggatcgaagtgaaagatga

SEQ ID NO: 812 - protein, 176 aa, Sorghum bicolor
  misc_feature: Ceres ANNOT ID no. 6010891
  misc_feature (19)..(159): Pfam Id: NUDIX Pfam Desc: NUDIX domain
  misc_feature (1)..(162): NCBI GI: 92884561 NCBI Desc: nudix hydrolase [medicago truncatula]
  misc_feature (13)..(160): NCBI GI: 145332371 NCBI Desc: atnudt16 (arabidopsis thaliana nudix hydrolase homolog 16)
  misc_feature (4)..(153): NCBI GI: 140052684 NCBI Desc: nudix hydrolase [medicago truncatula]
  misc_feature (1)..(153): NCBI GI: 15231598 NCBI Desc: mutt/nudix family protein [arabidopsis thaliana]
  misc_feature (1)..(153): NCBI GI: 8698735 NCBI Desc: contains similarity to ap2/erebp-like transcription factor from arabidopsis thaliana gbaf216581 and contains bacterial mutt protein pf00293 and ap2 pf00847 domains
MCDLVARTGRHLQRYENGRRLVAGCIPFRYRDINDEASDDEQKKLVEVLMISSQSGPGLLFPKGGWENDETVEEAAAREAIEEAGVRGDLVQLLGFYDFKSKQPEAMCRAAIFALHVKEELASWPEQNTRQRSWLTVPEAAEQSRYPWMQEALVTGFSAWLENWRNGGGRVDRSER

SEQ ID NO: 813 - DNA, 1752 bp, Sorghum bicolor
  misc_feature: Ceres ANNOT ID no. 6010899
  misc_feature: Encodes the peptide sequence at SEQ ID NO 814
atggccgcccctcctctggtgttcgtcttcgctgccatagccgcgctcgccatcctcgtcctcgtcgtcttcgccttccggcgatggtggcggcggcgtgggcagcggcagcggcagcgccgcccgctccagaccgcggaggcggccccgaccccggtcgctgtccaggatgaggatatagataggcctcttctttctggaaattggggcgatcactctaggcagagtaatagttttctcggaagttctgtaggagaaccttcgaagattcaaacaaataggagtaacacttcgcctagaagtcatgcaattactgatacagggaggatttatcctgctgaatgttgtgctacacaaggagaaactcatgtaatcaatgttgaaaatgatactactgaagagtatcaattaggaagcacactaaaacgtacaccaccaccaaaatggtcaacacctgatcagaagcacagaagaagggtttctggagaggataatcataatggaagtgtttctcttaaggataatacatatcgtaacctgaatctagaggtcatagctggtccatctcatggaataagctgttctcggcagtcaagtagaccttctatgctcccaataactcttggaagggttccccctagtgatttagtgttcaaggactctgaagtatcagggaaacatgctcagataaactggaatgcaaagacattaaaatgggaacttgtggacatgggcagcttgaatggaactttcttgaactcccagtcggttcaccatccagatgctcagtctaggcgttggggtgaacctgctgaacttgcacatggtgatattataactctagggacttcatctaaactatctgttcaaatttcactgcaaaatcaacgagttcctgctggtgttggtatggcatccgatccaatggtggcacgtagaagtggaaggaaacttccaatggaagacataagcttttgccagtgtcctctgcagggtgttgaacattttgggttcttcggtatttttgatggacatggtggggatggagctgccaaagctgtcagcaagattcttccagaaaatctgggatacattttgtctcatcctgaaacaaaagaacgagtgcaatcatgtgctgatgcttctgatgttcttagatatgcttttactttgacagaagacgcaatcgatcatcagtacgagggatgtacaggcacagctcttcttatttggtttgatcagaataaagattgttttgcccagtgtgctaatcttggtgattctgcttgtgtaatgagtgtcaatggaaggacaattgatatgactgaagatcatcgagtagctagtgcaactgaaagagctaggatagcaagaactgggcagcccctgaaagatggggaagttcgtcttaatggactaaatcttgctaggatgtttggagataagtttcttaaggagcaagactcacgcttcagctcagaaccgtatgtgagccaagctgttcgtatcaccaaagcatgcacagcttttgccgttattgctagtgatgggctttgggatgtcatcagcactaaaaaggcggtacagcttgttgttgagggaaaggagaggaacgctggtgacagcacctcagcggctaaagtagccaaccgtgtattgaacgaagctaggaatttgcgaaccaaggacaacacatccgtgatatttgtagattttgacattctgagaacagatctttgtatcgccaaatga

SEQ ID NO: 814 - protein, 583 aa, Sorghum bicolor
  misc_feature: Ceres ANNOT ID no. 6010899
  misc_feature (306)..(565): Pfam Id: PP2C Pfam Desc: Protein phosphatase 2C
  misc_feature (206)..(282): Pfam Id: FHA Pfam Desc: FHA domain
  misc_feature (1)..(582): NCBI GI: 2735008 NCBI Desc: kinase associated protein phosphatase [zea mays]
  misc_feature (1)..(583): NCBI GI: 3328364 NCBI Desc: kinase associated protein phosphatase [oryza sativa]
  misc_feature (1)..(583): NCBI GI: 34394480 NCBI Desc: kinase associated protein phosphatase [oryza sativa (japonica cultivar-group)]
  misc_feature (118)..(573): NCBI GI: 1076344 NCBI Desc: kinase-associated protein phosphatase precursor - arabidopsis thaliana
  misc_feature (59)..(573): NCBI GI: 28192988 NCBI Desc: kinase-associated protein phosophatase [brassica oleracea]
  misc_feature: The sequence is a functional homolog of SEQ ID NO. 386 in the 11/188,298 US application
  misc_feature: The sequence is a functional homolog of SEQ ID NO. 406 in the 11/188,298 US application
  misc_feature: The sequence is a functional homolog of SEQ ID NO. 448 in the 11/188,298 US application
  misc_feature: The sequence is a functional homolog of SEQ ID NO. 363 in the 11/188,298 US application
MAAPPLVFVFAAIAALAILVLVVFAFRRWWRRRGQRQRQRRPLQTAEAAPTPVAVQDEDIDRPLLSGNWGDHSRQSNSFLGSSVGEPSKIQTNRSNTSPRSHAITDTGRIYPAECCATQGETHVINVENDTTEEYQLGSTLKRTPPPKWSTPDQKHRRRVSGEDNHNGSVSLKDNTYRNLNLEVIAGPSHGISCSRQSSRPSMLPITLGRVPPSDLVFKDSEVSGKHAQINWNAKTLKWELVDMGSLNGTFLNSQSVHHPDAQSRRWGEPAELAHGDIITLGTSSKLSVQISLQNQRVPAGVGMASDPMVARRSGRKLPMEDISFCQCPLQGVEHFGFFGIFDGHGGDGAAKAVSKILPENLGYILSHPETKERVQSCADASDVLRYAFTLTEDAIDHQYEGCTGTALLIWFDQNKDCFAQCANLGDSACVMSVNGRTIDMTEDHRVASATERARIARTGQPLKDGEVRLNGLNLARMFGDKFLKEQDSRFSSEPYVSQAVRITKACTAFAVIASDGLWDVISTKKAVQLVVEGKERNAGDSTSAAKVANRVLNEARNLRTKDNTSVIFVDFDILRTDLCIAK

SEQ ID NO: 815 - DNA, 1158 bp, Sorghum bicolor
  misc_feature: Ceres ANNOT ID no. 6010909
  misc_feature: Encodes the peptide sequence at SEQ ID NO 816
atggcgtcgtcctccgacgagcagcccaagccgccggagccgcccgccgcggccgccgtggttgccgccgccgccgccgccgtgccgccgcagacgcacgccgagtgggccgcctcgctccaggcctactacgccgccgcggggcaccacccctacgcctggccggcgcagcacctcatggcggcggccgcggcgggggcgcccttcggcacgccggtgccgttccccgtctaccacccaggcgccgccgcggcgtactacgcgcacgcgtccatggccgcgggcgtcccttacccgacgagcgaagctgtccccgcggttgtgccggcggctcctctaccggaagggaaaggcaaggggaagggcgggggcgcgtcgcctgagaagggcagctctggggcgccctccggcgaggacgcctccaggagcggtgacagcggcagcgacgagtcgtcagatactagagatgatgacactgaccataaggattcatctgcgcccaagaagaggaaatctggtaacacatcggctgaaggtgagccatctcaaactgctgttgtgcgctatgctgcggttgagtcgccatatcccacaaagggaaggtcggcctcgaagcttccagtgtctgcacctgggcgggcagcacttcctagtgccaccccaaatctaaacattgggatggacatttggaatgcttctccggcgttggctgttcctgcagtgcagggagaagcgaatcctgggttggcacttgcccgacgtgatggcgttactcaactggatgaacgtgaatcgaagagggagaggcgaaaacaatctaacagggagtctgcaaggagatctaggttacgcaagcagcaagagtgtgaggaactagccaggaaggtagctgacctaacaactgagaatagtgctctcagagcagaacttgacaacctcaagaaggcttgccaagacatggaagcagaaaattcacgtctattgggtggaatggctcactcccagggaccaagtgtcacaaccacattgggaatgagcattgacccaccaaaggtgcagcatcatgatgatgagggccagctccacaagaaatctagtaataacagcaacgggaactatgcgggagtcagccacaaaccggaggctaacactaggtga

SEQ ID NO: 816 - protein, 385 aa, Sorghum bicolor
  misc_feature: Ceres ANNOT ID no. 6010909
  misc_feature (262)..(325): Pfam Id: bZIP_1 Pfam Desc: bZIP transcription factor
  misc_feature (262)..(316): Pfam Id: bZIP_2 Pfam Desc: Basic region leucine zipper
  misc_feature (1)..(160): Pfam Id: MFMR Pfam Desc: G-box binding protein MFMR
  misc_feature (1)..(384): NCBI GI: 6523564 NCBI Desc: maize em binding protein-1a [zea mays]
  misc_feature (1)..(385): NCBI GI: 1304266 NCBI Desc: half-1 [triticum aestivum]
  misc_feature (181)..(385): NCBI GI: 42733512 NCBI Desc: bri1-kd interacting protein 125 [oryza sativa (japonica cultivar-group)]
  misc_feature (1)..(360): NCBI GI: 469056 NCBI Desc: dna-binding protein
  misc_feature (1)..(360): NCBI GI: 119319 NCBI Desc: dna-binding embp-1 protein
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1225 in the 10/412,699US patent application
  misc_feature: The sequence is a functional homolog of SEQ ID NO 1477 in the 11/479,226US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 708 in the 10/412,699US patent application
  misc_feature: The sequence is a functional homolog of SEQ ID NO 910 in the 10/374,780US patent application
  misc_feature: The sequence is a functional homolog of SEQ ID NO 911 in the 10/374,780US patent application
  misc_feature: The sequence is a functional homolog of SEQ ID NO 922 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1225 in the 20040045049 US patent application
  misc_feature: The sequence is a functional homolog of SEQ ID NO 708 in the 20040045049 US patent application
  misc_feature: The sequence is a functional homolog of SEQ ID NO 910 in the 20060162006 US patent application
  misc_feature: The sequence is a functional homolog of SEQ ID NO 911 in the 20060162006 US patent application
  misc_feature: The sequence is a functional homolog of SEQ ID NO. 512 in the 11/188,298 US application
  misc_feature: The sequence is a functional homolog of SEQ ID NO. 337 in the 11/188,298 US application
MASSSDEQPKPPEPPAAAAVVAAAAAAVPPQTHAEWAASLQAYYAAAGHHPYAWPAQHLMAAAAAGAPFGTPVPFPVYHPGAAAAYYAHASMAAGVPYPTSEAVPAVVPAAPLPEGKGKGKGGGASPEKGSSGAPSGEDASRSGDSGSDESSDTRDDDTDHKDSSAPKKRKSGNTSAEGEPSQTAVVRYAAVESPYPTKGRSASKLPVSAPGRAALPSATPNLNIGMDIWNASPALAVPAVQGEANPGLALARRDGVTQLDERESKRERRKQSNRESARRSRLRKQQECEELARKVADLTTENSALRAELDNLKKACQDMEAENSRLLGGMAHSQGPSVTTTLGMSIDPPKVQHHDDEGQLHKKSSNNSNGNYAGVSHKPEANTR

SEQ ID NO: 817 - DNA, 1458 bp, Sorghum bicolor
  misc_feature: Ceres ANNOT ID no. 6010910
  misc_feature: Encodes the peptide sequence at SEQ ID NO 818
atgaggcacagggcgcggtcctcccccacctccccgctcaccccgtcctccagcaccagaacaaagaagatacttggtttctctgtatctctcatcctcatcaatctggcttcaattatggagcgtgctgatgagaatctccttccagcagtttacaaggaagtcagtgcagccttcaatgctggtcctactgatctgggatacctcacctttgcaatgaactttctgaagtcaatagcatctcccttggcaggtatccttgctctgcactatgatcggccaacagtgcttgcaatagggactgttttctgggccttatcaacggcggctgtcggtgttagccaacattttgggcaggttgcattctggagagctgtaaatggccttgggcttgccattgtaataccagcgcttcagtcgttcattgctgatagctataaagatggtacacgtggtgcaggattcggtttgttaagcctcattggtgctgtaggtggtataggtggtagtattttggcaacaatcatggctggaaaggactattggggattccctggatggcgtgttgcattcatgatggtcgcactagtcagcttgataattggaattcttgtgtacttatatgcaactgatccaagaagaatacctggcaatcgccttcttgatgaagatgactatgagaggttgcatttatcaagcaaagatgttcttcctccaccttctatctggagggattcttgggtggcaacaagatctgttatgaaagtgaagacatttcagatcattgtcctgcaagggatcattggctcattgccatggactgctatagttttcttcacaatgtggtttgaactcattggttttgacaacaaaagctcggcagcactgaacagcctcttcgccatcgggtgtgccagcggagcatttcttggcggagtgatagcagaccacctgtcaaagtactttccagattcggcacgtgtcatgtgcgcccagttcagtgccttcatgggcatcccgttctcttggatcctcctcacagtcatcccccagtcagttgactactggtatgccttcgccgtcacacttttcttcatgggcatcacgataagctggtgcgccacctcggcaaacaaccccatgtttgctgaggtggtccctcccaagcaccgcaccatgatctacgccttcgaccgtgcgttcgagggctcattcgcctcgctggctgcccccgcagtgggcctagtcaccgagaagatttatggctatgataccaagactgtgaaccttgcgaacggatcagcagaaggggcgtacgcactctcaagagggctgctgaccatgatgaccgtgcctttcggtgtttgtgtcctgttctacagcccactgtaccttgtgttcaagcacgacagagagaacgcgaaactcaccagcttcaaggagcaggagctagtgtga

SEQ ID NO: 818 - protein, 485 aa, Sorghum bicolor
  misc_feature: Ceres ANNOT ID no. 6010910
  misc_feature (34)..(410): Pfam Id: MFS_1 Pfam Desc: Major Facilitator Superfamily
  misc_feature (77)..(485): NCBI GI: 115471131 NCBI Desc: os07g0208900 [oryza sativa (japonica cultivar-group)]
  misc_feature (176)..(485): NCBI GI: 34393426 NCBI Desc: membrane transporter pfb0275w-like protein [oryza sativa (japonica cultivar-group)]
  misc_feature (39)..(484): NCBI GI: 42569131 NCBI Desc: transporter-related [arabidopsis thaliana]
  misc_feature (30)..(484): NCBI GI: 115478853 NCBI Desc: os09g0371200 [oryza sativa (japonica cultivar-group)]
  misc_feature (30)..(484): NCBI GI: 37806444 NCBI Desc: transporter-like protein [oryza sativa (japonica cultivar-group)]
  misc_feature: The sequence is a functional homolog of SEQ ID NO. 488 in the 11/188,298 US application
MRHRARSSPTSPLTPSSSTRTKKILGFSVSLILINLASIMERADENLLPAVYKEVSAAFNAGPTDLGYLTFAMNFLKSIASPLAGILALHYDRPTVLAIGTVFWALSTAAVGVSQHFGQVAFWRAVNGLGLAIVIPALQSFIADSYKDGTRGAGFGLLSLIGAVGGIGGSILATIMAGKDYWGFPGWRVAFMMVALVSLIIGILVYLYATDPRRIPGNRLLDEDDYERLHLSSKDVLPPPSIWRDSWVATRSVMKVKTFQIIVLQGIIGSLPWTAIVFFTMWFELIGFDNKSSAALNSLFAIGCASGAFLGGVIADHLSKYFPDSARVMCAQFSAFMGIPFSWILLTVIPQSVDYWYAFAVTLFFMGITISWCATSANNPMFAEVVPPKHRTMIYAFDRAFEGSFASLAAPAVGLVTEKIYGYDTKTVNLANGSAEGAYALSRGLLTMMTVPFGVCVLFYSPLYLVFKHDRENAKLTSFKEQELV

SEQ ID NO: 819 - DNA, 1317 bp, Sorghum bicolor
  misc_feature: Ceres ANNOT ID no. 6010911
  misc_feature: Encodes the peptide sequence at SEQ ID NO 820
atggcgacgcggcgccacgtcctcctcctcgccttcgcgaccctcctcgcgctcgccgcggccgcggagggggccgaagaggggccccgcgggcggcggctgctggtcctgctggacgacctggccgtgcggtcgtcgcactcggccttcttcggctcgctccaggcgcgcgggttcgatctcgacttccgcctcgccgacgaccccaagctctcgctccaccgctacggccagtacctctacgacggcctcgtgctcttcgccccctccaccccacgttttggtggatcagtggaccagaacgcagtcctcgaatttattgatgctgggcatgacatgatcctggcggcagattcctctgcctctgatcttattcgtggcattgcaacagagtgcggggttgattttgatgaggatccagaggcaatggttattgaccacattaactatgccgtcacggatgttgaaggtgatcacaccttgattgctggtgatgatcttatccagtcagatgtgatactggggtctaaaaagattgaggctcctgtattgtttcgaggaattggacacacggctaatccatcaaacagtttggttctgaaagtcctatctgcctctccatcagcatattcagctaacccaaagactaagttgtcatctcctccatcgctcactgggtcagctatatcattggtttcggttatgcaggcaagaaataatgctcgggtgctgatatctggatcactcgacctgtttagcaaccggttcctgaagtctggtgttcaaaaggctggtagcaaaacgagatacgagagggctggaaatgagcaatttgtgaccgagacaagcaaatgggttttccatgagagggggcatctaaaggctgttaatgttaagcatcacaaggttggggaggccaatgaaccaggcatgtaccgcattaatgatgacctggaatactctgttgagatctatgaatggtccggaacaagctggaagccatatgttgctgatgatgtgcaacttcaattttttatgatgagtccttatgttctgaaaactatgtcgactgacaacaagggtttatattcaacatccttcaaagttcctgatgtttatggagttttccagttcaaagttgagtaccaaagattgggatatactggtctgtcttttacaaagcagattccagtacgcccttacaggcataacgagtatgagagattcataacatcagcttacccatactacactgcctcattttcaacaatgggtgctttcttcatattctcgcttgtgtacctgtaccacaaataa

SEQ ID NO: 820 - protein, 438 aa, Sorghum bicolor
  misc_feature: Ceres ANNOT ID no. 6010911
  misc_feature (10)..(438): Pfam Id: DDOST_48kD Pfam Desc: Dolichyl-diphosphooligosaccharide-protein glycosyltransferase48kD subunit
  misc_feature (5)..(438): NCBI GI: 21553942 NCBI Desc: dolichyl-di-phosphooligosaccharide-protein glycotransferase (oligosaccharyltransferase)-like [arabidopsis thaliana]
  misc_feature (5)..(438): NCBI GI: 8843726 NCBI Desc: dolichyl-di-phosphooligosaccharide-protein glycotransferase (oligosaccharyltransferase)-like [arabidopsis thaliana]
  misc_feature (1)..(438): NCBI GI: 49118443 NCBI Desc: mgc80921 protein [xenopus laevis]
  misc_feature (31)..(438): NCBI GI: 61371936 NCBI Desc: dolichyl-diphosphooligosaccharide-protein glycosyltransferase [synthetic construct]
  misc_feature (31)..(438): NCBI GI: 1581615 NCBI Desc: oligosaccharyltransferase
MATRRHVLLLAFATLLALAAAAEGAEEGPRGRRLLVLLDDLAVRSSHSAFFGSLQARGFDLDFRLADDPKLSLHRYGQYLYDGLVLFAPSTPRFGGSVDQNAVLEFIDAGHDMILAADSSASDLIRGIATECGVDFDEDPEAMVIDHINYAVTDVEGDHTLIAGDDLIQSDVILGSKKIEAPVLFRGIGHTANPSNSLVLKVLSASPSAYSANPKTKLSSPPSLTGSAISLVSVMQARNNARVLISGSLDLFSNRFLKSGVQKAGSKTRYERAGNEQFVTETSKWVFHERGHLKAVNVKHHKVGEANEPGMYRINDDLEYSVEIYEWSGTSWKPYVADDVQLQFFMMSPYVLKTMSTDNKGLYSTSFKVPDVYGVFQFKVEYQRLGYTGLSFTKQIPVRPYRHNEYERFITSAYPYYTASFSTMGAFFIFSLVYLYHK

SEQ ID NO: 821 - DNA, 1035 bp, Sorghum bicolor
  misc_feature: Ceres ANNOT ID no. 6010945
  misc_feature: Encodes the peptide sequence at SEQ ID NO 822
atgtccaagtcgggagcgctggatcttgcttctggcctcggagggaagatcgacaaggagggagtgaagtcggccgtcgatgagtatgagaaatatcatggttactatggagggaaggaggaagcaagaaagtccaactatactgatatggttaataaatactatgatctagccactagcttctatgagtatggttggggtgaatccttccactttgctcacagatggaatggagaatccttacgcgaaagcatcaagcgacatgagcattttcttgccctgcaacttggtttgaagccaggaatgaaggttttagatgtgggctgtggaataggtggaccactgagagaaattgcaagatttagctcaacttcagttaccggattgaataacaatgagtaccagataaccaggggaaaggagctcaatcgtttggcaggaattagtggaacctgtgattttgtcaaggcagacttcatgaaaatgccgttcgatgacaacactttcgatgctgtttatgccattgaggcgacatgtcatgcacctgatccagttggttgctataaggagatatatcgtgtgttgaagcctggtcagtgctttgctgtgtatgagtggtgcattactgatcactatgatcctaacaatgcaacccacaaaaggatcaaggatgaaattgagcttggcaatggcctgccagatatcagaagcactcggcaatgtcttcaagcagtaaaagatgctgggtttgaggttgtttgggataaggatcttgctgaagattcccccttgccttggtacttgcccttggatccaagccgattttccctgagtagcttccgtttgacttctgtgggacgcatgattactcgcacaatggtcaaggccttggaatatgttggtcttgctccacagggcagtgagagggtctctaatttcctagagaaggctgcagaaggtctcgtagagggcggaaagaaggagatcttcacaccaatgtacttctttcttgctcagaagccggtttcggaatga

SEQ ID NO: 822 - protein, 344 aa, Sorghum bicolor
  misc_feature: Ceres ANNOT ID no. 6010945
  misc_feature (212)..(341): Pfam Id: Sterol_MT_C Pfam Desc: Sterol methyltransferase C-terminal
  misc_feature (105)..(203): Pfam Id: Methyltransf_11 Pfam Desc: Methyltransferase domain
  misc_feature (105)..(201): Pfam Id: Methyltransf_12 Pfam Desc: Methyltransferase domain
  misc_feature (40)..(256): Pfam Id: Ubie_methyltran Pfam Desc: ubiE/COQ5 methyltransferase family
  misc_feature (42)..(295): Pfam Id: CMAS Pfam Desc: Cyclopropane-fatty-acyl-phospholipid synthase
  misc_feature (1)..(344): NCBI GI: 1899060 NCBI Desc: endosperm c-24 sterol methyltransferase [zea mays]
  misc_feature (1)..(344): NCBI GI: 2909846 NCBI Desc: (s)-adenosyl-l-methionine:delta 24-sterol methyltransferase [zea mays]
  misc_feature (1)..(344): NCBI GI: 68566037 NCBI Desc: cycloartenol-c-24-methyltransferase 1 (24-sterol c-methyltransferase 1) (sterol c-methyltransferase 1)
  misc_feature (1)..(344): NCBI GI: 34393309 NCBI Desc: cycloartenol-c24-methyltransferase [oryza sativa (japonica cultivar-group)]
  misc_feature (1)..(344): NCBI GI: 3560531 NCBI Desc: cycloartenol-c24-methyltransferase [oryza sativa subsp. japonica]
  misc_feature (1)..(344): SWISSPROT Homolog: EC 2.1.1.41 Cycloartenol-C-24-methyltransferase 1
MSKSGALDLASGLGGKIDKEGVKSAVDEYEKYHGYYGGKEEARKSNYTDMVNKYYDLATSFYEYGWGESFHFAHRWNGESLRESIKRHEHFLALQLGLKPGMKVLDVGCGIGGPLREIARFSSTSVTGLNNNEYQITRGKELNRLAGISGTCDFVKADFMKMPFDDNTFDAVYAIEATCHAPDPVGCYKEIYRVLKPGQCFAVYEWCITDHYDPNNATHKRIKDEIELGNGLPDIRSTRQCLQAVKDAGFEVVWDKDLAEDSPLPWYLPLDPSRFSLSSFRLTSVGRMITRTMVKALEYVGLAPQGSERVSNFLEKAAEGLVEGGKKEIFTPMYFFLAQKPVSE

SEQ ID NO: 823 - DNA, 2160 bp, Sorghum bicolor
  misc_feature: Ceres ANNOT ID no. 6010974
  misc_feature: Encodes the peptide sequence at SEQ ID NO 824
atggcgatcgaagcagcgcgcctctccccgtccctcgccgccgccgccttcctcgcccgccgcccccctcccgccctctcccccttctccccccttcgtcgccggtttcccctcctccgcgtcctcgccagctcatcgggcggggacggacgcgtcgtcgccctctcctcgtctgagctccgaaagcgccggggtctctcctcctcctcctccggggctgcggcggactccgcgtctgacggggatgagaagctccgctcgcttcgtcgactcttcgcgcggcccgacgtcgccattgacgcctacatcgtcccctcacaggacgcccaccagagcgaattcatagcagaatgcttcacgaggcgtgcctatctgactgggttcactggcagtgctggtacagctgtggtcacaaaaaataaggctgctctctggactgatggccgctattttcttcaggcagagaaggaattgaaccatcactggacactcatgcgcagtgggaatcatggtgttccaactaccagtgagtggttgaatgatgttttaccatctggttgccgagttggtattgatccgtttcttttctcatttgatgctgctgaagaactgaaggattcaatcgccaataagaatcatgagttagttttggttcaggacatgaacctagttgatgagatatggggagatgcaaggccaaatcccccaaaagaaccaactagggtgcatgacatcaaatatgctggtattgatgtgccatcaaagttgtccttcattaggtcacaacttgctgaaaatgggtgtgatgctgttgtaatttcaatgctcgatgaagttgcttggttgttgaacatgagaggaagtgatgtcccacattcaccagtattttatagctatctcattgtggaggttaacactgctacactatttgtagatagcagcaaagtttctaaaggtgttctggagcaccttgagcaagctggtgtaaaacttaagccatatgaagcaattatttctgaagtaggaagactggcagagaaaggtgcaaagctctggttggattcttcaagtgtgaatgcagccataattactgcatttaaatcaagttgcgatagatgcatgaaaaagaaaggaaaaacagggaaaaaagttgaagagaaagaagcatcttcagacgacccaataattggagatcctggtgtccagaatggagtcataagtgctgtatacaatgtttcaccagttgcacttgccaagtcagttaaaaatgatgcagaaattgagggaatgaagagttcacacctaagagatgctgctgctttagcagaattctggtgctggctagaggaggaaatctgtaaaaatgttccccttacagaggtacaaattgctgagaagcttcttgagtttcgtcaaaagcaagctggatttatagagacaagcttcgacactataagtggttatggtgcaaatggtgctataatacactacagaccaaccccagagagctgcagctctgttggaactgacaatctgtttttgttagatagtggtgctcaatacattgatggaactactgacataacaagaacagtgcattttggtgagccttcccgaaggcaaaaggaatgcttcaccagagttttgcagggccacatagctctagatcaagcagtgttccccgagagaactccaggctttgtgctagatgttctggcacggtcatctctgtggaaaattggactggattatagacatggcacaggccatggagttggagctgcactaaatgtccacgagggccctcagagcattagctatcgatatggaaatttgacatccttacagaagggcatgattgtcagcaacgaacctggttattatgaagacaattcgtttggcattcgtatcgagaatttacttctggtaaaggagcttaatctagcaaattcttttggtggaatttcataccttggttttgagaaactaacttttgctccgattcagagcaagcttattgagtcatccttgctgtcaccttcagagatcaattgggtcaatgattatcacgaagaagtctgggaaaaggtttcccctttgttgagtggccattctcgtgactggttatggaagaacactcgacctcttttagatgtatga

SEQ ID NO: 824 - protein, 719 aa, Sorghum bicolor
  misc_feature: Ceres ANNOT ID no. 6010974
  misc_feature (433)..(650): Pfam Id: Peptidase_M24 Pfam Desc: metallopeptidase family M24
  misc_feature (84)..(224): Pfam Id: Creatinase_N Pfam Desc: Creatinase/Prolidase N-terminal domain
  misc_feature (51)..(716): NCBI GI: 24111421 NCBI Desc: at3g05350/t12h1_32 [arabidopsis thaliana]
  misc_feature (77)..(717): NCBI GI: 92891162 NCBI Desc: peptidase m24; peptidase aspartic, active site [medicago truncatula]
  misc_feature (165)..(716): NCBI GI: 79394340 NCBI Desc: aminopeptidase/ metalloexopeptidase [arabidopsis thaliana]
  misc_feature (413)..(716): NCBI GI: 38141729 NCBI Desc: aminopeptidase-p [aspergillus oryzae]
  misc_feature (413)..(716): NCBI GI: 119479705 NCBI Desc: xaa-pro aminopeptidase [neosartorya fischeri nrrl 181]
MAIEAARLSPSLAAAAFLARRPPPALSPFSPLRRRFPLLRVLASSSGGDGRVVALSSSELRKRRGLSSSSSGAAADSASDGDEKLRSLRRLFARPDVAIDAYIVPSQDAHQSEFIAECFTRRAYLTGFTGSAGTAVVTKNKAALWTDGRYFLQAEKELNHHWTLMRSGNHGVPTTSEWLNDVLPSGCRVGIDPFLFSFDAAEELKDSIANKNHELVLVQDMNLVDEIWGDARPNPPKEPTRVHDIKYAGIDVPSKLSFIRSQLAENGCDAVVISMLDEVAWLLNMRGSDVPHSPVFYSYLIVEVNTATLFVDSSKVSKGVLEHLEQAGVKLKPYEAIISEVGRLAEKGAKLWLDSSSVNAAIITAFKSSCDRCMKKKGKTGKKVEEKEASSDDPIIGDPGVQNGVISAVYNVSPVALAKSVKNDAEIEGMKSSHLRDAAALAEFWCWLEEEICKNVPLTEVQIAEKLLEFRQKQAGFIETSFDTISGYGANGAIIHYRPTPESCSSVGTDNLFLLDSGAQYIDGTTDITRTVHFGEPSRRQKECFTRVLQGHIALDQAVFPERTPGFVLDVLARSSLWKIGLDYRHGTGHGVGAALNVHEGPQSISYRYGNLTSLQKGMIVSNEPGYYEDNSFGIRIENLLLVKELNLANSFGGISYLGFEKLTFAPIQSKLIESSLLSPSEINWVNDYHEEVWEKVSPLLSGHSRDWLWKNTRPLLDV

SEQ ID NO: 825 - DNA, 1734 bp, Sorghum bicolor
  misc_feature: Ceres ANNOT ID no. 6010999
  misc_feature: Encodes the peptide sequence at SEQ ID NO 826
atggcctccgtggccgccgccgccgccgccgccacgctggccccggcactcgcgtgccggcgccgggcgcggccggggacgggcctgctgccgccgcgccgcgccgcgcccgcgcccgtccgctgctcgctcgacagcaacgtctccgacatgggcgtcaacgctcccaaagggttattcccacccgagccggagcactacagggggccgaagctcaaggtggccattataggggcgggcctcgccggcatgtccaccgctgttgagctcttggaccagggccatgaggttgatttgtacgagtcccgcccgtttattggtggtaaggttggctccttcgttgataaacaaggaaaccatatcgagatggggctgcatgtgttcttcgggtgttacagcaatctcttccgcctcatgaagaaggttggcgctgataataatctgctggtgaaggaacacacccatacttttgtaaataaagggggcgtgattggtgaacttgattttcggttcccggtgggagctccattacatggcattcaagcattcctaagaactaatcagctcaaggtttatgataaagcaagaaatgcagttgctcttgcccttagcccagttgttcgggctctggttgatccggatggtgcattgcagcaagtgcgggacttggatgatgtaagtttcagtgattggttcatgtccaaaggtggtactcgggagagcatcacaagaatgtgggatcctgttgcttacgctttgggtttcattgactgtgataatatcagtgcacgttgcatgcttactattttcaccttgtttgccacaaagacagaggcatccctgttacgcatgctaaagggttcacctgatgtttacttaagtggcccaataaagaagtatataacagacaggggtggtaggtttcacctaaggtggggatgcagagaggttctctatgagaaatcacctgatggactgacctatgttaaaggccttctcctcaccaaggctacaagtagagagataatcaaagccgatgcatatgttgcagcctgtgatgttccgggtatcaaaagactacttccatcagaatggagggaatgggaaatgtttgacaatatctacaagttagatggtgtccctgttgtcactgttcagcttcgctacaatggatgggtcactgaacttcaagatttggagaaatcaagacaactgcaaagggcggttgggttggacaaccttttgtacacggcggatgcagacttttcctgtttttcagaccttgctctctcatctcctgctgattactacattgaaggacaaggttccctgatccaagctgtgctgactcctggcgatccatacatgccattgccaaatgaggagatcattagtaaagttcaaaagcaggttgtagaattgttcccatcttcccggggcttggaagttacatggtccagtgtggtaaagattggacaatcgttgtaccgcgaggctcctggaagtgatccattcagacctgatcagaagacgcctgttaaaaacttcttcctctccggatcttacacaaaacaggactacattgacagcatggaaggagcaactctctctggcaggcgaacagctgcctacatctgcggcgccggagaggagctgctggccctccgaaaaaagctagtcatcgacgacagcgagaaggcgctggggaacgtccaagtcctgcagactagctga

SEQ ID NO: 826 - protein, 577 aa, Sorghum bicolor
  misc_feature: Ceres ANNOT ID no. 6010999
  misc_feature (81)..(546): Pfam Id: Amino_oxidase Pfam Desc: Flavin containing amine oxidoreductase
  misc_feature (4)..(577): NCBI GI: 4105563 NCBI Desc: zeta-carotene desaturase precursor [zea mays]
  misc_feature (1)..(577): NCBI GI: 115471093 NCBI Desc: os07g0204900 [oryza sativa (japonica cultivar-group)]
  misc_feature (24)..(565): NCBI GI: 140046304 NCBI Desc: nad-binding site [medicago truncatula]
  misc_feature (40)..(568): NCBI GI: 2924363 NCBI Desc: zeta-carotene desaturase [narcissus pseudonarcissus]
  misc_feature (3)..(569): NCBI GI: 9971810 NCBI Desc: zeta desaturase [tagetes erecta]
  misc_feature (4)..(577): SWISSPROT Homolog: EC 1.14.99.30 Zeta-carotene desaturase, chloroplast/chromoplast precursor
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: GREAT-hit functional homolog of the protein sequence given in SEQ ID NO 13578
  misc_feature: Useful for making plants with modulated biomass
  misc_feature: Useful for making plants with modulated flowering time
  misc_feature: Functional homolog of the protein sequence given in SEQ ID NO 13578
MASVAAAAAAATLAPALACRRRARPGTGLLPPRRAAPAPVRCSLDSNVSDMGVNAPKGLFPPEPEHYRGPKLKVAIIGAGLAGMSTAVELLDQGHEVDLYESRPFIGGKVGSFVDKQGNHIEMGLHVFFGCYSNLFRLMKKVGADNNLLVKEHTHTFVNKGGVIGELDFRFPVGAPLHGIQAFLRTNQLKVYDKARNAVALALSPVVRALVDPDGALQQVRDLDDVSFSDWFMSKGGTRESITRMWDPVAYALGFIDCDNISARCMLTIFTLFATKTEASLLRMLKGSPDVYLSGPIKKYITDRGGRFHLRWGCREVLYEKSPDGLTYVKGLLLTKATSREIIKADAYVAACDVPGIKRLLPSEWREWEMFDNIYKLDGVPVVTVQLRYNGWVTELQDLEKSRQLQRAVGLDNLLYTADADFSCFSDLALSSPADYYIEGQGSLIQAVLTPGDPYMPLPNEEIISKVQKQVVELFPSSRGLEVTWSSVVKIGQSLYREAPGSDPFRPDQKTPVKNFFLSGSYTKQDYIDSMEGATLSGRRTAAYICGAGEELLALRKKLVIDDSEKALGNVQVLQTS

SEQ ID NO: 827 - DNA, 1941 bp, Sorghum bicolor
  misc_feature: Ceres ANNOT ID no. 6011033
  misc_feature: Encodes the peptide sequence at SEQ ID NO 828
atgcgatcttcatgggctgactcagttgcgaacgccgaggaatcggcgcccgcgactgctgctgctaacggctctgttgtgactcatggcaactcgcgccccacgcgcagctcctacgtgcctcctcacctccgcggccggccagctggtgccggctttgacacccaagcgggcctagtagcaccggcacaaggtggaccactgccctcggctgccgcacaaccttctggtcagggtgctgctgttggtggccctcgctgggctggcattgtgaatggtggtggtggcagcgttggtgctcctcgccagggttatggtggtgctggcgggggcggaggacgtggtgcttggaactcccgtcctgggggttgggaccgcagagaccgtgagcccgatccttttgccaaagctgaggctgaagaagttgactttgagggccaggagaatactggcatcaattttgatgcctatgaagacatccctgttgagaccagtggtcatgacgttcctgcaccagccaacacatttgcagagattgatttgggtgacgcattgaatgagaatatccggaggtgcaagtatgtgaaaccaacaccagtgcagcgttacgccatcccaatctccattgctgggcgggatctcatggcctgcgcacagactggatccggaaaaactgctgcattctgtttcccaatcatcagtggcatcttgaagtctccaaggccacaacagaggtcgcggagctcaaggactgcttttcctctggctctgatcttatcaccaactcgtgagctttcagtccaaatccatgaagaagcaaggaagtttgcataccagactggtgtcagagttgtggttgcatatggtggtgcaccaataactaaccagctgagggacttagagagaggtgtggaaatccttgtggcaactcctggtcgcttaatggatctgttggagagggctagagtctcactgcaatcgataaggtatttagctctcgatgaagctgatcgtatgcttgatatgggttttgagccacagatacgtaaaattgttgagggaatggacatgcctcaacgtggtgagaggcagacaatgctgtttagtgcgacattcccaaaagagatacagaggatggctgcggatttccttgctgattacatctttcttgctgttgggagagttggttcaagcaccgatttgattgttcagagggtggagtttgtccttgattcagacaaacgaagctacctcatggaccttcttcatgcacaaaaggctaatggcacacatggaaagcacgctcttactttggtctttgtggagacaaagaggggggctgatgctctggaggactggctttttagaaatggattccctgcaactagcattcatggagacaggacacagcaggaaagggagcatgcacttaggtccttcaagagtggagcaactcccatccttgtggcgactgatgttgctgctcgtggtcttgacataccgcatgttgcccatgtgattaattttgacctccctaatgatatagatgattatgttcatcggattggaaggaccggacgtgctgggaaatctggtctggcgactgcattcttcaacgagagcaacactacacttgcaaggccgttgagtgatctcatgaaagaggccaaccaggaggttcctaagtggcttgaggggtacgccgcccgttcagcctatggaggcggaggtggtagaaaccgcagacaaggtggcggtgccagatttggtggccgtgatttccggcgagataggggcagtggtggagggtatggtggtggttcctttggaggaggtggcggtggtggtggatatgggggatcatcaggatacggtggtggctatggcggcggcggtggcagcggctatggtggtggtcagagtatgagttcttgggactaa

SEQ ID NO: 828 - protein, 646 aa, Sorghum bicolor
  misc_feature: Ceres ANNOT ID no. 6011033
  misc_feature (198)..(379): Pfam Id: DEAD Pfam Desc: DEAD/DEAH box helicase
  misc_feature (453)..(529): Pfam Id: Helicase_C Pfam Desc: Helicase conserved C-terminal domain
  misc_feature (31)..(646): NCBI GI: 92888082 NCBI Desc: helicase, c-terminal [medicago truncatula]
  misc_feature (35)..(636): NCBI GI: 6735368 NCBI Desc: atp-dependent rna helicase-like protein [arabidopsis thaliana]
  misc_feature (62)..(639): NCBI GI: 7635831 NCBI Desc: probable atp-dependent rna helicase ded1 [neurospora crassa]
  misc_feature (104)..(645): NCBI GI: 74671260 NCBI Desc: atp-dependent rna helicase ded1
  misc_feature (215)..(646): NCBI GI: 21387105 NCBI Desc: atp-dependent rna helicase-like protein [arabidopsis thaliana]
MRSSWADSVANAEESAPATAAANGSVVTHGNSRPTRSSYVPPHLRGRPAGAGFDTQAGLVAPAQGGPLPSAAAQPSGQGAAVGGPRWAGIVNGGGGSVGAPRQGYGGAGGGGGRGAWNSRPGGWDRRDREPDPFAKAEAEEVDFEGQENTGINFDAYEDIPVETSGHDVPAPANTFAEIDLGDALNENIRRCKYVKPTPVQRYAIPISIAGRDLMACAQTGSGKTAAFCFPIISGILKSPRPQQRSRSSRTAFPLALILSPTRELSVQIHEEARKFAYQTGVRVVVAYGGAPITNQLRDLERGVEILVATPGRLMDLLERARVSLQSIRYLALDEADRMLDMGFEPQIRKIVEGMDMPQRGERQTMLFSATFPKEIQRMAADFLADYIFLAVGRVGSSTDLIVQRVEFVLDSDKRSYLMDLLHAQKANGTHGKHALTLVFVETKRGADALEDWLFRNGFPATSIHGDRTQQEREHALRSFKSGATPILVATDVAARGLDIPHVAHVINFDLPNDIDDYVHRIGRTGRAGKSGLATAFFNESNTTLARPLSDLMKEANQEVPKWLEGYAARSAYGGGGGRNRRQGGGARFGGRDFRRDRGSGGGYGGGSFGGGGGGGGYGGSSGYGGGYGGGGGSGYGGGQSMSSWD

SEQ ID NO: 829 - DNA, 2667 bp, Sorghum bicolor
  misc_feature: Ceres ANNOT ID no. 6011037
  misc_feature: Encodes the peptide sequence at SEQ ID NO 830
atggcgcagccgctcgtcgtgaagaaggacgacgacctcgacgaggaagagtactattcgccgttcctcggcatcgagaagggcgccgtgctgcaggaggcccgcgtcttccacgaccctcagctcgacgcgcggcggtgctgccaggttatcaccaagctcctgtacctgctcaaccagggtgacacctttaccaaggttgaggccacagaggtcttctttgcaacaaccaagctgttccagtctaaagatgcaggacttaggaggatggtgtacctcatgatcaaggaactctcgccttcagctgatgaggttatcatagtaaccagctctttgatgaaggacatgaatagcaaaaccgatatgtaccgtgcaaacgctattagagttctttgtcgtattatcgactcaactcttctcacccaaatcgagaggtatttgaagcaagccattgttgacaagaatcctgttgttgccagtgcagcccttgttagtggcatctacttgcttcaaacaagtccggaagttgtaaaaagatggagcaatgaagttcaagaggctgtgcagtcaagagctgctcttgtgcagtttcatgcccttgctcttcttcaccaaattagacaaaatgatcggttggcggtcagcaagcttgtcactagcttgaccaggggttcagttcgctctcctttggcccagtgcctacttattcgctacacaagccaggttattagagagtctggcgtgaatcaaggtggggatcgtcctttctttgatttcctcgagtcctgtctccggaacaaagcagaaatggtcatacttgaggctgcaagagcaattactgaactgaacggtgttacaagccgtgagcttacacctgcaatcactgtgctgcagttgttcttaagttcatccaaacctgttctcagatttgcagctgttcgcacacttaacaaggttgcatcaactcatcctttggctgtcacaaattgtaacatagacatggagagcttaatctctgatcagaacaggagcattgcgacccttgcgattacaacactgttgaagacaggcaacgagtcaagtgttgatcgtttaatgaaacagatgaccaactttatgtcagacatagctgatgaattcaagatcgttgttgtcgaagcaataagatctttgtgcttgaagtttcctctgaaatatcgctcattgatgaacttcttgagtaatattctacgggaagagggtggatttgagtacaagaaagccatagttgattcaatcattatactcattagagatattcctgatgcaaaggaaagtggtttatttcacttatgtgaattcatagaagactgtgaattcacctatttgtccacccagatacttcactttttgggaaatgaaggcccaaaaacatcagatcccagtaaatacatacgttatatatacaatagggtgatacttgaaaatgctacagttcgagctagtgcagtcagcacattggcaaagtttggtgccttggttgactcactcaagcctcgcatatttgtgctcctgagacgctgcctgtttgatggggatgatgaggtccgtgacagagcgaccctttacctcaaattgttaggtggggaagctacagttggtgagacagagaaggatgtgaatgaatttctctttggctcacttgatgttccactagcaaacttggagacgagtctgcggaattatgaaccttcggatgtaccttttgatatttcatctgtttcaagggagacaaaatcccaaccccttgctgagaaaaagtctgcaggcaagaaatcagctggtccggcatctgctgtcagtggccctgtttctactgttgatgcttcgtatgagaagcttctttcatccattccggaatttgctgattttggaaagctatttaagtcatctgcacctgtagaattgactgaagctgagactgaatactcagtaaatgttgtgaagcatatttttgatggacatgttgtgcttcaatacaactgtaccaatacaattcctgaacaattgcttgaacaggtggttgtttttgttgatgcttctgaggctgatgaatttttagaagttgcttcgaggcctttagaatcattaccatatgattctcctggacagacctttgtggcttttgaaaagccagaaggtgtcattgccactggcaagttctcaaatatcctgaaattcattgttaaggaggttgatccgtccacgggtgaagctgaggatgatggtgttgaggatgagtaccagcttgaagatcttgaaatagtttctgcggattatatgttgaaggtgggagtatctaacttccgaaatgcctgggaaagcatggatccggagagtgagcgtgttgacgagtatgggcttggagtaagggagagcttggctgaggctgtaagtgctgtgataagcatccttggcatgcagccttgcgagggaactgacgtggtccctagcaattcaaggtcgcacacttgtctgctctctggcgtttttgtcggtaacgtgaaagtcttggtgagactgtcatttggaatcagtgcaccgaaggaggtggccatgaagttagcagttagatctgatgatccagagatcagtgacaagatccacgaaattgtcgccaatggctaa

SEQ ID NO: 830 - protein, 888 aa, Sorghum bicolor
  misc_feature: Ceres ANNOT ID no. 6011037
  misc_feature (26)..(544): Pfam Id: Adaptin_N Pfam Desc: Adaptin N terminal region
  misc_feature (620)..(886): Pfam Id: Gamma-COP Pfam Desc: Coatomer gamma subunit appendage domain
  misc_feature (1)..(888): NCBI GI: 146286093 NCBI Desc: coatomer subunit gamma-1 (gamma-coat protein 1) (gamma-cop 1)
  misc_feature (6)..(553): NCBI GI: 7270395 NCBI Desc: nonclathrin coat protein gamma-like protein [arabidopsis thaliana]
  misc_feature (218)..(888): NCBI GI: 110741159 NCBI Desc: nonclathrin coat protein gamma - like protein [arabidopsis thaliana]
  misc_feature (6)..(881): NCBI GI: 8926697 NCBI Desc: coatomer protein gamma 2-subunit [takifugu rubripes]
  misc_feature (6)..(881): NCBI GI: 66910281 NCBI Desc: copg2 protein [danio rerio]
MAQPLVVKKDDDLDEEEYYSPFLGIEKGAVLQEARVFHDPQLDARRCCQVITKLLYLLNQGDTFTKVEATEVFFATTKLFQSKDAGLRRMVYLMIKELSPSADEVIIVTSSLMKDMNSKTDMYRANAIRVLCRIIDSTLLTQIERYLKQAIVDKNPVVASAALVSGIYLLQTSPEVVKRWSNEVQEAVQSRAALVQFHALALLHQIRQNDRLAVSKLVTSLTRGSVRSPLAQCLLIRYTSQVIRESGVNQGGDRPFFDFLESCLRNKAEMVILEAARAITELNGVTSRELTPAITVLQLFLSSSKPVLRFAAVRTLNKVASTHPLAVTNCNIDMESLISDQNRSIATLAITTLLKTGNESSVDRLMKQMTNFMSDIADEFKIVVVEAIRSLCLKFPLKYRSLMNFLSNILREEGGFEYKKAIVDSIIILIRDIPDAKESGLFHLCEFIEDCEFTYLSTQILHFLGNEGPKTSDPSKYIRYIYNRVILENATVRASAVSTLAKFGALVDSLKPRIFVLLRRCLFDGDDEVRDRATLYLKLLGGEATVGETEKDVNEFLFGSLDVPLANLETSLRNYEPSDVPFDISSVSRETKSQPLAEKKSAGKKSAGPASAVSGPVSTVDASYEKLLSSIPEFADFGKLFKSSAPVELTEAETEYSVNVVKHIFDGHVVLQYNCTNTIPEQLLEQVVVFVDASEADEFLEVASRPLESLPYDSPGQTFVAFEKPEGVIATGKFSNILKFIVKEVDPSTGEAEDDGVEDEYQLEDLEIVSADYMLKVGVSNFRNAWESMDPESERVDEYGLGVRESLAEAVSAVISILGMQPCEGTDVVPSNSRSHTCLLSGVFVGNVKVLVRLSFGISAPKEVAMKLAVRSDDPEISDKIHEIVANG

SEQ ID NO: 831 - DNA, 1221 bp, Sorghum bicolor
  misc_feature: Ceres ANNOT ID no. 6011043
  misc_feature: Encodes the peptide sequence at SEQ ID NO 832
atgtcctcgccggagccacgcgacacacagcaacgtcgcaggcttcccgccgcgcccgccactcccgccgccgcgggcgctctgcccttggacgcgctgtgcgagatcctgctgcgtctccggggcaagcagctctgccggctgcggaccgtgtgccgggcgtggcggaccctcctcaccgcgccgtggttcgccgccgcccacgccgcgcgccgccgggagccgtacgtcgtggcgtcctacgtcgaccacgtggacctggaccgcgacagcctcgtcgacgtcctggacatgtcgtcggggcagatcgtcaggcacgtggcggcggggcacgcgagcgacgtggtcgtgagcgtcgcggcgtgctccggttcggccggtctcgtctgcgtcgtcaagacgatcgacggcggcagcttccggttgctcgacccggtcaccggcgccgtgcaccacttgtcaggcgagcttgcacgggaccacgcggcgcgcgggttcagcctgcgcgactatggggagcccgtgttcatgtttgggcaggtcgccggaacaggcgaactcaaggtgctgcggatgcttccctttcgacgacggtgtggcggcggcggcggcggcggtgaccgtgacgacctgttcgaggtctgcaccctcagcagaagtgcacggtggaggggaatgcatggacctccgaggtctttcgtgtggaatgaatggaccagggtggtggtcggtggggtggtctactgcttgagcgtggcggcgtatttcgccgtcgtgaatcgccgtgccgatgagcgaggatggatagtccggttcgatctcgaggcggagcaatggaggccgagcgtcaagggacccagaggcctcgttcatggcggccggcacaatttgtatgttacattggccaacctgaatggttccttggtcattgttcaggagtcaagccgcgtcatggacctgtggttcctgaaggattctgaggaagacctttgggtcaaacagtacagtgtgcagattgagcgttctggacacatttcgccgatgcatcctttgttggtgttagaggacggcaggattgtcacggttattagatccatgggattgctgcagatttatgacccaagaacaagtacattcgcgagtttgatgatgctaaggcattcctctcgaattagtgtgcatactggaagcttcttgagcctacatcatggtgagaactaa

SEQ ID NO: 832 - protein, 406 aa, Sorghum bicolor
  misc_feature: Ceres ANNOT ID no. 6011043
  misc_feature (23)..(70): Pfam Id: F-box Pfam Desc: F-box domain
  misc_feature (160)..(329): NCBI GI: 115471049 NCBI Desc: os07g0197000 [oryza sativa (japonica cultivar-group)]
  misc_feature (268)..(378): NCBI GI: 92888505 NCBI Desc: cyclin-like f-box; f-box protein interaction domain; galactose oxidase, central [medicago truncatula]
  misc_feature (17)..(147): NCBI GI: 38346045 NCBI Desc: osjnba0059d20.17 [oryza sativa (japonica cultivar-group)]
  misc_feature (17)..(155): NCBI GI: 115457216 NCBI Desc: os04g0193300 [oryza sativa (japonica cultivar-group)]
  misc_feature (17)..(155): NCBI GI: 38346527 NCBI Desc: osjnba0040d17.2 [oryza sativa (japonica cultivar-group)]
MSSPEPRDTQQRRRLPAAPATPAAAGALPLDALCEILLRLRGKQLCRLRTVCRAWRTLLTAPWFAAAHAARRREPYVVASYVDHVDLDRDSLVDVLDMSSGQIVRHVAAGHASDVVVSVAACSGSAGLVCVVKTIDGGSFRLLDPVTGAVHHLSGELARDHAARGFSLRDYGEPVFMFGQVAGTGELKVLRMLPFRRRCGGGGGGGDRDDLFEVCTLSRSARWRGMHGPPRSFVWNEWTRVVVGGVVYCLSVAAYFAVVNRRADERGWIVRFDLEAEQWRPSVKGPRGLVHGGRHNLYVTLANLNGSLVIVQESSRVMDLWFLKDSEEDLWVKQYSVQIERSGHISPMHPLLVLEDGRIVTVIRSMGLLQIYDPRTSTFASLMMLRHSSRISVHTGSFLSLHHGEN

SEQ ID NO: 833 - DNA, 1167 bp, Sorghum bicolor
  misc_feature: Ceres ANNOT ID no. 6011050
  misc_feature: Encodes the peptide sequence at SEQ ID NO 834
atggcgtcgtcatccaagatgcgctccggcctagacaggcgcgtgatgcctgctcttgctgcatccgacacaggtactcttccactagacactatttatgagatcctgttgcgcctcccggctaaggatctttgccgcctgcgcatcgtgtgtcggccgtggcaggccctcctctcagatccgcagttcatcgtggcccatgccacacgccacccggggccccttctcattgctgcttatagggataacgagaaaaatggcagccttgtggaaatcatggatctgtctggccagagccttaagaaggtgcctaagaagtatggcgatagggttgtcagcatggcgaaagatcttgttcatgtcagtaatataggatgcttcaacagcagattgttgaacccagctactggaactatgtattgcttctcagataggaaacaacaaggtgcctcttatttatttggacagacagcaagcaaaggcgagcagaaggtgcttcgaaggtttgataagattggttcaggtaggagtattcatgagttggttgaggtcttcacgctcaacaacggcagccatgcaatgtggaggaaaaaacaggcccctccacagagggttgcgaccaataagtggactgatgtggtcattgatggggttgcctaccttttgtcttggaatgccttttatgagctggccttctctagggaagttaacagggaagacatgataataacatttgaccttgagacagaggaatgggggactatcttgggacccaatatcagctttcttggtaatgcttttcaggtgcttcatggcgtttgttctccaataccaaggagtcttaccttggctgacctgaatggctctttggctgttgtgtgcttgtatggcataatccctagaatggacatatggatttcgacagacattgcgaagggaaactgggtcaatcagtatcacataagatttgaacaatatgacatgcggatttcctatgtgcatcctgtggtggtcctagatgaccaaactctagtcatatatatagaagacaaggaattattacagatttataacccaagaagcaagactttcacaaatgttgtggagctggagcactgctcttcaatttgtttgtatacaggaaacctgctgagcttggtgtgttga

SEQ ID NO: 834 - protein, 388 aa, Sorghum bicolor
  misc_feature: Ceres ANNOT ID no. 6011050
  misc_feature (22)..(69): Pfam Id: F-box Pfam Desc: F-box domain
  misc_feature (151)..(309): NCBI GI: 115471049 NCBI Desc: os07g0197000 [oryza sativa (japonica cultivar-group)]
  misc_feature (26)..(345): NCBI GI: 86439727 NCBI Desc: fimbriata-like protein [triticum aestivum]
  misc_feature (26)..(67): NCBI GI: 92874605 NCBI Desc: cyclin-like f-box; f-box protein interaction domain; galactose oxidase, central [medicago truncatula]
  misc_feature (26)..(387): NCBI GI: 30682162 NCBI Desc: f-box family protein [arabidopsis thaliana]
  misc_feature (27)..(334): NCBI GI: 86439730 NCBI Desc: fimbriata-like protein [triticum aestivum]
  misc_feature: The sequence is a functional homolog of SEQ ID NO. 456 in the 11/188,298 US application
MASSSKMRSGLDRRVMPALAASDTGTLPLDTIYEILLRLPAKDLCRLRIVCRPWQALLSDPQFIVAHATRHPGPLLIAAYRDNEKNGSLVEIMDLSGQSLKKVPKKYGDRVVSMAKDLVHVSNIGCFNSRLLNPATGTMYCFSDRKQQGASYLFGQTASKGEQKVLRRFDKIGSGRSIHELVEVFTLNNGSHAMWRKKQAPPQRVATNKWTDVVIDGVAYLLSWNAFYELAFSREVNREDMIITFDLETEEWGTILGPNISFLGNAFQVLHGVCSPIPRSLTLADLNGSLAVVCLYGIIPRMDIWISTDIAKGNWVNQYHIRFEQYDMRISYVHPVVVLDDQTLVIYIEDKELLQIYNPRSKTFTNVVELEHCSSICLYTGNLLSLVC

SEQ ID NO: 835 - DNA, 2049 bp, Sorghum bicolor
  misc_feature: Ceres ANNOT ID no. 6011077
  misc_feature: Encodes the peptide sequence at SEQ ID NO 836
atgaggaagcaggcagcgtcggcgggggcgggggcttccttccgccgccgcgcgatggagggcctggccgccgtgctgctcctctacgcgctcctcgtcttcgccctcgagtcgccgttcgtctccacctcgctctccggcggtggcgccggggccggtgccggggccgcgcggaagctcaccctctccttcggcggcgcgggcccgggcgagcacggggcgcccgcgcgccccgccaaggagccccgccccgcggcgggcggggcgtccgtctccgtctctgtctccgcccccggcgccgacggacaggatcgccggctctcgcgcttcgccacgggcctcgacgtccgcctcctcgacaccccgcgctccggcgtgctacgccggtccgtggccgacgccgtcgcggcgggcgcccgcgcgttcgccgacctcgagggcctcgaccctaacgccgtcgcggcgccctcctccggcgaactcgagggcggcggcgccgcggccacggccaggtgcccgcactcgatcgcgctcaccgcggaggagctcggcgcgcaggggggccgcggcgtggtggagctgccctgcgggctcgcgctggggtcccacgtcacggtcgccgcgacgccccgggggccgcacgaggagcggaaccccgcgatcgtggtgctcagggacggggagcggcctgccatggtgtcgcagttcatggtggagctgcaggggctcagggccgtcgaaggggaggacccgccccgcgtgctccacttcaacccgcgcctccgcggggactggagcggccgccccgtcatcgagcagaacacctgctaccgcatgaactggggcgccgcgcagcgctgcgatggttggaggtcacgccccgatgaggagactgtggatgggttggtgaagtgtgagaagtggattagggacgatgatgacaggttggaggaatggaagacatcatcaaagacagcagcatggttgctgaatcggttgatcgggcagaaggaggaggtcaatttcggttggccatttcctttcgtggagggccgcctgtttgttcttactctcagtgctgggttggagggttaccatgtgagcgttgatgggcgacatgtcacttcctttccttaccgcactgggtttgtgctggaggatgctacaggcctgtcactgtatggggacctcgatgtgcattcagtgattgcagggtctttgcccactacacacccaagctttgagccacagaattatctggagttttctactgtttggcaggcccctccgctgcctgatgagccagttgagattttcattggcatcctgtcatcagccaatcattttgctgagcgtatgggtgtgaggacgacatggatgtctgctgtccacaagtcaccaaacagggtggctcgttttttcgttgcactgcatggcagaaacgaggtgaatgtggtgctgaagaaggaagctgaattttttggggacattgtttttgtgccctatctggataactacgatcttgttgttatgaagactcttgcaatatgcgagtatggggttcatgttgtctctgctaaatatgtaatgaagtgcgatgatgatactttcgtgagaattgattcagtagtcactgaaattaagaaggtaccaagtgggagaagtctttacatggggagtatgaatatacaacacagaccgctacgccaagggaaatgggctgtgacttatgaggagtggccagaagaggtgtatccgtcatatgcaaatggccctggatatgttatatcatctgatattgctgaatttatcatgtcagaattcatgaagcaaaagctgaagctcttcaaaatggaagacgtgagcttgggtttgtgggttgagcagttcaataggacaagacctgttgaatacattcacagtggcaagttctgtccatttggatgcgtcgctgactactatactgctcattaccaatcgccaaggctaatgttatgcatgtggcaaaagttactggaaggaagaccagactgttgcaatatgagataa

SEQ ID NO: 836 - protein, 682 aa, Sorghum bicolor
  misc_feature: Ceres ANNOT ID no. 6011077
  misc_feature (189)..(404): Pfam Id: Gal-bind_lectin Pfam Desc: Galactoside-binding lectin
  misc_feature (450)..(636): Pfam Id: Galactosyl_T Pfam Desc: Galactosyltransferase
  misc_feature (15)..(682): NCBI GI: 15241899 NCBI Desc: galactosyltransferase family protein [arabidopsis thaliana]
  misc_feature (133)..(682): NCBI GI: 34393273 NCBI Desc: galactosyltransferase family-like protein [oryza sativa (japonica cultivar-group)]
  misc_feature (172)..(682): NCBI GI: 5882743 NCBI Desc: ests gbh36134 and gbh36132 come from this gene. [arabidopsis thaliana]
  misc_feature (172)..(682): NCBI GI: 19699371 NCBI Desc: at1g74800/f25a4_38 [arabidopsis thaliana]
  misc_feature (128)..(477): NCBI GI: 115456021 NCBI Desc: os03g0803600 [oryza sativa (japonica cultivar-group)]
  misc_feature: Useful for making plants with altered carbohydrate content
  misc_feature: Functional homolog of the protein sequence given in SEQ ID NO 13850
  misc_feature: The sequence is a functional homolog of SEQ ID NO. 346 in the 11/188,298 US application
MRKQAASAGAGASFRRRAMEGLAAVLLLYALLVFALESPFVSTSLSGGGAGAGAGAARKLTLSFGGAGPGEHGAPARPAKEPRPAAGGASVSVSVSAPGADGQDRRLSRFATGLDVRLLDTPRSGVLRRSVADAVAAGARAFADLEGLDPNAVAAPSSGELEGGGAAATARCPHSIALTAEELGAQGGRGVVELPCGLALGSHVTVAATPRGPHEERNPAIVVLRDGERPAMVSQFMVELQGLRAVEGEDPPRVLHFNPRLRGDWSGRPVIEQNTCYRMNWGAAQRCDGWRSRPDEETVDGLVKCEKWIRDDDDRLEEWKTSSKTAAWLLNRLIGQKEEVNFGWPFPFVEGRLFVLTLSAGLEGYHVSVDGRHVTSFPYRTGFVLEDATGLSLYGDLDVHSVIAGSLPTTHPSFEPQNYLEFSTVWQAPPLPDEPVEIFIGILSSANHFAERMGVRTTWMSAVHKSPNRVARFFVALHGRNEVNVVLKKEAEFFGDIVFVPYLDNYDLVVMKTLAICEYGVHVVSAKYVMKCDDDTFVRIDSVVTEIKKVPSGRSLYMGSMNIQHRPLRQGKWAVTYEEWPEEVYPSYANGPGYVISSDIAEFIMSEFMKQKLKLFKMEDVSLGLWVEQFNRTRPVEYIHSGKFCPFGCVADYYTAHYQSPRLMLCMWQKLLEGRPDCCNMR

SEQ ID NO: 837 - DNA, 651 bp, Sorghum bicolor
  misc_feature: Ceres ANNOT ID no. 6011078
  misc_feature: Encodes the peptide sequence at SEQ ID NO 838
atggcggcgccgccgtcgaggtcccggggcgactacgaccacctgattaagctcctgctcatcggcgacagcggagttggaaagagttgcttgctgctgcggttctctgatgacacattcacaacaagttttatcaccaccattggcattgatttcaaggtcaggacagttgagcttgatggaaagcgtgtaaaattacaaatctgggatactgctggtcaagaacgtttccgaacaattaccacagcttactacagaggagctatgggcattctgcttgtatatgatgtcacagacgaatcatccttcaataacattagaaattggattcgcaacatagagcagcacgcatctgataatgtcaacaagatcttggtgggcaacaaggttgatatggatgcaaagcgggtagtgtccacagctcaaggtcagaagctcgcagatgaatatgggatcaagtttttcgagacgagtgcaaaaacaaatcaaaatgtggagcaggttttcttcaccatggcaagggacataaagcaaagactcaccgagactgtagccgctgcgactgagcccccaactattcagattagcaggccagatcccgaccaggctggcacggcctcgtcaaggtggtcatcctgctgtaacacctga

SEQ ID NO: 838 - protein, 216 aa, Sorghum bicolor
  misc_feature: Ceres ANNOT ID no. 6011078
  misc_feature (17)..(178): Pfam Id: Ras Pfam Desc: Ras family
  misc_feature (17)..(131): Pfam Id: Miro Pfam Desc: Miro-like protein
  misc_feature (1)..(176): Pfam Id: Arf Pfam Desc: ADP-ribosylation factor family
  misc_feature (16)..(131): Pfam Id: MMR_HSR1 Pfam Desc: GTPase of unknown function
  misc_feature (24)..(216): NCBI GI: 115471033 NCBI Desc: os07g0195100 [oryza sativa (japonica cultivar-group)]
  misc_feature (1)..(216): NCBI GI: 18447913 NCBI Desc: ras-related protein rab8-1 [nicotiana tabacum]
  misc_feature (1)..(216): NCBI GI: 5669640 NCBI Desc: ethylene-responsive small gtp-binding protein [lycopersicon esculentum]
  misc_feature (1)..(216): NCBI GI: 18447917 NCBI Desc: ras-related protein rab8-3 [nicotiana tabacum]
  misc_feature (1)..(216): NCBI GI: 871510 NCBI Desc: small gtp-binding protein [pisum sativum]
  misc_feature: Useful for making plants with altered Lignin content
  misc_feature: Useful for making plants with modulated oxidative stress sensitivity
  misc_feature: Functional homolog of the protein sequence given in SEQ ID NO 13074
  misc_feature: GREAT-hit functional homolog of the protein sequence given in SEQ ID NO 13211
  misc_feature: Useful for making plants with altered lignin content
  misc_feature: Functional homolog of the protein sequence given in SEQ ID NO 13211
  misc_feature: Useful for making plants with modulated oxidative stress sensitivity
  misc_feature: Functional homolog of the protein sequence given in SEQ ID NO 13074
  misc_feature: The sequence is a functional homolog of SEQ ID NO. 400 in the 11/188,298 US application
MAAPPSRSRGDYDHLIKLLLIGDSGVGKSCLLLRFSDDTFTTSFITTIGIDFKVRTVELDGKRVKLQIWDTAGQERFRTITTAYYRGAMGILLVYDVTDESSFNNIRNWIRNIEQHASDNVNKILVGNKVDMDAKRVVSTAQGQKLADEYGIKFFETSAKTNQNVEQVFFTMARDIKQRLTETVAAATEPPTIQISRPDPDQAGTASSRWSSCCNT

SEQ ID NO: 839 - DNA, 1998 bp, Sorghum bicolor
  misc_feature: Ceres ANNOT ID no. 6011079
  misc_feature: Encodes the peptide sequence at SEQ ID NO 840
atgccgccggcgccggctgcgcggaagaagcgcctggtccgcgcgggcctcctaaccgccgcggtcgggtacttcgccttcgtgctcctcttcgagctccccttgctgcccttcctggcgtcgtcgtcctcccccgccgccacctcctcctcctcgtcgctccccttccagcacccgcgccggcgggagctagaggccgcggcggcggcgttcacgtcgccgtactcccccgcccgcccctccaagccagccttccccgccgccgcaccgggcccgagctcaacgccccggctcccgatcttctcgtccctcctcctcctcccgcggcccaacgccacggccaccccgttcgacaccaccgccgccgacgccttcgccgcggccaagccgcacctcgcccacctccagtccatccccaaccccgcctccgcctccacctccgcgtccgcgcccgcgtcgtcgccgccgccgccgacatgccccgcgtccatctccgtgcaccgggagcagctgccctacgacggcgtgcgcgtggtggagctcccctgcgggctcgccgtgggctcgcacgttaccgtggtggcccggccccgacccgccaggcccgagtacgaccccaagatcgccgagcgcaaggacggggaggccgccgtcatggtgtcgcagttcatggtcgagctggtcggcaccaaggccgtcgacggcgaggcgccgcccaggatcctgcacttcaaccccaggatccgcggggactacagccggaagcccgtcatcgagatgaacagctgctaccggatgcagtgggggcagtcgcagcgctgcgagggattcgcctcccgccccgccgaggacaccgttgacgggcaactcaagtgtgagaaatggattcacgacgatgacaacaagtcagaggaatcaaagatgaaatggtgggtgaaacgattgattggcagaccaaaggatgtccacatcagttggccatacccgttcacagaaggcaagctatttgttatgactttaacagctggtttggaaggttaccatgtcaatgttgatgggcggcatgttgcttcatttccttaccgcactggttactctcttgaggatgcaactgcgttgtctctgaatggagacattgatatcgagtcaatttttgctagttctctacccaattcacatcctagttttgctcccgagcgataccttgagatgtctgaacagtggaaagccccaccgctgcccactgaacctgttgagcttttcataggcattctctctgcagccagccattttgctgagcgtatggctgtaaggaaatcatggatgatgtatacaaggaaatcatccaatattgtagctcggttctttgtggctctgaatggaaaaaaggaagttaatgcagagctcaagaaggaggcagagttcttccaggacattgttatagtgccttttattgatagctatgaccttgttgtgttgaagaccgttgccattgctgagtatggggtgcgcgttgtccctgcaaagtacgtaatgaaatgtgatgatgatacattcgtcaggatcgattcagtactggatcaagtgaagaaaggtcgaaatgataaaagcgtttatgtcggaagtataaactacttccatcgaccactaagatctggcaagtgggcagtaacttatgaggaatggccggaagaagtgtacccgaattatgcgaatggacctggctatgtaatttcatctgatattgctcactacatcgtgtctgaattcgacaatcagacacttcggctgtttaagatggaggatgtgagcatgggcatgtgggtggagaagttcaacaagacgcggcggccggtggagatccggcacgacgtgcggttctaccagtcgggctgctacaacggctacttcacggcgcactaccagtccccgcagcacatgatctgcctgtggcggaagctgcagtctgggagtgcccggtgctgcaatgtgagatga

SEQ ID NO: 840 - protein, 665 aa, Sorghum bicolor
  misc_feature: Ceres ANNOT ID no. 6011079
  misc_feature (176)..(386): Pfam Id: Gal-bind_lectin Pfam Desc: Galactoside-binding lectin
  misc_feature (432)..(620): Pfam Id: Galactosyl_T Pfam Desc: Galactosyltransferase
  misc_feature (1)..(665): NCBI GI: 34393273 NCBI Desc: galactosyltransferase family-like protein [oryza sativa (japonica cultivar-group)]
  misc_feature (1)..(459): NCBI GI: 115456021 NCBI Desc: os03g0803600 [oryza sativa (japonica cultivar-group)]
  misc_feature (219)..(665): NCBI GI: 56202233 NCBI Desc: galactosyltransferase-like [oryza sativa (japonica cultivar-group)]
  misc_feature (14)..(665): NCBI GI: 15241899 NCBI Desc: galactosyltransferase family protein [arabidopsis thaliana]
  misc_feature (157)..(665): NCBI GI: 5882743 NCBI Desc: ests gbh36134 and gbh36132 come from this gene. [arabidopsis thaliana]
  misc_feature: Useful for making plants with altered carbohydrate content
  misc_feature: Functional homolog of the protein sequence given in SEQ ID NO 13850
MPPAPAARKKRLVRAGLLTAAVGYFAFVLLFELPLLPFLASSSSPAATSSSSSLPFQHPRRRELEAAAAAFTSPYSPARPSKPAFPAAAPGPSSTPRLPIFSSLLLLPRPNATATPFDTTAADAFAAAKPHLAHLQSIPNPASASTSASAPASSPPPPTCPASISVHREQLPYDGVRVVELPCGLAVGSHVTVVARPRPARPEYDPKIAERKDGEAAVMVSQFMVELVGTKAVDGEAPPRILHFNPRIRGDYSRKPVIEMNSCYRMQWGQSQRCEGFASRPAEDTVDGQLKCEKWIHDDDNKSEESKMKWWVKRLIGRPKDVHISWPYPFTEGKLFVMTLTAGLEGYHVNVDGRHVASFPYRTGYSLEDATALSLNGDIDIESIFASSLPNSHPSFAPERYLEMSEQWKAPPLPTEPVELFIGILSAASHFAERMAVRKSWMMYTRKSSNIVARFFVALNGKKEVNAELKKEAEFFQDIVIVPFIDSYDLVVLKTVAIAEYGVRVVPAKYVMKCDDDTFVRIDSVLDQVKKGRNDKSVYVGSINYFHRPLRSGKWAVTYEEWPEEVYPNYANGPGYVISSDIAHYIVSEFDNQTLRLFKMEDVSMGMWVEKFNKTRRPVEIRHDVRFYQSGCYNGYFTAHYQSPQHMICLWRKLQSGSARCCNVR

SEQ ID NO: 841 - DNA, 885 bp, Sorghum bicolor
  misc_feature: Ceres ANNOT ID no. 6011081
  misc_feature: Encodes the peptide sequence at SEQ ID NO 842
atgagtctctgcgtcgtgctgctcctcctggcggcgctcctcctggccaccaccgccgtcgtgccggtgctgctgctccttggcgaggacgacgacgccgccgtcgtcgcaccggcggcgcctcctttgagctcctctcgtgtcaaggccctctcatggcagccaaggatcttcgtgtacaaagggttcctctccgacgacgagtgcgaccacctcgtgacgctggcgaagaaggggaccatggtggcgcacaaccggtccagctactacaggcagacgcgcaccagctccggcatgttcctcaggaagcgccaggacccggtggtgagtaggatcgaagagaggattgcggcatggacacttcttcctcgagagaatgttgagaaaatgcagatacagcgctaccagcacggacagaagtacgatccgcacttcgactacttcgatgacaagatccaccatacccggggaggcccccggtatgccaccgtgctcatgtacctgtccaccgtcgacaagggaggcgagaccgtgttccccaaggccaagggatgggagtcccagcccaaggatgacacattctctgagtgtgcacacaaaggattggcagtgaaaccggtgaaaggcgacgctgtgctcttcttcagcctccacgtcgacggggggccagacccgctcaccctccatgggagctgcccggtgatccaaggcgagaaatggtctgcgcccaattggatccacgtcagtccccaaggatgcgccaacaagagcgagcattgcgcggagtgggctgcgatgatgggagagcaccgggaagaacctggcatagacgctgaggggtcaccaaggaagtgtcagaagagctgcagagtatgtgattcatag

SEQ ID NO: 842 - protein, 294 aa, Sorghum bicolor
  misc_feature: Ceres ANNOT ID no. 6011081
  misc_feature (126)..(248): Pfam Id: 2OG-FeII_Oxy Pfam Desc: 2OG-Fe(II) oxygenase superfamily
  misc_feature (8)..(294): NCBI GI: 34393269 NCBI Desc: prolyl 4-hydroxylase alpha-1 subunit precursor-like protein [oryza sativa (japonica cultivar-group)]
  misc_feature (8)..(294): NCBI GI: 115471029 NCBI Desc: os07g0194500 [oryza sativa (japonica cultivar-group)]
  misc_feature (46)..(294): NCBI GI: 92868637 NCBI Desc: metridin-like shk toxin; 2og-fe(ii) oxygenase [medicago truncatula]
  misc_feature (46)..(292): NCBI GI: 30689216 NCBI Desc: oxidoreductase, 2og-fe(ii) oxygenase family protein [arabidopsis thaliana]
  misc_feature (46)..(294): NCBI GI: 9294583 NCBI Desc: prolyl 4-hydroxylase alpha subunit-like protein [arabidopsis thaliana]
  misc_feature: The sequence is a functional homolog of SEQ ID NO. 333 in the 11/188,298 US application
MSLCVVLLLLAALLLATTAVVPVLLLLGEDDDAAVVAPAAPPLSSSRVKALSWQPRIFVYKGFLSDDECDHLVTLAKKGTMVAHNRSSYYRQTRTSSGMFLRKRQDPVVSRIEERIAAWTLLPRENVEKMQIQRYQHGQKYDPHFDYFDDKIHHTRGGPRYATVLMYLSTVDKGGETVFPKAKGWESQPKDDTFSECAHKGLAVKPVKGDAVLFFSLHVDGGPDPLTLHGSCPVIQGEKWSAPNWIHVSPQGCANKSEHCAEWAAMMGEHREEPGIDAEGSPRKCQKSCRVCDS

SEQ ID NO: 843 - DNA, 828 bp, Sorghum bicolor
  misc_feature: Ceres ANNOT ID no. 6011089
  misc_feature: Encodes the peptide sequence at SEQ ID NO 844
atggatcccgcctcgtcggtggccgccgagctctggcgaccgccgcacctgcaccaccaccaccacctcgcctcttccgccggccgtcatccccacctcgaggcctcctcctcctccgtcgtcaccgccgccgccgccgccgcccgctccgggggcggcggctccagcagcagcagccgcaggagggcgcggcgcgaagccgcggcgccgccggccgaggaggagccgtccaagctcgcctccacgtccgggaccgccgccagtagcagtgcggcaggcggccgggactcggctgacccagaagcaaaacggttgaagcagatgacacctagtgaaaataatgacagaaggacagaagctggatcaaattcagggaatgctagcaagtctgctgataaaaagcctgcacctaaagagccaccaaaagactacatccatgtgagggctagaagaggtcaagcaacggacagccatagcctcgcagaaagagcgcgacgagagaagataagtgaacggatgaaagttcttcaagatattgtccctggatgcaacaaggtaatcgggaaagcatcagtccttgatgagataataaattacatccagtctctacagcgtcaagtggagtttttgtccatgaaacttgaaaccattaatgctcatatgaacaatgcgactgtagcttttccaacgaaagattttggtgctccgccatataatactgcacctagtctgacgttggatccacaaacaccaagggaatatgcccagggctcgatgtcagattggcttcacatgcagatcggtaatgcatacgaaagagtgacatga

SEQ ID NO: 844 - protein, 275 aa, Sorghum bicolor
  misc_feature: Ceres ANNOT ID no. 6011089
  misc_feature (154)..(204): Pfam Id: HLH Pfam Desc: Helix-loop-helix DNA-binding domain
  misc_feature (20)..(232): NCBI GI: 115471019 NCBI Desc: os07g0193800 [oryza sativa (japonica cultivar-group)]
  misc_feature (90)..(275): NCBI GI: 33339703 NCBI Desc: myc1 [catharanthus roseus]
  misc_feature (62)..(275): NCBI GI: 55419646 NCBI Desc: bhlh transcription factor [gossypium hirsutum]
  misc_feature (72)..(232): NCBI GI: 8778763 NCBI Desc: t30e16.21 [arabidopsis thaliana]
  misc_feature (72)..(232): NCBI GI: 30696324 NCBI Desc: basic helix-loop-helix (bhlh) family protein [arabidopsis thaliana]
  misc_feature: The plant is abnormally small.
  misc_feature: The sequence is a functional homolog of SEQ ID NO 1929 in the 10/374,780US patent application
  misc_feature: The sequence is a functional homolog of SEQ ID NO 1930 in the 10/374,780US patent application
  misc_feature: Useful for making plants with modulated biomass
  misc_feature: Useful for making plants with modulated growth and phenotype characteristics
  misc_feature: Functional homolog of the protein sequence given in SEQ ID NO 13025
  misc_feature: The sequence is a functional homolog of SEQ ID NO 1929 in the 20060162006 US patent application
  misc_feature: The sequence is a functional homolog of SEQ ID NO 1930 in the 20060162006 US patent application
  misc_feature: The sequence is a functional homolog of SEQ ID NO 1930 in the 10/374,780 US patent application
  misc_feature: The sequence is a functional homolog of SEQ ID NO 1929 in the 10/374,780 US patent application
  misc_feature: The sequence is a functional homolog of SEQ ID NO. 414 in the 11/188,298 US application
  misc_feature: The sequence is a functional homolog of SEQ ID NO. 483 in the 11/188,298 US application
MDPASSVAAELWRPPHLHHHHHLASSAGRHPHLEASSSSVVTAAAAAARSGGGGSSSSSRRRARREAAAPPAEEEPSKLASTSGTAASSSAAGGRDSADPEAKRLKQMTPSENNDRRTEAGSNSGNASKSADKKPAPKEPPKDYIHVRARRGQATDSHSLAERARREKISERMKVLQDIVPGCNKVIGKASVLDEIINYIQSLQRQVEFLSMKLETINAHMNNATVAFPTKDFGAPPYNTAPSLTLDPQTPREYAQGSMSDWLHMQIGNAYERVT

SEQ ID NO: 845 - DNA, 3069 bp, Sorghum bicolor
  misc_feature: Ceres ANNOT ID no. 6011211
  misc_feature: Encodes the peptide sequence at SEQ ID NO 846
atggcttcccgtgggcgcggtttcggcggagggcggcaaggccctggtggtgggcgcggcagcgagggcagggggcgcgggatcggtggcggcggaggttaccaacaaccctacggtcgcggcggtgatggaggcggtgaatccggaggccgaggcggcgtgggccgagggcgcggggtcggcggtcgcggcaacgggggaggccgcggacccggcggacgaggtggcgtcggctaccagcagccgccaccgccgccgctcgggaacgtagaggtcggaggccggggccgcggtggcgtggcggtagctgtaccagtaccagcccgccccgcggcgcctcgtcctcttgcgccggtcgtcgctgccccggcagttccagcagcggcctcgtcttctgcgccgccggcgcaagcgcctcgtgcccccgccggggcggctggaggcggagctgccttggcggcaggcatggggaggttggccgtggccgacaaccccgctcctcccgcgcctgctgcaggtagatccgaggcgcaaggtcctgcgcaccggcctccgcctccgcccctctcgagcaaggggatcactccgcctgcgcgccccgggttcggcacgttggggaggaagctcatcgttcgcgcaaaccacttcgctgtccaggttttaatcaatcctgaaccaaaggcaagaagaaccaacagggtgattctgtcagagcttctcaaggtgcatggtgcgacatccctcgcccataagatacctgcctatgatggaagcaagagcctatacaccgcaggcgagctgccattcaaatcaatggagtttgttgtcaagttgggtgagtacaaggtgacaatccgatatgcggcacagccaaacctgtaccatcttcagcaattcctcaagggtcagcagagggacgccccatatgacacaattcaagcattggatgttgccctgagagagtctccttctctcaattatgtcactctttctcgatccttcttctccaagaagtttgataatggggtggacattggtggtgggctagagagctggagcggatattaccagagcttgcgcccaactcaaatgggcctctcattgaacattgatatatgctcgacttcattttaccaatctatccctgtggtaaaatttgttgatgattgtcttgggctgacaaaccctgcccaacctttttcggacagggatcgtttgaagcttaagaaagccctgcgtggagttcgtgttgagactacacaccagcaggggaaaaaaagcgcctacaagataactgggattactcctgttccattggctcagctgagcttttcttgtaacgaaggacctcagttgactgttgtccagtactttgctgaacggtacaactaccggttgcgctatactgcttggccctgccttcagtccggcaatgattctaagccgatatatttacctatggaggtgtgccaaatcattgaaggacagaggtaccctaggaagctcagcgacacacaggtgaccaatatactgaaggcaacctgtaaacgtcctcaggagagggaggggagcattattcagatggttcaccgcaacaactattcagctgataagatggcacaggtgtttgggatcactgtggccaaccagatggctaatgtgcaagctcgtgttctgcctgcacctatgctgaaatatcatgaatctggaagggagaaaacggttgcaccaagtttggggcaatggaatatgattaacaagaaaatggtcaatggtggaactgttcacagctggacttgtttgagcttttcgcggattcagcttcatatagtagacagaatatgcgaggacttggctcagatgtgcaattccattggcatggattttaatccaaggcccgtgacagaagttcagtcagcctcacccaaccacatagaagctgctttaagggatgtgcacatgagggctccaaatttgcagctgcttattgtcgttcttccagatgtttctggtcattatgggaaaattaagaggatatgcgagactgaccttggtatagtatctcagtgcatcaatccaaagaagaataaaaacaagcagtattttgaaaatgtcgcccttaaaatcaatgtgaaggtgggagggcgcaatacagtgcttgagagagcctttgtgcctaatggaataccttttgtctcagatgtgccaacaatcatttttggtgctgatgttacccatcctacagcaggagaagattcctcggcttctattgcagctgtggttgcatccatggactggccacaagtcacaacatataaagcactagtctcggcgcaagcacatagggaagagattatacaaaatctgttctggactggtacagatccagagaagggcactccagtgaacggtggaatgataagggagttgctgacttcattctttaagaggactggacgaaagcccaaaaggattatattttacagggatggtgtaagtgagggacaattcagccacgttttgctccatgaaatggacgcaatcaggaaggcctgtgcctctatggaagatggttatctaccaccagtgacattcgtggtggtacagaaaaggcaccacacaaggctcttccctgaagttcatggaaggagagatcttactgacaaaagcggaaacattcttcctggaactgtggttgatactagcatttgtcatcccagcgagtttgatttctacctctgtagccatgctggaattaagggaacaagcaggccaacacactatcatgtcctctatgatgagaaccgtttctcggctgatgctctgcagtttctcacaaacaacctttgctacacatacgcacgctgcacacgcgctgtttctgttgttccaccagcctactacgctcacctggcagcattccgcgcaaggtactatgacgaacaagagagcaccgatggaacctcagttgtcagtggtagcgccgccacagccggcggtggcccacctgcgttccgcaggctcccccagataaaggagaatgtgaaggaagtgatgttcttctgctga

SEQ ID NO: 846 - protein, 1022 aa, Sorghum bicolor
  misc_feature: Ceres ANNOT ID no. 6011211
  misc_feature (661)..(981): Pfam Id: Piwi Pfam Desc: Piwi domain
  misc_feature (381)..(517): Pfam Id: PAZ Pfam Desc: PAZ domain
  misc_feature (5)..(962): NCBI GI: 115455965 NCBI Desc: os03g0800200 [oryza sativa (japonica cultivar-group)]
  misc_feature (281)..(1022): NCBI GI: 38344266 NCBI Desc: osjnba0005n02.3 [oryza sativa (japonica cultivar-group)]
  misc_feature (16)..(1022): NCBI GI: 4510428 NCBI Desc: argonaute (ago1)-like protein [arabidopsis thaliana]
  misc_feature (5)..(1022): NCBI GI: 119351183 NCBI Desc: argonaute 1 [pisum sativum]
  misc_feature (579)..(1022): NCBI GI: 119351181 NCBI Desc: argonaute 2 [pisum sativum]
  misc_feature: The sequence is a functional homolog of SEQ ID NO 2086 in the 10/374,780US patent application
  misc_feature: Useful for making plants with modulated growth and phenotype characteristics
  misc_feature: The sequence is a functional homolog of SEQ ID NO 2086 in the 20060162006 US patent application
  misc_feature: The sequence is a functional homolog of SEQ ID NO 2086 in the 10/374,780 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
MASRGRGFGGGRQGPGGGRGSEGRGRGIGGGGGYQQPYGRGGDGGGESGGRGGVGRGRGVGGRGNGGGRGPGGRGGVGYQQPPPPPLGNVEVGGRGRGGVAVAVPVPARPAAPRPLAPVVAAPAVPAAASSSAPPAQAPRAPAGAAGGGAALAAGMGRLAVADNPAPPAPAAGRSEAQGPAHRPPPPPLSSKGITPPARPGFGTLGRKLIVRANHFAVQVLINPEPKARRTNRVILSELLKVHGATSLAHKIPAYDGSKSLYTAGELPFKSMEFVVKLGEYKVTIRYAAQPNLYHLQQFLKGQQRDAPYDTIQALDVALRESPSLNYVTLSRSFFSKKFDNGVDIGGGLESWSGYYQSLRPTQMGLSLNIDICSTSFYQSIPVVKFVDDCLGLTNPAQPFSDRDRLKLKKALRGVRVETTHQQGKKSAYKITGITPVPLAQLSFSCNEGPQLTVVQYFAERYNYRLRYTAWPCLQSGNDSKPIYLPMEVCQIIEGQRYPRKLSDTQVTNILKATCKRPQEREGSIIQMVHRNNYSADKMAQVFGITVANQMANVQARVLPAPMLKYHESGREKTVAPSLGQWNMINKKMVNGGTVHSWTCLSFSRIQLHIVDRICEDLAQMCNSIGMDFNPRPVTEVQSASPNHIEAALRDVHMRAPNLQLLIVVLPDVSGHYGKIKRICETDLGIVSQCINPKKNKNKQYFENVALKINVKVGGRNTVLERAFVPNGIPFVSDVPTIIFGADVTHPTAGEDSSASIAAVVASMDWPQVTTYKALVSAQAHREEIIQNLFWTGTDPEKGTPVNGGMIRELLTSFFKRTGRKPKRIIFYRDGVSEGQFSHVLLHEMDAIRKACASMEDGYLPPVTFVVVQKRHHTRLFPEVHGRRDLTDKSGNILPGTVVDTSICHPSEFDFYLCSHAGIKGTSRPTHYHVLYDENRFSADALQFLTNNLCYTYARCTRAVSVVPPAYYAHLAAFRARYYDEQESTDGTSVVSGSAATAGGGPPAFRRLPQIKENVKEVMFFC

SEQ ID NO: 847 - DNA, 1917 bp, Sorghum bicolor
  misc_feature: Ceres ANNOT ID no. 6011222
  misc_feature: Encodes the peptide sequence at SEQ ID NO 848
atggtgttcgacgcgagcggcagcagctcgccagcgacggcgccgccgccgtcggggaaccctctgggcgtgatcctgacgcggcggttcgcgcggcaggtgctcctgggccggtggttcacggtgttcgcgagcctgctcatcatggcggcctccggcgcgacgtacatcttcgggagctactccggcacgctcaagtcgtcgctcgggtacgaccagcgcacgctcaacacggtctccttcttcaaggacctcggcgccaacctgggcgtcttctcgggcctcatcaacgaggtgacgccgccgtgggtggtgctggccatgggcgccggcatgaacctcttcggctacctcatggtgtacctcgccgtgtcgggccgcacgtcgcgcccgccgctgtggctggtgtgcctctacttcttcgtcggctccaactcgcagtcgttcgccaacacgggcgcgctggtcacctgcgtcaagaacttcccggagagccgcggcgtggtgctgggcatcctcaagggcttcgtcggcctcagcggcgccgtgtacacgcagctgtaccaggcgctctacggcggcgacgacgccgagtcgctgatcctcctcatcgcgtggctccccgccgcggtctccgtcgtgttcgtccacaccatccggtacatgccgtaccctccgcggcggcggcggcggcgcggcggcggcggcggaggagggcaggagacgagctccgacccgttcttctgcttcctctacctgtccatcgcgctggcgtgcttcctcctcgtcatgatcgtggtgcagcatcaggtccccttctcccgcgacgcgttcggcgtcgccgccacgccgctgctcatcctcctcctcatgcccctctgcgtcgtcgtcaagcaggagtacaagatctaccgcgagcgccagctcgacgccgccgaccccacgccgcccaccatcaccatgtcagcagcagcaacggacgacaccaccaccaccaccaccaagaaaacagagcagccgtcctcgtcgtcgtcttgcctggggtcgttgggcaagtgcgtgcggaccatgttccgtccaccacctcgcggcgaggactacacgatcctacaagcactagtgagcgtagacatgctcgtcctgttcgtggcgaccatctgcggcgtgggcggcacactaacggcgatcgacaacatggggcagatcggggagtcgctgggctacccatccaagagcatcaacaccttcgtctccctcatcagcatctggaactacgccggccgcgtgaccgccggctacgcctcggaggccgtgctggtccggtaccgcgtgccacgcccggtgctcctgacggcggtgctcctgctggcgtgcgcggggcacgtggtgatcgccctgggcgtcggcaacgggctgtacgcggcgtcggtggtcatcgggttctgcttcggcgcgcagtggccgctcgtgttcgccatcatctccgaggtgttcgggctcaagtactactccacgctctacaacttcggcggcatggccagccccgtcgggtcgtacatcctcaacgtgcgcgtcgccgggaggctctacgacgccgccgccgcgcggcagcgtaacggcgccggtggaggagggaagcacgacaagctgtgcctcggggtggagtgctataagaggtccttcttgatcatcacggcggcgacggtggccggcgcggccgtgtcgctggtgctggtgtggcggacgtggaggttctacaggggcgacatctacgcgaggttccgggacggcgacggcggcgagggcgagggcacgggaaaggacgggcggctgccggtggaccggcggggggtgggagaggaggaggaggaggaggaggaggagagggagaaggcggccaatggcaggaaggggtga

SEQ ID NO: 848 - protein, 638 aa, Sorghum bicolor
  misc_feature: Ceres ANNOT ID no. 6011222
  misc_feature (38)..(297): Pfam Id: Nodulin-like Pfam Desc: Nodulin-like
  misc_feature (30)..(608): NCBI GI: 115489774 NCBI Desc: os12g0637800 [oryza sativa (japonica cultivar-group)]
  misc_feature (33)..(596): NCBI GI: 3402684 NCBI Desc: nodulin-like protein [arabidopsis thaliana]
  misc_feature (338)..(634): NCBI GI: 115488580 NCBI Desc: os12g0484600 [oryza sativa (japonica cultivar-group)]
  misc_feature (244)..(627): NCBI GI: 115455961 NCBI Desc: os03g0800000 [oryza sativa (japonica cultivar-group)]
  misc_feature (240)..(596): NCBI GI: 57545995 NCBI Desc: nitrate and chloride transporter [glycine max]
  misc_feature: The sequence is a functional homolog of SEQ ID NO. 454 in the 11/188,298 US application
MVFDASGSSSPATAPPPSGNPLGVILTRRFARQVLLGRWFTVFASLLIMAASGATYIFGSYSGTLKSSLGYDQRTLNTVSFFKDLGANLGVFSGLINEVTPPWVVLAMGAGMNLFGYLMVYLAVSGRTSRPPLWLVCLYFFVGSNSQSFANTGALVTCVKNFPESRGVVLGILKGFVGLSGAVYTQLYQALYGGDDAESLILLIAWLPAAVSVVFVHTIRYMPYPPRRRRRRGGGGGGGQETSSDPFFCFLYLSIALACFLLVMIVVQHQVPFSRDAFGVAATPLLILLLMPLCVVVKQEYKIYRERQLDAADPTPPTITMSAAATDDTTTTTTKKTEQPSSSSSCLGSLGKCVRTMFRPPPRGEDYTILQALVSVDMLVLFVATICGVGGTLTAIDNMGQIGESLGYPSKSINTFVSLISIWNYAGRVTAGYASEAVLVRYRVPRPVLLTAVLLLACAGHVVIALGVGNGLYAASVVIGFCFGAQWPLVFAIISEVFGLKYYSTLYNFGGMASPVGSYILNVRVAGRLYDAAAARQRNGAGGGGKHDKLCLGVECYKRSFLIITAATVAGAAVSLVLVWRTWRFYRGDIYARFRDGDGGEGEGTGKDGRLPVDRRGVGEEEEEEEEEREKAANGRKG

SEQ ID NO: 849 - DNA, 1209 bp, Sorghum bicolor
  misc_feature: Ceres ANNOT ID no. 6011234
  misc_feature: Encodes the peptide sequence at SEQ ID NO 850
  misc_feature: Up-regulated in root tissues in response to methyl jasmonate treatment
  misc_feature: Down-regulated in shoot tissues in response to salicylic acid treatment
atggccggcggcggcagcggcagcggcgaggcttcggcggcgggaggcgggaaggtggcgtgcgcggcgtggatccggcgccgggaggagaaggcggcggcggcggtggcgcgggtgttcgcggcgtacggccgggcgggggcggccggctccccgcccgcgctcgaggtgctcggcttcgacgccaaggagtgctccctctcccccgagcccctggcgagggccgtgctcggggagggcggcgcgggcgacgcgccgcgcagcatcgcggtgcaccccgccggcgacgagcttgtctgcgccaccgccacgggctgcaggttattcaaactgatatttgaagagttcacagtacgcatcattccaagagatgctcctccactagaatctgctggacctcaaaagtgtcttgctttcagcacagatggtgccaaatttgccattggtggagaggatgggcatctcagaatattccattggccaagcatgaatgtgcttttggacgaacccaaagctcataaatccttccgagacatggatatcagcttagactcagagttcttagtttcaacatccactgatggatctgcaagaatatggaagatagatgagggtgcaccactggtcaatttgactcgatcctcggatgagaagattgagtgttgccgcttttctagggatggaatgaaaccattcctgttttgcactgttgcaaaaggttccaaagttgttactgctgtatggaacataagcgattggaagagaattgggtacaaaagacttctgggaaagcctatctccacactttcagttagcttggatgggaagtatctggcattaggaagccatgatggtgacttctgtgctgttgatgtaaagaaaatggaagtttctcactggagcaagaaagttcatcttggttccccagtcacctccattggattttgtcctactgaaagggttataatctccacatcacatcaatggggagcagagttgacaaaactgaatgtgccggctgactggaaagaatggcaggtctggctcgtactcctggcgctcttcctagcgtccgccatcctgttctatgtgttctatgagcgctcggacacattctggaacttccccatggggcgacaccagccagcgaagccatggaacatgctcaaggagtctcctccggtccccgaggaccagaatccatggtga

SEQ ID NO: 850 - protein, 402 aa, Sorghum bicolor
  misc_feature: Ceres ANNOT ID no. 6011234
  misc_feature (164)..(201): Pfam Id: WD40 Pfam Desc: WD domain, G-beta repeat
  misc_feature (1)..(402): NCBI GI: 34394605 NCBI Desc: transducin / wd-40 repeat protein-like [oryza sativa (japonica cultivar-group)]
  misc_feature (39)..(334): NCBI GI: 8777388 NCBI Desc: protein transport protein sec12p-like [arabidopsis thaliana]
  misc_feature (39)..(363): NCBI GI: 166878 NCBI Desc: st12p protein
  misc_feature (135)..(317): NCBI GI: 67938616 NCBI Desc: g-protein beta wd-40 repeat [chlorobium phaeobacteroides bs1]
  misc_feature (96)..(327): NCBI GI: 78188196 NCBI Desc: wd-40 repeat [chlorobium chlorochromatii cad3]
  misc_feature: Up-regulated in root tissues in response to methyl jasmonate treatment
  misc_feature: Down-regulated in shoot tissues in response to salicylic acid treatment
MAGGGSGSGEASAAGGGKVACAAWIRRREEKAAAAVARVFAAYGRAGAAGSPPALEVLGFDAKECSLSPEPLARAVLGEGGAGDAPRSIAVHPAGDELVCATATGCRLFKLIFEEFTVRIIPRDAPPLESAGPQKCLAFSTDGAKFAIGGEDGHLRIFHWPSMNVLLDEPKAHKSFRDMDISLDSEFLVSTSTDGSARIWKIDEGAPLVNLTRSSDEKIECCRFSRDGMKPFLFCTVAKGSKVVTAVWNISDWKRIGYKRLLGKPISTLSVSLDGKYLALGSHDGDFCAVDVKKMEVSHWSKKVHLGSPVTSIGFCPTERVIISTSHQWGAELTKLNVPADWKEWQVWLVLLALFLASAILFYVFYERSDTFWNFPMGRHQPAKPWNMLKESPPVPEDQNPW

SEQ ID NO: 851 - DNA, 1320 bp, Sorghum bicolor
  misc_feature: Ceres ANNOT ID no. 6011265
  misc_feature: Encodes the peptide sequence at SEQ ID NO 852
atggccggccgccgccgccgccaccggcgtgggcatccccgacaagcgcttccgccgccgcttccttccccaggagagcccccgccgctggaatccaacgctctcagggaagtcaccgttgcagaaagctcatccaagaaaacctgccatgccttaagctctacccgatcttccgcacctagccctgatgtttgggcagatcttctggacagcctgcttctccaaataattgtcctcgttagctcattccatgatctccttgctttcattggcacctgccgctcttggcgcgctgtgctctcttccctcccactcccacctgcatttaccttcaacatcccacctctccaccttcggccaaatggccatgattctcatccccatcgcaggtacatcaagcacagccttttatccaatatcagttggcagcttgttgatcctgcgaagcaaacctcctcccttagctgttcagcgctccaaaaccttcaggtccacatgcagtatttgggttgctcatatggttatcttatcttctccaaattggagcaatgcctccttgtcgatgtgtacagtggtgctaccgtgcggcctcccaagctcaaattcactgacaaccgcagtgtgtactatggagcccttgtagctccgatcaatttacctaattcccgtctcctcttttgctcaagatcatccatgtttcagtggcaggttggatcaaacttttggtctgagcaccctttgggtgtccaatgcattgttcaaattgtgtccttcaaaggtgagatatttgccattgacttccttgagaggctccacagagtacagttggaacctcagctgagcacgcaggaagtagcagttgtctgggatgcggacatgtttctaggactgtggaatgcaccgtggttggtggtctgtggtgacatgcttctcttggttgacttctcagtaagcatcaatcaattttctggaatagctggaacctttaatgtatttcgccttgactttcaagttgaaccagctaagtgggtaaaagtggatgatctgggagacaatgccctctttattagttttgataggaggaatccaacattttcttgcccgggtcctgataaatggggtgggaaaaggaactgtatttacattgccagcccgtctgcagattctaaagaactttggagtgtggttgaagttggtcaggtggtgcttgatccaaagttgtgtactaatggtgcagaaaagtatctaccccgtgcccagttgatgcaactgcaaaacctttgggagcttcccagttttgtttatggtgttggccagtga

SEQ ID NO: 852 - protein, 439 aa, Sorghum bicolor
  misc_feature: Ceres ANNOT ID no. 6011265
  misc_feature (27)..(439): NCBI GI: 55295888 NCBI Desc: selenium-binding protein-like [oryza sativa (japonica cultivar-group)]
  misc_feature (104)..(439): NCBI GI: 55295904 NCBI Desc: selenium-binding protein-like [oryza sativa (japonica cultivar-group)]
  misc_feature (44)..(438): NCBI GI: 115465968 NCBI Desc: os06g0111200 [oryza sativa (japonica cultivar-group)]
  misc_feature (70)..(438): NCBI GI: 115465996 NCBI Desc: os06g0113500 [oryza sativa (japonica cultivar-group)]
  misc_feature (166)..(438): NCBI GI: 55295887 NCBI Desc: selenium-binding protein-like [oryza sativa (japonica cultivar-group)]
MAGRRRRHRRGHPRQALPPPLPSPGEPPPLESNALREVTVAESSSKKTCHALSSTRSSAPSPDVWADLLDSLLLQIIVLVSSFHDLLAFIGTCRSWRAVLSSLPLPPAFTFNIPPLHLRPNGHDSHPHRRYIKHSLLSNISWQLVDPAKQTSSLSCSALQNLQVHMQYLGCSYGYLIFSKLEQCLLVDVYSGATVRPPKLKFTDNRSVYYGALVAPINLPNSRLLFCSRSSMFQWQVGSNFWSEHPLGVQCIVQIVSFKGEIFAIDFLERLHRVQLEPQLSTQEVAVVWDADMFLGLWNAPWLVVCGDMLLLVDFSVSINQFSGIAGTFNVFRLDFQVEPAKWVKVDDLGDNALFISFDRRNPTFSCPGPDKWGGKRNCIYIASPSADSKELWSVVEVGQVVLDPKLCTNGAEKYLPRAQLMQLQNLWELPSFVYGVGQ

SEQ ID NO: 853 - DNA, 1224 bp, Sorghum bicolor
  misc_feature: Ceres ANNOT ID no. 6011304
  misc_feature: Encodes the peptide sequence at SEQ ID NO 854
atgatcggcctcgccgtcggctggtcctggcgcccgcgctggacggggctgctcttcctcggcctccgcagccgcctccgcgtcctctggctctgggtgccgccgggcctcggggcccggaggctctggctcgcctgcaccgcgctctccgcctgctccgtcgcgcccaggctcctctcctccgcattccgccgccaccgaagaggcaagcaccaggacaaggcctcccccgaggatcatgccgccgcggccccggacgacggaggttgcgccgttggcagcaggacaatttttgagggcgaacaagatactgtcactgagagggacctagaacatctcctgcaacttttagataacaaggaaagtggggatacggcttggcagaatttgatggagcgcacaacctccaacatgacctacaaggcctggcggcgtgaacctgaggagggacctattatgtactgcagccgcactatttttgaggatgctactcctgaactagttagagatttcttctgggatggtgattttcgtctaaagtgggatccaatgcttggatactccaaaactttggatgagttccctcagagtggagcaacaattgtccactggataaaaaagttcccattcttttgcagtgaccgtgaatacatctttggaggacgcatatgggaatcggggaagacttactattgtgttacaaagggtgtcccatatccatcattgcccaagaaagaaaaaccgaggcgtgtggagctgtacttctcaagttggcgtattaaagctgttcaatcaccaaaacatgcgggtcagcaatctgcgtgtgaagtaactttggtccactatgaagacatgggcataccaaaggatgttgccagggttgctgtccgtcacggcatgtggggtgctgtgaagaaactccagtctggattcagagcgtatcagcaaatgagaggcacagaaaacaccctgtcacacagagccatcatggctcgagtgaccaccaagatatccatctcggattcaaatggtccgttggatcatgacctctccgtcgtagatgaaaccagtgatggggacgacaggtcccagacagttcagcatggtttcgactggaagtgggtcgtggttggtggtgcggttgctgcggtttgtgtgctcaacaccggactggtaggcaaggtcctcttgcttggagcagcgagaaggcaggcaaagaagtag

SEQ ID NO: 854 - protein, 407 aa, Sorghum bicolor
  misc_feature: Ceres ANNOT ID no. 6011304
  misc_feature (20)..(407): NCBI GI: 115470931 NCBI Desc: os07g0185200 [oryza sativa (japonica cultivar-group)]
  misc_feature (56)..(403): NCBI GI: 10178166 NCBI Desc: membrane related protein-like [arabidopsis thaliana]
  misc_feature (1)..(403): NCBI GI: 21593272 NCBI Desc: membrane related protein-like [arabidopsis thaliana]
  misc_feature (1)..(405): NCBI GI: 46798907 NCBI Desc: membrane related protein [oryza sativa (japonica cultivar-group)]
  misc_feature (1)..(405): NCBI GI: 116317927 NCBI Desc: h0716a07.8 [oryza sativa (indica cultivar-group)]
MIGLAVGWSWRPRWTGLLFLGLRSRLRVLWLWVPPGLGARRLWLACTALSACSVAPRLLSSAFRRHRRGKHQDKASPEDHAAAAPDDGGCAVGSRTIFEGEQDTVTERDLEHLLQLLDNKESGDTAWQNLMERTTSNMTYKAWRREPEEGPIMYCSRTIFEDATPELVRDFFWDGDFRLKWDPMLGYSKTLDEFPQSGATIVHWIKKFPFFCSDREYIFGGRIWESGKTYYCVTKGVPYPSLPKKEKPRRVELYFSSWRIKAVQSPKHAGQQSACEVTLVHYEDMGIPKDVARVAVRHGMWGAVKKLQSGFRAYQQMRGTENTLSHRAIMARVTTKISISDSNGPLDHDLSVVDETSDGDDRSQTVQHGFDWKWVVVGGAVAAVCVLNTGLVGKVLLLGAARRQAKK

SEQ ID NO: 855 - DNA, 1872 bp, Sorghum bicolor
  misc_feature: Ceres ANNOT ID no. 6011308
  misc_feature: Encodes the peptide sequence at SEQ ID NO 856
  misc_feature: Down-regulated in shoot tissues in response to salicylic acid treatment
atggacctggacccagagggcatcttccgcgacgacagcgatgaggacgaagacaacgtccaggagagggaggcgaacaaggagatggttgtctaccttgtcgatgcctcgcccaaaatgttcacccctgctaccacccaggagacacattttcgtaccattgttagctgcatcactgagtctctcaagacgcaaattattggtagatcttatgatgaagtcgcaatatgtttctttaacactaaagagaagaagaatttacaggactcagctggtgtttatgtttataatgttggagacagagaagaacttgatagacccactgcaaaactcatcaaagatttttcttcaatagaagattcttttatgagcaccattggaagtcgatatgggataacatctggatctcgggagaataccctgtataatgctctttgggttgctcaggctttgctgcgcaagggatctgtgaagactgtcagtaaacgaattcttatattcaccaatgaagatgatccttttggtactattacaggagcagtgaaaactgatatgattaggacaacagttcaacgtgcaaaggatgcacaagatcttggcctgtctattgaacttcttccactgagccggcctgatgaacagttcgacatgtccctattttatgcagatttaattggtctggacggggatgagataaccgagtatttgccatctgctggtgttaggctagaggatatgtctaatcaactgagaaaacgaataatgaagaagcgcagagtcaaaactctttcatttgcgattacaaatgatgtgtgcatagaagtgaatacatatgcgctggtccgtcctactactccagggacaatcacatggcttgattcactaagtaaccttccattaaaggctgagaggtctttcatatgcaatgatactggggctctacttcaggatgcacagacacgtttccagatgtacaatgacacaactgtcaaattttctgtacgtgaactctctgaggttaaaagggttgcaagccatcatcttcgccttttaggtttcaagccattggattgcttgaaagattatcataacttaagaccatcgacatttgtttatccgagtgatcagcgtatatttggaagcactcgtgttttcgttgctttacatagctcaatgttacgtcttggaaggtttgcacttgcattttatgggaatccaactcgaccacagctcgtagcccttgttgctcaagaagaggttacttcctctggtggccagtttgaaccacctggcatgcacatgatctatcttccatactccgatgatattagatatcctgaagaagttcatgtgacttttgatgatgcaccgcgcgcaacagatgaacaaataaagaaagcttcaaatctattcaaacgtattgatctgaaaaatttctctacatgccaattagctaacccagctttgcaaagacactatgggatcttggaggccttagctttaggcgaagatgagatgcctgatataaaggatgagaccctgcctcacgaagaaggcttgtctaggccaggggtagtcaaagctattgaggaattcaagacatcagtatatggtgaaaattatgaccaagaggaggcagaagcagcagcagggaaagcttcccgtggtgatgcttcaaaaaagcggaaggaaatcactgatgcagctgcgcagatgagtgctgtttatgattgggcagaacttgcagacaatggaaaactgaaggaaatgacggcggcggaattgaaatgctacctgaccgcgcatgacctcccggtttctggtaagaaagacgtacttgtcagcaggatcttgactcatctgggcaagtga

SEQ ID NO: 856 - protein, 623 aa, Sorghum bicolor
  misc_feature: Ceres ANNOT ID no. 6011308
  misc_feature (29)..(260): Pfam Id: Ku_N Pfam Desc: Ku70/Ku80 N-terminal alpha/beta domain
  misc_feature (263)..(467): Pfam Id: Ku Pfam Desc: Ku70/Ku80 beta-barrel domain
  misc_feature (475)..(567): Pfam Id: Ku_C Pfam Desc: Ku70/Ku80 C-terminal arm
  misc_feature (587)..(621): Pfam Id: SAP Pfam Desc: SAP domain
  misc_feature (1)..(623): NCBI GI: 112982629 NCBI Desc: ku70 homolog [populus nigra]
  misc_feature (1)..(623): NCBI GI: 62320632 NCBI Desc: ku70-like protein [arabidopsis thaliana]
  misc_feature (11)..(617): NCBI GI: 45382537 NCBI Desc: ku70 protein [gallus gallus]
  misc_feature (11)..(623): NCBI GI: 114215700 NCBI Desc: ku70 autoantigen [danio rerio]
  misc_feature (11)..(623): NCBI GI: 49523218 NCBI Desc: thyroid autoantigen 70kda (ku antigen) [xenopus tropicalis]
  misc_feature: Down-regulated in shoot tissues in response to salicylic acid treatment
MDLDPEGIFRDDSDEDEDNVQEREANKEMVVYLVDASPKMFTPATTQETHFRTIVSCITESLKTQIIGRSYDEVAICFFNTKEKKNLQDSAGVYVYNVGDREELDRPTAKLIKDFSSIEDSFMSTIGSRYGITSGSRENTLYNALWVAQALLRKGSVKTVSKRILIFTNEDDPFGTITGAVKTDMIRTTVQRAKDAQDLGLSIELLPLSRPDEQFDMSLFYADLIGLDGDEITEYLPSAGVRLEDMSNQLRKRIMKKRRVKTLSFAITNDVCIEVNTYALVRPTTPGTITWLDSLSNLPLKAERSFICNDTGALLQDAQTRFQMYNDTTVKFSVRELSEVKRVASHHLRLLGFKPLDCLKDYHNLRPSTFVYPSDQRIFGSTRVFVALHSSMLRLGRFALAFYGNPTRPQLVALVAQEEVTSSGGQFEPPGMHMIYLPYSDDIRYPEEVHVTFDDAPRATDEQIKKASNLFKRIDLKNFSTCQLANPALQRHYGILEALALGEDEMPDIKDETLPHEEGLSRPGVVKAIEEFKTSVYGENYDQEEAEAAAGKASRGDASKKRKEITDAAAQMSAVYDWAELADNGKLKEMTAAELKCYLTAHDLPVSGKKDVLVSRILTHLGK

SEQ ID NO: 857 - DNA, 924 bp, Sorghum bicolor
  misc_feature: Ceres ANNOT ID no. 6011332
  misc_feature: Encodes the peptide sequence at SEQ ID NO 858
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
atggcggcgccggcgttcggaggacggcggaggccggcgtcagcagcagctctcctagccgtggcgacccttgttgttgtcttcctcgccgggccagccatggccgcggggaacaagaccggccaggtgacggtgttctggggccggaacaaggcggagggcacgctccgcgaggcctgcgactccgggctctacaccatggtcatcatgtcgttcctcgacgtctacggccccaacggcaagtaccatctggacctgtctggccacccgatcgccggcatcggcgacgacatcaagcactgccagttcgtcggcgtcccggtgtcgctctccatcggcggcttcggctccggctactcgctcccgtccaagcaggcggcgctggacctcttcgactacctctggaacgccttcttcggcgggtctaaacccggcgtccaccgccccttcggcgacgtatggctggacggcgtcgacctcttcctggagcacgggacgaacgccacggacaggtacgacgtgctggcgctggagctcgccaagcacaacatccgcggcggtcccgggaagccgctgcacctgacggcgacgccgcgctgcgagttcccgccggcggggtacctgaagcgggcgctggacacgggcatcttcgagcgcgtccacgtcaggatctacgacgacgccgactgcgaggcgtactggcacctggcctgggacaggtggacggcggcgtacccggccaccaggttctacgtcgggatgacggcgtcggagacgacgcacgggtgggtgcaccccaagaacgtctactacgacgtcgcgccgtcggtgcagaaggcggacaactacggcgggttcatgatctgggaacgctacgcggacacgctctccaactacaccagcatggtcaagtactatgcgtga

SEQ ID NO: 858 - protein, 307 aa, Sorghum bicolor
  misc_feature: Ceres ANNOT ID no. 6011332
  misc_feature (41)..(294): Pfam Id: Glyco_hydro_18 Pfam Desc: Glycosyl hydrolases family 18
  misc_feature (10)..(307): NCBI GI: 73622088 NCBI Desc: xylanase inhibitor protein 1 precursor (class iii chitinase homolog) (xip-i protein)
  misc_feature (10)..(307): NCBI GI: 20804336 NCBI Desc: xylanase inhibitor protein i [triticum aestivum]
  misc_feature (3)..(307): NCBI GI: 66766322 NCBI Desc: xylanase inhibitor xip-iii [triticum aestivum]
  misc_feature (36)..(307): NCBI GI: 51247633 NCBI Desc: chain a, crystal structure of family 11 xylanase in complex with inhibitor (xip-i)
  misc_feature (15)..(242): NCBI GI: 115468000 NCBI Desc: os06g0356800 [oryza sativa (japonica cultivar-group)]
  misc_feature: Useful for making plants with altered cell wall content and/or composition
  misc_feature: Functional homolog of the protein sequence encoded by LOCUS at5g24090
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
MAAPAFGGRRRPASAAALLAVATLVVVFLAGPAMAAGNKTGQVTVFWGRNKAEGTLREACDSGLYTMVIMSFLDVYGPNGKYHLDLSGHPIAGIGDDIKHCQFVGVPVSLSIGGFGSGYSLPSKQAALDLFDYLWNAFFGGSKPGVHRPFGDVWLDGVDLFLEHGTNATDRYDVLALELAKHNIRGGPGKPLHLTATPRCEFPPAGYLKRALDTGIFERVHVRIYDDADCEAYWHLAWDRWTAAYPATRFYVGMTASETTHGWVHPKNVYYDVAPSVQKADNYGGFMIWERYADTLSNYTSMVKYYA

SEQ ID NO: 859 - DNA, 1800 bp, Sorghum bicolor
  misc_feature: Ceres ANNOT ID no. 6011338
  misc_feature: Encodes the peptide sequence at SEQ ID NO 860
atggggtgtgccccggcgatgtgggccgcgctgtggctgcttgctgctgcggtggcggcaggggttgccgatcccggcggccttgagcgcgcgtttccaatagtggagccagactatgggcatacgaaacttcgtctcgcaaaagaaggtttggaagcaattcaaaggatcagaactccaatcgttattggtccctatcggtctggaaaatcttttcttctcaaccaacttctctctctatcatgtgacaaaggttttggagttggacacatgcgggataccaaaacaaaaggtatatgggtatggggttcccctgttgaggtggatattggtggctccaaagtgtctgtcctatacctggacactgaaggatttgagagtgttggaaaatcaaatgtatatgatgataggatatttgctctggcaactgttttaagttctgttctgatctacaatcttcctgaaacaattcgtgaagctgatatatctaggctttcatttgctgtcgaaattgctgaagaattctatggaagagtcaaggggcaagatgttgcttttgagccagcaaaacttctgtggttgatccagagagatttcctccaaggaaaatctgttcagcagatggttgatgaagctctgctacgggtacctaacaacaacggagacaaaaatattgatgagctcaaccaaatcagagactctttggcggttatgggagataacagtacagcttttagcttaccacagcctcatttgcaaaggacaaagttatgtgatatggaggaccaagaacttgatccattgtatgtaaagaagagggatcaattgaaagaagttgttgcatccatgataaaaccaaaaattgtgcagggtagaattctgaatgggacagagtttgtatccttcctagggcagatacttgaggctttgaataaaggtgaaattccatcaaccggatcgcttgttgaaattttcaataaggccattcttgaacgttgcttgaaggtgtacaatgaaagaatgggcagagcaggtctaccagtgtcagtggataaacttcagcagttccatgacctggcaaaagatgaagctaaaaggcttttcgacaagcagcatttcggtaaacatcatgctgctcagtccatcttcaagcttgatgaagagattaaaaaggtctacagaaacttcggtcaagctaatgagtatcagtcatcaaagctgtgcgaagcacggttctcagagtgtgaagataaaatggaacaccttcaagtcttgaagcttccatccatggcaaaatttgatgccggatttcttctctgcaatcaaagctttgaaatggattgcgtggggccagccaaggaaagctatcaacgccgaatgtcaaagatgctggcaaggtcccgagctcttttcatcaaggagtacaacaacaaactcttcaactggctggtcatattctccctggtcatggttgtcattggacgcttcttgatcaagttcttcctgcttgaaatcgctgcgtgggtgatgtttgccttcctggagacatacacgaggctgttttggtcatcagagtccctgtactacaaccccgtctggcacatgatcgtctcttcgtgggaaaccatcgtctacagccctgttcttgatcttgacagatgggcattcccaatcggtgcagttctgttttttctggcattttattggcgttgccttggtggaaggagaggaattgcccggtcactgctacctctgtataacgggtcttacagaagctccagtcgtacaagaacagactga

SEQ ID NO: 860 - protein, 599 aa, Sorghum bicolor
  misc_feature: Ceres ANNOT ID no. 6011338
  misc_feature (41)..(287): Pfam Id: GBP Pfam Desc: Guanylate-binding protein, N-terminal domain
  misc_feature (9)..(599): NCBI GI: 115470895 NCBI Desc: os07g0181700 [oryza sativa (japonica cultivar-group)]
  misc_feature (199)..(599): NCBI GI: 42569749 NCBI Desc: guanylate-binding family protein [arabidopsis thaliana]
  misc_feature (419)..(599): NCBI GI: 46402432 NCBI Desc: at2g38850 [arabidopsis thaliana]
  misc_feature (54)..(505): NCBI GI: 89304068 NCBI Desc: guanylate-binding protein, n-terminal domain containing protein [tetrahymena thermophila sb210]
  misc_feature (43)..(485): NCBI GI: 145358912 NCBI Desc: gtp binding / gtpase [arabidopsis thaliana]
MGCAPAMWAALWLLAAAVAAGVADPGGLERAFPIVEPDYGHTKLRLAKEGLEAIQRIRTPIVIGPYRSGKSFLLNQLLSLSCDKGFGVGHMRDTKTKGIWVWGSPVEVDIGGSKVSVLYLDTEGFESVGKSNVYDDRIFALATVLSSVLIYNLPETIREADISRLSFAVEIAEEFYGRVKGQDVAFEPAKLLWLIQRDFLQGKSVQQMVDEALLRVPNNNGDKNIDELNQIRDSLAVMGDNSTAFSLPQPHLQRTKLCDMEDQELDPLYVKKRDQLKEVVASMIKPKIVQGRILNGTEFVSFLGQILEALNKGEIPSTGSLVEIFNKAILERCLKVYNERMGRAGLPVSVDKLQQFHDLAKDEAKRLFDKQHFGKHHAAQSIFKLDEEIKKVYRNFGQANEYQSSKLCEARFSECEDKMEHLQVLKLPSMAKFDAGFLLCNQSFEMDCVGPAKESYQRRMSKMLARSRALFIKEYNNKLFNWLVIFSLVMVVIGRFLIKFFLLEIAAWVMFAFLETYTRLFWSSESLYYNPVWHMIVSSWETIVYSPVLDLDRWAFPIGAVLFFLAFYWRCLGGRRGIARSLLPLYNGSYRSSSRTRTD

SEQ ID NO: 861 - DNA, 1254 bp, Sorghum bicolor
  misc_feature: Ceres ANNOT ID no. 6011342
  misc_feature: Encodes the peptide sequence at SEQ ID NO 862
atggatcatgtcttctcaatggaggagatcctcggacccttttgggacctgccactgccaccaacaccaccagagcagcagcctctggtggtgaccgacagtgtcgtcatagatggtgttgttactcatggtggtgatggggagggtggtgacatgctggatcagattcagaacaccacagagtggacctttgagagattattggaagaggagcttctaactaacacaacaactgtggcaaactctagttgcccagccctaaatgttgatccactggtggaggtggaccacggaacgatggcgcctgcagaggtgagcgccgtaggtgaccccatggagtacaatgccatactgaagagaaagctggatgaggacctcatggccttcaaaatgtggagggcctctactagtggtgtgaactctgaaggctcaaacaatgaaaatggaggaggtagcaagaatctggtgcagaacaagctcaatagtgcagatccaaccaataatcatgcacaaaatgcagatcttcgtgtgaggtttgctactagctcttcctcaagggatccttcaccatcagatgaggatatggatggtgaagtagagattctgggatttaagatgcctactgaagaaagagtgagaaaaagaaaggaatctaatagagaatcagccaggcgctcaagatatagaaaagccgctcacttaaaggacctggaggaccaggtagaaaaattaaaagctgagaattcttgtttgctgaggcgccttgctgctatgaaccgaaagtacaatgaagctaatgttgacaacagggtactgaaagcagacatggagaccctaagagctaaggtgaaaatgggagaggactccctaaagcgcgttatagagatgagctcactgacctccatacccattccagagcttcccagcagctctgatgttccagtgcctatccacgaggagatcgtcaactatttcactaccaccccagcagacgatgctttggctgacaacagcttcatgcccatgccagagccattggcattgcaactccaagctgaagagccaaccatcaatggagctctaaatgccacagagatgaaccaaatcgctacgcactgcgcggcagggagccaaccatcaatggagcttatccaggagacaatgggagccatgatgccgacctcccccggatcaactctccaggaatctgagctgctgggtccaaacgagaccataaacatgcatacgtattag

SEQ ID NO: 862 - protein, 417 aa, Sorghum bicolor
  misc_feature: Ceres ANNOT ID no. 6011342
  misc_feature (207)..(261): Pfam Id: bZIP_2 Pfam Desc: Basic region leucine zipper
  misc_feature (207)..(270): Pfam Id: bZIP_1 Pfam Desc: bZIP transcription factor
  misc_feature (1)..(417): NCBI GI: 297482 NCBI Desc: opaque-2 [sorghum bicolor]
  misc_feature (1)..(417): NCBI GI: 463212 NCBI Desc: opaque 2 [coix lacryma-jobi]
  misc_feature (1)..(399): NCBI GI: 22388 NCBI Desc: opaque-2 protein [zea mays]
  misc_feature (9)..(417): NCBI GI: 30524861 NCBI Desc: opaque-2 protein [zea mays]
  misc_feature (17)..(417): NCBI GI: 168534 NCBI Desc: opaque-2 protein
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1232 in the 10/412,699US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 812 in the 10/412,699US patent application
  misc_feature: The sequence is a functional homolog of SEQ ID NO 910 in the 10/374,780US patent application
  misc_feature: The sequence is a functional homolog of SEQ ID NO 926 in the 10/374,780US patent application
  misc_feature: Useful for making plants with altered alkaloid content
  misc_feature: Useful for making plants with altered terpenoid content
  misc_feature: Useful for making plants with modulated endosperm cell number
  misc_feature: Useful for making plants with modulated endosperm size
  misc_feature: Useful for making plants with modulated growth and phenotype characteristics
  misc_feature: Functional homolog of the protein sequence given in SEQ ID NO 13237
  misc_feature: Functional homolog of the protein sequence given in SEQ ID NO 13412
  misc_feature: The sequence is a functional homolog of SEQ ID NO 12 in the 20040045049 US patent application
  misc_feature: The sequence is a functional homolog of SEQ ID NO 1232 in the 20040045049 US patent application
  misc_feature: The sequence is a functional homolog of SEQ ID NO 812 in the 20040045049 US patent application
  misc_feature: The sequence is a functional homolog of SEQ ID NO 910 in the 20060162006 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MDHVFSMEEILGPFWDLPLPPTPPEQQPLVVTDSVVIDGVVTHGGDGEGGDMLDQIQNTTEWTFERLLEEELLTNTTTVANSSCPALNVDPLVEVDHGTMAPAEVSAVGDPMEYNAILKRKLDEDLMAFKMWRASTSGVNSEGSNNENGGGSKNLVQNKLNSADPTNNHAQNADLRVRFATSSSSRDPSPSDEDMDGEVEILGFKMPTEERVRKRKESNRESARRSRYRKAAHLKDLEDQVEKLKAENSCLLRRLAAMNRKYNEANVDNRVLKADMETLRAKVKMGEDSLKRVIEMSSLTSIPIPELPSSSDVPVPIHEEIVNYFTTTPADDALADNSFMPMPEPLALQLQAEEPTINGALNATEMNQIATHCAAGSQPSMELIQETMGAMMPTSPGSTLQESELLGPNETINMHTY

SEQ ID NO: 863 - DNA, 963 bp, Sorghum bicolor
  misc_feature: Ceres ANNOT ID no. 6011345
  misc_feature: Encodes the peptide sequence at SEQ ID NO 864
atggcgttcgcgctcaaggccgccgccacggggtcggcgtcgttctccgccgcggggccgaggcggggcgccgcctccgccacggggagggtctcgttccggggcgccgcgcccgcggtcgccgtcagggccgcggcggctgccgccgccgctgttgcggaggacaagcgcagcatctccggcaccttcgccgagctcagggagcaggggaagactgccttcgtccccttcatcactgctggtgaccctgacttgtccaccacagcaaaagcactcaagatccttgatgcgtgtggttcggatgtcattgaattgggtgtgccttactctgatccattggctgacggccctgttattcaggcctctgcgacacgcgcgctagcaaagggcaccacatttgaggatgtcatctccatggtaaagggggtcatacctgagctgtcctgccctgtagcacttttcacatattacaacccgattctgaagcgtggcatcccgaagttcatgagtattgttaaagaagctggtgtacatggtcttgtggtaccagatgttcctttggaggagacagatgttctaaggagtgaggctgccaaaaacaacctagagctggtgctactgacaacaccgactacaccaaatgaaagaatggagaaaattgcacaggcttcagaaggatttatttatcttgtaagcactgttggagttactggtacacgtgcgaacgtgagtggcaaggtgcaatctcttcttcaggatatcaagaaggtgacagaaaaacctgtggcggttggctttggtgtgtcgactccagagcatgtccagcagattgcaggatggggcgcagatggtgtgatcgttggtagcgcaatggtgaggctattgggggaagctgcttctccagaagaaggattgaagaagctagaagagttagccaagaacctgaaggctgcattgccatga

SEQ ID NO: 864 - protein, 320 aa, Sorghum bicolor
  misc_feature: Ceres ANNOT ID no. 6011345
  misc_feature (63)..(320): Pfam Id: Trp_syntA Pfam Desc: Tryptophan synthase alpha chain
  misc_feature (26)..(319): NCBI GI: 21593559 NCBI Desc: tryptophan synthase alpha chain [arabidopsis thaliana]
  misc_feature (26)..(319): NCBI GI: 52673242 NCBI Desc: tryptophan synthase, alpha subunit (tsa1) [isatis tinctoria]
  misc_feature (26)..(319): NCBI GI: 7258367 NCBI Desc: tryptophan synthase alpha chain [arabidopsis thaliana]
  misc_feature (26)..(319): NCBI GI: 110740925 NCBI Desc: tryptophan synthase alpha chain [arabidopsis thaliana]
  misc_feature (1)..(320): NCBI GI: 62148960 NCBI Desc: indole synthase [triticum aestivum]
  misc_feature (58)..(319): SWISSPROT Homolog: EC 4.2.1.20 Tryptophan synthase alpha chain
MAFALKAAATGSASFSAAGPRRGAASATGRVSFRGAAPAVAVRAAAAAAAAVAEDKRSISGTFAELREQGKTAFVPFITAGDPDLSTTAKALKILDACGSDVIELGVPYSDPLADGPVIQASATRALAKGTTFEDVISMVKGVIPELSCPVALFTYYNPILKRGIPKFMSIVKEAGVHGLVVPDVPLEETDVLRSEAAKNNLELVLLTTPTTPNERMEKIAQASEGFIYLVSTVGVTGTRANVSGKVQSLLQDIKKVTEKPVAVGFGVSTPEHVQQIAGWGADGVIVGSAMVRLLGEAASPEEGLKKLEELAKNLKAALP

SEQ ID NO: 865 - DNA, 1752 bp, Sorghum bicolor
  misc_feature: Ceres ANNOT ID no. 6011350
  misc_feature: Encodes the peptide sequence at SEQ ID NO 866
atggccgccgccgccgccgccgccagctccctcctgcacgtaccggcggcccgcagggcgtccgccgccgccgcccgctcgccgctctcccaacctcccgcgcccactcctctcttcatccgtctccgcgctcggcgccctcaccgcctgcccctccgcctccgctccacctccccgaccgccgcgtccgacctcaccgcgttccctccgccgagcccgaccgggatcttcgcgtccgacccgcacccgcccatcgacgtggacgccgccacggaggcggagctgcgggagaacgggttccggagcacgcgccgcaccaagctcgtctgcaccgtggggcccgcaacctcgtcgcccgaccagctcgaggcgctcgccgtcggcgggatgaacgtggcccgcctcaacatgtgccacggggacagggagtggcaccgggacgccatccgcgccgtcaggaggctcaatgacgagaagggattcgccgtcgccgtcatgatggacaccgagggcagcgagatccacatgggcgacctcggcggcgcgtcctccgtcaaggcggaggatggagaagtatggacgtttagcgttagatcatttgaattgcctctcccagaacggactattaatgtgaactatgatggatttgctgaagatgtgagagttggtgatgagcttcttgtggatggtggaatggctcggtttgaggtgattgagaagataggaccagatgttaagtgccgttgcacagatcctggtttattgttgccacgtgccaatcttacattctggcgtgacggcagtattgtccgtgagaggaatgctatgcttcctacaatttcatcaaaggattggcttgacatagactttggaattgccgaaggtgttgatttcatcgctgtttcgtttgtcaagtctgcagaagtaattaaacacttgaaaagctacatagctgcaaggggccgtggcagtgatttagcagtcattgcaaaaattgagagcattgactctttaaagaacctggaggagatcatccgagcatcagatggtgccatggtagcgcgaggggatatgggtgcacaggttcccttggagcaggtcccctcaatacaacaaaagatagttcaactgtgcaggcagctcaacaagccagtcattgttgcttctcagcttctcgaatcgatgatagagtatcccacacccaccagggctgaagttgcagatgtttctgaagctgtccgccagcgagctgatgctctaatgctttctggcgagtcagcaatggggaggtacccggataaggctcttagtgttctaaggagtgttagcctaaggattgaaaagtggtggagggaggagaagcgtcatgaggcactggaacttcaaagtgtttcatcttctttctctgacaagatatcagaagagatatgcaactcagcagctaaaatggctaatggcttgggagtagatgccgtttttgttttcacgaagactgggcacatggcctcccttctctcgcggtgccgtcccgactgcccagttttcgccttcacaacctcaacgtctgtcaggagacggctgaacctccagtggggcctgatccccttccgcctcagcttctccgacgacatggagagcaacctgaaccgcaccttctccctgctcaaggccaggggcatgatccaatctggggacctcgtgattgcgctctcagacatgctgcagtccatccaggtgatgaatgtaccctaa

SEQ ID NO: 866 - protein, 583 aa, Sorghum bicolor
  misc_feature: Ceres ANNOT ID no. 6011350
  misc_feature (103)..(456): Pfam Id: PK Pfam Desc: Pyruvate kinase, barrel domain
  misc_feature (473)..(579): Pfam Id: PK_C Pfam Desc: Pyruvate kinase, alpha/beta domain
  misc_feature (41)..(583): NCBI GI: 115470887 NCBI Desc: os07g0181000 [oryza sativa (japonica cultivar-group)]
  misc_feature (25)..(583): NCBI GI: 2497539 NCBI Desc: pyruvate kinase isozyme a, chloroplast precursor
  misc_feature (85)..(583): NCBI GI: 482936 NCBI Desc: pyruvate kinase; plastid isozyme [nicotiana tabacum]
  misc_feature (127)..(583): NCBI GI: 169705 NCBI Desc: atp:pyruvate phosphotransferase
  misc_feature (94)..(574): NCBI GI: 93454897 NCBI Desc: pyruvate kinase [delta proteobacterium mlms-1]
  misc_feature (25)..(583): SWISSPROT Homolog: EC 2.7.1.40 Pyruvate kinase isozyme A, chloroplast precursor
MAAAAAAASSLLHVPAARRASAAAARSPLSQPPAPTPLFIRLRARRPHRLPLRLRSTSPTAASDLTAFPPPSPTGIFASDPHPPIDVDAATEAELRENGFRSTRRTKLVCTVGPATSSPDQLEALAVGGMNVARLNMCHGDREWHRDAIRAVRRLNDEKGFAVAVMMDTEGSEIHMGDLGGASSVKAEDGEVWTFSVRSFELPLPERTINVNYDGFAEDVRVGDELLVDGGMARFEVIEKIGPDVKCRCTDPGLLLPRANLTFWRDGSIVRERNAMLPTISSKDWLDIDFGIAEGVDFIAVSFVKSAEVIKHLKSYIAARGRGSDLAVIAKIESIDSLKNLEEIIRASDGAMVARGDMGAQVPLEQVPSIQQKIVQLCRQLNKPVIVASQLLESMIEYPTPTRAEVADVSEAVRQRADALMLSGESAMGRYPDKALSVLRSVSLRIEKWWREEKRHEALELQSVSSSFSDKISEEICNSAAKMANGLGVDAVFVFTKTGHMASLLSRCRPDCPVFAFTTSTSVRRRLNLQWGLIPFRLSFSDDMESNLNRTFSLLKARGMIQSGDLVIALSDMLQSIQVMNVP

SEQ ID NO: 867 - DNA, 2118 bp, Sorghum bicolor
  misc_feature: Ceres ANNOT ID no. 6011351
  misc_feature: Encodes the peptide sequence at SEQ ID NO 868
atgggaagaaaagacacctcatcctcctccgcggccgccggcggcgggaaaaaggacaaacctatgtcagtatccgccatgctcgcctccatggacgcccccgcagcgaagcccaacaagtcgtccaagtcggcggcgccgtccaaggccaaggcgaagccctccaaggcgccggcgtcgtcctacatgggcgacatcgacctgcccccttccgacgacgaggacgaggaggaggccgcccagcgcgccgcagccaagcccaaggcggcccgcgccgcagtggtcgacctcagcgccggcgccgcgccgtcgcagaaggacgccaagaagaaggacaagcgcgaggccgccaggcaggaggcgctccgcgacgaccgcgacgccttctccgtcgtcatcggcgcgcgcgtcaccggcgacgacggcggcggcggcgtcgacgacaacgtcagggacatcgtgctcgagaacttctccgtctccgcgggcgggaaggagctgctcaagagcgcctccctccggatctcgcacggccgcaggtacggcctcgtcggccccaacggcatgggcaagtccacgctgctcaagctcatggcatggcgccaggtccccgtgccacggaacatcgatgtcctgctcgtcgagcaggagatcatcggtgacgaccgctcggcccttgaggctgtggttgccgctgatgaggagctcaccgccctccgggccgagcaggcgaggcttgaggcctctaatgatgctgatgataacgagcggctcgtggaggtctatgagaagctgaatctccgggactctgatgctgcccgggccagagcgtccaagattcttgcggggctggggttcgatcaggcgatgcaggctagatccacaaagtccttcagtggtggatggaggatgcgtatttcgcttgcccgtgcgctcttcatgcagccaacgctgctgctcctcgatgagccgactaaccacctggatctaagagctgtgctatggctggaggaatacttgtgctcgcagtggaagaagacattgattgttgtgtcccatgaccgtgactttctgaatacagtgtgcaatgagatcatacacttgcatgataaaagtcttcatgtctatcgtggaaactttgatgattttgagagtgggtatgagcagaagaggaaggagatgaacaagaagtttgtgatgtatgaaaagcagatgaaagcagccaggaagtctgggagcaaggccgcgcaggataaggttaagggccaggcgctgtcaaaggctgctaaagaggccgccaagaacaaggggaaggggaagagtgctgcagatgacgacgatgaccagaaacaggtggctgtgccacagaagtggcgtgactacagtgttgaattccatttcccagagcctacagagctcacaccacctctccttcagctcattgaggtagggttcagttaccctggtaggccagacttcaagctctcaggtgttgatgttggcattgatatgggaacacgtgtagctattgttgggccgaatggagctggaaagtctactctgcttaatttacttgctggtgatcttaccccaactgaaggggaggtaaggaggagccagaagctgagaattggacgatactcacagcattttgttgacttattgacaatggaggaaaatccagttcaatatttgttgaggcttcacccagatcaggagggaatgagcaaagcagagactgtccgtgctaagcttgggaagtttgggttacctggacacaaccatctgactccaattgttaaattatctggtgggcagaaggcccgagttgtgttcacttctatatcaatgtctcaacctcacatactcctgcttgacgagccaacgaatcacttggacatgcaaagtattgatgcattggcagacgcactggacgaattcactggaggtgtcgtcttggttagccacgactcacggttaatatctcgtgtttgtgaggatgagcaaaggagtgagatatgggttgtggaggatgggactgtgaatagatatgacggcacatttgaggattacaaggatgaactcatggaagaaataaagaaggaagttgaagaataa

SEQ ID NO: 868 - protein, 705 aa, Sorghum bicolor
  misc_feature: Ceres ANNOT ID no. 6011351
  misc_feature (178)..(371): Pfam Id: ABC_tran Pfam Desc: ABC transporter
  misc_feature (505)..(679): Pfam Id: ABC_tran Pfam Desc: ABC transporter
  misc_feature (1)..(705): NCBI GI: 140047296 NCBI Desc: aaa atpase [medicago truncatula]
  misc_feature (8)..(705): NCBI GI: 31711756 NCBI Desc: at3g54540 [arabidopsis thaliana]
  misc_feature (7)..(705): NCBI GI: 52207936 NCBI Desc: abc transporter [populus tremula x populus tremuloides]
  misc_feature (63)..(415): NCBI GI: 38346402 NCBI Desc: osjnba0011f23.8 [oryza sativa (japonica cultivar-group)]
  misc_feature (455)..(703): NCBI GI: 116310849 NCBI Desc: osigba0132e09-osigba0108l24.5 [oryza sativa (indica cultivar-group)]
MGRKDTSSSSAAAGGGKKDKPMSVSAMLASMDAPAAKPNKSSKSAAPSKAKAKPSKAPASSYMGDIDLPPSDDEDEEEAAQRAAAKPKAARAAVVDLSAGAAPSQKDAKKKDKREAARQEALRDDRDAFSVVIGARVTGDDGGGGVDDNVRDIVLENFSVSAGGKELLKSASLRISHGRRYGLVGPNGMGKSTLLKLMAWRQVPVPRNIDVLLVEQEIIGDDRSALEAVVAADEELTALRAEQARLEASNDADDNERLVEVYEKLNLRDSDAARARASKILAGLGFDQAMQARSTKSFSGGWRMRISLARALFMQPTLLLLDEPTNHLDLRAVLWLEEYLCSQWKKTLIVVSHDRDFLNTVCNEIIHLHDKSLHVYRGNFDDFESGYEQKRKEMNKKFVMYEKQMKAARKSGSKAAQDKVKGQALSKAAKEAAKNKGKGKSAADDDDDQKQVAVPQKWRDYSVEFHFPEPTELTPPLLQLIEVGFSYPGRPDFKLSGVDVGIDMGTRVAIVGPNGAGKSTLLNLLAGDLTPTEGEVRRSQKLRIGRYSQHFVDLLTMEENPVQYLLRLHPDQEGMSKAETVRAKLGKFGLPGHNHLTPIVKLSGGQKARVVFTSISMSQPHILLLDEPTNHLDMQSIDALADALDEFTGGVVLVSHDSRLISRVCEDEQRSEIWVVEDGTVNRYDGTFEDYKDELMEEIKKEVEE

SEQ ID NO: 869 - DNA, 1215 bp, Sorghum bicolor
  misc_feature: Ceres ANNOT ID no. 6011361
  misc_feature: Encodes the peptide sequence at SEQ ID NO 870
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to salicylic acid treatment
atggtcgccttcagccgccccctcgtgaccgtgaaggccctggagggcgacatggtgaccgacgctcccggcatcgccctaccgcccgtcttcggggcgccgatccgccccgacgtggtccgcttcgcccacaagctgctgtcctgcaacaagcgccagccctacgccgtctcccgccgcgccggccaccagacgtcggccgagtcctggggtacgggccgcgccgtgtcccgtatcccccgcgtcccgggaggcggcacccaccgcgccggccagggagccttcggcaacatgtgccgcggcggccgcatgttcgcgcccaccaagatctggcgcaagtggcaccaccgcgtcaacatcaacctccgccgcgtcgccgtcgcctccgcgctcgccgccaccgccgtcccggccctcgtccaggcgcgcggccaccgcatcgagaccgtcccagagatgcccctggtcatctccgactcggcggagtccatcgagaagacctcccaggcgctcaagatcctcaagcagatcggcgcctacgccgacgccgagaaggccaaggactccgtcgccatccgccccggcaaggggaagatgcgcaaccgccgctacatcaaccgcaagggcccgctcatcgtctatggcaccgagggctccaaggtcgtcaaggccttccgcaacctccccggtgtggatgtcgccaacgtcgagcgcctcaacctgctcgacctcgcccctggtggccacctcgggcgctttgtgatctggaccgagagcgcgttcaagaagctagaggaggtttatgggagctttgacgcgccctccctgaagaagaagggcttcgttctgccgaggcccaagatgaccaacgctgacctgggcaggatcatcaactctgacgaggtgcagtctgtggtgaagccactcaacaaggaggtgaagcgcagggagaagaggaagaaccctctcaagaacatggctgctgtgctcaagctcaacccctacctcggcactgcccggaagatggccacccttgctgaggctgcccgtgtcaaggcccggaaggagaagctcgactccaagaggaccaagcttagcccggaggaggctgccaaggtcaaggctgcgggcaaggcatggtacaagaccatgatctcagacagtgactacactgagtttgagaacttcacaaagtggctcggtgtgacgcagtga

SEQ ID NO: 870 - protein, 404 aa, Sorghum bicolor
  misc_feature: Ceres ANNOT ID no. 6011361
  misc_feature (23)..(267): Pfam Id: Ribosomal_L4 Pfam Desc: Ribosomal protein L4/L1 family
  misc_feature (3)..(404): NCBI GI: 79313167 NCBI Desc: structural constituent of ribosome [arabidopsis thaliana]
  misc_feature (3)..(404): NCBI GI: 4887131 NCBI Desc: 60s ribosomal protein l1 [prunus armeniaca]
  misc_feature (3)..(404): NCBI GI: 21593543 NCBI Desc: 60s ribosomal protein l4-b (l1) [arabidopsis thaliana]
  misc_feature (3)..(404): NCBI GI: 22530964 NCBI Desc: 60s ribosomal protein-like [arabidopsis thaliana]
  misc_feature (3)..(404): NCBI GI: 92894088 NCBI Desc: ribosomal protein l4/l1e [medicago truncatula]
  misc_feature: The plant is abnormally small.
  misc_feature: Useful for making plants with modulated biomass
  misc_feature: GREAT-hit functional homolog of the protein sequence given in SEQ ID NO 13039
  misc_feature: Useful for making plants with modulated biomass
  misc_feature: Functional homolog of the protein sequence given in SEQ ID NO 13039
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to salicylic acid treatment
MVAFSRPLVTVKALEGDMVTDAPGIALPPVFGAPIRPDVVRFAHKLLSCNKRQPYAVSRRAGHQTSAESWGTGRAVSRIPRVPGGGTHRAGQGAFGNMCRGGRMFAPTKIWRKWHHRVNINLRRVAVASALAATAVPALVQARGHRIETVPEMPLVISDSAESIEKTSQALKILKQIGAYADAEKAKDSVAIRPGKGKMRNRRYINRKGPLIVYGTEGSKVVKAFRNLPGVDVANVERLNLLDLAPGGHLGRFVIWTESAFKKLEEVYGSFDAPSLKKKGFVLPRPKMTNADLGRIINSDEVQSVVKPLNKEVKRREKRKNPLKNMAAVLKLNPYLGTARKMATLAEAARVKARKEKLDSKRTKLSPEEAAKVKAAGKAWYKTMISDSDYTEFENFTKWLGVTQ

SEQ ID NO: 871 - DNA, 1779 bp, Sorghum bicolor
  misc_feature: Ceres ANNOT ID no. 6011363
  misc_feature: Encodes the peptide sequence at SEQ ID NO 872
atgagggttcttgtggagaagctgctactctcgttgtttttggtagcattctatcaagggtgcatggtcttgtctgtagaatatgatcacacggcaagcatcgagtgccttggcgacccaatgaaacccttgtacaagggcggcattgtccagaacagcgagttcaacagcggactgatggggtggtcgacgtaccggaacatgaaggctggcgtgagcagctcggcgtccggcaacaagtttgcagtggtgcatggggcgggaagctccgccgtggccagcagtggcaagctcctaccgtcccacagcgtctaccagagagtccagatgcagggcgacaggcactactcgctatcagcatggttacaggtgtcgtcgtcgaatggcacgacgtcgtcggcccatgtgagggcgatcatcaagtcccctaacggcgagcgcgtcatcgctggtgccatcgatgccaagtccggctgctggagcatgctcaagggaggcatgacctctgactcttcgggacacgcagagatctacttcgagagccacgcagctgtggacatctgggtggacagcgtgtcactgcagcccttcaccttcgacgagtgggacgcccacgcccggcgctccgccgccaagtcccgtcggcgaaccgtgaaggtggtggtcgccatgggcgccgccgacggcaagccgatcgcgcacgccaacgtgagcatcgagctcctccgcatgggtttcccgttcggcaacgcggccaccaaggagatcaccgagctccccgcgtacgagaagtggttcacctcgcgcttcaccgtggccaccttcgagaacgagatgaagtggtacagcacggagtggacgcagaaccacgaggactacggcgtcgccgacaagatgctgagcctgatgcagcggcacggcatcaaggtccgcggccacaacgtgttctgggacgaccagaactcgcagatgaagtgggtgatgccgctcagccttgcccagctcaaggcggccatccagaagcgcctcaagtccgtcgtctcccgctacgccggcaaggtgatccactgggacgtcgtcaacgagaacctccacttcaacttcttcgagaccaagctaggccccggcgcgtcggcgcagatcttccagcaggtggggcagctggaccgcaacccgatcctcttcatgaacgagttcaacacgctggagcagcccggcgaccccaacccaacgccggccaagtacgtggcgaagatgacacagatccggagctaccccggcaatggcggactgaagctcggcgtcggactggagagccacttcagcacgccgaacatcccgtacatgaggagctcgctggacacgctggcgaagctcaagctgccgatgtggctcaccgaggtggatgtcgtcaagggacccaaccaggtgaagaacctggagcaggtgctcagggaagggtacggacaccccggcgtcaatggcatcgtcatgtgggcggcgtggcacgccaagggctgctacgtcatgtgcctcacggacaacagcttcaagaacctccccgtcggcgacgtcgtcgacaagctcatcgcggagtggaagacgcaccgcgcgtccgccaccaccgaccgcgatggggcggtggagctcgatctgcccctaggcgagtataagttcaccgtaagacacccgtcgctgaaagctgctgcggttcaaaccgtgaccgtcgacgacacttcgtcgtcggcgtcggagttcaccatcaacgtcaagtcctag

SEQ ID NO: 872 - protein, 592 aa, Sorghum bicolor
  misc_feature: Ceres ANNOT ID no. 6011363
  misc_feature (237)..(530): Pfam Id: Glyco_hydro_10 Pfam Desc: Glycosyl hydrolase family 10
  misc_feature (47)..(197): Pfam Id: CBM_4_9 Pfam Desc: Carbohydrate binding domain
  misc_feature (224)..(521): NCBI GI: 7920155 NCBI Desc: tapetum-specific endoxylanase [zea mays]
  misc_feature (51)..(565): NCBI GI: 23429644 NCBI Desc: endoxylanase [carica papaya]
  misc_feature (100)..(585): NCBI GI: 42567365 NCBI Desc: glycosyl hydrolase family 10 protein [arabidopsis thaliana]
  misc_feature (276)..(591): NCBI GI: 27451976 NCBI Desc: anther endoxylanase [hordeum vulgare subsp. vulgare]
  misc_feature (162)..(373): NCBI GI: 22329142 NCBI Desc: glycosyl hydrolase family 10 protein [arabidopsis thaliana]
MRVLVEKLLLSLFLVAFYQGCMVLSVEYDHTASIECLGDPMKPLYKGGIVQNSEFNSGLMGWSTYRNMKAGVSSSASGNKFAVVHGAGSSAVASSGKLLPSHSVYQRVQMQGDRHYSLSAWLQVSSSNGTTSSAHVRAIIKSPNGERVIAGAIDAKSGCWSMLKGGMTSDSSGHAEIYFESHAAVDIWVDSVSLQPFTFDEWDAHARRSAAKSRRRTVKVVVAMGAADGKPIAHANVSIELLRMGFPFGNAATKEITELPAYEKWFTSRFTVATFENEMKWYSTEWTQNHEDYGVADKMLSLMQRHGIKVRGHNVFWDDQNSQMKWVMPLSLAQLKAAIQKRLKSVVSRYAGKVIHWDVVNENLHFNFFETKLGPGASAQIFQQVGQLDRNPILFMNEFNTLEQPGDPNPTPAKYVAKMTQIRSYPGNGGLKLGVGLESHFSTPNIPYMRSSLDTLAKLKLPMWLTEVDVVKGPNQVKNLEQVLREGYGHPGVNGIVMWAAWHAKGCYVMCLTDNSFKNLPVGDVVDKLIAEWKTHRASATTDRDGAVELDLPLGEYKFTVRHPSLKAAAVQTVTVDDTSSSASEFTINVKS

SEQ ID NO: 873 - DNA, 1107 bp, Sorghum bicolor
  misc_feature: Ceres ANNOT ID no. 6011384
  misc_feature: Encodes the peptide sequence at SEQ ID NO 874
atgatgaagctaaaaagtagacgactgctgttctacaaggatgttgagccagaagactgccattcaggctcaggtcatccacatttgaccgctcaagccaagtttgcagccatgaacatgcagactgaagatgtcaagactcgtcgaccagttcaagtcaaacgaagtagatgggttcttggtgatgttaccgaggtgttggatcataattcttggagacttgggaagattacagaagtgctgaagaatgactgttttgtcatcaggctagcaggttgcatccaaccaagagaattccacatatcttgcttgaggattccacatgatagcaagcagttgactgtaggagacagggtcattgaactgaataaaccaatccgatttgctgactgctcctctcatcactcaaaatttgtgatggaacaggaccatcaagcctatgaagaggttgatcactatgctaagaggaaagcagccaatatttgtgcttccactggtgctagagctgtcaagagaaaactagaagcaagtaggattccacctaatgatttagttagaagaacaggcaaggaacggaaagtagctgcatatgaatttcgtcagttaaccaagaatgagttgcctctgaaggtgtctgctaggaatgccatcgatggagatcactttcataggtctttaagtagcagatacaatgatcttaccaagaacatttctgatataaaaccagtttgcaaatttcttcctttgtctgagaaacctttgcgcgtcagagaagagaatgagtgctcagtggctagttgcagcgcaaattattcagagtacagtaccagtgataaccaacaatcagttggaatcggcaatagtttccctgatgatgttatgtctgcatgtcaatctgggcaggagattaagaacacctatggctctggtttatttctgaatgtccatgagctggagctgcaagcataccaatccactgtcagagctttccatgctgcaggacccctgacatgggagcaagagacactactgacaaacctgcgcctctcgctcaacatctcaaatgaggagcacttgcttcagttgaggcatctcttatctatttga

SEQ ID NO: 874 - protein, 368 aa, Sorghum bicolor
  misc_feature: Ceres ANNOT ID no. 6011384
  misc_feature (50)..(367): NCBI GI: 92895175 NCBI Desc: agenet [medicago truncatula]
  misc_feature (155)..(367): NCBI GI: 50725037 NCBI Desc: agenet domain-containing protein-like [oryza sativa (japonica cultivar-group)]
  misc_feature (315)..(367): NCBI GI: 92869047 NCBI Desc: agenet [medicago truncatula]
  misc_feature (307)..(358): NCBI GI: 140060504 NCBI Desc: ent [medicago truncatula]
MMKLKSRRLLFYKDVEPEDCHSGSGHPHLTAQAKFAAMNMQTEDVKTRRPVQVKRSRWVLGDVTEVLDHNSWRLGKITEVLKNDCFVIRLAGCIQPREFHISCLRIPHDSKQLTVGDRVIELNKPIRFADCSSHHSKFVMEQDHQAYEEVDHYAKRKAANICASTGARAVKRKLEASRIPPNDLVRRTGKERKVAAYEFRQLTKNELPLKVSARNAIDGDHFHRSLSSRYNDLTKNISDIKPVCKFLPLSEKPLRVREENECSVASCSANYSEYSTSDNQQSVGIGNSFPDDVMSACQSGQEIKNTYGSGLFLNVHELELQAYQSTVRAFHAAGPLTWEQETLLTNLRLSLNISNEEHLLQLRHLLSI

SEQ ID NO: 875 - DNA, 2667 bp, Sorghum bicolor
  misc_feature: Ceres ANNOT ID no. 6011402
  misc_feature: Encodes the peptide sequence at SEQ ID NO 876
atgaggagcagcttcctgtcggagtcgccgtgcgacgagcagcacatccatggatatggtttcaacccgcagtcgtggctgcaggtggagcgagggaagctgcccaagtcgtcctactcgccttcctccattgagtcactcatcaagattgctgagccgcctgtagtgccattgtataagcctttggattatgttgaggtgctgtcaaggatccatgaggagcttgaacaatgtaggcggagcgagcggccagggctgtatttggtccagtcccaggtgtttcggggccttggggaggcaaaattgcgccagaggagcctccactctgcctggcgctgtgcaaacacagtccatgagaaagtcatatttggggcatggctgcggtatgagaagcggggggaggagatcatatctgacgtccttgcatcatgtcagaagtgttgtcgagagtttggtccacttgatgttgcttccgagatgcctgtgcgaaactttgaggtaattggttcatgggagacaggctcctcgtctcaactttctgccatggtaaccttccaaatacaggatggtagggtgacatgtgataggtgcaagattgcgtctttgtcgataccattttgctccatgcttaatggaccgttcactgagtcacagcttgagcttgtcgatttgtcagagaatggtatttctttggagggcatgagagctgttgctgagtttagttctacatgtagtttaggggatctgcctgtggaaatcttattggagatcctggtctttgcaaacacattttgttgtgacagtctaaaagatgcctgtgataggaaactggcttcatttgtttcttcaaggcaggatgctgttgagctcatgacgttggcatttgaagaaaatgcaccaattcttgctgcttcttgcttgcagttgcttttacaggaacttcctgattgtctagctgacgatctagtaattagcctcttcttaggtgcaactgcacagcaacaacttatcatggttgggcaggcatcctttttgttgtattgcttgcttagtgaagtagcaatgaacattgatccgaggacagaaacaactgtattcttgtcagagaagcttgttcagctagcagttacccctactcagaagcaaatagcttttcatcaacttggatgcgttagacttttgagaaaggaatatagtgaagctgaacgtggatttgaggttgccttctctgccggtcatgtgtattcaattgctggtattgctagaatcgctggcatacaaggccaaaaggctttggcttatgagaagctcagttcagtcataacatcaaatttgccactggggtggatgtatctggagaggtcgttgtattctgaaggtgatagaaagctggcagatcttgacaaagcaagcgagctggatcctactctcacttacccttacatgtatcgagctgcatccttgatgagaaagaaagatgctaaacttgccttagaggaaattaaccggctcttgggcttcaagttagcattggagtgcctggagctacggatctgtctatacttggctcttgaagactataagtctgccatctgtgatatccatgcgattcttactctttcacctgattatcggatgttggaaggacgtgtagctgcttccaaaataggcactcttctcggtgcgcatgtcgagcagtggaatacagctgagtgttggctacaactttatgagcgctggtcatcagtggatgatattggttccctttcagtgatctatcagatgcttgagtcagatgcagcaaaaggtgtcctgtactttaggcaatctttgctgctccttaggttgaactgtcctgaggcagcgatgcgcagtttgcaattggcaaggcatcatgcagcaactgagcatgaacgactagtatatgaggggtggcttttatatgacacggggcactgtgaggaggccctacaaaaggctgaagaatctatttctattcaaagatcatttgaggctttctttctgaaagcctatgttttggctgactcaggagttgatccttcttattccgcgactgttatctcgcttcttgaagatgcattgaaatgtccttcagaccggcttcggaagggtcaggcattgaataaccttggtggtgtctatgttgattgtggaaagttagactcagcagctgattgctatacaagtgcattgaagattcgacacactagagcccatcaaggtcttgctcgtgttcattttctcagaaacaacagggaagctgcatatgaagagatgacaaagttgatagaaaaagctaaaaacaacgcttcggcttatgagaaacgctcagaatattgcgaacgagaacagactatgacagatttgcaaacagtgacccaattagatcctttacgcgtttatccatacagatatcgagcagcagtgctgatggatagccacaaggagaacgatgcaatagcggagctcagccgtgcgatatccttcaaagccgacctgcacttgctgcatctccgggcggctttccatgagcacatcggggatgtaccaagcgctctccgtgattgtagagccgccctctccttggacccaaatcaccaggagatgttggagcttcagaaacgtgtgaacagccaagagccctga

SEQ ID NO: 876 - protein, 888 aa, Sorghum bicolor
  misc_feature: Ceres ANNOT ID no. 6011402
  misc_feature (711)..(744): Pfam Id: TPR_1 Pfam Desc: Tetratricopeptide repeat
  misc_feature (1)..(888): NCBI GI: 70780055 NCBI Desc: ethylene overproducer 1 [lycopersicon esculentum]
  misc_feature (1)..(888): NCBI GI: 78707376 NCBI Desc: ethylene-overproducer1-like protein [lycopersicon esculentum]
  misc_feature (32)..(888): NCBI GI: 115486045 NCBI Desc: os11g0585900 [oryza sativa (japonica cultivar-group)]
  misc_feature (1)..(888): NCBI GI: 92871216 NCBI Desc: btb/poz [medicago truncatula]
  misc_feature (50)..(888): NCBI GI: 46810683 NCBI Desc: ethylene overproducer 1 [arabidopsis thaliana]
MRSSFLSESPCDEQHIHGYGFNPQSWLQVERGKLPKSSYSPSSIESLIKIAEPPVVPLYKPLDYVEVLSRIHEELEQCRRSERPGLYLVQSQVFRGLGEAKLRQRSLHSAWRCANTVHEKVIFGAWLRYEKRGEEIISDVLASCQKCCREFGPLDVASEMPVRNFEVIGSWETGSSSQLSAMVTFQIQDGRVTCDRCKIASLSIPFCSMLNGPFTESQLELVDLSENGISLEGMRAVAEFSSTCSLGDLPVEILLEILVFANTFCCDSLKDACDRKLASFVSSRQDAVELMTLAFEENAPILAASCLQLLLQELPDCLADDLVISLFLGATAQQQLIMVGQASFLLYCLLSEVAMNIDPRTETTVFLSEKLVQLAVTPTQKQIAFHQLGCVRLLRKEYSEAERGFEVAFSAGHVYSIAGIARIAGIQGQKALAYEKLSSVITSNLPLGWMYLERSLYSEGDRKLADLDKASELDPTLTYPYMYRAASLMRKKDAKLALEEINRLLGFKLALECLELRICLYLALEDYKSAICDIHAILTLSPDYRMLEGRVAASKIGTLLGAHVEQWNTAECWLQLYERWSSVDDIGSLSVIYQMLESDAAKGVLYFRQSLLLLRLNCPEAAMRSLQLARHHAATEHERLVYEGWLLYDTGHCEEALQKAEESISIQRSFEAFFLKAYVLADSGVDPSYSATVISLLEDALKCPSDRLRKGQALNNLGGVYVDCGKLDSAADCYTSALKIRHTRAHQGLARVHFLRNNREAAYEEMTKLIEKAKNNASAYEKRSEYCEREQTMTDLQTVTQLDPLRVYPYRYRAAVLMDSHKENDAIAELSRAISFKADLHLLHLRAAFHEHIGDVPSALRDCRAALSLDPNHQEMLELQKRVNSQEP

SEQ ID NO: 877 - DNA, 1584 bp, Sorghum bicolor
  misc_feature: Ceres ANNOT ID no. 6011407
  misc_feature: Encodes the peptide sequence at SEQ ID NO 878
atggagacgaagcgggtggccgtcgtcggggccggcgtcagcggcctcacggtgtgcaagcacctgcaggagctcggctgccggccggtcgtcttcgagggggacaccgtgctgggcggcgtgtgggcgcgcgcgccggcctgcaccgagctccagacgccgcggcccatgtaccagtactccgacttcccgtggccggagaccgtgacggaggtgttcccgacccaccgccaggtggtggcctacctcgaagcgtacgcgcgccatttcggcgtgttcggctgcatccgcttcgcccaccgggtgctcggcatggagtaccacggcggcgtcggcgagcaggccatggccgcgtgggaggagtgggctgggaatggccaggcgttcggctccggcgccggcgagtggcggctgtcggtggtcgacgccgacggccacgttgagacacacaaagcagactttgtcgttctttgcatggggaggttcagtggtgtacccaacatacccacattcccagcaggcaaaggtccagaagtatttgatgggcaggtgatccactccatggactacgccaaaatgggcacaagtaacgctaaggacatgataaggggaaagcgtgtaactgttgtgggctacctgaaatcagcacttgatatcgccgctgaatgtgccgaagtgaatggcactgctcacccatgtacaatggtggtcagaacaaagcactggatcttaccggactactccgcctggggcttccacatctcaaagctctatctcaaccgtttcgctgaactcctcatccacaagcctggcgagggccttctcctgtcaatcttggccacccttctgactcccttgaggtgggccttctccaagtttgccgagagctactactccatcccaatgaagaagcacggcatggtgcctgaccacagcatgttcgacgcttgggctgcgaccacgtttgccatcgcgcccaaggaccactacaagaggctggaagaaggcagcatcgtgctcaagaagtccaagacgtttaccttctgcaaggaaggcgtgatcgtggagggcgagccgtcgtcgccggtgaagagcgacgtggtgatcttcggcaccggcttcaagggcgacgacaagatcaaggacatgttcacttcagagtattttcgaaacattgcagttgggtcagaatccacaactgtgcctctctatagggagtgcatacatcctaagatccctcagcttgctgtgatcggatattccgagagcatagcgaatatctacacgtcggacattcgcgccaagtggttggcgcgcttcttggacggcggcttcacactaccgaacgtcgcggcgatgcagaaggatgtcttggaatgggagaagtacatgaagagatactgtggaagatactttcgccggtccagcatcttgatcctgcacacttggtacaacgaccagctctgccgtgacatggggtgcaatccgaggaggaagaaagggttcttttctgaactgtttgaggtctatggccctggcgattatgccaacctactctccaactcaaagtccaaggagcagtag

SEQ ID NO: 878 - protein, 527 aa, Sorghum bicolor
  misc_feature: Ceres ANNOT ID no. 6011407
  misc_feature (3)..(511): Pfam Id: FMO-like Pfam Desc: Flavin-binding monooxygenase-like
  misc_feature (1)..(518): NCBI GI: 116308895 NCBI Desc: h0515c11.3 [oryza sativa (indica cultivar-group)]
  misc_feature (1)..(518): NCBI GI: 116308896 NCBI Desc: h0515c11.4 [oryza sativa (indica cultivar-group)]
  misc_feature (4)..(522): NCBI GI: 115480525 NCBI Desc: os09g0548700 [oryza sativa (japonica cultivar-group)]
  misc_feature (1)..(518): NCBI GI: 50725113 NCBI Desc: flavin containing monooxygenase 3 -like [oryza sativa (japonica cultivar-group)]
  misc_feature (188)..(518): NCBI GI: 115457346 NCBI Desc: os04g0223900 [oryza sativa (japonica cultivar-group)]
METKRVAVVGAGVSGLTVCKHLQELGCRPVVFEGDTVLGGVWARAPACTELQTPRPMYQYSDFPWPETVTEVFPTHRQVVAYLEAYARHFGVFGCIRFAHRVLGMEYHGGVGEQAMAAWEEWAGNGQAFGSGAGEWRLSVVDADGHVETHKADFVVLCMGRFSGVPNIPTFPAGKGPEVFDGQVIHSMDYAKMGTSNAKDMIRGKRVTVVGYLKSALDIAAECAEVNGTAHPCTMVVRTKHWILPDYSAWGFHISKLYLNRFAELLIHKPGEGLLLSILATLLTPLRWAFSKFAESYYSIPMKKHGMVPDHSMFDAWAATTFAIAPKDHYKRLEEGSIVLKKSKTFTFCKEGVIVEGEPSSPVKSDVVIFGTGFKGDDKIKDMFTSEYFRNIAVGSESTTVPLYRECIHPKIPQLAVIGYSESIANIYTSDIRAKWLARFLDGGFTLPNVAAMQKDVLEWEKYMKRYCGRYFRRSSILILHTWYNDQLCRDMGCNPRRKKGFFSELFEVYGPGDYANLLSNSKSKEQ

SEQ ID NO: 879 - DNA, 1593 bp, Sorghum bicolor
  misc_feature: Ceres ANNOT ID no. 6011409
  misc_feature: Encodes the peptide sequence at SEQ ID NO 880
atggagaagaagcgggtggtcatcgtcggagccggcgtcagcggcctcacggtgtgcaagcacctgctggagctcggctgccggccggtcgtcttcgagggggacaccgtgctgggcggcgtgtgggcgcgcgcgccggcctgcaccgagctccagacgccgcggcccatgtaccagtactccgacttcccgtggccggagaccgtgacggaggtgttcccgaaccaccgccaggtggtggcgtacctcgacgcctacgcgcgccacttcggcgtgctggggtgcatccgcttcgcccaccgggtggtcggcatggagtaccacggcggcggcggcggcggcgtcagcgagcaggacatggacgcgtgcgaggagtgggctgggaacggccaggcgttcggctccggcgccggcgagtggcggttgtcggtggctgacgccgacggccacgttgagacacacaaagcagacttcgtcgttctatgcatgggaaggttcagtggtattcccaacatacctacattcccagcaggcaaaggtccagaagtatttgatgggcaggtgattcactccatggactatgccaaaatgggcgcaagtaaagctaaggagatgatcaggggcaagcgtgtaactgttgttggctacctgaaatcagcacttgatattgccgctgaatgcgccgaagtaaatggcactgctcacccatgtacaatggtggtcagaacaaagcactggatcttaccggactacttcgcctggggcttccacatctcaaagctctatctcaaccgtttctctgaactcctcattcacaagcctggcgaaggccttctgttgtcaattttggccacccttctgactccgttgaggtcggtgttctccaagttcgccgagagctactactccattccgatgaagaagcacgacatggtacctgaccacagcctgttcgaggcgttggctgcagccaccatcgccatcacgcccaaggaccactacaagcggctggacgaaggcagcatcgtgctcaagaagtccaagacgttcagcttctgcaaggaaggcgtggtcgtggagggtgagacgtcgccggtgaagagcgacgtggtgatcttcggcaccggcttcaagggcgacgacaaaatcaagaacatgttcacttcagagtattttcgaaacattgcagttgggtcagaatccactactgtgcctctctacagggagtgcatacatcctaagatccctcagctggccgtgatcggatattccgagagcattgcgaacatgtacacctcggacattcgcgccaagtggttggcgcgcttcttggacggcggcttcagactaccaaacgtcgcggcgatgcagaaggatgtcttggaatgggagaagtacatgaagagatactctggaagatactttcgccggtccagcattctaatcctgcacacttggtacaacgaccagctctgccgtgacatggggtgcaacccgaggaggaagaaagggttcttttctgaactgtttgaggtctatggccctggcgattatgccaacctactctccaactcaaagtccaaggagcagtag

SEQ ID NO: 880 - protein, 530 aa, Sorghum bicolor
  misc_feature: Ceres ANNOT ID no. 6011409
  misc_feature (3)..(514): Pfam Id: FMO-like Pfam Desc: Flavin-binding monooxygenase-like
  misc_feature (1)..(521): NCBI GI: 116308895 NCBI Desc: h0515c11.3 [oryza sativa (indica cultivar-group)]
  misc_feature (1)..(521): NCBI GI: 116308896 NCBI Desc: h0515c11.4 [oryza sativa (indica cultivar-group)]
  misc_feature (3)..(525): NCBI GI: 115480525 NCBI Desc: os09g0548700 [oryza sativa (japonica cultivar-group)]
  misc_feature (1)..(521): NCBI GI: 50725113 NCBI Desc: flavin containing monooxygenase 3 -like [oryza sativa (japonica cultivar-group)]
  misc_feature (192)..(521): NCBI GI: 115457346 NCBI Desc: os04g0223900 [oryza sativa (japonica cultivar-group)]
MEKKRVVIVGAGVSGLTVCKHLLELGCRPVVFEGDTVLGGVWARAPACTELQTPRPMYQYSDFPWPETVTEVFPNHRQVVAYLDAYARHFGVLGCIRFAHRVVGMEYHGGGGGGVSEQDMDACEEWAGNGQAFGSGAGEWRLSVADADGHVETHKADFVVLCMGRFSGIPNIPTFPAGKGPEVFDGQVIHSMDYAKMGASKAKEMIRGKRVTVVGYLKSALDIAAECAEVNGTAHPCTMVVRTKHWILPDYFAWGFHISKLYLNRFSELLIHKPGEGLLLSILATLLTPLRSVFSKFAESYYSIPMKKHDMVPDHSLFEALAAATIAITPKDHYKRLDEGSIVLKKSKTFSFCKEGVVVEGETSPVKSDVVIFGTGFKGDDKIKNMFTSEYFRNIAVGSESTTVPLYRECIHPKIPQLAVIGYSESIANMYTSDIRAKWLARFLDGGFRLPNVAAMQKDVLEWEKYMKRYSGRYFRRSSILILHTWYNDQLCRDMGCNPRRKKGFFSELFEVYGPGDYANLLSNSKSKEQ

SEQ ID NO: 881 - DNA, 1710 bp, Sorghum bicolor
  misc_feature: Ceres ANNOT ID no. 6011420
  misc_feature: Encodes the peptide sequence at SEQ ID NO 882
atgacggaagagagcgccaagaagagcaagctttcatggtccaagtccctcgtgaggaagtggttcaacatccggcccaaggcgcaggacttccatgcggatttcgacgccagccaggcaagggatggtggtggtggatcatggaagcccagctgttcctcaagcgaagcaagcgcaagcactgctgccaagaaaagcagaactgaccgatcgtcgtcaaagcggagtgctgaacgcgctcgccgagggaagaataattttgatgcagcacgcctgacagaagtgcaagattacaggatctttgctgcaacgtggaacgtcggtggtaagtcaccaccaagggggctaaatttagatgaatggctccatacttctcctcctgccgatatctatgtcttagggtttcaagagattgtccctttgaatgcgggaaacgttcttggcactgaagataaccttccagccaagaagtgggtgtcccttattaggcggacactgaacaagaatcctggagctagtggttgtggtggctatcatacaccttcaccagtcctggatccagttgtagaactggatgctgattttgaggggtctgcaagaaggcaggagaacttctcattctttcatcgccggtcgttccacaacctcagccgtagtttaagaatggatggggacttcatgttcccacaaccaaggctagatcgcaggtttagcgtttgcgatccagtcaacttaggaggcagaccaagtgattttgatgggaatctgcgctgccctggatcacctgatgaggataacatagatatggaagtgagcgatggtgcacaaatttcaccattccctcatagctacagtgcatctgcaccttctgaacaaaatgatgatcaatcaaacagctctaggtattgcttggttgccagcaaacaaatggttggcatatttctcacagtgtgggtacgcaatgaaataagagatgatgtcagaaacttgaaagtttcttgtgtgggcagaggattgatgggttatcttggaaataagggttcaatttcaataagcatgtctttgcaccagacaagcttctgcttcatatgttgccatttgacatcaggggaaaaggagggggatgaactgcgcaggaattccgatgttctggaaattttaagaaagactagattcccacgggttcgtggtgctggtgatgttaagtcacctgaaacgattcttgatcatgatcggattatatggctaggggatttgaattatcggattgccctatcatattgttcagcaaaggctcttgtggaaatgcataactggaagcaattattggagaaagatcagctgcggatgcaacaaagatatggacgagttttccaaggttggagagaagggaggatctattttcctcccacatacaaatattcattcaactcagatcggtatgctggagagggtaggcaccctaaagagaagaggagaacaccagcatggtgtgatcgcattctctggtatggtaacggcctcaatcagctgtcttatgttcgtggcgagtctcgtttctccgaccacaggccggtgtacagtatcttcctggcagaggttgacattgtacaccaaaggaggagaaacatgggatatttcagctctagaatcgaggtggaagagctcttgccgcattctcagagctatagagaaataaagttttattga

SEQ ID NO: 882 - protein, 569 aa, Sorghum bicolor
  misc_feature: Ceres ANNOT ID no. 6011420
  misc_feature (100)..(530): Pfam Id: Exo_endo_phos Pfam Desc: Endonuclease/Exonuclease/phosphatase family
  misc_feature (1)..(569): NCBI GI: 92883941 NCBI Desc: inositol polyphosphate related phosphatase [medicago truncatula]
  misc_feature (242)..(569): NCBI GI: 47155293 NCBI Desc: inositol 1,4,5-trisphosphate 5-phosphatase [arabidopsis thaliana]
  misc_feature (69)..(566): NCBI GI: 7523406 NCBI Desc: inositol-1, 4, 5-trisphosphate 5-phosphatase-like protein [arabidopsis thaliana]
  misc_feature (39)..(293): NCBI GI: 115450875 NCBI Desc: os03g0160600 [oryza sativa (japonica cultivar-group)]
  misc_feature (190)..(569): NCBI GI: 15220522 NCBI Desc: endonuclease/exonuclease/phosphatase family protein [arabidopsis thaliana]
  misc_feature (190)..(569): SWISSPROT Homolog: EC 3.1.3.56 Type I inositol-1,4,5-trisphosphate 5-phosphatase CVP2
MTEESAKKSKLSWSKSLVRKWFNIRPKAQDFHADFDASQARDGGGGSWKPSCSSSEASASTAAKKSRTDRSSSKRSAERARRGKNNFDAARLTEVQDYRIFAATWNVGGKSPPRGLNLDEWLHTSPPADIYVLGFQEIVPLNAGNVLGTEDNLPAKKWVSLIRRTLNKNPGASGCGGYHTPSPVLDPVVELDADFEGSARRQENFSFFHRRSFHNLSRSLRMDGDFMFPQPRLDRRFSVCDPVNLGGRPSDFDGNLRCPGSPDEDNIDMEVSDGAQISPFPHSYSASAPSEQNDDQSNSSRYCLVASKQMVGIFLTVWVRNEIRDDVRNLKVSCVGRGLMGYLGNKGSISISMSLHQTSFCFICCHLTSGEKEGDELRRNSDVLEILRKTRFPRVRGAGDVKSPETILDHDRIIWLGDLNYRIALSYCSAKALVEMHNWKQLLEKDQLRMQQRYGRVFQGWREGRIYFPPTYKYSFNSDRYAGEGRHPKEKRRTPAWCDRILWYGNGLNQLSYVRGESRFSDHRPVYSIFLAEVDIVHQRRRNMGYFSSRIEVEELLPHSQSYREIKFY

SEQ ID NO: 883 - DNA, 759 bp, Sorghum bicolor
  misc_feature: Ceres ANNOT ID no. 6011425
  misc_feature: Encodes the peptide sequence at SEQ ID NO 884
atgctgcgcacccatctgccgcctgaggcttggcggcggccgctgccccaggaggcaggaggagcccgagatcaaagtccgcgcatttccttccaccgagccgcgacgagatccaggatcccaggtgggaaacttcgatgcggcggccttgaaccgcgatggctgtcctcgtcgcggagttcgtcctcagattcaaagccgtggactagaatgtgcacgaaggcagactataccactcctgttgattctgttgccacctcggagcaaacaggtggtgaaactgaagccacctcggagcaaacaggtggcaaaactgaagagccagccattgtagcacctgctaatgaatatacagtgcaggaggctgctcctcaacagaagtgtgcaaagatacacgacttttgcctagggataccttttggtggatttttattctccatgggccttattggatatctattttggaggagccctgcaagtcttacttttggtgttgcacctggccttgctatattggctctggctgtacttagccttaacgtctggaggagtggaaagtccagtttaccgttcatactggcgcaagcaggcattgccgctgcggtagcctggaagcacagccaggcatacaccactactaggaagctgcttccgtggggcttctatgttgcgctgagtgctgcaatgatatgcttctactcctatgttgttcttgctggagggaatccacctcctaagaaggcaaaggctgctgcttga

SEQ ID NO: 884 - protein, 252 aa, Sorghum bicolor
  misc_feature: Ceres ANNOT ID no. 6011425
  misc_feature (134)..(237): Pfam Id: TMEM14 Pfam Desc: Transmembrane proteins 14C
  misc_feature (121)..(251): NCBI GI: 38344745 NCBI Desc: osjnba0089k21.3 [oryza sativa (japonica cultivar-group)]
  misc_feature (121)..(251): NCBI GI: 116310019 NCBI Desc: osigba0124n08.6 [oryza sativa (indica cultivar-group)]
  misc_feature (86)..(247): NCBI GI: 1143711 NCBI Desc: non-green plastid inner envelope membrane protein precursor
MLRTHLPPEAWRRPLPQEAGGARDQSPRISFHRAATRSRIPGGKLRCGGLEPRWLSSSRSSSSDSKPWTRMCTKADYTTPVDSVATSEQTGGETEATSEQTGGKTEEPAIVAPANEYTVQEAAPQQKCAKIHDFCLGIPFGGFLFSMGLIGYLFWRSPASLTFGVAPGLAILALAVLSLNVWRSGKSSLPFILAQAGIAAAVAWKHSQAYTTTRKLLPWGFYVALSAAMICFYSYVVLAGGNPPPKKAKAAA

SEQ ID NO: 885 - DNA, 528 bp, Sorghum bicolor
  misc_feature: Ceres ANNOT ID no. 6011426
  misc_feature: Encodes the peptide sequence at SEQ ID NO 886
atgctcaccttggccgcggcggcggcgatgctgcagctgctggcctcggcgccggcgccggcgtccgggcagcccggccccggcgtcgtcgtgggcgcggtgtcgtgcacgacgtcgctggtcaccagcttcacgccgtgcctcaacttcatcaccaacggcagcgcgtccccgaccgacgactgctgccggtccctgggcgcgctgacgaaggcgagcgccggctgcgcctgcctcatcctcaccggcagcgtgcccctcggcgtgcccgtcaaccggacgctcgccgtcacgctgcccagggcgtgcaactccacctctctccagctgcaatgccgagcgccggagcctgaagcgccggcgacagctccacctgcggaacccacggccacggcgacgccaccgatcagccaggtacagacgaagccggcggttgtgcccagcgccgccgggagagcaagctcggacgtgccagcgacggctaggtttggactgctgcttgcaattggagctgcgctgatggcctga

SEQ ID NO: 886 - protein, 175 aa, Sorghum bicolor
  misc_feature: Ceres ANNOT ID no. 6011426
  misc_feature (5)..(175): NCBI GI: 115455869 NCBI Desc: os03g0793900 [oryza sativa (japonica cultivar-group)]
  misc_feature (6)..(160): NCBI GI: 115470831 NCBI Desc: os07g0175500 [oryza sativa (japonica cultivar-group)]
  misc_feature (7)..(130): NCBI GI: 8778716 NCBI Desc: t25n20.10 [arabidopsis thaliana]
  misc_feature (7)..(150): NCBI GI: 42571345 NCBI Desc: protease inhibitor/seed storage/lipid transfer protein (ltp)-related [arabidopsis thaliana]
  misc_feature (29)..(148): NCBI GI: 92883938 NCBI Desc: plant lipid transfer/seed storage/trypsin-alpha amylase inhibitor [medicago truncatula]
MLTLAAAAAMLQLLASAPAPASGQPGPGVVVGAVSCTTSLVTSFTPCLNFITNGSASPTDDCCRSLGALTKASAGCACLILTGSVPLGVPVNRTLAVTLPRACNSTSLQLQCRAPEPEAPATAPPAEPTATATPPISQVQTKPAVVPSAAGRASSDVPATARFGLLLAIGAALMA

SEQ ID NO: 887 - DNA, 2712 bp, Sorghum bicolor
  misc_feature: Ceres ANNOT ID no. 6011433
  misc_feature: Encodes the peptide sequence at SEQ ID NO 888
atgccgttgtgtcgcggcggcggtggcgccgccgggggcggcagcagctcgggtgggctggcggccgggagaaccagcaaccggtacagcacctcgatcggcgcgctcctgccggcgcgcggcggcgggtggcgtccccgtctccgtctccggcggttcatcgtgtccccctacgacccgcggtacctggcgtgggagcactcgctggtggtgctggtggcgtactgcgcgtgggtggcgcccttcgagttcgggttcgtcccggacccgcacggcgcgctggccatcgccgacaacgccgtgaacgccgcgttcgccgtcgacatcgcgctcaccttcttcgtggcgtacgcggacggccggacgtacctgctccaggacgacccccgccggatcgcgtggcggtacgccagcacctggctcgccctcgacgtcgcctccaccgtgcccatcgacgtctaccgccggatcctgccgccgcaggccagcggctacaacttcttcggcatgctccggctatggcgcctccaccgcgtcggcaccttcttcacacggaagctgagctacttctgggtgcgatgcataaggctcatctgcgtgacgctgttcgcggtgcacagcgcggggtgcttctactacctgctggcggacaggtaccatgacgcggaccacacgtggctgagctcctccatgccggacttcaagcaggagagcgtgtggaagcggtacgcggcgtccatgtactggtccatcaccacgctcaccaccgtcggctacggcgacatgcacgccgtcaacacgggcgagatggtgttcaccacgctctacatgctcttcaacctcggcctcaccgcctacctcatcggcaacatgaccaacctcgtcgtccacggcaccagccgcaccaggaaatacagggacgcgatcaaggcggcgacgagcttcgcggtgcggcaccagctgccggcgaggctgcaggagcagatggtctcccacctgagcctcaagttcaggaccgactcggaggggctgcagcagcaggagacgctggacgcgctgcccaaggccatccgctccggcatctcccaccacctcttcttcgccctcgtccagggcgtctacctcttccagggcgtctccaacgacctcatcttccagctggtctctgagatgaacgccgagtacttcgcgcccagggaggatgtcatcctgcagaacgaggcgccgtcggacttctacgtcctagtcactggtagtgtgctggctgggatggccagggctggcgacgtcgtcggcgagatcggggtgctgtgctacaagccccagctcttcacggcgaggacacgcacactgtgccagctcctgcgcatggaacggaccgcgttcctcaggatcgtccaggcaaacgttggggacggcaccataatcatcaacaaccttatccagtacctcaaggagaagagagacagctgcgccatcgccggcgtcgcggaggagatcgagtacatgctagctcggggacagctcgagctccccgtcactctctgctacgccgcgtccaaaggcgacgacttcctgatgcgtcagctgctcaagcgcggtgtcgacccaaatgagtctgataactactggcatacggcactgcacatatcagcttccagcggacatgaccaatgcgtcaagcttctgctagagcatggcgctgatcctaatgccacagacgcgcaaggaagagtgccactgtgggaggccctgtcccggaggcaccgcgcggcggcgcggctgctggtggacgccggcgcggacctgtccgcgggcgacgcggcgctgtacgcgcgcgcggccgtggaggcggacgacgtcgcgctgctggaggacgtggcgcgccacggcggggacgtgacggtggcgtgctgggacgacggcgtcaccgcgctccaccgcgcggtgctgcaggggaacgtcgggatggccagggtcctgctggagcacggcgccgacgccgacagggaggacggcggcgggcgcacccccagggccttggcggaccagctcggccaccgcgacatgcagcagctgttcatcgggtcgtcgtcgtcgtcgtcgcaccaccgggaaggagcggtggagagcccgaagcagcagcagggttcgggaacggaccatggcggcagcaggctcgcggtcgtcgcggctcatcagccggcagtcacgaggttcaagagcgcgcccgcgccgagggtccccgtcgtcccgcagcacgacagcgccggctcgtcgccgtcgccgtcgccgtcgccgccgcagtcgtccaggcacagcactccccggcggctggtcggtttccgaaactccctctttggtgtcctctcatcgtcgcacttgcactggcacgacggaggaggaggagcaggcggcggcggcgggcctagccgccacgagaggcagacgcaaagcagcaggtcgcgtgtcagggtgaccatctcctgccccgagcagggcgccagcgcgaggaagctggtgttcatgcctgagacgatggtgcagctcgtggagctcgccgggagccagttcgggttcgctccgacgagggcggtgaccatggacggtgcccaggttgacgacgccaggctcgtcagggacggcgaccacctcctcctcgtcactcatcagtgggtgcctgacactaaggtcgtgcaaacgaatcagtaa

SEQ ID NO: 888 - protein, 903 aa, Sorghum bicolor
  misc_feature: Ceres ANNOT ID no. 6011433
  misc_feature (543)..(575): Pfam Id: Ank Pfam Desc: Ankyrin repeat
  misc_feature (641)..(673): Pfam Id: Ank Pfam Desc: Ankyrin repeat
  misc_feature (97)..(291): Pfam Id: Ion_trans Pfam Desc: Ion transport protein
  misc_feature (200)..(297): Pfam Id: Ion_trans_2 Pfam Desc: Ion channel
  misc_feature (393)..(471): Pfam Id: cNMP_binding Pfam Desc: Cyclic nucleotide-binding domain
  misc_feature (1)..(892): NCBI GI: 84027755 NCBI Desc: potassium channel akt1 (osakt1)
  misc_feature (1)..(892): NCBI GI: 113533244 NCBI Desc: os01g0648000 [oryza sativa (japonica cultivar-group)]
  misc_feature (37)..(892): NCBI GI: 17887457 NCBI Desc: akt1-like potassium channel [oryza sativa]
  misc_feature (27)..(709): NCBI GI: 62242121 NCBI Desc: potassium uptake channel [zea mays]
  misc_feature (27)..(708): NCBI GI: 2104908 NCBI Desc: potassium channel [zea mays]
  misc_feature: The sequence is a functional homolog of SEQ ID NO 1838 in the 10/374,780US patent application
  misc_feature: Useful for making plants with modulated growth and phenotype characteristics
  misc_feature: The sequence is a functional homolog of SEQ ID NO 1838 in the 20060162006 US patent application
MPLCRGGGGAAGGGSSSGGLAAGRTSNRYSTSIGALLPARGGGWRPRLRLRRFIVSPYDPRYLAWEHSLVVLVAYCAWVAPFEFGFVPDPHGALAIADNAVNAAFAVDIALTFFVAYADGRTYLLQDDPRRIAWRYASTWLALDVASTVPIDVYRRILPPQASGYNFFGMLRLWRLHRVGTFFTRKLSYFWVRCIRLICVTLFAVHSAGCFYYLLADRYHDADHTWLSSSMPDFKQESVWKRYAASMYWSITTLTTVGYGDMHAVNTGEMVFTTLYMLFNLGLTAYLIGNMTNLVVHGTSRTRKYRDAIKAATSFAVRHQLPARLQEQMVSHLSLKFRTDSEGLQQQETLDALPKAIRSGISHHLFFALVQGVYLFQGVSNDLIFQLVSEMNAEYFAPREDVILQNEAPSDFYVLVTGSVLAGMARAGDVVGEIGVLCYKPQLFTARTRTLCQLLRMERTAFLRIVQANVGDGTIIINNLIQYLKEKRDSCAIAGVAEEIEYMLARGQLELPVTLCYAASKGDDFLMRQLLKRGVDPNESDNYWHTALHISASSGHDQCVKLLLEHGADPNATDAQGRVPLWEALSRRHRAAARLLVDAGADLSAGDAALYARAAVEADDVALLEDVARHGGDVTVACWDDGVTALHRAVLQGNVGMARVLLEHGADADREDGGGRTPRALADQLGHRDMQQLFIGSSSSSSHHREGAVESPKQQQGSGTDHGGSRLAVVAAHQPAVTRFKSAPAPRVPVVPQHDSAGSSPSPSPSPPQSSRHSTPRRLVGFRNSLFGVLSSSHLHWHDGGGGAGGGGGPSRHERQTQSSRSRVRVTISCPEQGASARKLVFMPETMVQLVELAGSQFGFAPTRAVTMDGAQVDDARLVRDGDHLLLVTHQWVPDTKVVQTNQ

SEQ ID NO: 889 - DNA, 525 bp, Sorghum bicolor
  misc_feature: Ceres ANNOT ID no. 6011437
  misc_feature: Encodes the peptide sequence at SEQ ID NO 890
atggggatcgcctcggtgacgaccagtctggcggtggtgctgccggtgctggtggcgctggctttctccagggctgcggcgcagggcaatggctgctccagcgtgatgatgaccctctccccgtgcatggacttcatctccagcaaggcgccggaaccagggatctcctgctgctcggtgctcgccggagtggtccagaccgacccccgctgcctctgcatggtcctggatggcaccgcgacgtcctttggcatctccatcaaccagacgagggcgatggagctccctggagtctgcaaggtcaaagcaccaccgatcagccactgcacaggcgtccaaggagcacctgcaccaacaccttccaatgaggcagcaacagcagagggggaagaagttgaggcaacagcagattccccaaaaggatatggagcctcaatgacggaaagctccacaaactcaaagaatgcagcaagtttaatggccacaatgattactcccatctgtgtgttgctctatgccttctaa

SEQ ID NO: 890 - protein, 174 aa, Sorghum bicolor
  misc_feature: Ceres ANNOT ID no. 6011437
  misc_feature (32)..(109): Pfam Id: Tryp_alpha_amyl Pfam Desc: Protease inhibitor/seed storage/LTP family
  misc_feature (16)..(158): NCBI GI: 92883937 NCBI Desc: plant lipid transfer protein/par allergen [medicago truncatula]
  misc_feature (9)..(173): NCBI GI: 50509338 NCBI Desc: protease inhibitor-like protein [oryza sativa (japonica cultivar-group)]
  misc_feature (2)..(172): NCBI GI: 56549227 NCBI Desc: lipid transfer protein [capsicum annuum]
  misc_feature (2)..(172): NCBI GI: 56549235 NCBI Desc: lipid transfer protein [capsicum annuum]
  misc_feature (2)..(172): NCBI GI: 56549231 NCBI Desc: lipid transfer protein [capsicum chinense]
MGIASVTTSLAVVLPVLVALAFSRAAAQGNGCSSVMMTLSPCMDFISSKAPEPGISCCSVLAGVVQTDPRCLCMVLDGTATSFGISINQTRAMELPGVCKVKAPPISHCTGVQGAPAPTPSNEAATAEGEEVEATADSPKGYGASMTESSTNSKNAASLMATMITPICVLLYAF

SEQ ID NO: 891 - DNA, 459 bp, Sorghum bicolor
  misc_feature: Ceres ANNOT ID no. 6011441
  misc_feature: Encodes the peptide sequence at SEQ ID NO 892
atgtcgctgatcgcgggggaggacttccagcacatcctgcgtctgcttaacaccaacgtggatggcaagcagaagatcatgttcgccatgacctccatcaagggtgttggccgccgcttctccaacatcgtatgcaagaaggccgacatcgacatgaacaagcgggctggtgagctgtcatcagatgagcttgagcgcctcatgactgtagttgccaaccctcgccagtttaaggtccctgactggttcctcaacaggaagaaggattacaaggatggtaggttctctcaggttgtttccaatgcccttgacatgaagctcagggatgaccttgagaggctgaagaagatcaggaaccaccgtggtctgcgtcactactggggcctgcgtgttcgtggccagcacaccaagaccaccgggaggcgtggaaagactgtcggtgtgtcaaagaagagataa

SEQ ID NO: 892 - protein, 152 aa, Sorghum bicolor
  misc_feature: Ceres ANNOT ID no. 6011441
  misc_feature (14)..(142): Pfam Id: Ribosomal_S13 Pfam Desc: Ribosomal protein S13/S18
  misc_feature (1)..(152): NCBI GI: 92872607 NCBI Desc: ribosomal protein s13 [medicago truncatula]
  misc_feature (1)..(152): NCBI GI: 17978783 NCBI Desc: s18.a ribosomal protein [arabidopsis thaliana]
  misc_feature (1)..(152): NCBI GI: 24266988 NCBI Desc: ribosomal protein s18 [branchiostoma belcheri]
  misc_feature (1)..(152): NCBI GI: 67083901 NCBI Desc: ribosomal protein s18 [ixodes scapularis]
  misc_feature (1)..(152): NCBI GI: 22758908 NCBI Desc: ribosomal protein s18 [argopecten irradians]
MSLIAGEDFQHILRLLNTNVDGKQKIMFAMTSIKGVGRRFSNIVCKKADIDMNKRAGELSSDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 893 - DNA, 2604 bp, Sorghum bicolor
  misc_feature: Ceres ANNOT ID no. 6011452
  misc_feature: Encodes the peptide sequence at SEQ ID NO 894
atggccatctccacctcatccgcctcctcccctgctgccccgctccaccccacctccccgtcccctaccttcctctgcttcccgcccgcgccgtccgctcctccgcctccccatggggcccctccccgcctgcccctccgcgcggtggccgctgccgccgccgacccccgcgccgcgcacgcggcggcggttaagtccggcgcccttggcgcctccccggacgcccgcgcctccaacgccgtcatgtgcgcgtacctccgcgcgggccgccttgccgacgcgcgggacgtgttcgaccggatgcccgcgcgcgacgccgcctcctacagcgcgctcatctcgggccacgcgcgcctcggcggcggcggagccgccgccgccgccgcggagctgctcggacgcatgcgcctcgcggacgggctgctccccaccgagtacaccttcgtgggcctcctcaccgcgtgcgcccgcaggggcaacccgcggctcgggacgcaggtgcacgcgctcgtcgccaagtccggccacgcctcgtcgctcctcgtggccaacgcgctcctcggcatgtacgtcaagtgcggccgcttcggggacgcgctgagggcgttcgacggcatggaccgccgcgacgtctcgtcgtggaatgccgtcctggctgggctcgtcgagctggggcggcacgaggaggcgttcgagctgttcggcgagatgcgagcgagcgggaacgtccgcgccgacaggttcactctgtccgcgctcctcgccgcggccggcgaggggtttggccagccccagggcgaggcggtgcatgctctgtcgctcaagtcggggctggagacggacctgagcgtgggcaatgcgctcattgggttctatgcagagcatggcgcctctgttgatgatgttgtgagcgtgttccagaggatgccggtgaaggacgtgatttcgtggaccggtttgctgaatgggtacatggagtttggtctcgtggacatggcactggatgtgtttgaacggatgccgcagaggaacttcgttacatacaatgcggttctcactgggttttgtcagaacaaggaaggtgtgcgggtcacgtttgccaagaaggcaggcttccgagggcttggtttgtttaggcaaatggtggaggctggtttggagatctcagatgtcacggtgacaggcgttctgaatgcttgtgctattgctgcggataggaaggcgagcgagcaggttcatgcttttgtgatcaagtgtggatgcgtgtctagtccgtggattgatgctgcgttgattgatatgtgcatcaaatgtggccgatctggagatgcgcatctgttatttgagcaatggcagcatgacgagagctttcacattgcctggaattctctactgctggctagtgtcagagatggtgagtatgagaaagcactttcgaccttccttcagatgtttagaagcagtggtgtagaattcatcgatgagttcatgttgactgctgtccttggagtatgtggcagtctaggttttgctgaacttggaaagcaaatgcattcctttactgcgaaatctgggcttctgtgtgctcgtggagttggtaacgcgattatcagtatgtacggcaagtgcggggagttgaaagatgccggcagtttttttgaggggatgacttgtcgagatttggtgtcatggaatgcaatgatcactgcccatcttcttcatcatcagggggatgagatattgaagatatggtctgagatggagagattaatggtcaggcctgattccattacgtttcttctggtcatatctgcttgcagtcacacaagctcagactccacacagaaatgcagggatctctttctaactatgccaagcacatatggcattgaaccagccatggagcactatgcagcctttgtttatgtccttggctgctggggccattttgatgacgcagagcagcttataggtggtatgccattaaagcctggtgcattagtttggcggtctttgctagacagctgcagcaaacactccaacatggctgtgcggagacgagccatgaagcatctgctggcattggagccacaagacccatccacgtacgtgctgacttcaaacctgctatccgaatcagcaaggtggcactcctctgagaacagaaggctggagatgcgtgaaaagggcatgcgcaagatccctgccaggagctggacgtttcacggcaacatggtccactcatttttcgcacgggatagaacacacccacagtccagggacatatacgccggcctggatgtgctgatccttgagtgcataaaggctgggtacgaaccggacaccaccttcgtcctgcacgacgtcgaggagtaccagaagaggcactttctgatgtaccacagcgtgaagttagcgtcaatgtatggccttctgatggcaggccctggacagaccgtccgcgtggtcaagaacatccgcatgtgcggggattgccactctttcttggagcatgcctctgctgccaccggtaaagttatctcagtcagggactcgtctgggttccacattttcagggaagggaaatgttcctgtagacagtag

SEQ ID NO: 894 - protein, 867 aa, Sorghum bicolor
  misc_feature: Ceres ANNOT ID no. 6011452
  misc_feature (212)..(246): Pfam Id: PPR Pfam Desc: PPR repeat
  misc_feature (315)..(349): Pfam Id: PPR Pfam Desc: PPR repeat
  misc_feature (562)..(596): Pfam Id: PPR Pfam Desc: PPR repeat
  misc_feature (1)..(866): NCBI GI: 34394447 NCBI Desc: selenium-binding protein-like [oryza sativa (japonica cultivar-group)]
  misc_feature (366)..(865): NCBI GI: 38606535 NCBI Desc: osjnba0016o02.23 [oryza sativa (japonica cultivar-group)]
  misc_feature (366)..(865): NCBI GI: 116310014 NCBI Desc: osigba0124n08.1 [oryza sativa (indica cultivar-group)]
  misc_feature (375)..(865): NCBI GI: 54695180 NCBI Desc: ppr986-12 [physcomitrella patens]
  misc_feature (320)..(828): NCBI GI: 115488988 NCBI Desc: os12g0552300 [oryza sativa (japonica cultivar-group)]
  misc_feature: Useful for making plants with altered cell wall content and/or composition
  misc_feature: GREAT-hit functional homolog of the protein sequence encoded by LOCUS at5g03800
MAISTSSASSPAAPLHPTSPSPTFLCFPPAPSAPPPPHGAPPRLPLRAVAAAAADPRAAHAAAVKSGALGASPDARASNAVMCAYLRAGRLADARDVFDRMPARDAASYSALISGHARLGGGGAAAAAAELLGRMRLADGLLPTEYTFVGLLTACARRGNPRLGTQVHALVAKSGHASSLLVANALLGMYVKCGRFGDALRAFDGMDRRDVSSWNAVLAGLVELGRHEEAFELFGEMRASGNVRADRFTLSALLAAAGEGFGQPQGEAVHALSLKSGLETDLSVGNALIGFYAEHGASVDDVVSVFQRMPVKDVISWTGLLNGYMEFGLVDMALDVFERMPQRNFVTYNAVLTGFCQNKEGVRVTFAKKAGFRGLGLFRQMVEAGLEISDVTVTGVLNACAIAADRKASEQVHAFVIKCGCVSSPWIDAALIDMCIKCGRSGDAHLLFEQWQHDESFHIAWNSLLLASVRDGEYEKALSTFLQMFRSSGVEFIDEFMLTAVLGVCGSLGFAELGKQMHSFTAKSGLLCARGVGNAIISMYGKCGELKDAGSFFEGMTCRDLVSWNAMITAHLLHHQGDEILKIWSEMERLMVRPDSITFLLVISACSHTSSDSTQKCRDLFLTMPSTYGIEPAMEHYAAFVYVLGCWGHFDDAEQLIGGMPLKPGALVWRSLLDSCSKHSNMAVRRRAMKHLLALEPQDPSTYVLTSNLLSESARWHSSENRRLEMREKGMRKIPARSWTFHGNMVHSFFARDRTHPQSRDIYAGLDVLILECIKAGYEPDTTFVLHDVEEYQKRHFLMYHSVKLASMYGLLMAGPGQTVRVVKNIRMCGDCHSFLEHASAATGKVISVRDSSGFHIFREGKCSCRQ

SEQ ID NO: 895 - DNA, 2139 bp, Sorghum bicolor
  misc_feature: Ceres ANNOT ID no. 6011465
  misc_feature: Encodes the peptide sequence at SEQ ID NO 896
atgccagagctgcgaagcagtactcgtcaagcacgcctgaggtctaagaagctcgacgatctgcagacagcagagccgcctgcgaaaccggcgccacctgctccgcagagggcagcaaagcgtgctcctacacgtgctgctaggggcagaaagggtgctgctgggaaaggagtgcctcccgcaccaaagcctagaagaaagggggttcagattgccgacttagaagctgatccagcttgtgaagaaccccctaaagctgtcaagaaactggaagttgcccctaaagctgtcaagggactgcaagctgctgcacccaagaaccttcctttgaagaaggtacccgaggttggtgttctgaaaatggatggtgaaagtgcggagaagattgttggggctgaagatgaatcaacaactacacctgtgccagagagggttcaagtaggtaattctccagagtacataactgacaggaagttaggtaaaggtggttttggtcaggtctatgttggccgaagggtttctggtgggaatgctcgcactggtcctgatgcatatgaggttgcattgaaattcgagcatcggaacagtaaaggatgcaattatggccccccatacgagtggcaggtttataacactctcaatggttgctatggcataccatcggtccactacaagggtcgtcagggcgactactatatacttgtaatggatatgcttggtcccagcctttgggacgtgtggaattcaatggggcagacgatgtctgcaaatatggctgcttgcattgctgtagaggccatatcgattcttgagaagctccattctaaagggtttgtgcatggtgatgtgaaaccagagaattttctgcttggtcagcctggatctcctgatgataagaaactttaccttatagatcttggtttagcatccaagtggagagagagtcatggtcatcatgttgattatgatcaacgtcccgatatctttaggggaacaattagatatgcgagtgtccatgctcatttggggcgcaccggaagtaggagggatgatttagagtcactggcgtacacccttattttcctgataagaggaagattgccttggcaaggctatcagggggataccaagagtttccttgtttgcaagaagaaaatggctgtttctccagagttgctttgttgtttctgtccagctccattcaaacagtttcttgagattgttacaaatatgaaatttgatgaagagccaaactatgcaaagcttatctctctttttgatggtttgatcgaagcacctgcctcgagaccaatcagaattgatggggctctcaaggttgggcagaaacgtggaagattgcttgcaaatctagaagaagatgagcagcctaaaaagaaggttagattagggagcccggcagctcaatggatttcagtttataatgctaggcggcccatgaagcagaggtaccattacaatgtggctgactcaaggctaagtcaacatgtagaaaaaggcaatgatgatgggctttacattagttgtgtggcttcctcggcaaacctttgggcactcatcatggacgcaggaactggtttctgttctcaagtttatgagctctcaccagtttttctccacaaggactggataatggagcagtgggagaaaagttactacataacagcaattgctggatcaaccaatgggagttcattggttgtcatgtccaaaggaactccttacactcagcaatcgtacaaggttagcgaatcattcccttacaagtggatcaataaaaagtggaaagaaggatttcatgtaacatctatggccactgccggaaatcgctggggtgtagtcatgtcaaggaactcaggattttctactcaggttgtagagttggatttcctgtaccctagcgaaggcatccatcggcgatgggagagtggttacaggataacttccacagcggccaccaatgaccaagctgctttcatcttgagcatgccaaagcggaagccgatggatgagacacaagaaactctccgcacctctgccttccctagcgcacatgtcaaggagaaatgggccaagaatctctatatagcttcgatctgctatggacgaaccgtgtgctga

SEQ ID NO: 896 - protein, 712 aa, Sorghum bicolor
  misc_feature: Ceres ANNOT ID no. 6011465
  misc_feature (153)..(411): Pfam Id: Pkinase Pfam Desc: Protein kinase domain
  misc_feature (35)..(712): NCBI GI: 9758901 NCBI Desc: casein kinase-like protein [arabidopsis thaliana]
  misc_feature (93)..(712): NCBI GI: 92896769 NCBI Desc: protein kinase-like [medicago truncatula]
  misc_feature (57)..(711): NCBI GI: 115439889 NCBI Desc: os01g0744300 [oryza sativa (japonica cultivar-group)]
  misc_feature (74)..(711): NCBI GI: 30682888 NCBI Desc: protein kinase family protein [arabidopsis thaliana]
  misc_feature (74)..(711): NCBI GI: 42570917 NCBI Desc: protein kinase family protein [arabidopsis thaliana]
  misc_feature: The sequence is a functional homolog of SEQ ID NO. 399 in the 11/188,298 US application
  misc_feature: The sequence is a functional homolog of SEQ ID NO. 310 in the 11/188,298 US application
  misc_feature: The sequence is a functional homolog of SEQ ID NO. 520 in the 11/188,298 US application
MPELRSSTRQARLRSKKLDDLQTAEPPAKPAPPAPQRAAKRAPTRAARGRKGAAGKGVPPAPKPRRKGVQIADLEADPACEEPPKAVKKLEVAPKAVKGLQAAAPKNLPLKKVPEVGVLKMDGESAEKIVGAEDESTTTPVPERVQVGNSPEYITDRKLGKGGFGQVYVGRRVSGGNARTGPDAYEVALKFEHRNSKGCNYGPPYEWQVYNTLNGCYGIPSVHYKGRQGDYYILVMDMLGPSLWDVWNSMGQTMSANMAACIAVEAISILEKLHSKGFVHGDVKPENFLLGQPGSPDDKKLYLIDLGLASKWRESHGHHVDYDQRPDIFRGTIRYASVHAHLGRTGSRRDDLESLAYTLIFLIRGRLPWQGYQGDTKSFLVCKKKMAVSPELLCCFCPAPFKQFLEIVTNMKFDEEPNYAKLISLFDGLIEAPASRPIRIDGALKVGQKRGRLLANLEEDEQPKKKVRLGSPAAQWISVYNARRPMKQRYHYNVADSRLSQHVEKGNDDGLYISCVASSANLWALIMDAGTGFCSQVYELSPVFLHKDWIMEQWEKSYYITAIAGSTNGSSLVVMSKGTPYTQQSYKVSESFPYKWINKKWKEGFHVTSMATAGNRWGVVMSRNSGFSTQVVELDFLYPSEGIHRRWESGYRITSTAATNDQAAFILSMPKRKPMDETQETLRTSAFPSAHVKEKWAKNLYIASICYGRTVC

SEQ ID NO: 897 - DNA, 843 bp, Sorghum bicolor
  misc_feature: Ceres ANNOT ID no. 6011479
  misc_feature: Encodes the peptide sequence at SEQ ID NO 898
  misc_feature: Up-regulated in shoot tissues in response to salicylic acid treatment
atggcggccaaggtggcgtcgccgctcgcgttccgccgcgacgtgcgtggcccgctcggccggcctcatccgagcggcggctgccggagcgggaccgggatgccgggggtgctgtactggagcagcggcgccggcggcagcagggtgctcgcggcgcgggcgcgcgggcggaacaggttcggcggcggatcagggcggacggccaaggacgaggcggcggacgaggacgaggaggaggtcgcggacgtggtgatcgtcgacgccggggacgaggaggagttcgcctccgacgagctgtccgggttcaggggcctggttcttgatctctcctacaggcctgtcaatgtcgtgtgctggaagcgcgccatctgcctggagttcattgggaaggccgatgtgttggagtactatgatcagaccgtctcttcgcctagcggatccttctatatccctgcagttttaagggttccacagttgctgcaagtagtaaagagaagaagagtcaagcagagcctaagccgtaaaaacattctttacagggatgatttcacctgtcaatattgctcttcaggggacaacttgacaattgaccatgttattccgatttcgcgtggtggtaaatgggaatgggagaatttggtgactgcctgtgccagatgcaactccaggaagggtcagaagacaccggagcaggcaaacatgaagctgcttaagatccccagggcgcccaaggagtacgatattatggctgtgcccttgacaaaatctgcattcagaacgctcaagaggaaccatgggcttcctgaagtgtggctgcagtacctttccagaccatctccatga

SEQ ID NO: 898 - protein, 280 aa, Sorghum bicolor
  misc_feature: Ceres ANNOT ID no. 6011479
  misc_feature (183)..(228): Pfam Id: HNH Pfam Desc: HNH endonuclease
  misc_feature (67)..(278): NCBI GI: 38603958 NCBI Desc: at2g23840 [arabidopsis thaliana]
  misc_feature (87)..(276): NCBI GI: 124365579 NCBI Desc: hnh nuclease [medicago truncatula]
  misc_feature (98)..(243): NCBI GI: 94986243 NCBI Desc: hnh endonuclease [deinococcus geothermalis dsm 11300]
  misc_feature (105)..(275): NCBI GI: 75906614 NCBI Desc: hnh endonuclease [anabaena variabilis atcc 29413]
  misc_feature (105)..(275): NCBI GI: 86167313 NCBI Desc: hnh nuclease [synechococcus sp. rs9917]
  misc_feature: Up-regulated in shoot tissues in response to salicylic acid treatment
MAAKVASPLAFRRDVRGPLGRPHPSGGCRSGTGMPGVLYWSSGAGGSRVLAARARGRNRFGGGSGRTAKDEAADEDEEEVADVVIVDAGDEEEFASDELSGFRGLVLDLSYRPVNVVCWKRAICLEFIGKADVLEYYDQTVSSPSGSFYIPAVLRVPQLLQVVKRRRVKQSLSRKNILYRDDFTCQYCSSGDNLTIDHVIPISRGGKWEWENLVTACARCNSRKGQKTPEQANMKLLKIPRAPKEYDIMAVPLTKSAFRTLKRNHGLPEVWLQYLSRPSP

SEQ ID NO: 899 - DNA, 1110 bp, Sorghum bicolor
  misc_feature: Ceres ANNOT ID no. 6011480
  misc_feature: Encodes the peptide sequence at SEQ ID NO 900
atggccgcggcgaaggcgttgagggaggtggcgaggacgaggagggggagctgggcggcggtggtcgggcgccggtgcttgtccagcgggagcggtgggccggcggcggagcggaaggagggaggaggaggaggagcgaaagcggtgaacctgttcacagccgtcaaccaggcgctccacatcgccctcgacaccgacccccgcgcttttgtcttcggagaggatgttggattcggcggcgtctttcgctgcaccacaggtctggctgatcggtttggcaagaacagagtattcaatacgccgctatgtgagcagggtattgctggatttgccattggcctagcagcaatgggtaatcgagctattgcagaaatccagtttgcagactatatctttccagcctttgatcagattgtcaatgaagcagctaaattcagatatcggagtggaaatgaatttaactgtggaggcttaacaattcgaactccttatggtgctgttgggcacggtggtcactaccattcacagtcaccagaggctttcttctgtcatgttcctggactcaaggttgtcataccccgaagtccacgtgaagctaaggggttgctgttggctagcattcgagatccaaatccagttgtattttttgagccaaagtggttgtatcgtttggctgttgaagaagttcctgaggaggattatatgctgcccttatctgaggcagaagtgattaggaaaggaagtgatataacactcattggatggggagctcaacttgcagtactgaaagaagcttgtgaagatgctgcaaaggatggggtatcttgtgagctcattgatctaaaaacacttataccatgggacaaggaaacagtagaggcctcggtcaagaagactggaaagcttctcgttagccatgaggctccaatcaccgggggctttggtgcagagattgctgcatccatcaccgagcgctgcttccagaggttagaagcacctgtggcgagagtctgcggcctcgacactcctttccctctcgtttacgaaccattttacatgcccaccaagaacaaggtcctggatgctataaaatcaactgtaaattactga

SEQ ID NO: 900 - protein, 369 aa, Sorghum bicolor
  misc_feature: Ceres ANNOT ID no. 6011480
  misc_feature (47)..(225): Pfam Id: Transket_pyr Pfam Desc: Transketolase, pyrimidine binding domain
  misc_feature (239)..(359): Pfam Id: Transketolase_C Pfam Desc: Transketolase, C-terminal domain
  misc_feature (19)..(369): NCBI GI: 3746568 NCBI Desc: branched-chain alpha-keto acid decarboxylase e1 beta subunit [arabidopsis thaliana]
  misc_feature (19)..(369): NCBI GI: 9280297 NCBI Desc: branched chain alpha-keto acid dehydrogenase e1 beta subunit [arabidopsis thaliana]
  misc_feature (17)..(369): NCBI GI: 60475528 NCBI Desc: 3-methyl-2-oxobutanoate dehydrogenase (lipoamide) [dictyostelium discoideum]
  misc_feature (44)..(369): NCBI GI: 45382817 NCBI Desc: mitochondrial branched-chain alpha-keto acid dehydrogenase e1-beta subunit [gallus gallus]
  misc_feature (17)..(369): NCBI GI: 109939995 NCBI Desc: branched chain keto acid dehydrogenase e1, beta polypeptide (maple syrup urine disease) [bos taurus]
  misc_feature (17)..(369): SWISSPROT Homolog: EC 1.2.4.4 2-oxoisovalerate dehydrogenase subunit beta, mitochondrial precursor
MAAAKALREVARTRRGSWAAVVGRRCLSSGSGGPAAERKEGGGGGAKAVNLFTAVNQALHIALDTDPRAFVFGEDVGFGGVFRCTTGLADRFGKNRVFNTPLCEQGIAGFAIGLAAMGNRAIAEIQFADYIFPAFDQIVNEAAKFRYRSGNEFNCGGLTIRTPYGAVGHGGHYHSQSPEAFFCHVPGLKVVIPRSPREAKGLLLASIRDPNPVVFFEPKWLYRLAVEEVPEEDYMLPLSEAEVIRKGSDITLIGWGAQLAVLKEACEDAAKDGVSCELIDLKTLIPWDKETVEASVKKTGKLLVSHEAPITGGFGAEIAASITERCFQRLEAPVARVCGLDTPFPLVYEPFYMPTKNKVLDAIKSTVNY

SEQ ID NO: 901 - DNA, 519 bp, Sorghum bicolor
  misc_feature: Ceres ANNOT ID no. 6011486
  misc_feature: Encodes the peptide sequence at SEQ ID NO 902
atggcacaagagagctggaaacaagagtctgaggaaactggagtccatgcccctgaggccccgattctgtgcataaacaattgtggtttcttcggcagcagcatgacaaacaatatgtgctcgaagtgctatagggacttcatcaagttgatggaaacccctgtggtggagaagaaggttatagcaggggcatcatcctctgcagtgctgccactagaggcagcaaagcgagacgcattgcccaccgctgctgctgctgctgctgctgaagcagccgcagctgtagacgacaagcaagcagcacaggaggagcccccaaagccgccgagcaaccggtgcctgacgtgccgcaagaaggtggggctgactgggttccagtgccgctgcggtggaaccttctgctccatgcaccgctacacggactcccaccagtgcaccttcgactacaagacagcggccagggagcagatcgccaagcagaaccctgtcgtgatggccgagaagatcaacaagatctga

SEQ ID NO: 902 - protein, 172 aa, Sorghum bicolor
  misc_feature: Ceres ANNOT ID no. 6011486
  misc_feature (113)..(153): Pfam Id: zf-AN1 Pfam Desc: AN1-like Zinc finger
  misc_feature (21)..(45): Pfam Id: zf-A20 Pfam Desc: A20-like zinc finger
  misc_feature (1)..(172): NCBI GI: 118424243 NCBI Desc: zinc finger protein [aeluropus littoralis]
  misc_feature (1)..(172): NCBI GI: 75146195 NCBI Desc: zinc finger a20 and an1 domain-containing stress-associated protein 9 (ossap9)
  misc_feature (1)..(172): NCBI GI: 75149663 NCBI Desc: zinc finger a20 and an1 domain-containing stress-associated protein 6 (ossap6)
  misc_feature (9)..(172): NCBI GI: 75123464 NCBI Desc: zinc finger a20 and an1 domain-containing stress-associated protein 4 (ossap4)
  misc_feature (9)..(172): NCBI GI: 75119379 NCBI Desc: zinc finger a20 and an1 domain-containing stress-associated protein 8 (ossap8) (stress-associated protein 3)
MAQESWKQESEETGVHAPEAPILCINNCGFFGSSMTNNMCSKCYRDFIKLMETPVVEKKVIAGASSSAVLPLEAAKRDALPTAAAAAAAEAAAAVDDKQAAQEEPPKPPSNRCLTCRKKVGLTGFQCRCGGTFCSMHRYTDSHQCTFDYKTAAREQIAKQNPVVMAEKINKI

SEQ ID NO: 903 - DNA, 1098 bp, Sorghum bicolor
  misc_feature: Ceres ANNOT ID no. 6011504
  misc_feature: Encodes the peptide sequence at SEQ ID NO 904
atggctgaaggggaaggagaacatagctacgcaaagaattcgaggattcaggagaagcttatggtacgaactctgcccatcattgagaatgctataaaggaagcatgtactgctcttgcccccaaaaccatgatcattgctgacctaggatgctcttcgggaccaaacacattgcgcttcatctccagtgtgttagacatcttatctggccaatgcaacaaatctactgatggatgtgatcctatggaacttcaaatcttccttaatgacctacctggtaatgacttcaaccagctcttcagttcacttgaaaacttgaagcatggtacaataatggaacaaatggggtacacaccacctttgtactacatttctgggttgccaaaatcgtactacagcaggctgtttcctcgtcaaagtgtccatctctttcactccgcttgttgccttcattggcgctctcaggtacccgaggaactttatgcaaggaataaaaccctgttaaacaaagataatatttacatcgcaaagtccacgccgtcatttgtggtgaagttcttccaagagcagttccataaggacttctcactcttcctcaagctacgtcatgaagaacttgtatatggaggaaaaatgattttaacatttgttgggaggaaggatgatgatgtatacagtggagatagcgtccaactttatggattacttgcaagatcactgcaatctcttgttgcaaagggccttgtggagaaagaaaggctagaagctttcaatctaccgttgtatgggccatcaattgctgaagtgaaggaaatagtcatggagagccacatgttcaaattggatcacatcaaattacttgagctaaactgggatccttatgatgatacagaaggcgatgatgtccataacagtgtccgtagtggcatgaatgtttctaagcttgttagagcattgatggagcctttgattgcaagtcattttggagaaaacatacttgacttattgtttgcagattattcatatctcttagccaagcaccttgagcaagagaagacaaaaaccgcctttatcatcatgtccttgaagaaactgtag

SEQ ID NO: 904 - protein, 365 aa, Sorghum bicolor
  misc_feature: Ceres ANNOT ID no. 6011504
  misc_feature (28)..(365): Pfam Id: Methyltransf_7 Pfam Desc: SAM dependent carboxyl methyltransferase
  misc_feature (1)..(365): NCBI GI: 115467342 NCBI Desc: os06g0242000 [oryza sativa (japonica cultivar-group)]
  misc_feature (1)..(362): NCBI GI: 42528301 NCBI Desc: benzothiadiazole-induced s-adenosyl-l-methionine:salicylic acid carboxyl methyltransferase 1; bth-induced s-adenosyl-l-methionine:salicylic acid carboxyl
  misc_feature (1)..(362): NCBI GI: 42528301 (continued) methyltransferase 1 [oryza sativa (indica cultivar-group)]
  misc_feature (1)..(364): NCBI GI: 45238343 NCBI Desc: carboxyl methyltransferase [crocus sativus]
  misc_feature (1)..(297): NCBI GI: 115467776 NCBI Desc: os06g0313200 [oryza sativa (japonica cultivar-group)]
  misc_feature (1)..(364): NCBI GI: 140067009 NCBI Desc: sam dependent carboxyl methyltransferase [medicago truncatula]
MAEGEGEHSYAKNSRIQEKLMVRTLPIIENAIKEACTALAPKTMIIADLGCSSGPNTLRFISSVLDILSGQCNKSTDGCDPMELQIFLNDLPGNDFNQLFSSLENLKHGTIMEQMGYTPPLYYISGLPKSYYSRLFPRQSVHLFHSACCLHWRSQVPEELYARNKTLLNKDNIYIAKSTPSFVVKFFQEQFHKDFSLFLKLRHEELVYGGKMILTFVGRKDDDVYSGDSVQLYGLLARSLQSLVAKGLVEKERLEAFNLPLYGPSIAEVKEIVMESHMFKLDHIKLLELNWDPYDDTEGDDVHNSVRSGMNVSKLVRALMEPLIASHFGENILDLLFADYSYLLAKHLEQEKTKTAFIIMSLKKL

SEQ ID NO: 905 - DNA, 981 bp, Sorghum bicolor
  misc_feature: Ceres ANNOT ID no. 6011515
  misc_feature: Encodes the peptide sequence at SEQ ID NO 906
atgaggccgatcctgatgaagggccacgagcgcccgctgacgttcctgcgctacaaccgcgacggggacctgctcttctcctgcgccaaggatcacaccccgacggtctggtacgccgacaacggtgaccgcctcggcacctaccggggccacaacggcgccgtctggacctgcgacgtctcccgcgactcggcgcgcctcatcaccggatccgccgaccagaccgccaagctctgggaggtgagcacggggaaggagctcttcagcttccgcttcgacgcgcccgccaggtccgtcgagttcgccatcggggacgcgctcgccgtcgtcaccaccgacaacttcatggaccacgtccccaccgtccaggtcaagcacatcgccgaggacatcgacgaccaaacggaggattctgcactcgtcatcaccggcatcaagggaaggatcaacagggccgtttgggggccgctgaacaggaccatcatcactgccggggaggatgccaccattcgcatctgggactcagagactggaaaactgctgaaagagtctgataaagaatctggacatcagaagaccattacatcgttgtcaaaatccttagattggtcacatttcgttactggctccttggataaatctgcaaagctatgggatacaaggacgctaaccctgatcaagacgtatgtcacagagagacctgtcaatgctgttgacatctctccgactcatgatactgtggttctaggaggtggtcaggatgcaatgaatgtgaccatgacagaccgccgtgctggtaaattcgaggctaaattctatcacaagattttgcaagaggaaattggtggtgttaaaggacattttgggccaattaatgctttggcatttaatcctgatgggcggagcttttcaagtggtggtgaagatggatatgtaaggctgcatcattttgattccgaatacttcagcatcaagatgtag

SEQ ID NO: 906 - protein, 326 aa, Sorghum bicolor
  misc_feature: Ceres ANNOT ID no. 6011515
  misc_feature (42)..(80): Pfam Id: WD40 Pfam Desc: WD domain, G-beta repeat
  misc_feature (136)..(174): Pfam Id: WD40 Pfam Desc: WD domain, G-beta repeat
  misc_feature (181)..(219): Pfam Id: WD40 Pfam Desc: WD domain, G-beta repeat
  misc_feature (278)..(316): Pfam Id: WD40 Pfam Desc: WD domain, G-beta repeat
  misc_feature (1)..(326): NCBI GI: 13936812 NCBI Desc: tgf-beta receptor-interacting protein 1 [phaseolus vulgaris]
  misc_feature (6)..(326): NCBI GI: 140040340 NCBI Desc: quinonprotein alcohol dehydrogenase-like [medicago truncatula]
  misc_feature (1)..(326): NCBI GI: 3702321 NCBI Desc: eukaryotic translation initiation factor 3 delta subunit [arabidopsis thaliana]
  misc_feature (1)..(326): NCBI GI: 17978705 NCBI Desc: eukaryotic translation initiation factor 3 delta subunit [arabidopsis thaliana]
  misc_feature (1)..(326): NCBI GI: 12407664 NCBI Desc: eukaryotic initiation factor 3i1 subunit [arabidopsis thaliana]
  misc_feature: The sequence is a functional homolog of SEQ ID NO. 502 in the 11/188,298 US application
  misc_feature: The sequence is a functional homolog of SEQ ID NO. 485 in the 11/188,298 US application
MRPILMKGHERPLTFLRYNRDGDLLFSCAKDHTPTVWYADNGDRLGTYRGHNGAVWTCDVSRDSARLITGSADQTAKLWEVSTGKELFSFRFDAPARSVEFAIGDALAVVTTDNFMDHVPTVQVKHIAEDIDDQTEDSALVITGIKGRINRAVWGPLNRTIITAGEDATIRIWDSETGKLLKESDKESGHQKTITSLSKSLDWSHFVTGSLDKSAKLWDTRTLTLIKTYVTERPVNAVDISPTHDTVVLGGGQDAMNVTMTDRRAGKFEAKFYHKILQEEIGGVKGHFGPINALAFNPDGRSFSSGGEDGYVRLHHFDSEYFSIKM

SEQ ID NO: 907 - DNA, 3225 bp, Sorghum bicolor
  misc_feature: Ceres ANNOT ID no. 6011519
  misc_feature: Encodes the peptide sequence at SEQ ID NO 908
atggagacttcgatatctccaccaggcacatcaaagcaatcagctatccgcaaaccttctcctggaagctctcttaaggatctgtgccttgtttccaaacaagggtcaatagctgaagtagaatctgctttggccttgttgaaaaggagtggtgggaatattgatggtagaaatgcatttggccttagtgcactccaccttgcaacctggagaaatcatctacccatcgtgaggagactcctagatgctggcgctgatccagatgcaagggatggagaatctggctggagtagcctgcatagagcgctccattttggtcacctgtgtattgctggtgttcttttacagtttggtgcttccctcactttggaggacactaagggtcgtcccacgaaattgctctcttatattctatctactctgatgccctcttggcaattcaacttgctttatgaaattgcaacggacgtcttcacttggggaagtgcgacaaattatcagctgggaactggcaatgcccacatacaaaaactaccatgcaaagtagataccttgcatggatcatatatcaaaacagttgctgcatcgaagttccatagtgtagcagttagttatgatggtgaactatacacatggggatttggtcgaggtggtcgtcttggtcatccagatattcaaagtggccagacaactgctgtgattacccctcgccaagtgacagtaggattaggccgcaagcgagttaatgttgtcgctgcagccaaacatcatactgtgattgctacagagacgggggaattgtttacctggggatcaaatagagagggtcagcttggttacccttctgttgatacccaaccaacaccaaggcgtgttagttcgcttaagcaaaggataatttctgtagctgctgcaaacaagcactctgctgcagttgctgatactggcgaagtattcacctggggttgcaataaggagggccaactaggatatggcacttcaaactcagcatcaaattgtatgccaagaatggtggagtacttgaaaggaaaagtatttagaggtgtatctgcagcaaagtatcatacaatagtgttgggagttgatggagaggtgttctcttggggacatcgccttgtcaccccacggcgtgttgtagtagctcgatgccttaagaagggtgggaatacaaatctgaagtttcatcgtatggaacggcttcaagtgatttcagtggctgctggaaccacacacagtactgctttaacagctgatggtgctcttttctactgggtttcatcagatcctgatctaaaatgccagcagatcttttcaatgtgtggaagggatattgtgaacatctcggctggaaagtactggactgctgtggctacatcaacaggtgatgttttcatgtgggatgcaaagaaacgtaaggacgaaatgccaattttcactcgggtgcatggtgttaagcgagcaacatctgtttgtgttggtgaaacacatatgcttgtgctctcaagtatataccatcctgagtatccgcccaaacctaaaagccaaggcagaaaatccatgttagaatggaacagtggaacagaagagttggatgaagatatcctgtttaatgatgttcagcccaacagtggtttatcaggaagcagtggtgaaatgagcaaaggtgtgcctagcttgaaaagcctctgtgagaaggttgcagttgagtatttgttagagccaaaaaacgcaatacaacttcttgaagttgctgattccttggaagccaaggagctaaagaagcattgtgaggatttagctattcgcaatctcgattatattttcacagtgggagctccttcaattatgaatgcttctcctgaaattcttgtgaacttagagaaattactagatgagaaatcctcggagccttggagtcagcgccgtcttcccacaatgacagctacctatcccgctgtcattgacagtgatgtagaggaagatgaaagagaattccctaagccccgtaaatgtgggaaatctgcatcaaggccatctgcaatgtccagtcatgacaacttccttcagaaagactgcactgctgaacaagctgttactaagcagatcagagcacttcgcaagaagctgcaacaaattgagattcttgaggctaaacaacttgcaggtcatcagcttgacaatcagcagctagcgaagcttgagtctagggctgcccttgaaggtgaactttctgaacttggcgttccctcagaggcatactcaacttcctctgcttgtccagcagaaggtagggcaaacagaaaacctgaggtttctaagaaacagaagagaaagaacaagcaggcaacacagactctgtctgtgaaaagtgagcctgggcaacaaatccccattaaggatcttcaagaagttctatcagtcaatgtctctgctgaaaaggaggcgtatgctgctgatccaatcaaacatatagaggctgccgctttcagcaacacaaaagacattgcttctccattggagaagaaagcttcgcaaccaacttcatcaaaaaagaagaataggaaaggtggcttatcgttgtttctgagtggtgctctcgacgacaccccaaaaccaagcctccctgcccctgttgtacctgtcacgccaaagcctgaaggacctgcctggggtggtgcaaagataaccaagggacctgcttcccttcgagatatccagagtgagcagagtaaaacaaatgagcccacatcggccaaggcaaaagaccgctatgagaactcacctgatagtgctgggcgtgtgcgactttcttcattcattccagattcacactcaagcccaatagctgtcacacctgctcgtgcagtgccttcttctgaaggtgacaagagcacgccaccatggtcatcttctgctacctcacccaatgtatcacggccttcgctcagggacatacaaatgcagcaggagaagcggcaccatggcatctcccacagcccgaaaacccacacatcaggcttcgctttaccacaccatggcggatcaccagaggttggtggtgtgaaagacaacatacccaaccgctggttcaggccagagactgatgctccgtcgtccatccgctctatccagatcgaggaacaggctattaaagacttcaagcgcttctacagcagcgtgaggatcgtcaagccgcaggtctag

SEQ ID NO: 908 - protein, 1074 aa, Sorghum bicolor
  misc_feature: Ceres ANNOT ID no. 6011519
  misc_feature (315)..(366): Pfam Id: RCC1 Pfam Desc: Regulator of chromosome condensation (RCC1)
  misc_feature (60)..(92): Pfam Id: Ank Pfam Desc: Ankyrin repeat
  misc_feature (1)..(756): NCBI GI: 115470737 NCBI Desc: os07g0165200 [oryza sativa (japonica cultivar-group)]
  misc_feature (1)..(1073): NCBI GI: 124359292 NCBI Desc: regulator of chromosome condensation/beta-lactamase-inhibitor protein ii [medicago truncatula]
  misc_feature (1)..(1073): NCBI GI: 42572237 NCBI Desc: ankyrin repeat family protein / regulator of chromosome condensation (rcc1) family protein [arabidopsis thaliana]
  misc_feature (1)..(1073): NCBI GI: 30678939 NCBI Desc: ankyrin repeat family protein / regulator of chromosome condensation (rcc1) family protein [arabidopsis thaliana]
  misc_feature (6)..(503): NCBI GI: 134034142 NCBI Desc: inhibitor of bruton tyrosine kinase (ibtk)
METSISPPGTSKQSAIRKPSPGSSLKDLCLVSKQGSIAEVESALALLKRSGGNIDGRNAFGLSALHLATWRNHLPIVRRLLDAGADPDARDGESGWSSLHRALHFGHLCIAGVLLQFGASLTLEDTKGRPTKLLSYILSTLMPSWQFNLLYEIATDVFTWGSATNYQLGTGNAHIQKLPCKVDTLHGSYIKTVAASKFHSVAVSYDGELYTWGFGRGGRLGHPDIQSGQTTAVITPRQVTVGLGRKRVNVVAAAKHHTVIATETGELFTWGSNREGQLGYPSVDTQPTPRRVSSLKQRIISVAAANKHSAAVADTGEVFTWGCNKEGQLGYGTSNSASNCMPRMVEYLKGKVFRGVSAAKYHTIVLGVDGEVFSWGHRLVTPRRVVVARCLKKGGNTNLKFHRMERLQVISVAAGTTHSTALTADGALFYWVSSDPDLKCQQIFSMCGRDIVNISAGKYWTAVATSTGDVFMWDAKKRKDEMPIFTRVHGVKRATSVCVGETHMLVLSSIYHPEYPPKPKSQGRKSMLEWNSGTEELDEDILFNDVQPNSGLSGSSGEMSKGVPSLKSLCEKVAVEYLLEPKNAIQLLEVADSLEAKELKKHCEDLAIRNLDYIFTVGAPSIMNASPEILVNLEKLLDEKSSEPWSQRRLPTMTATYPAVIDSDVEEDEREFPKPRKCGKSASRPSAMSSHDNFLQKDCTAEQAVTKQIRALRKKLQQIEILEAKQLAGHQLDNQQLAKLESRAALEGELSELGVPSEAYSTSSACPAEGRANRKPEVSKKQKRKNKQATQTLSVKSEPGQQIPIKDLQEVLSVNVSAEKEAYAADPIKHIEAAAFSNTKDIASPLEKKASQPTSSKKKNRKGGLSLFLSGALDDTPKPSLPAPVVPVTPKPEGPAWGGAKITKGPASLRDIQSEQSKTNEPTSAKAKDRYENSPDSAGRVRLSSFIPDSHSSPIAVTPARAVPSSEGDKSTPPWSSSATSPNVSRPSLRDIQMQQEKRHHGISHSPKTHTSGFALPHHGGSPEVGGVKDNIPNRWFRPETDAPSSIRSIQIEEQAIKDFKRFYSSVRIVKPQV

SEQ ID NO: 909 - DNA, 1593 bp, Sorghum bicolor
  misc_feature: Ceres ANNOT ID no. 6011522
  misc_feature: Encodes the peptide sequence at SEQ ID NO 910
atggcgtcgctgctgcgcctcccctcgctgctctccccgtccaaggggcccctgctccggcgccggctgccggcggcgaggctcgcggcctccgccgcgtctaggggccaggcctcggcggccgcggagacccgcggcggggacagggaggggcaggtcacgccgcggtccgcggacttcaacgcctggtacacggacgtgatcgccgccgccgagctcgcggactacgggcccgtccgggggaccatggtcatccgcccctacggatacgccatctgggaggccatccaggactatttgaatgtcaaattcaaggaaacagggcatagcaacatgtacttccctcagttcattccatactcatttatagagaaggaagctagtcacgttgaagggtttagcccggagcttgcattggtcaccattggaggaggaaaagaactagaggaaaagcttgtggtaagaccaacaagtgagaccattgtaaaccacatgttcaccaaatggattcatagctatcgtgatcttcctctcatgattaaccagtgggctaatgtgacaagatgggaaatgcggactaaaccattcatccgaactcttgaatttttatggcaagaaggtcatacagcccatgccacccttgaggaggcagagaaggaggcgatgcagatgattgatgtatataccaagtttgcctatgagcatgctgcaataccagttattccaggtagaaaatcaaaagtagaaacatttgctggtgccaatcggacttacactatagaagctatgatgggtgacaagaaggccttacaagctggaactagtcacaacctcggccaaaacttttcacgagcttttggaacacagtttatggatgaaaatggtcaaatcgaacacgtctggcagacctcttgggctattagtactcgttttgttggtgggattatcatgacccacggtgatgatgccggtctaatgcttccaccaaggattgcacccattcaggttataatagtacctatatggaaaaagggtgatgagaagtctgctgttctggaagctgtagattcagttcaaaaaatactcaaagaagcaggaatcagagttaaagtggatgactcagagctgcggactcctggatggaagttcaaccattatgagatgaaaggggttcctgtaagaatagagattggtcctcgtgatgtcacaaataagagtgttgtggtttctaggcgtgatgtcccaggaaagcaaggaaaggagtttggagtgtctatggagccatctatattggtgaaccatataaagggtcgtctagatgacatacaagcatcccttttacagaaggccatcacattccgtgatagcaacattgtcgatgtaaactcatacggagagctgaaggacgctatttctgaaggaaagtgggctagaggtccttggtcagctagcgatgctgatgagctgaaagtgaaagaagagaccagcgccaccatcagatgctaccctttcgagcagcccgagggcaccaagaaatgcttcatgactggcaacccggcagaggaagtcgcaattttcgcaaagtcatactag

SEQ ID NO: 910 - protein, 530 aa, Sorghum bicolor
  misc_feature: Ceres ANNOT ID no. 6011522
  misc_feature (464)..(530): Pfam Id: ProRS-C_1 Pfam Desc: Prolyl-tRNA synthetase, C-terminal
  misc_feature (335)..(438): Pfam Id: HGTP_anticodon Pfam Desc: Anticodon binding domain
  misc_feature (92)..(267): Pfam Id: tRNA-synt_2b Pfam Desc: tRNA synthetase class II core domain (G, H, P, S and T)
  misc_feature (1)..(530): NCBI GI: 34365755 NCBI Desc: at5g52520 [arabidopsis thaliana]
  misc_feature (1)..(530): NCBI GI: 32140557 NCBI Desc: prolyl-trna synthetase [raphanus sativus]
  misc_feature (154)..(530): NCBI GI: 115470733 NCBI Desc: os07g0165000 [oryza sativa (japonica cultivar-group)]
  misc_feature (53)..(530): NCBI GI: 76260501 NCBI Desc: prolyl-trna synthetase, archael and euk type [chloroflexus aurantiacus j-10-fl]
  misc_feature (53)..(530): NCBI GI: 118047443 NCBI Desc: prolyl-trna synthetase [chloroflexus aggregans dsm 9485]
  misc_feature (49)..(530): SWISSPROT Homolog: EC 6.1.1.15 Prolyl-tRNA synthetase
MASLLRLPSLLSPSKGPLLRRRLPAARLAASAASRGQASAAAETRGGDREGQVTPRSADFNAWYTDVIAAAELADYGPVRGTMVIRPYGYAIWEAIQDYLNVKFKETGHSNMYFPQFIPYSFIEKEASHVEGFSPELALVTIGGGKELEEKLVVRPTSETIVNHMFTKWIHSYRDLPLMINQWANVTRWEMRTKPFIRTLEFLWQEGHTAHATLEEAEKEAMQMIDVYTKFAYEHAAIPVIPGRKSKVETFAGANRTYTIEAMMGDKKALQAGTSHNLGQNFSRAFGTQFMDENGQIEHVWQTSWAISTRFVGGIIMTHGDDAGLMLPPRIAPIQVIIVPIWKKGDEKSAVLEAVDSVQKILKEAGIRVKVDDSELRTPGWKFNHYEMKGVPVRIEIGPRDVTNKSVVVSRRDVPGKQGKEFGVSMEPSILVNHIKGRLDDIQASLLQKAITFRDSNIVDVNSYGELKDAISEGKWARGPWSASDADELKVKEETSATIRCYPFEQPEGTKKCFMTGNPAEEVAIFAKSY

SEQ ID NO: 911 - DNA, 4230 bp, Sorghum bicolor
  misc_feature: Ceres ANNOT ID no. 6011523
  misc_feature: Encodes the peptide sequence at SEQ ID NO 912
  misc_feature: Up-regulated in root tissues in response to methyl jasmonate treatment
atggctgcgccctcgccttcgaccgcgcccgctccgtcctcctcagcgtcggcggcggcggtggtcttcgccgtgaacggcgagcgggtggagctccgcgagggggacgtggaccccggcgccaccctcctcgagttcctccgcacccgcacccgcttcaccgggcccaagctcggctgcggcgaaggcggatgcggcgcgtgcgtggtgctgctctcctcgtacgacgcggcgtcgggcgcggtgtcgcacgcggcggcgagctcctgcctcacgctggtgcacgggctccaccaccgcgccgtcaccaccaccgaggggctcgggggcggccggggcagcggacgcctccacgccgtgcacgagcgcctcgcggggttccacgccacgcagtgcggcttctgctcgcccggggtgtgcatgtccctcgccgcggcgctcgcgggcgccgaggccaaggccagggcggggaggaggcccgagcccgacgacgacccgcccgaggggttcgcgaggctcacggcggctgaggcggagcgggcggtggcgggcaacctctgccgctgcacggggtaccgcccgatcgccgatgcctgcaagagcttcgcggccgacgtggatttggaggacctgggcctcaactccttctggaggaaaggggacgcccatgcttccaagctgccgcggtacgacgaggggagcatcggtgtgttcccggagttccttaaggctgagatcagagcttcttctggggttgatgacctgtacacgccgccggcattggtcggaagtgccagcacttggcaccggcctcggagcgtggaggagtactataagctggtaggttctgagttgtttggcgaaagtagaacaaaggtggttgtgggaaacaccgcttcaggcgtttacagagaaacagatgtgtatgataggtacattgacctcagatgcatcccagagctgaattcggttaataaggaagccaatggtgttcacattggagctgcagtaccgatttctcaggcaattgagattttaagagtagaagctggtggctgcaatgatgtgatattctgtaagattgctgatcatatggaaaaagtggcttctccatttgttcggaacaccgcaagtttgggtggaaatttgataatggcacagagggaccagtttgcctctgacgttgcaacgatcctccttgctgctggttcatcaatatgcatccaggcatcatcaaaaaggttgactgtcacgttggagaacttccttcagatgccaccttgtgatcacaagacactgctattaaacatttacattcctcggtggactctcattggtggcttatctggtggtaaaaccatggatgggacagtaagtaaaataggaacttctgtgctatttgagacgtaccgagctgctccacgccctcttggcaatgcagtcgcatatcttaattcggctttcttggctcaagtctcttcagatgaaacttcaagcagcttagtattgacagagctatgtctggcttttggtgcgtatgggagccaacacgccatcagggctaggaatattgagaaactgttagtgggtaaacctattactgcatcggtgctacttgaagcatgtagacttctcaaggaaacaattgttcctaaagaaggcacaaggcatgctgcttataggtcaagcttggcagttgcctttctgtttagttttctttacccagtaactgaaggaactttgaagcctgtaaaggcagttcatcttaatggctatgtaacttctggcactaacggaaatccaaattgtggacccgatgcggatgttgatgtttcacttaagaagatcaatgatgtgaactctggttcatgtaccaatgatcgcattcttgaatattcaaaccagattattgaaatcaataaagactatctccctgttggcataccaaccaagaaagttggagcagaactccaaacctctggtgaggccgtatttgtggatgacatccccgctcccaaggactgtgtttatggagcatttatatatagcacaaaacctttagcccatgtgaagagcataaaactcgacctttcactcgagcagcttaaaacgctggaagtagttactgttaaggatattccggaaggtggcagcaatgttggggccaacactatatttggacctgaacctctgtttggtgatccagttactcagtgtgcaggggaacctcttggtgttgtgattgcagaaacacaaagatttgccaatatagctgcaaaaagagctgttattgactacagtactgagaacttagatgctccaattttatccatagaggaggctgttaaaaggtgcagttattttgaaaccccaccgtttcttcttcctcagaaaattggtgatttctcaaaaggaatggcagaagcagatcagaaaatctcctctgaggttaaacttaattctcagtactacttttacatggaaacacaagctgctctggcaatacccgatgaggataactgtttggtagtgtatagctcaagccaatgccccgagacagcacagaatgtcattgcaaagtgccttggtttaccttgtcacaatgttcgtgttattaccagaagagttggtggtggatttggaggaaaagctgttagatcattacctgtggcaactgcgtgtgcgcttgcagcatttaagttgtgtcgtcctgtccgtatgtatcttgaccgcaagactgacatgatagtgactggaggtcggcatcccatgaaaatatgctattcagtgggattcaaatcagatgggaaaatcactgctttgcatatagatttgttcataaatgcaggaatgacaaaagatgttagcctcataatccctcataatttcattgaggcactgaagaaatataattggggtgctttttcttatgaagcaaagatctgtaaaacaaacattgctacaaagtctgcgatgcgggggcctggggaagtacaaggttcttatgttgccgaagctataattgagcatgttgcttccacgctctccgctgatgctaatttggttagacataaaaatcttcacacggttgagagccttgctttgttccatagtgagtgctctgaagatgccatgggctatactcttcgctctatatgcgatcaagtgactgcatcagaaaactatcagcatcggcttgaaacaatccagtctttcaacaaaaacaacaaatggaaaaagagaggcctctcttttgtgccaatagtacacaaagtattatctcgaccgacacctggaaaagtgtctattcttaatgatgggtctattgctgttgaagttggaggcattgagttaggccaggggctttggacaaaagtgaagcagatggcagcgtttggtcttggacaactctgtcctgatcgaagtcaagagctgttggagagaataagagttattcaagcggatacattaagtaatgtacaaggagggtggaccacagggagtaccacatcagaatctagctgtgaagcagttcgtctcgcatgctatgtcttggtcgacaggctgaagccagtcaaggagcaatttcaagaaaagcaaggcaatgtttcatgggacgaacttatttccaaggccataatggttggtgtgaacttatcagcacgagaatactacattcctggtccttctggttcctacctaaactatggggctgctgctagtgaggtagagattgatcttctcactggggcctccacaattgtacgaagtgatcttatatatgactgtggccagagcttaaaccccgctgtggacttgggacaggttgaaggggcatttgttcaaggaatcggctatttcatgactgaggaatatgtcaccaactcagatggattgcttatctctgacgggacttggacatacaagatcccaactgtggacaccatcccaaagcagtttaatgtgaagttacttaacagtggatttcacaagaaacgcgtgctctcttcaaaagcatctggggagccaccattgcttcttgcagcttcagtgcactgcgcaacaagagaagcaatcagagctgcaaggaatgaaccacactgctctgggtttggaccttcaccatcccattttgatttggaagttcctgccatcatgcccgtggtgaaggaactgtgcggcttggacaacgtagagaggtacctgcagagcctgccgagttccgaatga

SEQ ID NO: 912 - protein, 1409 aa, Sorghum bicolor
  misc_feature: Ceres ANNOT ID no. 6011523
  misc_feature (781)..(1317): Pfam Id: Ald_Xan_dh_C2 Pfam Desc: Aldehyde oxidase and xanthine dehydrogenase, molybdopterinbinding domain
  misc_feature (264)..(442): Pfam Id: FAD_binding_5 Pfam Desc: FAD binding domain in molybdopterin dehydrogenase
  misc_feature (468)..(581): Pfam Id: CO_deh_flav_C Pfam Desc: CO dehydrogenase flavoprotein C-terminal domain
  misc_feature (104)..(201): Pfam Id: Fer2_2 Pfam Desc: [2Fe-2S] binding domain
  misc_feature (660)..(770): Pfam Id: Ald_Xan_dh_C Pfam Desc: Aldehyde oxidase and xanthine dehydrogenase, a/b hammerheaddomain
  misc_feature (23)..(96): Pfam Id: Fer2 Pfam Desc: 2Fe-2S iron-sulfur cluster binding domain
  misc_feature (465)..(1404): NCBI GI: 75298566 NCBI Desc: probable aldehyde oxidase 2 (ao-2)
  misc_feature (465)..(1404): NCBI GI: 115455835 NCBI Desc: os03g0790900 [oryza sativa (japonica cultivar-group)]
  misc_feature (465)..(1404): NCBI GI: 75298567 NCBI Desc: probable aldehyde oxidase 3 (ao-3)
  misc_feature (497)..(1408): NCBI GI: 2589162 NCBI Desc: aldehyde oxidase [zea mays]
  misc_feature (465)..(1408): NCBI GI: 115481080 NCBI Desc: os10g0138100 [oryza sativa (japonica cultivar-group)]
  misc_feature (630)..(1403): SWISSPROT Homolog: EC 1.2.3.14 Abscisic-aldehyde oxidase
  misc_feature (629)..(1403): SWISSPROT Homolog: EC 1.2.3.1 Aldehyde oxidase 4
  misc_feature: Up-regulated in root tissues in response to methyl jasmonate treatment
MAAPSPSTAPAPSSSASAAAVVFAVNGERVELREGDVDPGATLLEFLRTRTRFTGPKLGCGEGGCGACVVLLSSYDAASGAVSHAAASSCLTLVHGLHHRAVTTTEGLGGGRGSGRLHAVHERLAGFHATQCGFCSPGVCMSLAAALAGAEAKARAGRRPEPDDDPPEGFARLTAAEAERAVAGNLCRCTGYRPIADACKSFAADVDLEDLGLNSFWRKGDAHASKLPRYDEGSIGVFPEFLKAEIRASSGVDDLYTPPALVGSASTWHRPRSVEEYYKLVGSELFGESRTKVVVGNTASGVYRETDVYDRYIDLRCIPELNSVNKEANGVHIGAAVPISQAIEILRVEAGGCNDVIFCKIADHMEKVASPFVRNTASLGGNLIMAQRDQFASDVATILLAAGSSICIQASSKRLTVTLENFLQMPPCDHKTLLLNIYIPRWTLIGGLSGGKTMDGTVSKIGTSVLFETYRAAPRPLGNAVAYLNSAFLAQVSSDETSSSLVLTELCLAFGAYGSQHAIRARNIEKLLVGKPITASVLLEACRLLKETIVPKEGTRHAAYRSSLAVAFLFSFLYPVTEGTLKPVKAVHLNGYVTSGTNGNPNCGPDADVDVSLKKINDVNSGSCTNDRILEYSNQIIEINKDYLPVGIPTKKVGAELQTSGEAVFVDDIPAPKDCVYGAFIYSTKPLAHVKSIKLDLSLEQLKTLEVVTVKDIPEGGSNVGANTIFGPEPLFGDPVTQCAGEPLGVVIAETQRFANIAAKRAVIDYSTENLDAPILSIEEAVKRCSYFETPPFLLPQKIGDFSKGMAEADQKISSEVKLNSQYYFYMETQAALAIPDEDNCLVVYSSSQCPETAQNVIAKCLGLPCHNVRVITRRVGGGFGGKAVRSLPVATACALAAFKLCRPVRMYLDRKTDMIVTGGRHPMKICYSVGFKSDGKITALHIDLFINAGMTKDVSLIIPHNFIEALKKYNWGAFSYEAKICKTNIATKSAMRGPGEVQGSYVAEAIIEHVASTLSADANLVRHKNLHTVESLALFHSECSEDAMGYTLRSICDQVTASENYQHRLETIQSFNKNNKWKKRGLSFVPIVHKVLSRPTPGKVSILNDGSIAVEVGGIELGQGLWTKVKQMAAFGLGQLCPDRSQELLERIRVIQADTLSNVQGGWTTGSTTSESSCEAVRLACYVLVDRLKPVKEQFQEKQGNVSWDELISKAIMVGVNLSAREYYIPGPSGSYLNYGAAASEVEIDLLTGASTIVRSDLIYDCGQSLNPAVDLGQVEGAFVQGIGYFMTEEYVTNSDGLLISDGTWTYKIPTVDTIPKQFNVKLLNSGFHKKRVLSSKASGEPPLLLAASVHCATREAIRAARNEPHCSGFGPSPSHFDLEVPAIMPVVKELCGLDNVERYLQSLPSSE

SEQ ID NO: 913 - DNA, 915 bp, Sorghum bicolor
  misc_feature: Ceres ANNOT ID no. 6011525
  misc_feature: Encodes the peptide sequence at SEQ ID NO 914
atgaacattcatatttcacaggattcctttgagctccctcggcgggactcctcaagagatgcggacattgaaatgggaatgcatcaggctgatgcttcagacaacttaaaggatttcttgaagaaggtcgatgcaattgagagtttaattgcaaagctgacaaatctattgaataagctccagactgcaaatgaggaatccaaagcagttacaaaagcaagttccatgaaagcaattaagcagcggatggagaaagatattgatgaagtggggaaaattgctcgtcaggcaaagacaaaagttgatgaactggaaaaagataacttattgaataggcaaaaacctggatgtggaaagggttctgccgtggaccgatcaagagagcagactactggagcagtaaaaaagaaattgaaggagcggatggatgattttcagaccttgagagaagcaatcaggcaagagtatcgggaggttgttgaaagaagggtttttactgtaactggtaatcgtcctgatgaagagacaattgatgatttgatagagactggaaaaagtgagcaaatattcaaagatgctatccaacatcagggaagaggccagatactggacacagttgctgaaatacaggagcgacatgatgctgtaagggatctagagaggaagcttttggagttgcaacagatattcatggacatggcagttcttgttgaggctcaaggagacatgatcaacaacatcgagacacatgtctcgaacgccaccaatcacatacagcaaggtgtgaccgcactccagagcgcgaagaaactgcagaagaattcgaggaagtggatgtgctatgccatcatcctactgctggtgatagtggtggtcattgtcgtcgcggtcatccagccatggaagaagggctag

SEQ ID NO: 914 - protein, 304 aa, Sorghum bicolor
  misc_feature: Ceres ANNOT ID no. 6011525
  misc_feature (211)..(273): Pfam Id: SNARE Pfam Desc: SNARE domain
  misc_feature (35)..(142): Pfam Id: Syntaxin Pfam Desc: Syntaxin
  misc_feature (1)..(302): NCBI GI: 8346545 NCBI Desc: syntaxin-like protein [arabidopsis thaliana]
  misc_feature (8)..(272): NCBI GI: 115315688 NCBI Desc: syntaxin [nicotiana benthamiana]
  misc_feature (5)..(202): NCBI GI: 115472479 NCBI Desc: os07g0528900 [oryza sativa (japonica cultivar-group)]
  misc_feature (9)..(303): NCBI GI: 4206787 NCBI Desc: syntaxin-related protein nt-syr1 [nicotiana tabacum]
  misc_feature (35)..(301): NCBI GI: 42572385 NCBI Desc: syntaxin 121 (syp121) / syntaxin-related protein (syr1) [arabidopsis thaliana]
MNIHISQDSFELPRRDSSRDADIEMGMHQADASDNLKDFLKKVDAIESLIAKLTNLLNKLQTANEESKAVTKASSMKAIKQRMEKDIDEVGKIARQAKTKVDELEKDNLLNRQKPGCGKGSAVDRSREQTTGAVKKKLKERMDDFQTLREAIRQEYREVVERRVFTVTGNRPDEETIDDLIETGKSEQIFKDAIQHQGRGQILDTVAEIQERHDAVRDLERKLLELQQIFMDMAVLVEAQGDMINNIETHVSNATNHIQQGVTALQSAKKLQKNSRKWMCYAIILLLVIVVVIVVAVIQPWKKG

SEQ ID NO: 915 - DNA, 1890 bp, Sorghum bicolor
  misc_feature: Ceres ANNOT ID no. 6011527
  misc_feature: Encodes the peptide sequence at SEQ ID NO 916
atgagagcacctagcagtggcaaaaagagtgagacctcccatggcatgaagtgtggggtctctgatcaagcttgtcatggcaaatgccaaagctgtgacattgctgcaaaacctatttgttctggagtggatggagtctcctcgttgactggtagtcatactgatgtgaaggcctcaaaagagaactgtggagcatgcagtctgaacaatgatcgtgctgattctttagaagaagaggtaaagggttccacagcgaggataggtcatgttgagagtgctgatcctgatggctgtgtggatgtaaaaaaggaaagtttcatggctgttgatgatctaccacaggagtttgagggggagcaagttggggcaacactggaggatctgtttttctttaatggtgaagaggaagatgacagtgattgggaacctgctagtcgccttgttgaggatagatggttttgctttaactgcacaatgccgattgtggaccagattacacattgcatgaattgccgtgagcttaaggaatctgcagtagatggatatgatgttttcaaaaaacaaattgcacagacagctttgttatctgccgacacagagttgctgccagtatctacagcgattggttttgatgaaagaatgctgctccacagtgagctagaagttaaaccaaatccgcatccagaaagaccggatcgccttcgcgccattgctgcaagtcttgctgctgcagggatctttccctcaaaatgtgctttggtacctcctcgagaaatcacgaaggaggaactccttatggttcatagtccagaccacattgaaagtgtcgagcagacaaagaacatgctttacagttacttcacttcggatacttatgcaaatggacattcagcatgtgctgccaaacttgcagctggattatgtgctgatcttgctagtttgatggtatctgggcgtgttcgtaatggttttgctctggtaagacctcctgggcatcatgcaggggtgaagcaagcaatgggtttttgtcttcacaacaatgcagcagtggctgctttagctgcaaaaagagcaggtgccaagaaagtcctcatagttgactgggatgtgcaccatggaaatggcacacaagagatattcgaaggggataaaacagtcttgtacatatcattacatcgtcatgaggatggaaacttttaccctggaactggagcagctcatgaggtgggagttctggatggtcaaggattctcagttaatataccttggagccgtggtggtgttggagacaatgactacatctttgcttttcagactgtggtgcttccaatagctgcagagtttgccgcagacatcactataatatctgcaggattcgatgcagctagaggtgaccctctaggtggttgtgatgtcactccagttggatactcttggatgacatccctgctagctgattgctcaaatggaagattgttggtgatacttgagggaggatacaatctccagtcgatatcctcatcagctactgaagttgttaaggtcctacttggggatggtccaaatcgtgcttcatttgtaggttcaccatcaagagaggccttgaagactgtttctcaagtcctgaagattcaacaacgattttggccagttttaggtccaacatatgcatcactacaggcacagcaggggtcggtttcttccaatcatatcaccaaacgtaatgagctgaagaaaaggaagcattcaggaggattagggcccttctggtggaagttgggaagcaaaaggcttctgtacgaagcgctttttgagcaccgtcgtcagaggaaaatcaaggggtccggagaaggaaaagcaactggtttcagcagtaccttagatgggtag

SEQ ID NO: 916 - protein, 629 aa, Sorghum bicolor
  misc_feature: Ceres ANNOT ID no. 6011527
  misc_feature (205)..(518): Pfam Id: Hist_deacetyl Pfam Desc: Histone deacetylase domain
  misc_feature (1)..(615): NCBI GI: 22135463 NCBI Desc: histone deacetylase hda110 isoform 1 [zea mays]
  misc_feature (107)..(615): NCBI GI: 22135467 NCBI Desc: histone deacetylase hda110 isoform 3 [zea mays]
  misc_feature (214)..(615): NCBI GI: 22135469 NCBI Desc: histone deacetylase hda110 isoform 4 [zea mays]
  misc_feature (214)..(617): NCBI GI: 109716222 NCBI Desc: histone deacetylase hdac4 [triticum aestivum]
  misc_feature (134)..(603): NCBI GI: 18401915 NCBI Desc: histone deacetylase family protein [arabidopsis thaliana]
MRAPSSGKKSETSHGMKCGVSDQACHGKCQSCDIAAKPICSGVDGVSSLTGSHTDVKASKENCGACSLNNDRADSLEEEVKGSTARIGHVESADPDGCVDVKKESFMAVDDLPQEFEGEQVGATLEDLFFFNGEEEDDSDWEPASRLVEDRWFCFNCTMPIVDQITHCMNCRELKESAVDGYDVFKKQIAQTALLSADTELLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLMVSGRVRNGFALVRPPGHHAGVKQAMGFCLHNNAAVAALAAKRAGAKKVLIVDWDVHHGNGTQEIFEGDKTVLYISLHRHEDGNFYPGTGAAHEVGVLDGQGFSVNIPWSRGGVGDNDYIFAFQTVVLPIAAEFAADITIISAGFDAARGDPLGGCDVTPVGYSWMTSLLADCSNGRLLVILEGGYNLQSISSSATEVVKVLLGDGPNRASFVGSPSREALKTVSQVLKIQQRFWPVLGPTYASLQAQQGSVSSNHITKRNELKKRKHSGGLGPFWWKLGSKRLLYEALFEHRRQRKIKGSGEGKATGFSSTLDG

SEQ ID NO: 917 - DNA, 2829 bp, Sorghum bicolor
  misc_feature: Ceres ANNOT ID no. 6011528
  misc_feature: Encodes the peptide sequence at SEQ ID NO 918
  misc_feature: Up-regulated in shoot tissues in response to methyl jasmonate treatment
  misc_feature: Up-regulated in root tissues in response to methyl jasmonate treatment
atgccggcggcggcgccgacgcccaaggcggtggtgcaccagcggttcggcgccaaggcgcggtacacggtggaggaggtgcgggaggccgtgggcggctgcccgggcctcgcgccgcagaccaggagcgtctaccgctgcgcgctcgacctcccgggcctctccgtcgccacgcctggcaccttcctcaggaagaaggacgccgagcaggccgccgcgcagatcgcgctcgacaagcttggtattcagcccacggcaaatattcccagtacaccccaagaagcttgggatgaactgattgctcgcatatctggttttttcatagatgagagcttcctatcatctacccatcctcttgttggccacttgtgtgtgactctcaggagaactggagatctcattgggaggatacctctgccggctattgctgcatgtgatgtgaaggtcaatacattgtgtaaagtgattgaccatagggcagaatttgatcctctcttgattttgtcattgatgtacaatgctgcgaaacaatctcctggagtctctgttagtgacagaaacttctggattcagagtgaaaagccctattctacggaggctgttgacttggcacttgagcgttggtctggtacaacacatcccgtagaagtagaagcgattcttgttcctcacgtgttggaggatgaactgaagacagtaagaattaatctacaagataatgaacattatatgagttatgttgcagcagagctctcagcaagtgattcctctcatgttcttgtatcgagaacaattggaaaagcatcctcagagataaggctgtattttgcagccccaaatatacatgttgtttctgatatatcaaaaaatgtgcttgcttgtcatggagatggtgacatcaactggcaagtaaataagcgagcttcctatatttgtggccaaacaatttatggagatgcactcttggcaaatatcggatacacaaggagagattcgaaacttcaaactgaagatgtcaatctatgtacctattacaggatacttctgggcaagttacctgatggaaattgtaagatgtctagggactcaattcttgcagcggagcttccatctgcatactctcgttttagttggaaaggcctctctccacgagatctcctttgctcattttgtcgccttcagaggttgccagagccccagtttgctgtcagtaggatctcctatgatacgttaatgtcagctgtgagctctgaagaaagaggagcaccagcaggcagtgtagaaaatcagtacaccaatgatgtcaggatcaacaaggaaaacccagatctttttaaatgtgaagtgaacatacgttcacggaagcaagagcttttactagagtattctgcagctgacacttggagcaaggaatctgatgctattcagaatgctgcattgaaggtcttgatttggttcaatgattattttaagaaactaacctcaaaaacagacaaactttatctttttgactgtactgatggtgtcaagatacattcaaatatttttctgcaagagtttgcaatgtgcctatctgtttatggcaagaccagaggcaatgattcagcaatgtgcagtgcagttggaccattttctatggatacacaaaagaagcgccttgagagcactgcaaagttaacacacattgagggtccggactctggtgttttcccgtcccacggatcattgacttgtataagttatactgcttcccttgtgacgaaggataaagcaaaaacatatttgttggagagccgcaatgagtttgagtttgagattgggacgggtgctgttagtaatcagcttgaatcatgtgtaactcagctgtcagtgaatcaaactgcacgttttgtagctgaactgcctcctagggatttaatcatggctgcagcttttgaggtctcgcatgacctctctaatgtatctatcgagaactgcttcctggagttcactgtaaaggttctgcaggtaactgaacccttagaagatagaatggagaaagccttgttcagtcctccattatctaaacaaagagttgaatttgctgtacggcacatcaacgagctgcacgctaccacacttgttgattttggctgtggatctggtagccttcttgattcattgttagagcatccaaccacgctagaaaagcttgtcggtgttgatatttctcgaaaaggactcacacgtgcagcaaagagccttcatcagaagctgagcaagaaatcgatgatgcagacaaatgttccaactgctgtgctctatgacggatcaataatggaatatgattctcgcttatatgggttcgatattggcacttgtcttgaggtgatcgaacacgttgaggaggaccaagcaactttatttggcaacgtcgtcttgagctcattccgcccaacggtgctcattgtttccacacccaactacgaatacaaccctatcctccaggggtcagctatgcccagcaaggatgacgaggcagacgaaagcgttggtccctgcaagttccgcaatcacgaccacaagttcgagtggaccagggcacagttccagtgctgggctactggcctcgcggtgaagcataactacagcgtggaattctctggcgtcggtggctcaggcgaggaaccaggctacgcttcccagatcgctgttttcagaagaatgatgcaggggcacgaagcaatgtgcctggacaaaggtggtgatcaaccttacgagcttctctgggagtggcctaacgcgtgtgaggagaaggagatcggcactgactgtgaactaggagtctag

SEQ ID NO: 918 - protein, 942 aa, Sorghum bicolor
  misc_feature: Ceres ANNOT ID no. 6011528
  misc_feature (708)..(816): Pfam Id: Methyltransf_12 Pfam Desc: Methyltransferase domain
  misc_feature (409)..(928): NCBI GI: 115470715 NCBI Desc: os07g0164000 [oryza sativa (japonica cultivar-group)]
  misc_feature (6)..(933): NCBI GI: 15638615 NCBI Desc: hen1 [arabidopsis thaliana]
  misc_feature (6)..(933): NCBI GI: 13241746 NCBI Desc: corymbosa2 [arabidopsis thaliana]
  misc_feature (683)..(930): NCBI GI: 55962591 NCBI Desc: novel protein [danio rerio]
  misc_feature (679)..(932): NCBI GI: 55958244 NCBI Desc: novel protein (flj30525) [homo sapiens]
  misc_feature: Up-regulated in shoot tissues in response to methyl jasmonate treatment
  misc_feature: Up-regulated in root tissues in response to methyl jasmonate treatment
MPAAAPTPKAVVHQRFGAKARYTVEEVREAVGGCPGLAPQTRSVYRCALDLPGLSVATPGTFLRKKDAEQAAAQIALDKLGIQPTANIPSTPQEAWDELIARISGFFIDESFLSSTHPLVGHLCVTLRRTGDLIGRIPLPAIAACDVKVNTLCKVIDHRAEFDPLLILSLMYNAAKQSPGVSVSDRNFWIQSEKPYSTEAVDLALERWSGTTHPVEVEAILVPHVLEDELKTVRINLQDNEHYMSYVAAELSASDSSHVLVSRTIGKASSEIRLYFAAPNIHVVSDISKNVLACHGDGDINWQVNKRASYICGQTIYGDALLANIGYTRRDSKLQTEDVNLCTYYRILLGKLPDGNCKMSRDSILAAELPSAYSRFSWKGLSPRDLLCSFCRLQRLPEPQFAVSRISYDTLMSAVSSEERGAPAGSVENQYTNDVRINKENPDLFKCEVNIRSRKQELLLEYSAADTWSKESDAIQNAALKVLIWFNDYFKKLTSKTDKLYLFDCTDGVKIHSNIFLQEFAMCLSVYGKTRGNDSAMCSAVGPFSMDTQKKRLESTAKLTHIEGPDSGVFPSHGSLTCISYTASLVTKDKAKTYLLESRNEFEFEIGTGAVSNQLESCVTQLSVNQTARFVAELPPRDLIMAAAFEVSHDLSNVSIENCFLEFTVKVLQVTEPLEDRMEKALFSPPLSKQRVEFAVRHINELHATTLVDFGCGSGSLLDSLLEHPTTLEKLVGVDISRKGLTRAAKSLHQKLSKKSMMQTNVPTAVLYDGSIMEYDSRLYGFDIGTCLEVIEHVEEDQATLFGNVVLSSFRPTVLIVSTPNYEYNPILQGSAMPSKDDEADESVGPCKFRNHDHKFEWTRAQFQCWATGLAVKHNYSVEFSGVGGSGEEPGYASQIAVFRRMMQGHEAMCLDKGGDQPYELLWEWPNACEEKEIGTDCELGV

SEQ ID NO: 919 - DNA, 2877 bp, Sorghum bicolor
  misc_feature: Ceres ANNOT ID no. 6011534
  misc_feature: Encodes the peptide sequence at SEQ ID NO 920
atggcgctcgcgcgcccgtcctccgcgctcctctcctgctcctcctccgcctgcatccgccgcctcaacccgctcctcctctccgcctgccgccgcccggcgtgggccccgcgccgcgccgcccgcaggttctgcgcagcgattgcctccgagacggatgtgttcacctccccggagatcgcgaagtcgttcgacttcaccaacgaggagcgcatctacaagtggtgggaatctcagggattctttaagcctaactttgaccgcggaggagatccatttgtcatcccgatgccaccaccaaatgttaccggatcactacatatgggccatgctatgtttgtcacccttgaggatataatggttagatatttccgaatgaaagggagacctgcactctggatacctggcactgaccatgctgggattgcgactcagttggttgtggaaaagatgctggccgctgaaggtgtcaagaggacagatatgacacgagaggagttcaccaaaaaagtttgggagtggaaagagaaatatgggggcactatcactaatcagattaggcgattgggtgcatcttgtgattggagtcgtgaacgtttcactcttgatgaacaattgagtcgtgcagttgttgaagcatttgttagactccatgataaagggcttatatatcaaggatcttatttggtcaattggtctcctaacctgcaaactgcagtatctgatttagaagtagaatactctgaagaacctggaaatttgtacttcatcaagtaccgggttgctggcggaaccagagatgattttatgactattgcgaccacaagacctgaaactctatttgctgatgttgcaattgctgttaacccacaggataagcgttatgcccaatatgttggcaaattggctattgtaccgttgacatgtgggaggcatgtacctattattgctgaccggtatgttgatccagaattcgggactggggtgctgaagattagccctggacatgatcataatgattatcatattgctcgaaagcttgggctgccaattcttaatgttatgaacaaagatggtacactaaatgatgttgctggaatatacagtggtatggatcgatttgaggcccgagaaaagttgtggtctgaccttgttgagactaacttggcagtaaagaaagaactttatacacttcgagtccctaggtctcaacggggtggtgaagtgattgagcctttgattagtaagcaatggtttgttacgatggagccattggctgaaaaggctctccatgctgttgaaaatgggcaattaaccattcttccggagagatttgagaagatatataatcattggctaacaaacataaaggattggtgtataagtagacaattgtggtggggtcattgtataccagtttggtatattgttggaaagaaatgtgaagaagactatattgttgctagaactgaagaggaggcacttgcaaaagctcaggaaaaatatggaaaatcagttgaaatatatcaagaccctgatgttcttgatacttggttctcaagcacacttggttggcctgatctttccaaggaggattataagcatttttatccttcaactgttctggagacaggccatgacattttgttcttctgggttgcacgaatggtcatgatgggaattgagtttacaggatcagtaccattttcttatgtctatcttcatggccttatccgggacgctgagggtcgaaaaatgtcgaagacattggggaatgtcattgatcccctagataccatcaaagattatggcacagatgctttgagatttacactatctttgggcactgcagggcaggacctcaatctctctatagaaaggttgacatcaaataaggctttcacaaacaagctgtggaacgcaggcaaatttttgttgcagaatttgcctgataaaagtgatgtctcggcatgggatgtcttgttagcaaataagttcgactcagaagcatcactccagaaactgccattgccagaatgctgggtggttacaggactacatgaactcattgataaggtcagcagaagctatgacaagtttttttttggagatgctgctagagaaatatatgatttcttctggggggattttgctgattggtatattgaagctagcaaaacacggctttaccactcaagtgacaagttcgctgctgctacagcccagagcgttctggtgtatgtgtttgaaaacatactgaagttattgcatcccttcatgccatttgtgactgaagaattatggcaggcatttccatacagaaaacaagcacttatggttactccctggcctaccactggccttcctaaggatttgaggtccatcaaaaggttccagaatttgcaatcattgataagaggaatcagaaatgttcgagcagaatattctgttgagccagctaaacggatatcagcttctgttgttgctactgcagatgtcctggaatatgtatcgaaggagaagcaggtcctagctttactttcaaagcttgacgttcagaatgtaaattttactgaatcagcaccaggtgatgcaaaccagtcggttcacattgttgctgatgagggtttggaggcctatctacctttggctgatatggttgacgtgtctgaagaggttaagcggctctccaagcgcctctctaagatgcaatcagagtatgatgctcttgttgcacgcctcaattcccctagttttgtagaaaaggcccctgaagatattgttcgtggagttcgtgaaaaagcgtctgaggcagacgagaagatctctctaactaagaatcgtcttgcttttctccaatcaaccatctccacttaa

SEQ ID NO: 920 - protein, 958 aa, Sorghum bicolor
  misc_feature: Ceres ANNOT ID no. 6011534
  misc_feature (71)..(624): Pfam Id: tRNA-synt_1 Pfam Desc: tRNA synthetases class I (I, L, M and V)
  misc_feature (679)..(828): Pfam Id: Anticodon_1 Pfam Desc: Anticodon-binding domain
  misc_feature (93)..(629): Pfam Id: tRNA-synt_1g Pfam Desc: tRNA synthetases class I (M)
  misc_feature (2)..(957): NCBI GI: 42567891 NCBI Desc: trna synthetase class i (i, l, m and v) family protein [arabidopsis thaliana]
  misc_feature (49)..(447): NCBI GI: 9755723 NCBI Desc: valine--trna ligase-like protein [arabidopsis thaliana]
  misc_feature (50)..(950): NCBI GI: 118062857 NCBI Desc: valyl-trna synthetase [roseiflexus castenholzii dsm 13941]
  misc_feature (58)..(950): NCBI GI: 106892432 NCBI Desc: valyl-trna synthetase [roseiflexus sp. rs-1]
  misc_feature (69)..(950): NCBI GI: 113938120 NCBI Desc: valyl-trna synthetase [herpetosiphon aurantiacus atcc 23779]
  misc_feature (69)..(642): SWISSPROT Homolog: EC 6.1.1.9 Valyl-tRNA synthetase
MALARPSSALLSCSSSACIRRLNPLLLSACRRPAWAPRRAARRFCAAIASETDVFTSPEIAKSFDFTNEERIYKWWESQGFFKPNFDRGGDPFVIPMPPPNVTGSLHMGHAMFVTLEDIMVRYFRMKGRPALWIPGTDHAGIATQLVVEKMLAAEGVKRTDMTREEFTKKVWEWKEKYGGTITNQIRRLGASCDWSRERFTLDEQLSRAVVEAFVRLHDKGLIYQGSYLVNWSPNLQTAVSDLEVEYSEEPGNLYFIKYRVAGGTRDDFMTIATTRPETLFADVAIAVNPQDKRYAQYVGKLAIVPLTCGRHVPIIADRYVDPEFGTGVLKISPGHDHNDYHIARKLGLPILNVMNKDGTLNDVAGIYSGMDRFEAREKLWSDLVETNLAVKKELYTLRVPRSQRGGEVIEPLISKQWFVTMEPLAEKALHAVENGQLTILPERFEKIYNHWLTNIKDWCISRQLWWGHCIPVWYIVGKKCEEDYIVARTEEEALAKAQEKYGKSVEIYQDPDVLDTWFSSTLGWPDLSKEDYKHFYPSTVLETGHDILFFWVARMVMMGIEFTGSVPFSYVYLHGLIRDAEGRKMSKTLGNVIDPLDTIKDYGTDALRFTLSLGTAGQDLNLSIERLTSNKAFTNKLWNAGKFLLQNLPDKSDVSAWDVLLANKFDSEASLQKLPLPECWVVTGLHELIDKVSRSYDKFFFGDAAREIYDFFWGDFADWYIEASKTRLYHSSDKFAAATAQSVLVYVFENILKLLHPFMPFVTEELWQAFPYRKQALMVTPWPTTGLPKDLRSIKRFQNLQSLIRGIRNVRAEYSVEPAKRISASVVATADVLEYVSKEKQVLALLSKLDVQNVNFTESAPGDANQSVHIVADEGLEAYLPLADMVDVSEEVKRLSKRLSKMQSEYDALVARLNSPSFVEKAPEDIVRGVREKASEADEKISLTKNRLAFLQSTIST

SEQ ID NO: 921 - DNA, 1680 bp, Sorghum bicolor
  misc_feature: Ceres ANNOT ID no. 6011535
  misc_feature: Encodes the peptide sequence at SEQ ID NO 922
atggccacctccctcctccgcctctcccgcccccgccgcgcgctgccgctgctccccatctcctccctccgccaaccgctctccacccagtcccacgccccgtcccctaccccctcctccgcccgccgcctcccgcatttcctctccttcctcgccgccgctgccgccgccgccgccgccgggggagcaaccgtcgcgctctgcgactccggcctagaccaccaccgggtcggcggcaaggacagcaccgatctggtggttcgtggagagcggaagctcgtgccgcaggagttcatcgacgagctcgcgtccttcctcggggacaacatgactttggactacgaagagaggagcttccatggcacgccacaaaacagcttccacaaggcaatcaacgtgcctgatgtcgtcgtgttcccgagctcgcaagatgaggtacaaaagattgtgatggcctgtaacaagtacaaggttccaattgtaccatatggtggggctacctcaattgagggtcacacactggcacctcatggtggtgtttgcatcgacatgaccttgatgaagaaaatcaaatccctgaatgttgaggatatggacgtagttgttgaacctggagttggatggatagagctgaacgagtacctgaagccttatggcctattttttcctcttgatccaggaaaggcaccctggcctggggccaccattggaggaatgtgtgctactcgctgttctggttcattagctgtgaggtatggaacaatgcgggataatgtgattaatcttcgggctgttttgccaaatggtgatgttgtgaagacaggctcccgggctcgaaagagtgcagctgggtatgaccttgctcgtttgatcattgggagtgaaggaactttgggtgtaattacagaagtgactttacgactccaaaagcttccatctcattctgtggttgcaatgtgcaattttaaaacaattaaggatgctgctgatgttgctattgcaacaatgctttctgggatacaggtttcaagagtggaattgttggatgaggttcagataaaggcaataaacatggcaaatggcaaaaatttgcctgaagtgccgaccttgatgtttgaattcatagggacagaagcatatgctcttgaacaaactctcttggttcaaaaaattgccaacaaacaccatggatcagattttgtttttgttgaggagccagatgctaaagcggaattatggaagatcaggaaggaggcactttgggctggctttgctatgaaacctgattatgaagctatgatcacggatgtttgcgtccctctgtccagacttgctgaatgcatatctacatcaaagcgtctgcttgatgcgtcaccattgacttgtctggttattgctcatgctggtgatggaaattttcacacgattatcctgtttgatccaagtcaagacgaccaacaaaaggaagcagagagactaaaccatttcatggttgatacagctctgtctatggaaggtacatgcacaggagagcatggtgttggcacagggaaaatgaagtacctggagaaggagttgggcatcgagtcactgaggacgatgaaaagaataaagggtgcgttggatcccaacaacatcatgaatccgggaaagctgatcccacctcacgtctgcatatga

SEQ ID NO: 922 - protein, 559 aa, Sorghum bicolor
  misc_feature: Ceres ANNOT ID no. 6011535
  misc_feature (311)..(552): Pfam Id: FAD-oxidase_C Pfam Desc: FAD linked oxidases, C-terminal domain
  misc_feature (134)..(275): Pfam Id: FAD_binding_4 Pfam Desc: FAD binding domain
  misc_feature (4)..(558): NCBI GI: 15010680 NCBI Desc: at5g06580/f15m7_11 [arabidopsis thaliana]
  misc_feature (142)..(558): NCBI GI: 10178114 NCBI Desc: glycolate oxidase subunit d-like; d-lactate dehydrogenase-like [arabidopsis thaliana]
  misc_feature (91)..(552): NCBI GI: 118038600 NCBI Desc: fad linked oxidase-like [burkholderia phytofirmans psjn]
  misc_feature (91)..(552): NCBI GI: 94311856 NCBI Desc: fad linked oxidase-like protein [ralstonia metallidurans ch34]
  misc_feature (91)..(552): NCBI GI: 118701067 NCBI Desc: fad linked oxidase-like [burkholderia ambifaria mc40-6]
MATSLLRLSRPRRALPLLPISSLRQPLSTQSHAPSPTPSSARRLPHFLSFLAAAAAAAAAGGATVALCDSGLDHHRVGGKDSTDLVVRGERKLVPQEFIDELASFLGDNMTLDYEERSFHGTPQNSFHKAINVPDVVVFPSSQDEVQKIVMACNKYKVPIVPYGGATSIEGHTLAPHGGVCIDMTLMKKIKSLNVEDMDVVVEPGVGWIELNEYLKPYGLFFPLDPGKAPWPGATIGGMCATRCSGSLAVRYGTMRDNVINLRAVLPNGDVVKTGSRARKSAAGYDLARLIIGSEGTLGVITEVTLRLQKLPSHSVVAMCNFKTIKDAADVAIATMLSGIQVSRVELLDEVQIKAINMANGKNLPEVPTLMFEFIGTEAYALEQTLLVQKIANKHHGSDFVFVEEPDAKAELWKIRKEALWAGFAMKPDYEAMITDVCVPLSRLAECISTSKRLLDASPLTCLVIAHAGDGNFHTIILFDPSQDDQQKEAERLNHFMVDTALSMEGTCTGEHGVGTGKMKYLEKELGIESLRTMKRIKGALDPNNIMNPGKLIPPHVCI

SEQ ID NO: 923 - DNA, 1095 bp, Sorghum bicolor
  misc_feature: Ceres ANNOT ID no. 6011540
  misc_feature: Encodes the peptide sequence at SEQ ID NO 924
atgcccgccgcagtttcagccgccaccggcgtgtcacctccggcggcggccaacgtcgtcgtcgtcgaggacatctatggcttcctgcgcgtcctcagtgatggcaccatcctccggtcaccggagcaacccgtgttctgcccggccaccttccccagcagccacccgtcggtgcaatggaaggaggaagtctacgacaaggccaacaacctccgcgtccgcatgtacaagccgttgtccacggccgccggcggcggcggcgaggccgggaagaagctgccggtgctcgtccacttccacggcggcggcttctgccttggttcgtgcacgtgggcgaatgtgcacgcgtactgcctccgccttgccgcggaggccggcgccgtcgtgctctccgcggggtaccgcctcgcgcccgagcaccgcctccccacggcggtcgacgacggcgtgggtttcctgcggtggctgcgtgcgcagtccaccatggacgccgccgccgcggccgacggctggctcaccgaggccgccgacttcggccgcgtgttcgtcaccggcgactcggcgggcggcaacatagcgcaccacctcgccgtgcgcgccggcctgtcggacaccaagcgcggcgaggtcgacctcgacctcgacctccgcccggtgacggtccgcggctacgtcctcctgatgccgttcttcggcggcgtccggcggacgccgtcggaggccgagtgccccgcggaggtgctgctgaacctggacctgttcgaccggttctggcggctgtcgctgccggccggcggcaccagggaccacccggcggcgaacccgttcgggccggacagccccgagctgggctcggtggacttccgggcgccggtcctggtggtggtcggtggcctcgacatgatgcgcgaccgcgccgtcgactacgccgagcggctggcggcgatgggcaagcccgtggagctcgtcgagttcgcgggcaagccccacgggttctacctgcacgagccggggtccgaggccaccggcgagctgatcggcctcgtcagccgattcctgcacagttgcgcttgcgatcgaggcgcggttgcttga

SEQ ID NO: 924 - protein, 364 aa, Sorghum bicolor
  misc_feature: Ceres ANNOT ID no. 6011540
  misc_feature (96)..(334): Pfam Id: Abhydrolase_3 Pfam Desc: alpha/beta hydrolase fold
  misc_feature (1)..(357): NCBI GI: 115470703 NCBI Desc: os07g0162700 [oryza sativa (japonica cultivar-group)]
  misc_feature (23)..(358): NCBI GI: 82697949 NCBI Desc: cxe carboxylesterase [malus pumila]
  misc_feature (89)..(353): NCBI GI: 82697963 NCBI Desc: cxe carboxylesterase [actinidia deliciosa]
  misc_feature (21)..(332): NCBI GI: 82697961 NCBI Desc: cxe carboxylesterase [actinidia deliciosa]
  misc_feature (34)..(200): NCBI GI: 82697957 NCBI Desc: cxe carboxylesterase [actinidia eriantha]
MPAAVSAATGVSPPAAANVVVVEDIYGFLRVLSDGTILRSPEQPVFCPATFPSSHPSVQWKEEVYDKANNLRVRMYKPLSTAAGGGGEAGKKLPVLVHFHGGGFCLGSCTWANVHAYCLRLAAEAGAVVLSAGYRLAPEHRLPTAVDDGVGFLRWLRAQSTMDAAAAADGWLTEAADFGRVFVTGDSAGGNIAHHLAVRAGLSDTKRGEVDLDLDLRPVTVRGYVLLMPFFGGVRRTPSEAECPAEVLLNLDLFDRFWRLSLPAGGTRDHPAANPFGPDSPELGSVDFRAPVLVVVGGLDMMRDRAVDYAERLAAMGKPVELVEFAGKPHGFYLHEPGSEATGELIGLVSRFLHSCACDRGAVA

SEQ ID NO: 925 - DNA, 981 bp, Sorghum bicolor
  misc_feature: Ceres ANNOT ID no. 6011543
  misc_feature: Encodes the peptide sequence at SEQ ID NO 926
atgtcgtcgtcgcccacgccggcggcaggcacggcggcggcaccacacgtcgtcgaggactgcctcggcttcgtgcagctgctcagcgacggcacggtgaggcgctccacggactactccatgctccgtcccactggccgcgtgccgtcggactcggaccttcccgtgcagtggaaggacgtggtgtacgacgacgcgcacggcctccgcctccgcatgtaccggcccaccaacgccggagccacgaagaagaagctgccggtgctcgtctacttccacggcggcggcttctgcctcctcagcttcgagatgaccagcttccacgccgccgcgctccggctcgccgccgagctcccggcgctcgtgctctccgcggactaccgcctggcgccggagcaccgcctccccgcggcgctggacgacgccgagtccgtcttctcctggctccgcgcccaggccatggcggacccgtggctcgccgggtcggccgacttcgcccgggtgttcgtcaccggccactcggccggcggcaacatctcgcaccacgtcgccgtgcgcctcgccgggtgcgtgatgctgtggccctacttcggcggcgaggagccgacgccgtcggaggcggcgtgcccggcggaccaggtcatgggcccggcgctgttcgaccagatgtggcgcctggcgctgccggcgggcgcgaccaaggaccacccgttcgcgaacccgttcgcgccggggagcgtccagctcggcgacctcggcgcggcgttcccgccggtgctcgtcgtggaccccgaccaggacccgctgcacgaccgcgtggtggactacgtcgccaggctgaaggcggccgggaaggacgtcgagctcgtcgtgttcgcggggcaggggcaggggcatgggttcttcgccacggagccgtgcggtgaggccgccgacgagctgatccagtggtcagttatggatccgaacaacctccgctaa

SEQ ID NO: 926 - protein, 326 aa, Sorghum bicolor
  misc_feature: Ceres ANNOT ID no. 6011543
  misc_feature (89)..(303): Pfam Id: Abhydrolase_3 Pfam Desc: alpha/beta hydrolase fold
  misc_feature (8)..(189): NCBI GI: 115470703 NCBI Desc: os07g0162700 [oryza sativa (japonica cultivar-group)]
  misc_feature (6)..(316): NCBI GI: 82697963 NCBI Desc: cxe carboxylesterase [actinidia deliciosa]
  misc_feature (11)..(315): NCBI GI: 82697949 NCBI Desc: cxe carboxylesterase [malus pumila]
  misc_feature (17)..(316): NCBI GI: 5487873 NCBI Desc: prmc3 [pinus radiata]
  misc_feature (17)..(316): NCBI GI: 82697935 NCBI Desc: cxe carboxylesterase [malus pumila]
MSSSPTPAAGTAAAPHVVEDCLGFVQLLSDGTVRRSTDYSMLRPTGRVPSDSDLPVQWKDVVYDDAHGLRLRMYRPTNAGATKKKLPVLVYFHGGGFCLLSFEMTSFHAAALRLAAELPALVLSADYRLAPEHRLPAALDDAESVFSWLRAQAMADPWLAGSADFARVFVTGHSAGGNISHHVAVRLAGCVMLWPYFGGEEPTPSEAACPADQVMGPALFDQMWRLALPAGATKDHPFANPFAPGSVQLGDLGAAFPPVLVVDPDQDPLHDRVVDYVARLKAAGKDVELVVFAGQGQGHGFFATEPCGEAADELIQWSVMDPNNLR

SEQ ID NO: 927 - DNA, 1323 bp, Sorghum bicolor
  misc_feature: Ceres ANNOT ID no. 6011549
  misc_feature: Encodes the peptide sequence at SEQ ID NO 928
atggcgaccgacggcggcgagaagggcagcagcggccacgcggcggcggagtggcggttcgcgcgggcggcggcggccaaggaggagggcgcgctggccgtggccggggacaagatgagcatccgggcggcgcggttcaagatcagcgcgagcgtggacgcgcgcgacccgcggcccgtgctgccgctggcgcacggggacccctcggtgttcccggccttccgcaccgccgccgaggccgaggacgccgtggccgccgcgctccggaccggcaagttcaactgctaccccgccggcgtcggcctccccgacgcccgccgtgctctggcggagcacctgtcaagtgatcttccatacaagctgtcaactgatgacatcttcctcactgctggaggcactcaagcaattgaggttgtcgtctcagtgcttgctcaaccgggcaccaacatattgctcccaagaccaggctatccaaattatgaggcgcgtgcagggctgcacaacttagaagttcgtcgtttcgatctgattcctgaaagaggctgggaaattgatatcgactctctcgagtcgattgctgacaagaacaccactgcaatggtcatcataaaccccaacaatccttgcgggagtgtctatacccatgaacatttagccaaggtcgcggaggtagcaaggaagcttggaatcctagtcatcgctgatgaagtatatggaaatctggtgtttggggacacccctttcgtccccatgggtgtctttggccacattgcccctgtgttgagcataggatcactatcaaagagatggatagtgcctgggtggcgacttggttgggtagctgtatgtgatcccaacaagattctgctaaacacaaagatcattgcatcgatcacaaacttccttaacatttcaactgatccagcaacttttattcagggagcacttccccatattcttgagaacacaaaggaagattttttcaagaggatcattggtctgctagcggaaacatcagagatatgttacagagaaataaaggacatcaagtgcatcacttgccctcacaagccagaaggttccatgtttgtcatggtgaaattaaatttgtatcttctggaagggatccatgatgatattgatttttgctgcaagctggcaaaagaagagtccgtgattttgtgtccagggagtgttttgggaatggaaaactggatccgtatcactttcgccattgattcatcttctcttcttgatggtcttgagaggatcaaatctttctgccaaaggcataagaagaagaatttgcttaatggtcattaa

SEQ ID NO: 928 - protein, 440 aa, Sorghum bicolor
  misc_feature: Ceres ANNOT ID no. 6011549
  misc_feature (58)..(424): Pfam Id: Aminotran_1_2 Pfam Desc: Aminotransferase class I and II
  misc_feature (68)..(317): Pfam Id: Beta_elim_lyase Pfam Desc: Beta-eliminating lyase
  misc_feature (2)..(439): NCBI GI: 6498122 NCBI Desc: nicotianamine aminotransferase a [hordeum vulgare subsp. vulgare]
  misc_feature (2)..(439): NCBI GI: 6469090 NCBI Desc: nicotianamine aminotransferase [hordeum vulgare subsp. vulgare]
  misc_feature (2)..(435): NCBI GI: 6469089 NCBI Desc: nicotianamine aminotransferase [hordeum vulgare subsp. vulgare]
  misc_feature (2)..(435): NCBI GI: 6469087 NCBI Desc: nicotianamine aminotransferase b [hordeum vulgare subsp. vulgare]
  misc_feature (211)..(433): NCBI GI: 115485877 NCBI Desc: os11g0552000 [oryza sativa (japonica cultivar-group)]
  misc_feature: The sequence is a functional homolog of SEQ ID NO. 526 in the 11/188,298 US application
  misc_feature: The sequence is a functional homolog of SEQ ID NO. 286 in the 11/188,298 US application
  misc_feature: The sequence is a functional homolog of SEQ ID NO. 527 in the 11/188,298 US application
MATDGGEKGSSGHAAAEWRFARAAAAKEEGALAVAGDKMSIRAARFKISASVDARDPRPVLPLAHGDPSVFPAFRTAAEAEDAVAAALRTGKFNCYPAGVGLPDARRALAEHLSSDLPYKLSTDDIFLTAGGTQAIEVVVSVLAQPGTNILLPRPGYPNYEARAGLHNLEVRRFDLIPERGWEIDIDSLESIADKNTTAMVIINPNNPCGSVYTHEHLAKVAEVARKLGILVIADEVYGNLVFGDTPFVPMGVFGHIAPVLSIGSLSKRWIVPGWRLGWVAVCDPNKILLNTKIIASITNFLNISTDPATFIQGALPHILENTKEDFFKRIIGLLAETSEICYREIKDIKCITCPHKPEGSMFVMVKLNLYLLEGIHDDIDFCCKLAKEESVILCPGSVLGMENWIRITFAIDSSSLLDGLERIKSFCQRHKKKNLLNGH

SEQ ID NO: 929 - DNA, 1308 bp, Sorghum bicolor
  misc_feature: Ceres ANNOT ID no. 6011552
  misc_feature: Encodes the peptide sequence at SEQ ID NO 930
atggcgacccacggcggcgagaacggcagcgggcacgcggcggcggagtggcggttcgcgcgggcggcggcggccaaggacgtggccggggcggacaagatgagcatccgggcggcgcggttcaagatcagcgcgagcgtggacgcgcgcgacccgcggcccgtgctgccgctggcgcacggggacccctccgtgttcccggccttccgcaccgccgccgaggccgaggacgccgtggccgccgcgctccggaccggcaagttcaactgctaccccgccggcgtcggcctccccgacgcccgccgtgctctggcggagcacctgtcaagtgatcttccatacaagctgtcaactgatgacatcttcctcactgctggaggcactcaagccattgaggttgtcgtctcagtccttgcccaaccgggcaccaacatattgctcccaagaccaggctatccaaattatgaggcgcgtgcagggctgcacaacttagaagttcgtcgtttcgatctgattcctgaaagaggctgggaaatcgatatcgactctctggagtcgattgctgacaagaacaccaccgcaatggtcatcataaaccccaacaatccttgcgggagtgtctatacccatgaacatttagcaaaggtcgcggaggtagcaaggaagcttggaatactagtcatcgctgatgaagtatatggaaatctggtgtttggggacacccctttcgtccccatgggtgtctttggccacattgcccctgtgttgagcataggatcactatcaaagagatggatagtgcctgggtggcgacttggttgggtagctgtatgtgatcccaacaagattctgctaaacacaaagatcattgcatccatcacaaacttccttaacatttcaactgacccagcaacttttgttcagggagcacttccccatattcttgagaacacaaaggaagattttttcaagaggatcattggtctgctagcggaaacatcagagatatgttacagagaaataaaggacatcaagtgcatcacttgccctcacaagccagaaggttccatgtttgtcatggtgaaattaaatttgtatcttttggaagggatcaatgatgatattgatttttgctgcaagctggcaaaagaagagtccgtgattttgtgtccagggagtgtattgggaatggaaaattggatccgtatcactttcgccattgattcatcttctcttcttgatggtcttgagaggatcaaatctttctgccgaaggcataagaagaagaatttgcttaatggccattaa

SEQ ID NO: 930 - protein, 435 aa, Sorghum bicolor
  misc_feature: Ceres ANNOT ID no. 6011552
  misc_feature (53)..(419): Pfam Id: Aminotran_1_2 Pfam Desc: Aminotransferase class I and II
  misc_feature (27)..(312): Pfam Id: Beta_elim_lyase Pfam Desc: Beta-eliminating lyase
  misc_feature (2)..(434): NCBI GI: 6498122 NCBI Desc: nicotianamine aminotransferase a [hordeum vulgare subsp. vulgare]
  misc_feature (2)..(434): NCBI GI: 6469090 NCBI Desc: nicotianamine aminotransferase [hordeum vulgare subsp. vulgare]
  misc_feature (2)..(430): NCBI GI: 6469089 NCBI Desc: nicotianamine aminotransferase [hordeum vulgare subsp. vulgare]
  misc_feature (2)..(430): NCBI GI: 6469087 NCBI Desc: nicotianamine aminotransferase b [hordeum vulgare subsp. vulgare]
  misc_feature (206)..(428): NCBI GI: 115485877 NCBI Desc: os11g0552000 [oryza sativa (japonica cultivar-group)]
  misc_feature: The sequence is a functional homolog of SEQ ID NO. 526 in the 11/188,298 US application
  misc_feature: The sequence is a functional homolog of SEQ ID NO. 286 in the 11/188,298 US application
  misc_feature: The sequence is a functional homolog of SEQ ID NO. 527 in the 11/188,298 US application
MATHGGENGSGHAAAEWRFARAAAAKDVAGADKMSIRAARFKISASVDARDPRPVLPLAHGDPSVFPAFRTAAEAEDAVAAALRTGKFNCYPAGVGLPDARRALAEHLSSDLPYKLSTDDIFLTAGGTQAIEVVVSVLAQPGTNILLPRPGYPNYEARAGLHNLEVRRFDLIPERGWEIDIDSLESIADKNTTAMVIINPNNPCGSVYTHEHLAKVAEVARKLGILVIADEVYGNLVFGDTPFVPMGVFGHIAPVLSIGSLSKRWIVPGWRLGWVAVCDPNKILLNTKIIASITNFLNISTDPATFVQGALPHILENTKEDFFKRIIGLLAETSEICYREIKDIKCITCPHKPEGSMFVMVKLNLYLLEGINDDIDFCCKLAKEESVILCPGSVLGMENWIRITFAIDSSSLLDGLERIKSFCRRHKKKNLLNGH

SEQ ID NO: 931 - DNA, 1101 bp, Sorghum bicolor
  misc_feature: Ceres ANNOT ID no. 6011557
  misc_feature: Encodes the peptide sequence at SEQ ID NO 932
atggacgcgggggcgtcggcggcgcagatggagaagcactcgtcggcggcggccttcgtggagggcggcgtccaggacgcgtgcgacgacgcctgcagcatctgcctcgaggccttctccgacagcgacccatccgcggtgaccagctgcaggcacgagttccacctccagtgcatccttgagtggtgccagagaagctcccagtgccccatgtgttggcaagcaatcagcatgaaggaccctatgagccaagagctccttgaggctgtcgaggaagagcggaacgcacaagaaaatcatgcgcgcaccacaaccattttccgtcatccactgctcggagactttgaggtaccggtggatgcagatgatgctgaaattgaggagcgtatcttacagcacttggctgctgctgccgccattcgtaggtcgcaccgccatgctagaagagaaggccgtcgcagcaggtctgcagctcatggtcatggccatcaacaagtcctgttctttccagctgctggtgaagccactcctggtggttctctgtcttcacgttcacagcaagaaggggaccatgaacatgcctctactgtagtttcttctccgccattgcctaccgtggactctgcagaagaaacagctgcagacatacctgtgaatcacactgcctcggttaatagccctccagttgggtcaaatgatagtgtttcttggaatcagtcttcgcctgtcaaccaagatgaagctggaccatctgaagcgcagtcattctcagacacgatcaaatctcggctgcagtcagtttctacaaagtacaaggattccataacgaaaagtacacgcgggtggaaggaaaggtggttcacacagaacagcaccatatcgaaccttggctcagagatgaggagggaggtcaatgctgggatcgctgccgtgtcacgcatgatggagaaactggagacacgggatggaacaggaccgtcgtctgcttccccagctaatctgcatcctggttcagatgcagatagtcaaggagctgtcgtcgttccccttccccctacagctgcaactgctttacataacgcctcgtcttcaacagcttga

SEQ ID NO: 932 - protein, 366 aa, Sorghum bicolor
  misc_feature: Ceres ANNOT ID no. 6011557
  misc_feature (32)..(72): Pfam Id: zf-C3HC4 Pfam Desc: Zinc finger, C3HC4 type (RING finger)
  misc_feature (11)..(366): NCBI GI: 87240562 NCBI Desc: zinc finger, ring-type [medicago truncatula]
  misc_feature (1)..(334): NCBI GI: 30688252 NCBI Desc: zinc finger (c3hc4-type ring finger) family protein [arabidopsis thaliana]
  misc_feature (27)..(189): NCBI GI: 121489747 NCBI Desc: ring-h2 zinc finger protein precursor [phillyrea latifolia]
  misc_feature (14)..(156): NCBI GI: 30682750 NCBI Desc: zinc finger (c3hc4-type ring finger) family protein [arabidopsis thaliana]
  misc_feature (14)..(156): NCBI GI: 7268127 NCBI Desc: ring-h2 finger protein rhf1a [arabidopsis thaliana]
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 329 in the 11/188,298 US application
  misc_feature: The sequence is a functional homolog of SEQ ID NO. 468 in the 11/188,298 US application
MDAGASAAQMEKHSSAAAFVEGGVQDACDDACSICLEAFSDSDPSAVTSCRHEFHLQCILEWCQRSSQCPMCWQAISMKDPMSQELLEAVEEERNAQENHARTTTIFRHPLLGDFEVPVDADDAEIEERILQHLAAAAAIRRSHRHARREGRRSRSAAHGHGHQQVLFFPAAGEATPGGSLSSRSQQEGDHEHASTVVSSPPLPTVDSAEETAADIPVNHTASVNSPPVGSNDSVSWNQSSPVNQDEAGPSEAQSFSDTIKSRLQSVSTKYKDSITKSTRGWKERWFTQNSTISNLGSEMRREVNAGIAAVSRMMEKLETRDGTGPSSASPANLHPGSDADSQGAVVVPLPPTAATALHNASSSTA

SEQ ID NO: 933 - DNA, 1416 bp, Sorghum bicolor
  misc_feature: Ceres ANNOT ID no. 6011571
  misc_feature: Encodes the peptide sequence at SEQ ID NO 934
atgggcagcggcgccctcccactgctcttcctcctcgtcctctccctcgcagccgccaccaccgtggcggcattggaagcggagcatcagagcccgcctgcattgtcgtccccatccaccgccggcggcggcggcggcggcggcggcggctcgggcgtgagctccaactccgtccttgtagcgctacttgactcgcgctacacggagctatccgagctagtagagaaggcgctgctgctgcagccgctggagaccgccgtgggcagaggcaacgtcactatcctggcgccccggaacgaggccctggagcgggacctggacccggagttccggcggttcctgcttgagccccgcaaccttccttccctccagtcgctgctcctcttccacgtcctccccgcccgcctccacgccgcctccctcctctcccgacgccaccaccccacgctcgccggcgagccgctggagctcgggcccgccgtgtcccgcgccgtgacgcggcccgacgcggtggtgcgcgcggacggcgtcatccacggcgtggaccgtctcctcgtcccgcgctccgtccaggacgccttcaaccgccgccgcagcctcgcgtcgtccatctccgccgcgctcccgaccggcgcccccgaggtggacccgcgcacgcaccgcctcctcaggaaactgagccccggacccgccccgccgctgggtgccccgccggcgctccctgtctgggacgcgatggcacccggcccatccatcgcgccggcgccggcgccgggtccaggcaccgggacgcaccgcttcgacgggcacgggcaggtgaaggacttcatccagacgctcctcctctacggcgggtacaacgagctggccgacatcctcgtgaacctcacctcgctcgccaccgagatgggccgcctcgtctccgaagggtacgtcctcaccgtgctggcccccaacgacgaggccatggcgcggctcaccacggaccagctcagcgagccggggtcgccggagaacatcctgtactaccacgtgatcccggagtaccagaccgaggagtccatgtacaacgccgtccggcggttcggcaaggtccggtacgacacgctgcggctgccgcataaggtcaccgcccgcgaggccgacgggtccgtcaagttcggcgccggcgagggcagcgcgtacctcttcgacccggatatctacaccgacggtaggatctccgtgcagggcatcgacgccgtgctgttcccgccggccgagatcggcgggacgcgccccgccgctgtcgccgctcccacctggaaggcgcccgccgtcactggtggcgccgacaagcccaagctccgacgagggaagctgttggaaggggcttgccagttgatgggcgtcttcgtcgggcgatcgcggctgtga

SEQ ID NO: 934 - protein, 471 aa, Sorghum bicolor
  misc_feature: Ceres ANNOT ID no. 6011571
  misc_feature (66)..(187): Pfam Id: Fasciclin Pfam Desc: Fasciclin domain
  misc_feature (285)..(418): Pfam Id: Fasciclin Pfam Desc: Fasciclin domain
  misc_feature (11)..(468): NCBI GI: 33146739 NCBI Desc: gpi-anchored protein -like [oryza sativa (japonica cultivar-group)]
  misc_feature (1)..(471): NCBI GI: 115349938 NCBI Desc: fasciclin-like protein fla27 [triticum aestivum]
  misc_feature (16)..(469): NCBI GI: 115349934 NCBI Desc: fasciclin-like protein fla25 [triticum aestivum]
  misc_feature (4)..(471): NCBI GI: 115349936 NCBI Desc: fasciclin-like protein fla26 [triticum aestivum]
  misc_feature (36)..(465): NCBI GI: 56121932 NCBI Desc: at5g06390 [arabidopsis thaliana]
  misc_feature: Useful for making plants with altered cell wall content and/or composition
  misc_feature: Functional homolog of the protein sequence encoded by LOCUS at3g52370
  misc_feature: Useful for making plants with altered carbohydrate content
  misc_feature: Functional homolog of the protein sequence given in SEQ ID NO 14043
  misc_feature: Useful for making plants with altered cell wall content and/or composition
  misc_feature: Functional homolog of the protein sequence given in SEQ ID NO 14044
MGSGALPLLFLLVLSLAAATTVAALEAEHQSPPALSSPSTAGGGGGGGGGSGVSSNSVLVALLDSRYTELSELVEKALLLQPLETAVGRGNVTILAPRNEALERDLDPEFRRFLLEPRNLPSLQSLLLFHVLPARLHAASLLSRRHHPTLAGEPLELGPAVSRAVTRPDAVVRADGVIHGVDRLLVPRSVQDAFNRRRSLASSISAALPTGAPEVDPRTHRLLRKLSPGPAPPLGAPPALPVWDAMAPGPSIAPAPAPGPGTGTHRFDGHGQVKDFIQTLLLYGGYNELADILVNLTSLATEMGRLVSEGYVLTVLAPNDEAMARLTTDQLSEPGSPENILYYHVIPEYQTEESMYNAVRRFGKVRYDTLRLPHKVTAREADGSVKFGAGEGSAYLFDPDIYTDGRISVQGIDAVLFPPAEIGGTRPAAVAAPTWKAPAVTGGADKPKLRRGKLLEGACQLMGVFVGRSRL

SEQ ID NO: 935 - DNA, 663 bp, Sorghum bicolor
  misc_feature: Ceres ANNOT ID no. 6011573
  misc_feature: Encodes the peptide sequence at SEQ ID NO 936
atggccgatggccagccggcgccgccacggccggtggtggtggtggcgatgaaaggccacccggggtccggcaagtccacggcggcgcgcgccatcgcggccgcgcttggttggccgctgctggacaaagacgatgtcagggactgcacgctgcccctcgagggcttggctgctgcagggatcctcaacgacctctcctacgccgtgctgtggcggatggctgagcgccaggtacggctcggtctgtctgtcgtcatcgactccccgctgtcgcgccgcgctcaccttgatgctctgacacgcctggctggtgcgcttgtcgtcgtcgtggagtgccgccctggtgataacgaggagtggcgccggaggctggagagccgtggggcggctgtcccaaatggtggtggcagtgatggatggcataagccgaagacgtgggccgagctggagaggcttctggaagggtaccaaggctgcacggactatgagattggggatgtgccgaggattgtggtggatacaactgatccggcggttgatgcgcaggcgatagctgagaaggttgtgggtttcattaggtcccttctttcttgtagccaatcatcttgtgagagacaggattcacctgtctgctattggaaaccaaaatgtacattaacttaa

SEQ ID NO: 936 - protein, 220 aa, Sorghum bicolor
  misc_feature: Ceres ANNOT ID no. 6011573
  misc_feature (21)..(193): Pfam Id: SKI Pfam Desc: Shikimate kinase
  misc_feature (1)..(132): NCBI GI: 83592585 NCBI Desc: kinase-like [rhodospirillum rubrum atcc 11170]
  misc_feature (17)..(127): NCBI GI: 29894436 NCBI Desc: atp-binding protein (p-loop) [bacillus cereus atcc 14579]
  misc_feature (17)..(127): NCBI GI: 118476394 NCBI Desc: abc transporter, atp-binding protein [bacillus thuringiensis str. al hakam]
  misc_feature (17)..(133): NCBI GI: 30267723 NCBI Desc: shy8 [streptomyces hygroscopicus subsp. yingchengensis]
  misc_feature (11)..(190): NCBI GI: 118737919 NCBI Desc: kinase-like [dinoroseobacter shibae dfl 12]
MADGQPAPPRPVVVVAMKGHPGSGKSTAARAIAAALGWPLLDKDDVRDCTLPLEGLAAAGILNDLSYAVLWRMAERQVRLGLSVVIDSPLSRRAHLDALTRLAGALVVVVECRPGDNEEWRRRLESRGAAVPNGGGSDGWHKPKTWAELERLLEGYQGCTDYEIGDVPRIVVDTTDPAVDAQAIAEKVVGFIRSLLSCSQSSCERQDSPVCYWKPKCTLT

SEQ ID NO: 937 - DNA, 1017 bp, Sorghum bicolor
  misc_feature: Ceres ANNOT ID no. 6011590
  misc_feature: Encodes the peptide sequence at SEQ ID NO 938
atggccgccgccgtcacagcaaccttccgcaccctgctccagcacgcagcggctggcggcgtccccgtcccgcttcccagcgttcggttccagagcctgcagcgccaccgcgtcggcctccgcctcctcgcgcccccgcgtgggcgccccgtcctactcccgcccgtcgccgccgccgcagccggcgaggaattctcttccgacggagaggattccaccggcgacgagtacttcgatgaggaagaggcctccgagtcggaggaagaagccgaggccccgcgcgcctactcgccgccacgaagccgcccgacgcgcggcgacgaccccggccggctcttcgtcggcaaccttccctatacctatacctctgaggagctcgcccaggtcttcgctgaggccggcagggtcgacgacgcgcagataatctatgacaaggtcaccaacaggagccggggctttgccttcgtcaccatggccaccgccgaggaggctgccaaggccatccagatgttcgacggcgctctgctgggagggaggaccgctagggtgaactacccggaggtgccgcgtggtggggagaggagaacggtcaccatggctggccgcaggcgtgacgatggcacatacaagatttatgccggcaacctggggtggggagtgcgtgccgacacattgaggaatgtgtttgagggtcgggccggcttgctcgacgccagggtcatctttgagcgtgagactggccgctccagagggttcgggttcgtctccttcaggacagcagaggatgcacaggctgcattggaggctttggatggagtggaactggaagggaggccacttcgacttagtctggcggaacagaatccaccacctggttccccgcctagtaatgcgcaggcacagcaggaagaaacagattcaggcgcatctgatgcagagacggaagtagtcagttcttcagaattatctgaagcagagttggacgagaacaacttgcagacagctgcaacttattaa

SEQ ID NO: 938 - protein, 338 aa, Sorghum bicolor
  misc_feature: Ceres ANNOT ID no. 6011590
  misc_feature (112)..(183): Pfam Id: RRM_1 Pfam Desc: RNA recognition motif. (a.k.a. RRM, RBD, or RNP domain)
  misc_feature (211)..(282): Pfam Id: RRM_1 Pfam Desc: RNA recognition motif. (a.k.a. RRM, RBD, or RNP domain)
  misc_feature (1)..(338): NCBI GI: 3550485 NCBI Desc: cp33hv [hordeum vulgare subsp. vulgare]
  misc_feature (59)..(319): NCBI GI: 17064758 NCBI Desc: ubiquitin / ribosomal protein cep52 [arabidopsis thaliana]
  misc_feature (59)..(319): NCBI GI: 681912 NCBI Desc: cp33 [arabidopsis thaliana]
  misc_feature (67)..(307): NCBI GI: 133249 NCBI Desc: 33 kda ribonucleoprotein, chloroplast precursor
  misc_feature (67)..(294): NCBI GI: 311952 NCBI Desc: 33 kd chloroplast ribonucleoprotein [nicotiana sylvestris]
  misc_feature: Useful for making plants with altered Lignin content
  misc_feature: Useful for making plants with altered cell wall content and/or composition
  misc_feature: Useful for making plants with altered terpenoid content
  misc_feature: GREAT-hit functional homolog of the protein sequence given in SEQ ID NO 12935
  misc_feature: Useful for making plants with altered cell wall content and/or composition
  misc_feature: Useful for making plants with altered lignin content
  misc_feature: Useful for making plants with altered terpenoid content
  misc_feature: Functional homolog of the protein sequence given in SEQ ID NO 12935
  misc_feature: The sequence is a functional homolog of SEQ ID NO. 339 in the 11/188,298 US application
  misc_feature: The sequence is a functional homolog of SEQ ID NO. 458 in the 11/188,298 US application
MAAAVTATFRTLLQHAAAGGVPVPLPSVRFQSLQRHRVGLRLLAPPRGRPVLLPPVAAAAAGEEFSSDGEDSTGDEYFDEEEASESEEEAEAPRAYSPPRSRPTRGDDPGRLFVGNLPYTYTSEELAQVFAEAGRVDDAQIIYDKVTNRSRGFAFVTMATAEEAAKAIQMFDGALLGGRTARVNYPEVPRGGERRTVTMAGRRRDDGTYKIYAGNLGWGVRADTLRNVFEGRAGLLDARVIFERETGRSRGFGFVSFRTAEDAQAALEALDGVELEGRPLRLSLAEQNPPPGSPPSNAQAQQEETDSGASDAETEVVSSSELSEAELDENNLQTAATY

SEQ ID NO: 939 - DNA, 1110 bp, Sorghum bicolor
  misc_feature: Ceres ANNOT ID no. 6011640
  misc_feature: Encodes the peptide sequence at SEQ ID NO 940
atgggggagatcaccaatgtcatggagtaccaggcgatcgcgaagcagaagcttccgaagatggcctacgactactacgcgtctggagctgaggacgagtggacgctaaaggagaacagggaggccttctccaggatcctgttccgtccacgcatactgatcgacgtgtccaagatcgacatgaccaccaccgtgctgggattcaagatctccatgcctatcatggttgcccccactgctatgcagaagatggctcacccagatggagagtacgccacagcacgcgccgcagctgcagcaggcactataatgacactgtcatcctgggcaacttcaagcgttgaggaggttgcctcaactggaccagggatccgattctttcagctctatgtctacaaggacaggaaagtggtggagcagcttgtgaggagagctgaaagggctgggttcaaggccatcgcgctcaccgtcgacaccccgcgcctcggccgcagggaggctgacatcaagaacagatttgttctgccaccacacctgacactgaagaacttcgaaggtctggacctcggcaaaatggaccaggcagctgattcagggctggcttcctacgtcgccggccaagtcgaccgcaccctgagctggaaagacgtcaagtggctgcagaccatcaccacgatgccgatcctcgtcaagggagtgatcaccgctgaagacacgaggcttgcggtggcgaacggcgcggcggggatcatcgtgtcgaaccacggcgcgcggcagctggactacgtgccggccaccatcagcgcgctggaggaggtcgtgaaggcggcccggggccagatccccgtcttcctcgacggaggcgtccgccgcggcaccgacgtcttcaaggcgctcgccctcggcgccgccggcgtattcgtcgggaggccggtggttttctccctggcggcggcgggcgaggccggggtgtccaacgtcctgcggatgctgcgggacgagttcgagctcaccatggcgctcagcggctgcacctccctcgccgacatcacccgcaaccacatcatcaccgagtccgacaggctccgcgtcatgccgtcgcgcttgtag

SEQ ID NO: 940 - protein, 369 aa, Sorghum bicolor
  misc_feature: Ceres ANNOT ID no. 6011640
  misc_feature (14)..(357): Pfam Id: FMN_dh Pfam Desc: FMN-dependent dehydrogenase
  misc_feature (3)..(369): NCBI GI: 27549566 NCBI Desc: glycolate oxidase [zantedeschia aethiopica]
  misc_feature (3)..(366): NCBI GI: 54043095 NCBI Desc: glycolate oxidase [brassica napus]
  misc_feature (3)..(366): NCBI GI: 7431428 NCBI Desc: (s)-2-hydroxy-acid oxidase (ec 1.1.3.15) - cucurbit
  misc_feature (3)..(366): NCBI GI: 217909 NCBI Desc: glycolate oxidase [cucurbita cv. kurokawa amakuri]
  misc_feature (3)..(363): NCBI GI: 16226772 NCBI Desc: at3g14420/moa2_2 [arabidopsis thaliana]
  misc_feature (3)..(360): SWISSPROT Homolog: EC 1.1.3.15 Peroxisomal (S)-2-hydroxy-acid oxidase
MGEITNVMEYQAIAKQKLPKMAYDYYASGAEDEWTLKENREAFSRILFRPRILIDVSKIDMTTTVLGFKISMPIMVAPTAMQKMAHPDGEYATARAAAAAGTIMTLSSWATSSVEEVASTGPGIRFFQLYVYKDRKVVEQLVRRAERAGFKAIALTVDTPRLGRREADIKNRFVLPPHLTLKNFEGLDLGKMDQAADSGLASYVAGQVDRTLSWKDVKWLQTITTMPILVKGVITAEDTRLAVANGAAGIIVSNHGARQLDYVPATISALEEVVKAARGQIPVFLDGGVRRGTDVFKALALGAAGVFVGRPVVFSLAAAGEAGVSNVLRMLRDEFELTMALSGCTSLADITRNHIITESDRLRVMPSRL

SEQ ID NO: 941 - DNA, 816 bp, Sorghum bicolor
  misc_feature: Ceres ANNOT ID no. 6011641
  misc_feature: Encodes the peptide sequence at SEQ ID NO 942
atgtcaggttcaccgccaaagccttgggagcgttctggagctgaaggaacatcaggcccagcacctttcaagcccccatctggtggaagcaccagcgatgttgttgaagcttctggtaccgctaaacctggcgaaaatgttactgcgacagagaggaatgtctctgctaatgtaaatagcactgtttcgaggcctgtgccacagcggccttggcagcagacaggctatggaaacacctatggaggatatggtggatctaacatgtatagttcatatggtggattcggtaacacttatggtagcggcgggctctatggaaatagcatgtactcgagttacggaggaggttatggtggtggcatgtacggtggtgggatgtatggaggaggcatgtatggtggtgggatgggaggttatggtggttacggcatgggcggaatgggtggtatgggtatgggtccatacggtaatcaggatccaaattcaatgggccctcctgcatccccgccaggtttctggatgtccttcctacgagtgatgcatggtgttgtcaatttcttcgggcgaatctcattccttgttgaacagaacactcaggcatcctattttttcatgacagcaatgctgcagctcttcgatcggtctggtatgctctatggtgaacttgcacggtttgtgttgcgtttgctaggagtcaaaagaaagccaaagaagggcagccttcagggacctcaaacgcaggcattcgagggacctagccaacagtttgtcgaggcaccaaaagcaaacaactgggacaacgtttggggaaactaa

SEQ ID NO: 942 - protein, 271 aa, Sorghum bicolor
  misc_feature: Ceres ANNOT ID no. 6011641
  misc_feature (4)..(222): NCBI GI: 111609730 NCBI Desc: peroxin 13 [penicillium chrysogenum]
  misc_feature (63)..(270): NCBI GI: 2498763 NCBI Desc: peroxisomal membrane protein pex13 (peroxin-13)
  misc_feature (33)..(171): NCBI GI: 29841163 NCBI Desc: similar to nm_079796 ribonuclear protein at 97d in drosophila melanogaster [schistosoma japonicum]
  misc_feature (21)..(207): NCBI GI: 20129941 NCBI Desc: cg4663-pa [drosophila melanogaster]
  misc_feature (3)..(171): NCBI GI: 116129863 NCBI Desc: ensangp00000000741 [anopheles gambiae str. pest]
MSGSPPKPWERSGAEGTSGPAPFKPPSGGSTSDVVEASGTAKPGENVTATERNVSANVNSTVSRPVPQRPWQQTGYGNTYGGYGGSNMYSSYGGFGNTYGSGGLYGNSMYSSYGGGYGGGMYGGGMYGGGMYGGGMGGYGGYGMGGMGGMGMGPYGNQDPNSMGPPASPPGFWMSFLRVMHGVVNFFGRISFLVEQNTQASYFFMTAMLQLFDRSGMLYGELARFVLRLLGVKRKPKKGSLQGPQTQAFEGPSQQFVEAPKANNWDNVWGN

SEQ ID NO: 943 - DNA, 2826 bp, Sorghum bicolor
  misc_feature: Ceres ANNOT ID no. 6011669
  misc_feature: Encodes the peptide sequence at SEQ ID NO 944
  misc_feature: Up-regulated in shoot tissues in response to methyl jasmonate treatment
atgcgcgaggaggtacggagctcgtcggcggcgccccccgacccgccgcccgggaggtcggcctcgccgccgcccacacccgtcgccagttctgctggtgcctcgtcgccccctgcacaaactaatgtagctagcatagattggcttggcagtgaccaagtgcccaaagcgggatcctctcatattgctccgccgacatctcagcctgcgcttagtactaacgctaatggagctgctgtggattgctttcagtcatcatgcagaccgtgggaacgaggtgacttgcttcgtcggctggctacatttaagccttctacttgggcttctaagccaaaggctgctagttcactggcttgtgctcgaagaggctgggtgaacattgacatggacaagattgaatgtgaatcttgtggtgcacatcttatatttactgctttgacatcctggtccccagctgaagttgcaagtgctggggaagcttttgctgagcagcttgatgcatcacacccgaatgattgtccctggagaggaaatagctgtgctgatagcttggtccagttccacctaaccccatcagctcttgttggtggctttaaagatcgctgtgatggattgttgcagttcacgtctcttcctgctattgccttatctgcaattgagagtatgaaactcactagaagcgttcaaattgatcgagtcttatcccagtcagttacaattttgtctggggagctgggctacagaacagacagtacaacgggaattgatattgtccaacaagatgaaacctgctgctactctcaagcacagaaacttattagcgtttgtggatgggagcctagatggcttcctaatgttcaagattgggaagagaattcaacccgctctgccagaaatgcaggcccagctgaaccagatggccaattccattctcaatttcctgagcatcatcaaaattcatactctgcgtcagttaagaaagacaaggggaaaggtaaaatgcgtgtcaaagattctggatgcagcatgagatcacctttgcttgattgcagcctatgtggagctacagtgagaatctgggacttcagatcagtgccacggccttctcattttagtctgaataacattgacatgcctgatactggaaggaagcctgtgttgatccgcggaattagtgctacaagtggtatcaatggactggttgctgaaggagcagagagagaaaatgttgagggacgtggtgaagcaggtattgatgagggtaagtctctgtcgaatgctcaagttgacttaaacctgacaatggcaggaggtttgccatcaaactattctgcattgccgccgatgcctggacatctcaattatggaggaatgggaagagatctagttattgggcaacccactggaagtgagcttggtggccatgcagcctcatttgaatctcggggccccagttcgagaaagcgtaacctggaggagggtgggagcacagctgacaagccaataaacaggcttcagcctgctgacagcattgagggaaccgtcattgaccgtgattgtgatgaagttgacgatgccgcacaggattctggtgctcggagcaaaaggcttcgtggttttaatctttttgatatcaatcgcccatcttcttcaggagctggtcccagcagaaacttaagtttggacctggatattgatgttaataagtttgatacatctaatgctgagggtccatctgcccttcacaacccatttccaaaggactctatgcgggcgtcttctgttattgcgatggacacagttcatggtatggaggaaaattcaatggagagtgttgaataccatccatgtgatgttgatgatgttaataagccttctagtgcaatcaggagcggtgtaatgagtgacacattggatctgaattatagcaaccaagcacagcaaagcagttttgtacagcctgctgctgaaactgaaagtaatgcaagggacataggagggagtagtatgaatggaggggaagaagtcctcaatgctgaaacaactcctgcatttgctagagatcaacttagcctgggagttagtggagggagtgtcgggatgggtgctagtcatgaagctgaaattcatgggactgatgtttctgagcataaaactggtagcgttgttggagatgctgatccagttcctgagctcattgagactatgggccacaccggtgagtcagcccctggacctgcattaatggatgagtttgtccctgaagaagttggtcgagaagatcctaacggtgatagccaagatatggcatctcggttagcagttcgagctgacagtggttctaaaatttgtggttcaactaaagctgattcagttgagagtggagagaagatgagtcgtgagaatagcgcacatccttctctttcttgcaacgcaagagtttattctggcattgatgcatcaaaagaggaagtgactggtataatgctaactaatgatgactatgatccaggaaatggtctaggagcaataaacgtagaaaatgattatgaaacagatcttccagactttgatccaatacggcaccacaacaattactgcccttgggtgaatggaaatgtcgctgctgcatgttgtattagtactggttcgagcacagctctttcaggctggcagctcacggtagatgccatcgagactttgcagtctcttggtcaagctcaaaaccagaacatgcagtcagactctgcagcttcattatataaggatgatcacgtcccacctagccggaagctgttgaaaagggcaaaccacagcaagagctga

SEQ ID NO: 944 - protein, 941 aa, Sorghum bicolor
  misc_feature: Ceres ANNOT ID no. 6011669
  misc_feature (89)..(216): Pfam Id: zf-C3HC Pfam Desc: C3HC zinc finger-like
  misc_feature (25)..(368): NCBI GI: 115438362 NCBI Desc: os01g0605600 [oryza sativa (japonica cultivar-group)]
  misc_feature (795)..(941): NCBI GI: 115455763 NCBI Desc: os03g0785300 [oryza sativa (japonica cultivar-group)]
  misc_feature (55)..(278): NCBI GI: 119604149 NCBI Desc: zinc finger, c3hc-type containing 1, isoform cra_f [homo sapiens]
  misc_feature (70)..(278): NCBI GI: 51094851 NCBI Desc: nuclear interacting partner of anaplastic lymphoma kinase (alk) [homo sapiens]
  misc_feature (55)..(278): NCBI GI: 29119637 NCBI Desc: nuclear interacting partner of alk [homo sapiens]
  misc_feature: Up-regulated in shoot tissues in response to methyl jasmonate treatment
MREEVRSSSAAPPDPPPGRSASPPPTPVASSAGASSPPAQTNVASIDWLGSDQVPKAGSSHIAPPTSQPALSTNANGAAVDCFQSSCRPWERGDLLRRLATFKPSTWASKPKAASSLACARRGWVNIDMDKIECESCGAHLIFTALTSWSPAEVASAGEAFAEQLDASHPNDCPWRGNSCADSLVQFHLTPSALVGGFKDRCDGLLQFTSLPAIALSAIESMKLTRSVQIDRVLSQSVTILSGELGYRTDSTTGIDIVQQDETCCYSQAQKLISVCGWEPRWLPNVQDWEENSTRSARNAGPAEPDGQFHSQFPEHHQNSYSASVKKDKGKGKMRVKDSGCSMRSPLLDCSLCGATVRIWDFRSVPRPSHFSLNNIDMPDTGRKPVLIRGISATSGINGLVAEGAERENVEGRGEAGIDEGKSLSNAQVDLNLTMAGGLPSNYSALPPMPGHLNYGGMGRDLVIGQPTGSELGGHAASFESRGPSSRKRNLEEGGSTADKPINRLQPADSIEGTVIDRDCDEVDDAAQDSGARSKRLRGFNLFDINRPSSSGAGPSRNLSLDLDIDVNKFDTSNAEGPSALHNPFPKDSMRASSVIAMDTVHGMEENSMESVEYHPCDVDDVNKPSSAIRSGVMSDTLDLNYSNQAQQSSFVQPAAETESNARDIGGSSMNGGEEVLNAETTPAFARDQLSLGVSGGSVGMGASHEAEIHGTDVSEHKTGSVVGDADPVPELIETMGHTGESAPGPALMDEFVPEEVGREDPNGDSQDMASRLAVRADSGSKICGSTKADSVESGEKMSRENSAHPSLSCNARVYSGIDASKEEVTGIMLTNDDYDPGNGLGAINVENDYETDLPDFDPIRHHNNYCPWVNGNVAAACCISTGSSTALSGWQLTVDAIETLQSLGQAQNQNMQSDSAASLYKDDHVPPSRKLLKRANHSKS

SEQ ID NO: 945 - DNA, 2838 bp, Sorghum bicolor
  misc_feature: Ceres ANNOT ID no. 6011677
  misc_feature: Encodes the peptide sequence at SEQ ID NO 946
atgctgctgtcgcgtccccaaaccctgcccctgcccttgccccgggcccgggccccgctttcctccccgacccttcgccacctccgcgcgctcgtctcgtccccgccactagggttcgcgtccgcggcgcgaggcctcgctccgctccgcctccgcgcggtggtgtccgaccacgagcagcgcgggatggaggcgggggagcaggggaggccgctccgcgtcggcctcatctgcggcgggccctccggcgagaggggcgtctccctcaactccgcgcgctccgtgctggatcacatccagggagaggatttggtggtccgctgctactacattgactctgctatgaaggccttcgcgatatctcctgcgcagctatattccaacacgccttcggattttgacttcaaacttgaaagtttagcccaaggatttgactccttatctgactttgcggagcatcttgccatcaatgttgacattgtcttcccagtgatccatgggaaatttggtgaagatggtggcattcaggagcttttggagaaagcaaatgttccatttgttgggacaccctctaaggaatgcgagcgtgcttttgacaagcataatgcgtcgctcgagctcaatgcacaaggtttcttaacagtgccaaactttcttgtggagaaggacaagttggccaagccagagttagaggcatggttcaaaactgtcaatctgaacaaagaaaatggcaaagtgattgtcaaacctacaagggctgggtcaagcattggcgtggttgttgcttatggtgtgaatgacgctgcccagaaagctgaggaaattatttcagagggaattgatgataaagttatcatagaagttttccttgaagggggcactgagtttacagccatcgtggttgatgttgggactgctaacaacagtcagcctgttgttctgcttccaacagaagttgagcttcagtactccaacagtagtgataccgatgaggacacaatatttaactaccgcaagaagtaccttccaagtcgacaggttgcttatcattcgcctccacgttttccggcagaggtgatcgattgtataagacaagggatttctcttttatttcgtcgctttggcctgcatgactatgcaagggtagatggttggtttttaccttctcctgttgcttctttatcctcagctgaaaatagtgaaaaatttggaaataccaagtatggaactgttcttttcacggatattaatttgataagtgggatggagcaaaccagctttttgttccaacaagcttcagcggttgggttctctcactctcgaatcctccgtacagttgttcagcatgcttgctcgcgattcccttctcttgttccatgcaataacgcttggaccgctttgtccagaaaactacaaccatcgaaacaaataggagcaatccacaaaggtacatcaagacagaaggtttttgtgatcttcggaggggacacttcagagcggcaagtatcacttatgagtggtaccaatgtctggcttaatctccaaggttttgatgatcttgacgtgacaccatgtttgctcgctcctgcaaatggatatttctcatcccatgatcaagttttcagtgacacttcaagagaagtctggacgttgccatattcattagtgttacgacataccactgaagaagttcatgctgcatgtgttgaggcaactgagccagaacgagttaaaatgacaaaacgtttgcgtgatcaagtaatgaatgaacttgggccagcattgagcaaacatgattggtttgcgggctttgacattgcttatgaacaacctatcaaatactctctgcaacagtggatcgaccatgtaaaagaaacagaagctgtagtctttatagcagtgcatggtggcattggagaggatggtaccattcagacattgttggaatctgcaggagttcctttcacaggaccaggaccaatagcttctagaacatgcattgacaaagttgcaagttcacttgcggttgaccatcttgctagttatggagtccataccattcctaaggatgtaagagcaacagaagaagtactgaagtcatctcttgttgatatctggaatgaacttaaagcaaaactacgaacagaaacagtatgtgtgaaaccagctcgtgatgggtgctcaactggtgtagcaagattgtgctgtccaaaggacctagaagtctatacaaatgcattgaggaggaagtttcagcatctgcctgctaattgcctgtccagggcacatggcgtaattgagatgccagtccctcctccagagtcactaatatttgagccttttattgaaacggatgaaattatcatttcaaataaattggggaatggtagtgcccgccatctggtatggaagggtgaaaatgactggcttgaaattactgttggtgtagttggcaagcgtggagaaatgcactcgttaaatccaagtatcacagtgaaagaaagtggtgatattttatctcttgaggagaaatttcaaggtggcactggaatcaacttgacaccacctcctgcaacaattatgggcgaggatgctctgcagaggtgcaagaagagtatcgagatgatggcaaatgctctaggtttggaaggcttctcgcgcattgacgcatttgtcaacgtgcggagcggggaggtgctgctgatcgaagtcaacactgtacctggaatgactccatccaccgtgctgatccaccaagcactcgcagaggaacctcccgtgtaccctcacaagtttttccgcactcttctggatttggcgtttacaagggcgaaatag

SEQ ID NO: 946 - protein, 945 aa, Sorghum bicolor
  misc_feature: Ceres ANNOT ID no. 6011677
  misc_feature (72)..(191): Pfam Id: Dala_Dala_lig_N Pfam Desc: D-ala D-ala ligase N-terminus
  misc_feature (487)..(667): Pfam Id: Dala_Dala_lig_N Pfam Desc: D-ala D-ala ligase N-terminus
  misc_feature (67)..(943): NCBI GI: 42572325 NCBI Desc: d-alanine--d-alanine ligase family [arabidopsis thaliana]
  misc_feature (67)..(846): NCBI GI: 42572327 NCBI Desc: d-alanine--d-alanine ligase family [arabidopsis thaliana]
  misc_feature (410)..(943): NCBI GI: 76880176 NCBI Desc: d-alanine-d-alanine ligase [physcomitrella patens subsp. patens]
  misc_feature (33)..(364): NCBI GI: 76880178 NCBI Desc: d-alanine-d-alanine ligase [physcomitrella patens subsp. patens]
  misc_feature (630)..(945): NCBI GI: 110637336 NCBI Desc: d-alanine--d-alanine ligase a [cytophaga hutchinsonii atcc 33406]
MLLSRPQTLPLPLPRARAPLSSPTLRHLRALVSSPPLGFASAARGLAPLRLRAVVSDHEQRGMEAGEQGRPLRVGLICGGPSGERGVSLNSARSVLDHIQGEDLVVRCYYIDSAMKAFAISPAQLYSNTPSDFDFKLESLAQGFDSLSDFAEHLAINVDIVFPVIHGKFGEDGGIQELLEKANVPFVGTPSKECERAFDKHNASLELNAQGFLTVPNFLVEKDKLAKPELEAWFKTVNLNKENGKVIVKPTRAGSSIGVVVAYGVNDAAQKAEEIISEGIDDKVIIEVFLEGGTEFTAIVVDVGTANNSQPVVLLPTEVELQYSNSSDTDEDTIFNYRKKYLPSRQVAYHSPPRFPAEVIDCIRQGISLLFRRFGLHDYARVDGWFLPSPVASLSSAENSEKFGNTKYGTVLFTDINLISGMEQTSFLFQQASAVGFSHSRILRTVVQHACSRFPSLVPCNNAWTALSRKLQPSKQIGAIHKGTSRQKVFVIFGGDTSERQVSLMSGTNVWLNLQGFDDLDVTPCLLAPANGYFSSHDQVFSDTSREVWTLPYSLVLRHTTEEVHAACVEATEPERVKMTKRLRDQVMNELGPALSKHDWFAGFDIAYEQPIKYSLQQWIDHVKETEAVVFIAVHGGIGEDGTIQTLLESAGVPFTGPGPIASRTCIDKVASSLAVDHLASYGVHTIPKDVRATEEVLKSSLVDIWNELKAKLRTETVCVKPARDGCSTGVARLCCPKDLEVYTNALRRKFQHLPANCLSRAHGVIEMPVPPPESLIFEPFIETDEIIISNKLGNGSARHLVWKGENDWLEITVGVVGKRGEMHSLNPSITVKESGDILSLEEKFQGGTGINLTPPPATIMGEDALQRCKKSIEMMANALGLEGFSRIDAFVNVRSGEVLLIEVNTVPGMTPSTVLIHQALAEEPPVYPHKFFRTLLDLAFTRAK

SEQ ID NO: 947 - DNA, 1146 bp, Sorghum bicolor
  misc_feature: Ceres ANNOT ID no. 6011686
  misc_feature: Encodes the peptide sequence at SEQ ID NO 948
atggcttcccccgcgctcggatctcaggtggccgccgctgcctcggtgcccgtcggttcggattgttgcttcaagggcaccgcgctcaagggtaacagtaatctaaacttccggaacaagccatgcattgggatggcactagcatggaaaaacaagacccaacaatcgcgacatctgaacaaggtcttctgcatgtctgttcaacaagcaagcagaagcaaagttgctgttaaacccattgagctggagaatgcaaaggagccaccacttaacttatacaaaccaaaggaaccttacacggccacaattgtctctgttgagaggattgtaggacccaaagctcctggtgagacatgccacattgtcattgatcatggtggcaatgttccgtactgggaaggacagagttatggtgtcattcctcctggagagaatccaaaaaaacctggatctccaaatactgttaggctctattcaattgcttctacaaggtatggtgattcttttgatggaaagacaacaagcttatgtgttcgtcgtgctgtttattatgatcctgaaactggagaggaagacccctcaaagaaaggtatctgcagtaacttcctgtgtgactcaaaaccaggggacaaagttcagatcacaggcccctcaggcaaaataatgcttcttcccgaagatgatccaaaagcgactcatatcatgattgccacggggactggtgttgctccttaccgtggctacttacgtcgtatgttcatggaagatgtcccaactttcaaatttggtggtctggcttggctcttccttggtgtggctaactctgacagccttctctatgatgaagagttcacaaactaccttcagcagtatccatataatttcaggtatgacaaagcactaagcagggagcagaagaacaagaacggcggcaagatgtacgtgcaggacaagattgaggagtacagcgatgaaatcttcaagctgctagatggcggtgcgcacatctacttctgcggtttgaaggggatgatgcctgggatccaggacacgctcaagagggtggctgagcaaagaggcgagagttgggaccagaagctgtcacagctgaaaaagaacaagcagtggcacgtggaggtttactag

SEQ ID NO: 948 - protein, 381 aa, Sorghum bicolor
  misc_feature: Ceres ANNOT ID no. 6011686
  misc_feature (234)..(350): Pfam Id: NAD_binding_1 Pfam Desc: Oxidoreductase NAD-binding domain
  misc_feature (1)..(381): NCBI GI: 3913653 NCBI Desc: ferredoxin--nadp reductase, embryo isozyme, chloroplast precursor (fnr)
  misc_feature (1)..(381): NCBI GI: 729480 NCBI Desc: ferredoxin--nadp reductase, root isozyme, chloroplast precursor (fnr)
  misc_feature (1)..(381): NCBI GI: 113549947 NCBI Desc: os03g0784700 [oryza sativa (japonica cultivar-group)]
  misc_feature (1)..(381): NCBI GI: 115455751 NCBI Desc: os03g0784700 [oryza sativa (japonica cultivar-group)]
  misc_feature (13)..(381): NCBI GI: 3913648 NCBI Desc: ferredoxin--nadp reductase, root isozyme, chloroplast precursor (fnr)
  misc_feature (1)..(381): SWISSPROT Homolog: EC 1.18.1.2 Ferredoxin--NADP reductase, embryo isozyme, chloroplast precursor
MASPALGSQVAAAASVPVGSDCCFKGTALKGNSNLNFRNKPCIGMALAWKNKTQQSRHLNKVFCMSVQQASRSKVAVKPIELENAKEPPLNLYKPKEPYTATIVSVERIVGPKAPGETCHIVIDHGGNVPYWEGQSYGVIPPGENPKKPGSPNTVRLYSIASTRYGDSFDGKTTSLCVRRAVYYDPETGEEDPSKKGICSNFLCDSKPGDKVQITGPSGKIMLLPEDDPKATHIMIATGTGVAPYRGYLRRMFMEDVPTFKFGGLAWLFLGVANSDSLLYDEEFTNYLQQYPYNFRYDKALSREQKNKNGGKMYVQDKIEEYSDEIFKLLDGGAHIYFCGLKGMMPGIQDTLKRVAEQRGESWDQKLSQLKKNKQWHVEVY

SEQ ID NO: 949 - DNA, 405 bp, Sorghum bicolor
  misc_feature: Ceres ANNOT ID no. 6011694
  misc_feature: Encodes the peptide sequence at SEQ ID NO 950
atggcagcctcagtcatggcctctttgtctctgaaaccatctccatttttggatcggtcgaggttcacaagtgtccagccatcagcaagatcttcaaccttcagagtaatggccaagaaaacaaagaagatcaaaacatcccaacctttcggagggttgaacttgaaggatggtgttgatgcatctggaaggccagccaaggggaagggtgtctaccagtttgccaataaatacggagcaaatgttgatgggtacagtccaatatataacccagaagaatggtctccaagcggtgacgtttatgttggaggaaagacagggttgttgctctgggcagtcactcttgctggaatattgctgggtggtgctcttcttatttacaatactagtgccctggcttcttga

SEQ ID NO: 950 - protein, 134 aa, Sorghum bicolor
  misc_feature: Ceres ANNOT ID no. 6011694
  misc_feature (39)..(134): Pfam Id: PsbR Pfam Desc: Photosystem II 10 kDa polypeptide PsbR
  misc_feature (1)..(134): NCBI GI: 1321868 NCBI Desc: 10kd psii protein [hordeum vulgare]
  misc_feature (3)..(133): NCBI GI: 104763664 NCBI Desc: chloroplast photosystem ii 10 kda protein [agave tequilana]
  misc_feature (1)..(133): NCBI GI: 112292665 NCBI Desc: chloroplast photosystem ii light-inducible protein [pachysandra terminalis]
  misc_feature (1)..(133): NCBI GI: 21489 NCBI Desc: st-ls1 protein [solanum tuberosum]
  misc_feature (1)..(133): NCBI GI: 25989650 NCBI Desc: photosystem ii 10 kda protein [xerophyta humilis]
MAASVMASLSLKPSPFLDRSRFTSVQPSARSSTFRVMAKKTKKIKTSQPFGGLNLKDGVDASGRPAKGKGVYQFANKYGANVDGYSPIYNPEEWSPSGDVYVGGKTGLLLWAVTLAGILLGGALLIYNTSALAS

SEQ ID NO: 951 - DNA, 1119 bp, Sorghum bicolor
  misc_feature: Ceres ANNOT ID no. 6011697
  misc_feature: Encodes the peptide sequence at SEQ ID NO 952
atgacaaaggggaagaggtccaagagacggaggtcctcggcggccagcctcacagatgatcttgtcgtcgagatcctctgtcgcctcccagccagatcggtctgtcgcttcaagtgtgtgtccacgacctggcgagacctcatctctgtccacaacaggaagctcccccagtccctgtccggcatctttaccatgcacgatgccgagaatatgatgggatcagttccacatttcaccagtgttttgggcagagactgcccattggtcttcccctggttcgatttcctgccagcaaaccgagtctatcttttggactgctgcaatggacttgtcctttgcaactactggcctaggcctgccatcgatggttgccacttatttgtgtgtaatcccgccacgaaaaaatgggtggaattgccggattccaacctaggaaacaggccccgatattactgtcttggttttgatcccacagtgtcaccccacttttatgtgtttgagttctttcgagaccatgatgaagacttcaacttattggtagctggagtggaggtgtattcatctgagacaggacagtgggttcgtatggaggacaatggcattagctctcatgcttgtcatactggcttgcatgtctttctgaacaatggacgtgtacactatctcaccgatgatcctgctatagctgtggtggacactcaggggaaagcatgccagagcatacctgtccctgacaacagggattatggtttcattcagcagtctcagggccatctgtattatgctaattttgaggcagataatgaagatcaggtggttcgatttgtagtttatgttcttgaggactatgacaaccaacggtggacgctgaagcatacagctgaggcttttgatgtacttggacgaggaagtcataatcttgcacgggactttgagtgggttgcaattcacccggactgcaacatgatcttctacactgttgggtgggagaaaacactaatgtcctatgatatggatcgtcggcaggtccaagtcatctgcactcttggacaggacactcgggaggcatacttgccgtatgtgccgttgttttcagagttacaggctttgcacatatga

SEQ ID NO: 952 - protein, 372 aa, Sorghum bicolor
  misc_feature: Ceres ANNOT ID no. 6011697
  misc_feature (12)..(59): Pfam Id: F-box Pfam Desc: F-box domain
  misc_feature (44)..(366): NCBI GI: 50508392 NCBI Desc: receptor-like kinase-like [oryza sativa (japonica cultivar-group)]
  misc_feature (14)..(366): NCBI GI: 115462391 NCBI Desc: os05g0177100 [oryza sativa (japonica cultivar-group)]
  misc_feature (14)..(293): NCBI GI: 115462393 NCBI Desc: os05g0177400 [oryza sativa (japonica cultivar-group)]
  misc_feature (13)..(293): NCBI GI: 115462373 NCBI Desc: os05g0175800 [oryza sativa (japonica cultivar-group)]
  misc_feature (17)..(167): NCBI GI: 117670145 NCBI Desc: f-box-like protein [hordeum vulgare]
  misc_feature: The sequence is a functional homolog of SEQ ID NO. 456 in the 11/188,298 US application
MTKGKRSKRRRSSAASLTDDLVVEILCRLPARSVCRFKCVSTTWRDLISVHNRKLPQSLSGIFTMHDAENMMGSVPHFTSVLGRDCPLVFPWFDFLPANRVYLLDCCNGLVLCNYWPRPAIDGCHLFVCNPATKKWVELPDSNLGNRPRYYCLGFDPTVSPHFYVFEFFRDHDEDFNLLVAGVEVYSSETGQWVRMEDNGISSHACHTGLHVFLNNGRVHYLTDDPAIAVVDTQGKACQSIPVPDNRDYGFIQQSQGHLYYANFEADNEDQVVRFVVYVLEDYDNQRWTLKHTAEAFDVLGRGSHNLARDFEWVAIHPDCNMIFYTVGWEKTLMSYDMDRRQVQVICTLGQDTREAYLPYVPLFSELQALHI

SEQ ID NO: 953 - DNA, 1809 bp, Sorghum bicolor
  misc_feature: Ceres ANNOT ID no. 6011706
  misc_feature: Encodes the peptide sequence at SEQ ID NO 954
atgatctccctgctccgccgcgcactcgcctcgtctccggccgccacctgccggaggcccctcctcgccgcgctcctctctccgccatcggcacctcccggcccatgccaggcgcccacgccagggtcgccggcgccgccgaggcgggcgctccacggctcgccgaaccccctggggttcaggtccacccccgcgtcgtggaccaggcccggaccgggggaaggcgtgggcgtggatacgggggctgaggaggggctggagatcgcgaggctgtggatctcgccgcggatcgtggagaagctcgcggcgcggggcatcaccaagctcttccccatccagagggctgttcttgagccagcaatgcaaggaaaagacatgattggccgtgctcgaacagggacagggaagaccttggcttttggtattcctatcatggacaagatcctcagtcacaacgagaagaatggtaacggtaggaatcctttagccatagtcttggctccaacaagagaacttgctcggcaggttgagaaggaatttagagaatctgctcccttggacaccctctgtgtctatggaggtgtgcctatcaatcagcaaatgagagttctcaactatggtgttgacatagtggtcggaactccaggtcgtattattgatcttctcagaaggggtgttttaaacctttcacaaatccagtttgtggttctagatgaagctgatcagatgctggctgtgggtttcgatgaagatgttgaggtgatcatggagcagttgccgcagaaccgtcaaagtatgctgttctctgcaacaatgcctagttggataagaaagatttcgaacaagtacttaaatgatccagttataattgaccttgttggtgactcagaccagaaattacctgaaggaatctctctctattccattgcctctgataacttcgggaagcaatcaattcttggtcctttgattaaagagcatgccaatggtggaaaatgcattgtgtttactcaaactaaacgggatgcagatagattggcatatgtcatgggaaggagttatccatgtcaggcactacatggggatatttcacagaatcaaagagagaggacactctcaggatttcgtgatggtcgttttaatatccttgtggcaactgatgtcgcagctcgtggattggacatacccaatgttgatctagtggtacattatgagattccaaatacctcggagttatttgttcacagatctgggagaactgcacgagcagggaagaaaggcagtgcaattttaatatacacatatgagcagactagagctgtaagggtcatcgagcaagatataggatgcaggttcacagagcttcccaagatgccagtttcagatgaggctgcagacatgtttaatgtcacgagagatactcgctctagatcagctggaagcagaagaacgggcggaccttttagccgtgaaggttatggtggctttggagaccatcgttccagcagttttggtgattttggtggttcctctgaccgcagtggtggattccgtgactcaggttcaaggtaccgcggtggatctggaggtttgagacgatcgtccagtgagttaggcaggcctagtttcagtcgttctgatagatttggcgactttggagacagtgacttcagcagacgtggtaacactgactttggtcgttcccggagctctgatgattcaggctcctcacgttatggcagaggttctagtgggttcggcacttcaggttccggcaaccttggtggcttcaaggattccaagcgatga

SEQ ID NO: 954 - protein, 602 aa, Sorghum bicolor
  misc_feature: Ceres ANNOT ID no. 6011706
  misc_feature (110)..(279): Pfam Id: DEAD Pfam Desc: DEAD/DEAH box helicase
  misc_feature (348)..(424): Pfam Id: Helicase_C Pfam Desc: Helicase conserved C-terminal domain
  misc_feature (1)..(600): NCBI GI: 143456572 NCBI Desc: dead-box atp-dependent rna helicase 53
  misc_feature (3)..(596): NCBI GI: 122227760 NCBI Desc: dead-box atp-dependent rna helicase 9
  misc_feature (74)..(466): NCBI GI: 47827092 NCBI Desc: atp-dependent rna helicase [hordeum vulgare subsp. vulgare]
  misc_feature (41)..(462): NCBI GI: 22135801 NCBI Desc: at5g26740 [arabidopsis thaliana]
  misc_feature (41)..(462): NCBI GI: 20856975 NCBI Desc: at5g26743 [arabidopsis thaliana]
MISLLRRALASSPAATCRRPLLAALLSPPSAPPGPCQAPTPGSPAPPRRALHGSPNPLGFRSTPASWTRPGPGEGVGVDTGAEEGLEIARLWISPRIVEKLAARGITKLFPIQRAVLEPAMQGKDMIGRARTGTGKTLAFGIPIMDKILSHNEKNGNGRNPLAIVLAPTRELARQVEKEFRESAPLDTLCVYGGVPINQQMRVLNYGVDIVVGTPGRIIDLLRRGVLNLSQIQFVVLDEADQMLAVGFDEDVEVIMEQLPQNRQSMLFSATMPSWIRKISNKYLNDPVIIDLVGDSDQKLPEGISLYSIASDNFGKQSILGPLIKEHANGGKCIVFTQTKRDADRLAYVMGRSYPCQALHGDISQNQRERTLSGFRDGRFNILVATDVAARGLDIPNVDLVVHYEIPNTSELFVHRSGRTARAGKKGSAILIYTYEQTRAVRVIEQDIGCRFTELPKMPVSDEAADMFNVTRDTRSRSAGSRRTGGPFSREGYGGFGDHRSSSFGDFGGSSDRSGGFRDSGSRYRGGSGGLRRSSSELGRPSFSRSDRFGDFGDSDFSRRGNTDFGRSRSSDDSGSSRYGRGSSGFGTSGSGNLGGFKDSKR

SEQ ID NO: 955 - DNA, 1134 bp, Sorghum bicolor
  misc_feature: Ceres ANNOT ID no. 6011718
  misc_feature: Encodes the peptide sequence at SEQ ID NO 956
atgatcactggggctctgcaggtcgccgccggcggccagccgctcctgctcacccgtcggggccagcagcggcgccgggtgttccggccgccccaagcagtggcgtccgacgccgctgccgccgccacggcgaacgaggagggcggcaaagtggcgctgggcgggtccggcgtcgccgtcaccaagctcggcgtcggggcctggtcctggggcgacaccacctactggaacgagttccagtgggacgataggaaactgaaggccgctaaaggagcatttgacgcgagtatcgactgtggaataaccttttttgatactgctgaagtgtatggagcagggatatcaggagcgattaattcagaaagtttactaggaagatttatcaaggaaaggcaacagaaggaacaggtagacgtggctatcgcgacaaagtttgcagctcttccatggaggtttggtcgtgggagcgtcatttgtgcgttgaaggcctcgttggatcgccttggcgtctcttcagttgagctctaccaacttcattggccagggatatggggcaacgaagattacctggatggccttggagacgctgtcgagcagggccttgtaaaggctgttggagtctcaaactacagcgaaaaacgtctccgggatgcctaccagcgcctcaagaagagggggattccactcgcttcgaaccaagtgaattacagtctgatatacaggaacccggaggaaaacggggtgaaggcggcttgcgatgagcttggcgttactctaatcgcttattccccaatcgcccaaggtgctctgacaggaaaatacactccggagaatccccctaaaggtcctcgaggacggatatacacaccagagttcctgacaaagctccaaccacttatcaaccggatcaaggagattggagaaagctacgggaggacttcaacccaggtggtgctgaactggctggtgtgccagggcaacgtggtgccgatccctggcgccaagaacgcggagcaggcccgggagttcgcaggcgcgctggggtggagcctcacggccgacgaggtggaggagctccggtccatggcgcgccaggtgaagcccgtcatcggcttcccggtggagaagctgtga

SEQ ID NO: 956 - protein, 377 aa, Sorghum bicolor
  misc_feature: Ceres ANNOT ID no. 6011718
  misc_feature (54)..(364): Pfam Id: Aldo_ket_red Pfam Desc: Aldo/keto reductase family
  misc_feature (1)..(377): NCBI GI: 115470553 NCBI Desc: os07g0143000 [oryza sativa (japonica cultivar-group)]
  misc_feature (2)..(377): NCBI GI: 24059944 NCBI Desc: aldo/keto reductase family-like protein [oryza sativa (japonica cultivar-group)]
  misc_feature (21)..(377): NCBI GI: 24111265 NCBI Desc: at1g06690/f4h5_17 [arabidopsis thaliana]
  misc_feature (189)..(332): NCBI GI: 6692675 NCBI Desc: f12k11.2 [arabidopsis thaliana]
  misc_feature (51)..(366): NCBI GI: 16332043 NCBI Desc: auxin-induced protein [synechocystis sp. pcc 6803]
MITGALQVAAGGQPLLLTRRGQQRRRVFRPPQAVASDAAAAATANEEGGKVALGGSGVAVTKLGVGAWSWGDTTYWNEFQWDDRKLKAAKGAFDASIDCGITFFDTAEVYGAGISGAINSESLLGRFIKERQQKEQVDVAIATKFAALPWRFGRGSVICALKASLDRLGVSSVELYQLHWPGIWGNEDYLDGLGDAVEQGLVKAVGVSNYSEKRLRDAYQRLKKRGIPLASNQVNYSLIYRNPEENGVKAACDELGVTLIAYSPIAQGALTGKYTPENPPKGPRGRIYTPEFLTKLQPLINRIKEIGESYGRTSTQVVLNWLVCQGNVVPIPGAKNAEQAREFAGALGWSLTADEVEELRSMARQVKPVIGFPVEKL

SEQ ID NO: 957 - DNA, 558 bp, Sorghum bicolor
  misc_feature: Ceres ANNOT ID no. 6011719
  misc_feature: Encodes the peptide sequence at SEQ ID NO 958
atggcggcctctgcaacggatcccctcgccacggcgcttgtcatggcggcggtggcgctcatgctcaccgccacgacgacccacgccgcgcgccacctcgccgacacaaccccggcggccgcgcccgccgccgtcgtccctggcatccctgccgtgccgaagccgcccgtcgtgcccaccgtgcctgcggtggtcgccctgccaccgatgcccgccgtgccgacgacagtgcccgcggtgggcgccgtcccaccgatccccgcagtgccggcagtccctgccgcgacgaccttgccgcccatgccatctgtgccggcggtccccgcggcgacattgccgccgatgcccaaggtgccaaccgtgccgaccgccgctgcgttgcctccgatgccggccatcccctccgtacccaaagtggcgctgccgccggtggtcccgtcgtccgtgcccaaggttaccttgccgccgatgccgtccgtgcccaaggtgacactgccgccgatgccttccatccccggtgtgccgatgccgttcttggcgccacctccttcggcttga

SEQ ID NO: 958 - protein, 185 aa, Sorghum bicolor
  misc_feature: Ceres ANNOT ID no. 6011719
  misc_feature (3)..(185): NCBI GI: 34393335 NCBI Desc: early nodulin 75 precursor-like protein [oryza sativa (japonica cultivar-group)]
  misc_feature (3)..(185): NCBI GI: 24059939 NCBI Desc: early nodulin 75 precursor-like protein [oryza sativa (japonica cultivar-group)]
  misc_feature (44)..(185): NCBI GI: 24059937 NCBI Desc: proline-rich protein-like [oryza sativa (japonica cultivar-group)]
  misc_feature (64)..(185): NCBI GI: 115455727 NCBI Desc: os03g0782400 [oryza sativa (japonica cultivar-group)]
  misc_feature (4)..(175): NCBI GI: 115459480 NCBI Desc: os04g0521900 [oryza sativa (japonica cultivar-group)]
MAASATDPLATALVMAAVALMLTATTTHAARHLADTTPAAAPAAVVPGIPAVPKPPVVPTVPAVVALPPMPAVPTTVPAVGAVPPIPAVPAVPAATTLPPMPSVPAVPAATLPPMPKVPTVPTAAALPPMPAIPSVPKVALPPVVPSSVPKVTLPPMPSVPKVTLPPMPSIPGVPMPFLAPPPSA

SEQ ID NO: 959 - DNA, 525 bp, Sorghum bicolor
  misc_feature: Ceres ANNOT ID no. 6011722
  misc_feature: Encodes the peptide sequence at SEQ ID NO 960
atggcctcttccgcctcagctctcttcgtcaaagcggcgctcgtcatggcgctcatgctcgccgggagcaccacgtgccatgctgctcgctacctcgccgactcgacttcggcggccgctcctgccgcagtagtgccgaccgtgcccgcggtgcctgccgcggcagccttgccaccgcttgccgcggtaccgacgacggtccccgcggtcaccgtgccaccgaagcccacggtgccagtggtcgtcgtccctgcggcgaccttgccacccatgccggcggtgcccgcagcgaccctcccgccgatgcctgcggtgcctgcagtaccaaacgccgcgctgccccgtatgccggccgtccccgccgtgcccaaggcgaccctcccgccgccgatgcctgcagtgccggccgtgcccaaggtgacactgccgccgatggccgccgtgcctaaggtgacagtactgccaccgatgccctccatcccgggcgtgccgaagccattcttggcgccacctccttcggcataa

SEQ ID NO: 960 - protein, 174 aa, Sorghum bicolor
  misc_feature: Ceres ANNOT ID no. 6011722
  misc_feature (1)..(174): NCBI GI: 24059937 NCBI Desc: proline-rich protein-like [oryza sativa (japonica cultivar-group)]
  misc_feature (1)..(174): NCBI GI: 34393335 NCBI Desc: early nodulin 75 precursor-like protein [oryza sativa (japonica cultivar-group)]
  misc_feature (1)..(174): NCBI GI: 24059939 NCBI Desc: early nodulin 75 precursor-like protein [oryza sativa (japonica cultivar-group)]
  misc_feature (2)..(174): NCBI GI: 115459480 NCBI Desc: os04g0521900 [oryza sativa (japonica cultivar-group)]
  misc_feature (1)..(174): NCBI GI: 115470547 NCBI Desc: os07g0142600 [oryza sativa (japonica cultivar-group)]
MASSASALFVKAALVMALMLAGSTTCHAARYLADSTSAAAPAAVVPTVPAVPAAAALPPLAAVPTTVPAVTVPPKPTVPVVVVPAATLPPMPAVPAATLPPMPAVPAVPNAALPRMPAVPAVPKATLPPPMPAVPAVPKVTLPPMAAVPKVTVLPPMPSIPGVPKPFLAPPPSA

SEQ ID NO: 961 - DNA, 759 bp, Sorghum bicolor
  misc_feature: Ceres ANNOT ID no. 6011724
  misc_feature: Encodes the peptide sequence at SEQ ID NO 962
atgccggagcattcagagaacgcggcggcggacctgatgggtaacatcatggagaccatcgcggagaaccttccgaagcagaagtcagtccggttcgacgacggcgagggctccatctccgaccaggccaagaagctcttcggcggcgggcaggccggtaacaagaagtctatccaccatgtcctgggtggcgggaaatccgccgacgtgctgctgtggcggaacaagaagatctcgtccagcgtgctgggcgtggcgacgctggtgtgggtcttcttcgagtggctggactaccacttcctcaccatcgtctgcttcctgctcgcgctcggcatggccgtccagttcgcctggtccaccttcgccgccgtgctcaacagagggtccccttccagcgtgcctcgcgtgcagctgccggaggagctgttcgccaacgtgggcgcggccgtcggcgcccaggtgaacagggcgctgggcttcctccaggacgtgtcctgcggacgagacctcaagcagttgctcatcgtgatcgccgggttctttgcggcggcgatcgtcggcagcttctgcaacttcttgacagtcatctacatcgggttcgtgtgcgcgcacacgctgccagtgctgtacgagaggtaccaggaccaagtggacgacttcctgtacaacatgctgggcgtggtgcagagccagtaccagaagctggacaccaagggcatcctcaagggtggcgtctccaagttcaggaagaacgagtag

SEQ ID NO: 962 - protein, 252 aa, Sorghum bicolor
  misc_feature: Ceres ANNOT ID no. 6011724
  misc_feature (67)..(244): Pfam Id: Reticulon Pfam Desc: Reticulon
  misc_feature (1)..(241): NCBI GI: 30681227 NCBI Desc: reticulon family protein [arabidopsis thaliana]
  misc_feature (1)..(220): NCBI GI: 20160502 NCBI Desc: osjnbb0021a09.5 [oryza sativa (japonica cultivar-group)]
  misc_feature (15)..(249): NCBI GI: 56381963 NCBI Desc: at3g61560 [arabidopsis thaliana]
  misc_feature (57)..(250): NCBI GI: 78714222 NCBI Desc: reticulon [hordeum vulgare]
  misc_feature (53)..(251): NCBI GI: 92874883 NCBI Desc: reticulon [medicago truncatula]
MPEHSENAAADLMGNIMETIAENLPKQKSVRFDDGEGSISDQAKKLFGGGQAGNKKSIHHVLGGGKSADVLLWRNKKISSSVLGVATLVWVFFEWLDYHFLTIVCFLLALGMAVQFAWSTFAAVLNRGSPSSVPRVQLPEELFANVGAAVGAQVNRALGFLQDVSCGRDLKQLLIVIAGFFAAAIVGSFCNFLTVIYIGFVCAHTLPVLYERYQDQVDDFLYNMLGVVQSQYQKLDTKGILKGGVSKFRKNE

SEQ ID NO: 963 - DNA, 1485 bp, Sorghum bicolor
  misc_feature: Ceres ANNOT ID no. 6011734
  misc_feature: Encodes the peptide sequence at SEQ ID NO 964
atggccgacgacagcttctccgcggcgcggctgttctcgcagggcgtctcctacacctacgacgacgtgatcgtcctcccgggctacatcgacttccccgccgacgccgtcgacctctccacccgcctctcccgccgcgtgccgctgtcgctcccctgcgtcgcctccccgatggacaccgtctccgagtccgccatggccgccgccatggcctccctcggcgccgccgccgtcgtccacagcaacgccgacgccgagacccaggcctccatcctccgcgccgccaagtcgcgccgcgtcccctgggtctcctccacccagttcttcgccccgtccgccgccccctccgccgccgacttcgccggctgcgcgtacgccgtcgtcaccgagcgcggggacgcgctctccaggctcgtcggcatcgccgccgccgccgaccacaggcccggcgtccccgtgtcggagtacatgacccccgcgccccgcacggcgtctgccgccttcgatttcgagcaagccgccgcctttctcgccgacgagggcctggacttcgcgcccctcgtctccgacgacggcgccggcgaggtcgtcgtcgacctcgtcaccgcccaggacgtcgagcgcatccgtagctacccgaagctgggcacgccgtcgctcggggcggacgggaggttcgtcgtcgcggcggcgattgggacgcgggaggaggacaagcgcaggctcgagatgctggtgaaggaaggggcgaacgccattgtgatcgacagctcccaggggaactctgtttaccagctcgacatgatcaagtatgccaagaggatgtaccctgaggtggatttgatcggtggaaatgtggtcaccgttgcgcaggcacagaatttgatcgccgccggggtggatggattgcgggttgggatgggctctggatcgatttgcaccacgcaggaggtttgtgctgtaggcagaggacaggctactgcagtttacaaggtagggcaatatgccaaggatcatggtgtgcctgttattgctgatggtggaatctcaaactctgggcatattgtaaaggctctgactctaggggcatctactgttatgatgggtagtttcctggctggcagtcttgaagctcccggtgtttatgagtacaaggatggccatcgtgtcaaaaaatatagaggcatgggttctcttgaagccatgacaaagggaagtgatgtgagataccttggagacacgcttaagcttaaggttgctcaaggagttgttggagcagttgctgacaagggctctgtattgaggttcattccttatacgatgcaagctgtcaagcaaggattccaggacctgggtgcagcctccttgcagtcagcccatgaccttttacgatcagaatctcttcgactagaggtaagaaccggtgctgcccaagtcgaaggagggatccatggtcttgtttcatatgagaagaaggcattctga

SEQ ID NO: 964 - protein, 494 aa, Sorghum bicolor
  misc_feature: Ceres ANNOT ID no. 6011734
  misc_feature (16)..(484): Pfam Id: IMPDH Pfam Desc: IMP dehydrogenase / GMP reductase domain
  misc_feature (3)..(494): NCBI GI: 4468193 NCBI Desc: inosine monophosphate dehydrogenase [glycine max]
  misc_feature (3)..(494): NCBI GI: 28413147 NCBI Desc: inosine monophosphate dehydrogenase [vigna unguiculata]
  misc_feature (3)..(494): NCBI GI: 23463051 NCBI Desc: at1g79470/t8k14_11 [arabidopsis thaliana]
  misc_feature (24)..(494): NCBI GI: 38096048 NCBI Desc: inosine-5'-phosphate dehydrogenase [nicotiana tabacum]
  misc_feature (110)..(494): NCBI GI: 16417597 NCBI Desc: inosine-5'-monophosphate dehydrogenase-like protein [glycine max]
  misc_feature (3)..(494): SWISSPROT Homolog: EC 1.1.1.205 Inosine-5'-monophosphate dehydrogenase
MADDSFSAARLFSQGVSYTYDDVIVLPGYIDFPADAVDLSTRLSRRVPLSLPCVASPMDTVSESAMAAAMASLGAAAVVHSNADAETQASILRAAKSRRVPWVSSTQFFAPSAAPSAADFAGCAYAVVTERGDALSRLVGIAAAADHRPGVPVSEYMTPAPRTASAAFDFEQAAAFLADEGLDFAPLVSDDGAGEVVVDLVTAQDVERIRSYPKLGTPSLGADGRFVVAAAIGTREEDKRRLEMLVKEGANAIVIDSSQGNSVYQLDMIKYAKRMYPEVDLIGGNVVTVAQAQNLIAAGVDGLRVGMGSGSICTTQEVCAVGRGQATAVYKVGQYAKDHGVPVIADGGISNSGHIVKALTLGASTVMMGSFLAGSLEAPGVYEYKDGHRVKKYRGMGSLEAMTKGSDVRYLGDTLKLKVAQGVVGAVADKGSVLRFIPYTMQAVKQGFQDLGAASLQSAHDLLRSESLRLEVRTGAAQVEGGIHGLVSYEKKAF

SEQ ID NO: 965 - DNA, 1809 bp, Sorghum bicolor
  misc_feature: Ceres ANNOT ID no. 6011760
  misc_feature: Encodes the peptide sequence at SEQ ID NO 966
atggccgccgctctcccgcactcccacctccgcctcccgctccacaccccaagtcccacctcccgccgtcgcccccgccttcgcctgccctccgtcgtcgccgtctcgcgccttcagaaccccaccaccacaacccacccagtcctgccacccccggctccgcccccctccgcggcgctcctcgccgccgagggcgcctccctcgcgccgcgccgggagccccgcttcccgggctcggtctcctctccaacaagctccgcctccgccggcctctccgaggcggaggacgccgtcgtgcgccgcgccctccaggtgcgccgcgccgtcgccgccgaggcgctcgtggccgcgctcggcggcgggaaggtcggcggtctgacttacgtcaagaacctcatgtcgcggatgggcccgttcgtggaccgcgtcgtcgtcgaggccgccgcgatgcggcgggaccgtcccgacctcgcccacatgtccttcaacgcccgggcaaaggcgtacatcctggagtccggcctcgtcgagctagtcaagtggttcaagcacaattcaatgacatatccccaaatcgcaaaagtcgtttgcgcatgttctggcgatttggggaaagttaggaggatgataaagtggctaaggtccatttatgtaaaaggagactttttggggcgcgtccttgcaaatggtggatccttcttgaaccgaagttttgaagaactggaagagattatcggctatttggaaagccatggtgtcaggagagattggattggttatgtggtcagcagatgtccacagctgctgagcttgccaatggatgagttggagacacgggtcaggttttatacggatttgggaatggacgagaaggactttggcacaatggtctatgattatccaagagttcttggatttttaagcctggaagagatgaacagtaaggttcaatatttgaaagaatttggtttaagcactgaagaacttgggaggttactggctttcaagccacagctcatggcctgtagcattgaagaaaggtggaaacctcttgtgaaatacctgtatcaccttaacattacaagggatggcatgaaacgaatgttgatggtccaaccaacaatattctgtcttgatttggagacagtgattgtaccaaaggtacaatttctaatggatattggtgtgaggagtgatgcaatcggcaatgtgcttgtgaagttccctcctgtattaacgtatagcctgtacaagaaaatacgcccagtggttatattcctgctgacgaaaggtggagtaaaacaggatgacatcggaaaggttattgccttggatccacagctcttgggctgtagtattgcccataagctagaagttagtgtcaagtacttccggtcactgggcatctaccactttgtgctgggtcagatgattgccgacttcccaacacttctcagatacaatgtggatatcctgagaccaaaataccagtacttgaggcgtgtaatggtgcggccactgaaggacctcattgaatttcctcggttcttcagttactccctggaggacaggatagagcctcgacaccaaactttggtggcgaacaggatcaacatgaagctgcggtacatgctgactggctctgacgaagagtttgcacagagggtgcgagaggctgtcgagaggagagcgagatttgaagctagaaaggcttgtccggagacattttcaggttcttcagagacatccagggaaacagaaggtacagtagcaccagcatgccaagatagcatagatgtggtggattag

SEQ ID NO: 966 - protein, 602 aa, Sorghum bicolor
  misc_feature: Ceres ANNOT ID no. 6011760
  misc_feature (194)..(554): Pfam Id: mTERF Pfam Desc: mTERF
  misc_feature (93)..(568): NCBI GI: 42569224 NCBI Desc: mitochondrial transcription termination factor-related / mterf-related [arabidopsis thaliana]
  misc_feature (181)..(568): NCBI GI: 92885872 NCBI Desc: mterf [medicago truncatula]
  misc_feature (181)..(568): NCBI GI: 140044566 NCBI Desc: mitochodrial transcription termination factor-related [medicago truncatula]
  misc_feature (221)..(553): NCBI GI: 33589698 NCBI Desc: at1g78930 [arabidopsis thaliana]
  misc_feature (244)..(557): NCBI GI: 47497486 NCBI Desc: mitochondrial transcription termination factor-like [oryza sativa (japonica cultivar-group)]
  misc_feature: Useful for making plants with altered terpenoid content
  misc_feature: Functional homolog of the protein sequence given in SEQ ID NO 13264
MAAALPHSHLRLPLHTPSPTSRRRPRLRLPSVVAVSRLQNPTTTTHPVLPPPAPPPSAALLAAEGASLAPRREPRFPGSVSSPTSSASAGLSEAEDAVVRRALQVRRAVAAEALVAALGGGKVGGLTYVKNLMSRMGPFVDRVVVEAAAMRRDRPDLAHMSFNARAKAYILESGLVELVKWFKHNSMTYPQIAKVVCACSGDLGKVRRMIKWLRSIYVKGDFLGRVLANGGSFLNRSFEELEEIIGYLESHGVRRDWIGYVVSRCPQLLSLPMDELETRVRFYTDLGMDEKDFGTMVYDYPRVLGFLSLEEMNSKVQYLKEFGLSTEELGRLLAFKPQLMACSIEERWKPLVKYLYHLNITRDGMKRMLMVQPTIFCLDLETVIVPKVQFLMDIGVRSDAIGNVLVKFPPVLTYSLYKKIRPVVIFLLTKGGVKQDDIGKVIALDPQLLGCSIAHKLEVSVKYFRSLGIYHFVLGQMIADFPTLLRYNVDILRPKYQYLRRVMVRPLKDLIEFPRFFSYSLEDRIEPRHQTLVANRINMKLRYMLTGSDEEFAQRVREAVERRARFEARKACPETFSGSSETSRETEGTVAPACQDSIDVVD

SEQ ID NO: 967 - DNA, 804 bp, Sorghum bicolor
  misc_feature: Ceres ANNOT ID no. 6011775
  misc_feature: Encodes the peptide sequence at SEQ ID NO 968
atggcggcgcgaaaccttctgcggcgtgcggcgtacgcggcggcgtgcggtcaccgcttccccgtccctgttccctcaggcgctcttgctggttctggaagccggagcatcggcgccgccgctcagggtcttcgtcattatgctgccccgtccagtgtggaggatgcagtggaaaacttggaaatgcatgcacccaaggcaaaccgtcggtcaaatatcccaaagaaaaatggaacagccatgatgcttccactccatttccattacgaagatgtactacgtcaggatctgttgctcaaacagaatcatgccaatatcatgcaagttccagggttgtttgagatcaaactagcaccaaaagcaggctccgatctcaagatcccaattggaaaaatggctatggaggttttgagtggtcagagattcaaagaggcacaaagtgacccttttgcgaaagcaagaaagtcttctcgaaccaatccatttatcggggctgacaaggacagtagcaccgcctttgcgcaaccgactgttctccgaggacatgcaatgtacaactttttggtgaggatgctgacagtgatgtccatgttagactcgcgggccgaaattcgggaaaacactataaagttcttcatggaaacagagttctgcgagttctctccggaattggaagaccatttcgagatctttgagcacatccgaggtttcaatgtgactatcgttacttcagccgatacaaaggatgagacctcactactttggagtggcttcacgcttaatgatgagggagagactaagtaa

SEQ ID NO: 968 - protein, 267 aa, Sorghum bicolor
  misc_feature: Ceres ANNOT ID no. 6011775
  misc_feature (1)..(267): NCBI GI: 30351950 NCBI Desc: mitochondrial ribosomal protein l5 [zea mays]
  misc_feature (84)..(267): NCBI GI: 67043677 NCBI Desc: mitochondrial ribosomal protein l5 [panicum repens]
  misc_feature (98)..(255): NCBI GI: 67043681 NCBI Desc: mitochondrial ribosomal protein l5 [zea mays]
  misc_feature (84)..(260): NCBI GI: 67043673 NCBI Desc: mitochondrial ribosomal protein l5 [chasmanthium latifolium]
  misc_feature (81)..(267): NCBI GI: 81176514 NCBI Desc: rpl5 [triticum aestivum]
MAARNLLRRAAYAAACGHRFPVPVPSGALAGSGSRSIGAAAQGLRHYAAPSSVEDAVENLEMHAPKANRRSNIPKKNGTAMMLPLHFHYEDVLRQDLLLKQNHANIMQVPGLFEIKLAPKAGSDLKIPIGKMAMEVLSGQRFKEAQSDPFAKARKSSRTNPFIGADKDSSTAFAQPTVLRGHAMYNFLVRMLTVMSMLDSRAEIRENTIKFFMETEFCEFSPELEDHFEIFEHIRGFNVTIVTSADTKDETSLLWSGFTLNDEGETK

SEQ ID NO: 969 - DNA, 1857 bp, Sorghum bicolor
  misc_feature: Ceres ANNOT ID no. 6011800
  misc_feature: Encodes the peptide sequence at SEQ ID NO 970
atgaacgccgacttcggcgcacccaaggagctcgcgggggggctgcagcatcgacgggccctctaccagcctcccctcccgccatgcctgcaggggccgacggtgagggccgagtacggcgacgcgaccaccaccatcgaccccacctgtgcccaagccgtcgcgcaggccttcccgcacaccttcggccagccgctcgtcagctttgtcgcgccgtccgccgacgccgcagctgctgaggagcgccacccgatcagggtgggcgtggtgttctctgggaggcagtcgccgggagggcacaacgtcgtctggggcctccatgacgcactcaaagcctacaatcctcagagcgtgctctacggatttgtcggtggcacggagggactgtttgcaaacaagacgttggtgctcacagacgatgttcttgcttcctataagaaccaaggtggcttcgatttgctcggtaggagtatcgatcagatccgcactactaagcaagtgaatgctgcaatgacaacatgccgcagtctgaacttggatgggttggtcatcattggaggagtgacctccaattcagatgctgcacagcttgcagagacccttatacagaataactgtaagaccaaggtcgttggtgtgccagtttcattgaatggtgacctcaagaaccagttcgttgaaacaacagttggatttgatacagtgtgcaaggttaattcacagcttgtaagcaatgtttgcctcgatgcaatctcagctggaaagtactattattttgttcgtctgatgggacggaaagcatctcatgttgcctttgaatgtgcacttcagtcacacccaaacatgctcatcttaggagaggaagtagcattgtcaaaactcactctgatggaaattataaacaagatatgcgatggtgtacaagcaagggcagaattagggaaatatcatggtgtgcttgtaattcccgaaggacttatagaaagcattccagaaatgtatgctcttattcaggaaatcaatatccttcacaacaataatgttccggtggctgagatgtcatcacaactgtctccatgggcagctgctctgttccagttcttgccacccttcatcagaagagagctgctgctccaccaagaatcagataactctgcacagttgtcccagattgacacggagcaactgttagcccatctagtagaaacagaaatgataaagagaacaaaagaaggaagatacaagggaaggaagttcagttcagtttgtcatttctttggatatcaggctcgaggatctataccgtcaaattttgactgtgactatgcttatgctcttggacgtatctccctgcatatgatcacagttggattgactgggtacatggcaactgtggctaacctgaaagaccctgttgacaaatggagatgtgctgctgctcctttaactgcgatgatgagtgtcaagaggcatttacgtggccctggagcaatccctataggaagaccttccattcatccttcccccattgacctaaaagggaaggcttatgagttgctgcgagagaaggcttcaagcttcctcctcgatgacttctacaggactccaggaggcattcagttcgaagggcctggttcagacgcaaagcccatcacactgaccattgagaaccaggactacatgggcgacattgagatactgaaagagtatcttggcaaggttaggaccatggtgaagccagggtgctcccgggagatcctgaaggcagcaatcagctccatggtgtcggtgacggatgtgcttaccgtgatgtcccaccccctcaacaccgagctgcccctctaccatttcaagtga

SEQ ID NO: 970 - protein, 618 aa, Sorghum bicolor
  misc_feature: Ceres ANNOT ID no. 6011800
  misc_feature (86)..(366): Pfam Id: PFK Pfam Desc: Phosphofructokinase
  misc_feature (1)..(614): NCBI GI: 483547 NCBI Desc: pyrophosphate-dependent phosphofructokinase alpha subunit [ricinus communis]
  misc_feature (1)..(607): NCBI GI: 115467858 NCBI Desc: os06g0326400 [oryza sativa (japonica cultivar-group)]
  misc_feature (1)..(605): NCBI GI: 3790102 NCBI Desc: pyrophosphate-dependent phosphofructokinase alpha subunit [citrus x paradisi]
  misc_feature (1)..(613): NCBI GI: 169538 NCBI Desc: pyrophosphate-fructose 6-phosphate 1-phosphotransferase alpha-subunit
  misc_feature (1)..(605): NCBI GI: 30725422 NCBI Desc: at1g20950 [arabidopsis thaliana]
  misc_feature (1)..(614): SWISSPROT Homolog: EC 2.7.1.90 Pyrophosphate--fructose 6-phosphate 1-phosphotransferase alpha subunit
MNADFGAPKELAGGLQHRRALYQPPLPPCLQGPTVRAEYGDATTTIDPTCAQAVAQAFPHTFGQPLVSFVAPSADAAAAEERHPIRVGVVFSGRQSPGGHNVVWGLHDALKAYNPQSVLYGFVGGTEGLFANKTLVLTDDVLASYKNQGGFDLLGRSIDQIRTTKQVNAAMTTCRSLNLDGLVIIGGVTSNSDAAQLAETLIQNNCKTKVVGVPVSLNGDLKNQFVETTVGFDTVCKVNSQLVSNVCLDAISAGKYYYFVRLMGRKASHVAFECALQSHPNMLILGEEVALSKLTLMEIINKICDGVQARAELGKYHGVLVIPEGLIESIPEMYALIQEINILHNNNVPVAEMSSQLSPWAAALFQFLPPFIRRELLLHQESDNSAQLSQIDTEQLLAHLVETEMIKRTKEGRYKGRKFSSVCHFFGYQARGSIPSNFDCDYAYALGRISLHMITVGLTGYMATVANLKDPVDKWRCAAAPLTAMMSVKRHLRGPGAIPIGRPSIHPSPIDLKGKAYELLREKASSFLLDDFYRTPGGIQFEGPGSDAKPITLTIENQDYMGDIEILKEYLGKVRTMVKPGCSREILKAAISSMVSVTDVLTVMSHPLNTELPLYHFK

SEQ ID NO: 971 - DNA, 1071 bp, Sorghum bicolor
  misc_feature: Ceres ANNOT ID no. 6011832
  misc_feature: Encodes the peptide sequence at SEQ ID NO 972
atggatcagagctttgggaatctcggggccggagctggtggtgggagcagcagcgggggctccaactccaaggcggcggtgtcgtcgtcctcgttcctgcagctgccgctgtcgacggcgtcccccgcgtactacggcgcgccgctcgcgctcctgcaccaccacgccgccgccgtcgccgcgggcggccccggcccgtcgtcgtcgcagcagcagcagtcgccgtacgccaccaagcacgccagcaccgccgagatgtcgtcggcggaggccgaggccatcaaggccaagatcgtcgcgcacccgcagtactcggcgctcctcgccgcctacctcgactgccagaaagtgggcgcgccgccggacgttctggagaggctgacggccatggcggcgaagctggacgcgcgcccgccgggccgccacgagccgcgcgacccggagctggatcagttcatggaggcgtactgcaacatgctcgtcaagtaccgggaggagctgacccggcccatcgacgaggccatggagttcctcaagcgggtggaggcgcagctcgactccatctccggcggcggcggctcctcctcctccgcgcgcctctccctcaccgatggtaaatcagaaggtgtcggctcttctgaagatgacatggatccaagcggccgtgagaatgacccaccggagattgacccgcgagcggaggacaaggagctcaaataccagctcctgaagaagtacagtggctacttgagcagcctcaggcaagagttttccaagaaaaagaagaaagggaagctcccaaaggaggccaggcagaaactgctccactggtgggagctgcactacaagtggccttacccttcagagacggagaagattgcgcttgcagagtcaacaggcctagaccagaagcagatcaacaactggttcatcaaccagaggaaacggcattggaagccgtcagaggacatgcctttcgtgatgatggaaggcttccacccgcagaacgccgctgcgctgtacatggacggcccattcatggccgacggcatgtaccgcctcggttcatga

SEQ ID NO: 972 - protein, 356 aa, Sorghum bicolor
  misc_feature: Ceres ANNOT ID no. 6011832
  misc_feature (139)..(190): Pfam Id: KNOX2 Pfam Desc: KNOX2 domain
  misc_feature (92)..(136): Pfam Id: KNOX1 Pfam Desc: KNOX1 domain
  misc_feature (237)..(258): Pfam Id: ELK Pfam Desc: ELK domain
  misc_feature (1)..(356): NCBI GI: 3024577 NCBI Desc: homeobox protein rough sheath 1
  misc_feature (1)..(356): NCBI GI: 32351469 NCBI Desc: homeobox transcription factor gnarly1 [zea mays]
  misc_feature (1)..(356): NCBI GI: 34395067 NCBI Desc: homeobox gene [oryza sativa (japonica cultivar-group)]
  misc_feature (1)..(356): NCBI GI: 2935575 NCBI Desc: knox class homeodomain protein [oryza sativa]
  misc_feature (1)..(356): NCBI GI: 4887608 NCBI Desc: homeobox gene [oryza sativa (japonica cultivar-group)]
  misc_feature: Abnormal phyllotaxy, leaf number higher than wild-type
  misc_feature: No seed is being produced by the plant
  misc_feature: The plant is abnormally small.
  misc_feature: The plant produces a reduced number of seeds.
  misc_feature: There is no branching.
  misc_feature: Useful for biocontainment applications
  misc_feature: Useful for making plants with altered Lignin content
  misc_feature: Useful for making plants with modulated biomass
  misc_feature: Functional homolog of the protein sequence given in SEQ ID NO 13065
  misc_feature: Functional homolog of the protein sequence given in SEQ ID NO 13205
  misc_feature: GREAT-hit functional homolog of the protein sequence given in SEQ ID NO 13209
  misc_feature: GREAT-hit functional homolog of the protein sequence given in SEQ ID NO 13573
  misc_feature: Useful for making plants with modulated biomass
  misc_feature: Functional homolog of the protein sequence given in SEQ ID NO 13573
  misc_feature: Useful for biocontainment applications
  misc_feature: Functional homolog of the protein sequence given in SEQ ID NO 12970
  misc_feature: The sequence is a functional homolog of SEQ ID NO. 320 in the 11/188,298 US application
  misc_feature: The sequence is a functional homolog of SEQ ID NO. 499 in the 11/188,298 US application
MDQSFGNLGAGAGGGSSSGGSNSKAAVSSSSFLQLPLSTASPAYYGAPLALLHHHAAAVAAGGPGPSSSQQQQSPYATKHASTAEMSSAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDSISGGGGSSSSARLSLTDGKSEGVGSSEDDMDPSGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 973 - DNA, 519 bp, Sorghum bicolor
  misc_feature: Ceres ANNOT ID no. 6011842
  misc_feature: Encodes the peptide sequence at SEQ ID NO 974
atggcgtcgtcctcctcgtcaccgacgaagctgctagcgtgcctcgtcgccgcagctctggcgctggctgccaccgtcgtcgcgccgtgcgcggcgcagaactcgccgcaggactacgtgaacccgcacaacgcggcgcgcgccgacgtcggcgtcggcccggtgtcgtgggacgacacggtggccgcgtacgcgcagagctacgcggcgcagcggcagggcgactgcaagctgatccactccggcggtccctacggcgagaacatcttctggggctccgccggcgccgactggtcggcgtccgacgccgtggcgtcgtgggtttccgagaagcagtactacaaccacgacaccaacagctgcgcggacggcaaggtgtgcgggcactacacgcaggtggtgtggcgtgactccacggccatcggctgcgcccgcgtcgtctgcgacaacaacgccggcgtcttcatcatctgcagctacaacccgccgggcaactacgtcggccagagcccatactag

SEQ ID NO: 974 - protein, 172 aa, Sorghum bicolor
  misc_feature: Ceres ANNOT ID no. 6011842
  misc_feature (40)..(160): Pfam Id: SCP Pfam Desc: SCP-like extracellular protein
  misc_feature (12)..(172): NCBI GI: 75994059 NCBI Desc: pathogenesis-related protein 1 [zea mays subsp. parviglumis]
  misc_feature (12)..(172): NCBI GI: 3290004 NCBI Desc: pathogenesis related protein-1 [zea mays]
  misc_feature (13)..(172): NCBI GI: 75994041 NCBI Desc: pathogenesis-related protein 1 [zea mays subsp. parviglumis]
  misc_feature (12)..(172): NCBI GI: 75994085 NCBI Desc: pathogenesis-related protein 1 [zea diploperennis]
  misc_feature (12)..(172): NCBI GI: 75994069 NCBI Desc: pathogenesis-related protein 1 [zea mays subsp. parviglumis]
MASSSSSPTKLLACLVAAALALAATVVAPCAAQNSPQDYVNPHNAARADVGVGPVSWDDTVAAYAQSYAAQRQGDCKLIHSGGPYGENIFWGSAGADWSASDAVASWVSEKQYYNHDTNSCADGKVCGHYTQVVWRDSTAIGCARVVCDNNAGVFIICSYNPPGNYVGQSPY

SEQ ID NO: 975 - DNA, 519 bp, Sorghum bicolor
  misc_feature: Ceres ANNOT ID no. 6011847
  misc_feature: Encodes the peptide sequence at SEQ ID NO 976
atggcgtactcacggaaactagcgccccttgctgtggccttagcaaccatcgtcgtcgtcctgctggtggttgtcactcccagcgcggcgcaggggtcgtcggcgcaggacgtcgtcgtctacctgcacaacgaggcgcgcgccgacgtgggtgtcaagcccttgtcgtggaacgagagcctggccacctacgcggcgaactacgcggcggcgcggcaggacgactgcaacctgacgctctccggcgggccctacggcgagaacctcttctggggcgccgccggcggcaactattcggccgccgacgtcgtgggtctgtgggtgtcccagaagcagtactacgaccacgacagtaacacctgcgcagcaggggagaggtgcgactcgtacacgcaggtggtgtggagcggcaccaccaccatcggctgcgccgccgtcgagtgcagcaacaacgccggcgtcttcgccatctgcagctacaacccgccggggaacctcgacggccagagcccgtactag

SEQ ID NO: 976 - protein, 172 aa, Sorghum bicolor
  misc_feature: Ceres ANNOT ID no. 6011847
  misc_feature (40)..(160): Pfam Id: SCP Pfam Desc: SCP-like extracellular protein
  misc_feature (7)..(172): NCBI GI: 75994079 NCBI Desc: pathogenesis-related protein 1 [zea diploperennis]
  misc_feature (7)..(172): NCBI GI: 75994067 NCBI Desc: pathogenesis-related protein 1 [zea mays subsp. parviglumis]
  misc_feature (7)..(172): NCBI GI: 75994059 NCBI Desc: pathogenesis-related protein 1 [zea mays subsp. parviglumis]
  misc_feature (7)..(172): NCBI GI: 75994063 NCBI Desc: pathogenesis-related protein 1 [zea mays subsp. parviglumis]
  misc_feature (7)..(172): NCBI GI: 75994087 NCBI Desc: pathogenesis-related protein 1 [zea diploperennis]
MAYSRKLAPLAVALATIVVVLLVVVTPSAAQGSSAQDVVVYLHNEARADVGVKPLSWNESLATYAANYAAARQDDCNLTLSGGPYGENLFWGAAGGNYSAADVVGLWVSQKQYYDHDSNTCAAGERCDSYTQVVWSGTTTIGCAAVECSNNAGVFAICSYNPPGNLDGQSPY

SEQ ID NO: 977 - DNA, 711 bp, Sorghum bicolor
  misc_feature: Ceres ANNOT ID no. 6011848
  misc_feature: Encodes the peptide sequence at SEQ ID NO 978
atggccggccgccgcgaaggcgagcgccaggcgagcccgtggccgtccgggacggccgcggtggaggactcgggcgccttcccctccgccatcatcttcttcgccctcgtcggcgccaccggcaccaccgccgccgtcggacaactgcgccggacggtcagctggctctacactcagcttcgtaggtccgaaccgtatgtattctgggaagacatacctcgtcgtcgaccaaatcagcgtggtgaagcctgggaacggtatcaccagaggatgcgtgaaagggctgaggatcaaagggaaagagtggaacgcatacggcgcatgcaagatgtatttgaaaaggagagatgtaaatgccgggattatcggacttgggaaagccataatcccaactattatcagcatcatcaaagagctgactggtactggaatgcagaaacattttatgcgaatcaaaggacaaatttcagggcgatgcccagggaagctatgagttacactatgttacatcactattctgttttgggccttgacaggtcaagatcagagccattttcagatgctgaaatcaagaatgctttcaggagaaaagcaatggagtatcatccagatcaaaaccaaaataataaagaggttgctgaggcaaaattcaaagaggttatggattcttatgaagcaataaaactagaacggcgaaacagaagttgctga

SEQ ID NO: 978 - protein, 236 aa, Sorghum bicolor
  misc_feature: Ceres ANNOT ID no. 6011848
  misc_feature (170)..(237): Pfam Id: DnaJ Pfam Desc: DnaJ domain
  misc_feature (1)..(235): NCBI GI: 34395286 NCBI Desc: dnaj protein family-like protein [oryza sativa (japonica cultivar-group)]
  misc_feature (1)..(234): NCBI GI: 18413065 NCBI Desc: dnaj heat shock n-terminal domain-containing protein [arabidopsis thaliana]
  misc_feature (168)..(227): NCBI GI: 54887416 NCBI Desc: dnajb10 protein [mus musculus]
  misc_feature (171)..(227): NCBI GI: 144832 NCBI Desc: dnaj
  misc_feature (164)..(234): NCBI GI: 124003497 NCBI Desc: chaperone protein dnaj [microscilla marina atcc 23134]
MAGRREGERQASPWPSGTAAVEDSGAFPSAIIFFALVGATGTTAAVGQLRRTVSWLYTQLRRSEPYVFWEDIPRRRPNQRGEAWERYHQRMRERAEDQRERVERIRRMQDVFEKERCKCRDYRTWESHNPNYYQHHQRADWYWNAETFYANQRTNFRAMPREAMSYTMLHHYSVLGLDRSRSEPFSDAEIKNAFRRKAMEYHPDQNQNNKEVAEAKFKEVMDSYEAIKLERRNRSC

SEQ ID NO: 979 - DNA, 1101 bp, Sorghum bicolor
  misc_feature: Ceres ANNOT ID no. 6011856
  misc_feature: Encodes the peptide sequence at SEQ ID NO 980
atggcgccgccgccgcgggagctggtcagcgacatcatctccgagatcctcctccgcctcccaccggacgagcccgagtgcctcttccgcgccgccctcgtctgcaagccatggctccgcaccatctccgaccccggcttcctcggccgctaccgcgccttccacggaacccctcctctcctcggccttattgacgcggaccagaaaatcgacagaagctggtttttccgcctcgtccccaccagagtagtgcccgcgttcccttttccggcgcccgacacctgcggtgagctgcccctcgactgccgccatggccgcgtcctcatcggcatggttcaagactggcgtatgtgttaccttgtccttgaccctgttacgggcgtccgctgtcacctaccccagccgaaaatcaggtacgctgggatcggccacatttgcagcgctgctgctgactgcagacaccttgactgccatggcgatcccttctgtgtggtcttgatgatcagagacggctcaactgctacaatgtcagcaacattttattcgtcagagataggcgcatggagcgaggcagccacattgcaaggcattcgtggactctacgggcgtggtgcccttatcggagatggaatctacttcatgctatacttgaatactggaattatcaagtatgactgggggaagaatagcttgtctctggctaatcccccgccatcggtagtgtacagcaatcgggttaccctcatggtgatggaggactcttctcttgggatcgctgagattaagcattccagtctttatttgtggtcaagaagggcgagttcagaggaaaatgcagaatgggtacagtgcagggtcattgatctggacacaatgatgcccatggcaaatccgagtgatggagcatatgtggttggcttcgcagagggtgtggacgttatcttcgtcagaacacttgttggattattcatgatggagctcaagtcagggcgagtgacgaaacgtcacgagcctgattatctttcaagtgtcctaccctacatggccttctacactcctgaggggtttgcagcatgggtgcagatacaaatacaatattga

SEQ ID NO: 980 - protein, 366 aa, Sorghum bicolor
  misc_feature: Ceres ANNOT ID no. 6011856
  misc_feature (3)..(53): Pfam Id: F-box Pfam Desc: F-box domain
  misc_feature (203)..(353): NCBI GI: 115475786 NCBI Desc: os08g0299900 [oryza sativa (japonica cultivar-group)]
  misc_feature (1)..(353): NCBI GI: 115437584 NCBI Desc: os01g0557400 [oryza sativa (japonica cultivar-group)]
  misc_feature (1)..(353): NCBI GI: 115470391 NCBI Desc: os07g0122900 [oryza sativa (japonica cultivar-group)]
  misc_feature (21)..(353): NCBI GI: 115481210 NCBI Desc: os10g0158700 [oryza sativa (japonica cultivar-group)]
  misc_feature (11)..(199): NCBI GI: 115481344 NCBI Desc: os10g0188000 [oryza sativa (japonica cultivar-group)]
MAPPPRELVSDIISEILLRLPPDEPECLFRAALVCKPWLRTISDPGFLGRYRAFHGTPPLLGLIDADQKIDRSWFFRLVPTRVVPAFPFPAPDTCGELPLDCRHGRVLIGMVQDWRMCYLVLDPVTGVRCHLPQPKIRYAGIGHICSAAADCRHLDCHGDPFCVVLMIRDGSTATMSATFYSSEIGAWSEAATLQGIRGLYGRGALIGDGIYFMLYLNTGIIKYDWGKNSLSLANPPPSVVYSNRVTLMVMEDSSLGIAEIKHSSLYLWSRRASSEENAEWVQCRVIDLDTMMPMANPSDGAYVVGFAEGVDVIFVRTLVGLFMMELKSGRVTKRHEPDYLSSVLPYMAFYTPEGFAAWVQIQIQY

SEQ ID NO: 981 - DNA, 1944 bp, Sorghum bicolor
  misc_feature: Ceres ANNOT ID no. 6011858
  misc_feature: Encodes the peptide sequence at SEQ ID NO 982
atgaccaacaacaacggcaatggcacgaacgcggcggcgagcagctggctaggcttctcgctgtcgcctcacatggcctccgccatggacgagcaccaccacgttcagcagcaacagcagcaccaccaccaccatagcctcttcttcccttccgtcactgcggcggccgccgccgcctacggcctcggtggcagcgacggcggcgtggccaccagcgcgtcgccgtactacacgccgcagctggcgtccatgccgctcaagtccgacggctccctctgcatcatggaggcgctccggaggagcgatcaaccagatcaccatgggcccaagctcgaggacttcctgggcgcggcggcggcgcagtcgcaggccatggcgctgagcctgcaggacaaccccgcggcggccgcctccagcttctactactacggcaacggcgggggcggcggttcggggcaccagcaccacggcgggttcctgcagccgtgcgccgacctgtacggcgggccctcggaggcgtccctggtggcggacgacgacgaggctgcggccgccgcgacggccatggcgagctgggtggcggcgcgcgccggcgagagcggcggcgtgctgtccgctgctgctgccgcggccgggcaccagcaccaccaccacgcgctggccctgtccatgagctccgggtcgctgtcgagctgcgtgaccgcgcaccccggcgccgccgccgccgactatggcgtggtggcggccaccgcgtcggcgtcgctggatggcgggcgcaagcgcggcggcgcggcggggcagaagcagcccgtgcaccaccgcaagtccatcgacacgttcgggcagaggacgtcgcagtaccgcggcgtcaccaggcataggtggacagggaggtatgaggcacacctgtgggacaacagctgcaagaaggaaggccagactaggaagggcaggcaaggcgggtacgacatggaggagaaggcggcgagagcttacgaccttgcggcgctcaagtactggggcccttccacgcacatcaacttcccgctggaggactaccaggaggagctggaggagatgaagaacatgacacggcaggagtacgtggctcacctcaggaggaagagcagcggcttctcacggggcgcgtcgatgtaccgaggagtcacaaggcaccaccagcacgggcgttggcaggcgcgcatcggccgcgtctccggcaacaaggacctctacctcggcaccttcagcacgcaggaggaggcggcggaggcgtacgacatcgcggcgatcaagttccgggggctcaacgccgtcaccaacttcgacatcacgcgctacgacgtcgacaagatcatggccagcaacacgctgctgccgggcgacctcgcgcgccgcaggaaggacgacgacccggctgccgtcatcgccggcgccgacgccagcaacggcggcggcgtcacgaccgcggcggcggcggccgccctggtgcagcaggccgctggtgccgcgccgagggatggaaaccaccaccaccaccaccacgacgtgctctccggcgaggccttctccgtgctgcacgacctggtggtcaccgccgcggatggcggcaacggcaacggcaacggcggacaccaccaccaccacgtccacaacagcgcagccaccgcgcagcacatgtccatgtccagcgcgtcgtcgctcgtcaccagcctcggcaactcccgggagggcagccccgaccgcggcggcggcctgtccatgctcttctccaagccgccggctccagcaccagcagcctcggcgcacgccgccaacaagccgatgagcccgctcatgccgcttggctcctgggcgtccacggcggcggcgtccgccagggccgccgccgccgccgtctccatcgcgcacatgcccgtcttcgccgcctggaccgacgcctga

SEQ ID NO: 982 - protein, 647 aa, Sorghum bicolor
  misc_feature: Ceres ANNOT ID no. 6011858
  misc_feature (285)..(342): Pfam Id: AP2 Pfam Desc: AP2 domain
  misc_feature (384)..(436): Pfam Id: AP2 Pfam Desc: AP2 domain
  misc_feature (9)..(374): NCBI GI: 115455605 NCBI Desc: os03g0770700 [oryza sativa (japonica cultivar-group)]
  misc_feature (3)..(593): NCBI GI: 38492172 NCBI Desc: ant-like protein [nicotiana tabacum]
  misc_feature (251)..(489): NCBI GI: 1171429 NCBI Desc: ckc
  misc_feature (258)..(469): NCBI GI: 76365509 NCBI Desc: aintegumenta 2 [brassica napus]
  misc_feature (310)..(647): NCBI GI: 115470415 NCBI Desc: os07g0124700 [oryza sativa (japonica cultivar-group)]
  misc_feature: The sequence is a functional homolog of SEQ ID NO 400 in the 10/374,780US patent application
  misc_feature: The sequence is a functional homolog of SEQ ID NO 592 in the 10/225,066US patent application
  misc_feature: Useful for making plants with modulated biomass
  misc_feature: Useful for making plants with modulated growth and phenotype characteristics
  misc_feature: GREAT-hit functional homolog of the protein sequence given in SEQ ID NO 13511
  misc_feature: The sequence is a functional homolog of SEQ ID NO 592 in the 20050160493 US patent application
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: Useful for biocontainment applications
  misc_feature: Functional homolog of the protein sequence given in SEQ ID NO 13650
  misc_feature: The sequence is a functional homolog of SEQ ID NO. 274 in the 11/188,298 US application
MTNNNGNGTNAAASSWLGFSLSPHMASAMDEHHHVQQQQQHHHHHSLFFPSVTAAAAAAYGLGGSDGGVATSASPYYTPQLASMPLKSDGSLCIMEALRRSDQPDHHGPKLEDFLGAAAAQSQAMALSLQDNPAAAASSFYYYGNGGGGGSGHQHHGGFLQPCADLYGGPSEASLVADDDEAAAAATAMASWVAARAGESGGVLSAAAAAAGHQHHHHALALSMSSGSLSSCVTAHPGAAAADYGVVAATASASLDGGRKRGGAAGQKQPVHHRKSIDTFGQRTSQYRGVTRHRWTGRYEAHLWDNSCKKEGQTRKGRQGGYDMEEKAARAYDLAALKYWGPSTHINFPLEDYQEELEEMKNMTRQEYVAHLRRKSSGFSRGASMYRGVTRHHQHGRWQARIGRVSGNKDLYLGTFSTQEEAAEAYDIAAIKFRGLNAVTNFDITRYDVDKIMASNTLLPGDLARRRKDDDPAAVIAGADASNGGGVTTAAAAAALVQQAAGAAPRDGNHHHHHHDVLSGEAFSVLHDLVVTAADGGNGNGNGGHHHHHVHNSAATAQHMSMSSASSLVTSLGNSREGSPDRGGGLSMLFSKPPAPAPAASAHAANKPMSPLMPLGSWASTAAASARAAAAAVSIAHMPVFAAWTDA

SEQ ID NO: 983 - DNA, 1146 bp, Sorghum bicolor
  misc_feature: Ceres ANNOT ID no. 6011860
  misc_feature: Encodes the peptide sequence at SEQ ID NO 984
atggcggcttctgctggtccggcggcggctgcggtgggagaggaggaggccggggagagccggaagctcttcgtcggcgggatcccggcgggggcgcaggagcccgagctgcgggcccacttcgcgcgcttcggggaggtgcgctccgtcatcgtcatgcgggacagggagacgggacacggccgcgggttcggcttcgtcgagttcgaggacgaggccgccgcagccgccgcgctcggcgacggggacgcgccaaggcacttcctctgcggccgcatggtggacgttaagagggcaaggacaagggctccgcgaaaccagggcgagcagcactcccagcctcagcaggctgaacaaggccggggtcaggggaaccaggacaatcagtcccccgctgctggtaacggtaccgcggacagcgacaacaacgtgagctatgattcaaaaaaggtgttcattggtggtttgcgggataacatcaccgaggaggagttccggtcttactttgagacgtttggcactgtaacggatgtcgtggtgatttatgacagcgcgacgagccggtcgagggggttcggtttcgtcacctttgactcggaggaagcagtgggaaaggtgatgcggcagagctttcataacctaaacgggaccaaggtagaggccaagattgctatccccaaggatgaggcgtattaccgtaacagaggccgtggcgcacgtccctttggtgggaggggccctgctggctatgaaggctccatgtaccaaccatacaatgctagatatggcccatacaatggctacatgccacaacctgttcctgcccagccctactttcctgccccctattttgctgtgggggcctatccctatgggagtggatacccaagccaaggcgtcatgacaaacgttcctggcatgatgtcaaggcggattcctccggcctatggaacatatcctcaaatgtatccagggtttaaccttctatacagagctggttatggtggtgcagccacttcttttcagcatggaattaatggtggaagtgataacaaaaaggatcaaacgagtgtagatatgcagcaagttgacaacacttctagtgttgcgacaatgttggaacatatgaagctaggttcacaatga

SEQ ID NO: 984 - protein, 381 aa, Sorghum bicolor
  misc_feature: Ceres ANNOT ID no. 6011860
  misc_feature (23)..(96): Pfam Id: RRM_1 Pfam Desc: RNA recognition motif. (a.k.a. RRM, RBD, or RNP domain)
  misc_feature (151)..(221): Pfam Id: RRM_1 Pfam Desc: RNA recognition motif. (a.k.a. RRM, RBD, or RNP domain)
  misc_feature (121)..(337): NCBI GI: 7268135 NCBI Desc: ribonucleoprotein like protein [arabidopsis thaliana]
  misc_feature (148)..(323): NCBI GI: 30696616 NCBI Desc: rna recognition motif (rrm)-containing protein [arabidopsis thaliana]
  misc_feature (22)..(346): NCBI GI: 18181938 NCBI Desc: rna binding protein [arabidopsis thaliana]
  misc_feature (22)..(346): NCBI GI: 6566348 NCBI Desc: rna binding protein [arabidopsis thaliana]
  misc_feature (148)..(323): NCBI GI: 9758187 NCBI Desc: rna-binding protein-like [arabidopsis thaliana]
  misc_feature: The sequence is a functional homolog of SEQ ID NO. 458 in the 11/188,298 US application
  misc_feature: The sequence is a functional homolog of SEQ ID NO. 339 in the 11/188,298 US application
MAASAGPAAAAVGEEEAGESRKLFVGGIPAGAQEPELRAHFARFGEVRSVIVMRDRETGHGRGFGFVEFEDEAAAAAALGDGDAPRHFLCGRMVDVKRARTRAPRNQGEQHSQPQQAEQGRGQGNQDNQSPAAGNGTADSDNNVSYDSKKVFIGGLRDNITEEEFRSYFETFGTVTDVVVIYDSATSRSRGFGFVTFDSEEAVGKVMRQSFHNLNGTKVEAKIAIPKDEAYYRNRGRGARPFGGRGPAGYEGSMYQPYNARYGPYNGYMPQPVPAQPYFPAPYFAVGAYPYGSGYPSQGVMTNVPGMMSRRIPPAYGTYPQMYPGFNLLYRAGYGGAATSFQHGINGGSDNKKDQTSVDMQQVDNTSSVATMLEHMKLGSQ

SEQ ID NO: 985 - DNA, 1191 bp, Sorghum bicolor
  misc_feature: Ceres ANNOT ID no. 6011861
  misc_feature: Encodes the peptide sequence at SEQ ID NO 986
atgccgccgccgccgccgcctgacctggtccacgacgccatctccgagatcctgctccgcctcccgccggacgagccccagtggctcttccgcgccgccctcgtctgcaagtcatggctccgcaccctcaccggccccgccttcctccgccggtaccgcgacttccacggagcccctcctctcctcagcctcgtcaacggggagaaagcaatcaaaacaggccagggtcgccgcttcatccccacgacagcagtgcctgccttcctcattccagagtccgacgacaccccctatgcgtggccgttcgactgccgccatgggcgtgtcctcctcggcatgtaccgaagtgcgtgttaccttgtctatgaccctgttacgggcgaccgccgtcgcgtgcccgagcaagcaatcggaatccaatggatgttaatgttccgcagtgcgaccgcagtgttctgcgctgccgctggctgtgatcacctcgactgccatggtggccccttctgtttggtctgcgtgttcaccgactacacgaggcctactactaccatgtcggtgaccatgtactcgtcggagataggcgtgtggagcgctccagtcacgcttgacaatgttccttatgtgccctacagccgtggtcccctcattggagacgaaatctacttcgctcttctggaggctgctacaattgtcaagtatgactgggccaacaattcactatctgtggttaagccccagccaccagcaatgcatgacggcttcgtgctcatggagatggaggatcattctctgggccttgctggcattgaggattccacacttcatctttggtcgagaagagtgagtttagagggaattgctgaatgggtacaatgcagagtcattgatctggagaaaaagatgcctatggcgaaccctagcgactctgcatcagtggttggcttcgcagagggtgtggacatcatcttcgtcagcacaggtgttggattgttcctaatggagctaaagtcagggcgagtgaggaaggttagcgagcctgggtgcttcttcaaaatcctaccctacatgagattctacactcctggtattgtactaacccttgcttatcctttggccttctttatctttgccgcttccatatatttgcttagttggttttggcttgtgaatcaactgctgattgcaatttaa

SEQ ID NO: 986 - protein, 396 aa, Sorghum bicolor
  misc_feature: Ceres ANNOT ID no. 6011861
  misc_feature (4)..(54): Pfam Id: F-box Pfam Desc: F-box domain
  misc_feature (5)..(361): NCBI GI: 115475786 NCBI Desc: os08g0299900 [oryza sativa (japonica cultivar-group)]
  misc_feature (6)..(365): NCBI GI: 115437584 NCBI Desc: os01g0557400 [oryza sativa (japonica cultivar-group)]
  misc_feature (6)..(373): NCBI GI: 115470391 NCBI Desc: os07g0122900 [oryza sativa (japonica cultivar-group)]
  misc_feature (1)..(180): NCBI GI: 38567955 NCBI Desc: osjnbb0115i21.11 [oryza sativa (japonica cultivar-group)]
  misc_feature (22)..(361): NCBI GI: 115481210 NCBI Desc: os10g0158700 [oryza sativa (japonica cultivar-group)]
MPPPPPPDLVHDAISEILLRLPPDEPQWLFRAALVCKSWLRTLTGPAFLRRYRDFHGAPPLLSLVNGEKAIKTGQGRRFIPTTAVPAFLIPESDDTPYAWPFDCRHGRVLLGMYRSACYLVYDPVTGDRRRVPEQAIGIQWMLMFRSATAVFCAAAGCDHLDCHGGPFCLVCVFTDYTRPTTTMSVTMYSSEIGVWSAPVTLDNVPYVPYSRGPLIGDEIYFALLEAATIVKYDWANNSLSVVKPQPPAMHDGFVLMEMEDHSLGLAGIEDSTLHLWSRRVSLEGIAEWVQCRVIDLEKKMPMANPSDSASVVGFAEGVDIIFVSTGVGLFLMELKSGRVRKVSEPGCFFKILPYMRFYTPGIVLTLAYPLAFFIFAASIYLLSWFWLVNQLLIAI

SEQ ID NO: 987 - DNA, 1122 bp, Sorghum bicolor
  misc_feature: Ceres ANNOT ID no. 6011864
  misc_feature: Encodes the peptide sequence at SEQ ID NO 988
atggcgccgccgccgccgccgcccgagctgatcgacgacgccatcgcagagatcctcctccgtctccctcccgacgaccccgcgtgcttcgtacgcgcctccctcgtctgcaagctctggcgccgtatcctttccaaccccacgttccccgaccgctaccgcgagttccatcgaacacctcccctcctcggcttcctaggtagtaactatagctactgccgcgccagcaaagtcagccgcttcgatcccatcacgactcgcatccccttcctcgagccagagttcgattgccgggctctggactgccgccatggccgtgtcctcttcgatatggtagggggcaccaagggaagtctcgctgtgggggaccccatcaccggcgaccacaagttgctcgcagatccggacccggaccccatctcattctaccgctctggcgtggttctttgtgcggtggacggctgcaaccaccgtggctgccacggcggccctttcgttgtggtgtttgtgagcaccccatcaaacaacgacggcaccaaaggtacaagggcatgggtgtactcgtcggagactgctgcatggagctcaccggcctctttgcagctacctaaaggttcctccgtctacaaaaaacgtggggcccatgttggagaccaaatctacttcttgctcacagataccagaattctcaagtatgatctgggaaagcattgcttgactacgatttgcttgccagccatgtacaccaattgccatcgtggtagcctcatcacaatggacgacggttcatcgctgggttttgttgttattgaggattcaaccctccacttgtgggcgagaaaggtgaatctggatggatctatggcatgggtacaagatagagtcgtcttgcttaacaatctagttcctattattccgactgcacacacccatgggctcgttaatgttattggattcgctgagggcgtggatattctcttactaggcgaagatgctagtggctacatgtttgatctgaaatcagggcagttcaagaaactaagcaaccctgagtaccactactatgatgtcttcccctacttgagctttttcattccagagctgatgctttctagtgtctag

SEQ ID NO: 988 - protein, 373 aa, Sorghum bicolor
  misc_feature: Ceres ANNOT ID no. 6011864
  misc_feature (5)..(55): Pfam Id: F-box Pfam Desc: F-box domain
  misc_feature (7)..(366): NCBI GI: 115470391 NCBI Desc: os07g0122900 [oryza sativa (japonica cultivar-group)]
  misc_feature (7)..(370): NCBI GI: 115437584 NCBI Desc: os01g0557400 [oryza sativa (japonica cultivar-group)]
  misc_feature (6)..(366): NCBI GI: 115475786 NCBI Desc: os08g0299900 [oryza sativa (japonica cultivar-group)]
  misc_feature (23)..(366): NCBI GI: 115481210 NCBI Desc: os10g0158700 [oryza sativa (japonica cultivar-group)]
  misc_feature (3)..(160): NCBI GI: 38567955 NCBI Desc: osjnbb0115i21.11 [oryza sativa (japonica cultivar-group)]
MAPPPPPPELIDDAIAEILLRLPPDDPACFVRASLVCKLWRRILSNPTFPDRYREFHRTPPLLGFLGSNYSYCRASKVSRFDPITTRIPFLEPEFDCRALDCRHGRVLFDMVGGTKGSLAVGDPITGDHKLLADPDPDPISFYRSGVVLCAVDGCNHRGCHGGPFVVVFVSTPSNNDGTKGTRAWVYSSETAAWSSPASLQLPKGSSVYKKRGAHVGDQIYFLLTDTRILKYDLGKHCLTTICLPAMYTNCHRGSLITMDDGSSLGFVVIEDSTLHLWARKVNLDGSMAWVQDRVVLLNNLVPIIPTAHTHGLVNVIGFAEGVDILLLGEDASGYMFDLKSGQFKKLSNPEYHYYDVFPYLSFFIPELMLSSV

SEQ ID NO: 989 - DNA, 1152 bp, Sorghum bicolor
  misc_feature: Ceres ANNOT ID no. 6011865
  misc_feature: Encodes the peptide sequence at SEQ ID NO 990
atggcatcaccaccgccgccggagctgattccggacgccgtcgccgagatcctgctccgcctaacgccggaagaccccgcgggcctcgtccgcgcctccgccgtctgcaagccctggctccggaccctcaccgaccccgccttcctccgccgctaccgcgccttccacgggacgtcccgcgtgctcggcttcctccacaacccgatcgaccgcagacgcgagcgtttcgtccccaccacggcgctccgcccgcacgccgccgcccaccgcacctgcgtcgtgatcgactgccgccacggccgcgccctcctctacgactacggctccggtgagttcgtcgtctgggaccccgtcaccggccgcgagcgcaggattcccgacgaggcgcccgacgtctgcacccaccactcggtgctctgcgccgcgggccccggctgcgaccacagcacctgcggcggggggccgctcctacttcctactgatgatgaagagaatgaaggcatgcactgctttgcctatggctgctgctactcctctgagaccggcgagacgagcgcacagactgacctgtacctggagcacgagcacaaccagtgcttccttgatggccgtcccccagtgctcgtggggggtgcgctctacttagtcgaggactctggcattggcaagctgctgcggtacgatcttctgggtgggcgtggcctgtcggtgatgaagctacctcctgccaaccttctcggtacgagtaccgttgtcatgacagcaagcaatggtgggctgggattagccaccttttatcgtggcatgctattcctgtggtcgactgagacgggtcctaacggagatgccaaatgggcgcacatcaatatcatccaacttgagaagctgctcccggttggcattcgtatgagcttagcatgtttgagtggatttgctgaagacgccaatgtcattttcttgagcacagatgacaatggaatcttcactattgagctcaagtcattgctgaccaggaaggtgtgtgacatgggcaatgtcaaccgtgtctttccctacgtgagcttctacactccagctggtacggccactcgtgtatctcccatctttgtttggatcactgcaatctgtgactattcagtcaggcatatatag

SEQ ID NO: 990 - protein, 383 aa, Sorghum bicolor
  misc_feature: Ceres ANNOT ID no. 6011865
  misc_feature (4)..(54): Pfam Id: F-box Pfam Desc: F-box domain
  misc_feature (6)..(382): NCBI GI: 115470391 NCBI Desc: os07g0122900 [oryza sativa (japonica cultivar-group)]
  misc_feature (6)..(358): NCBI GI: 115437584 NCBI Desc: os01g0557400 [oryza sativa (japonica cultivar-group)]
  misc_feature (5)..(358): NCBI GI: 115475786 NCBI Desc: os08g0299900 [oryza sativa (japonica cultivar-group)]
  misc_feature (23)..(358): NCBI GI: 115481210 NCBI Desc: os10g0158700 [oryza sativa (japonica cultivar-group)]
  misc_feature (4)..(103): NCBI GI: 38567955 NCBI Desc: osjnbb0115i21.11 [oryza sativa (japonica cultivar-group)]
MASPPPPELIPDAVAEILLRLTPEDPAGLVRASAVCKPWLRTLTDPAFLRRYRAFHGTSRVLGFLHNPIDRRRERFVPTTALRPHAAAHRTCVVIDCRHGRALLYDYGSGEFVVWDPVTGRERRIPDEAPDVCTHHSVLCAAGPGCDHSTCGGGPLLLPTDDEENEGMHCFAYGCCYSSETGETSAQTDLYLEHEHNQCFLDGRPPVLVGGALYLVEDSGIGKLLRYDLLGGRGLSVMKLPPANLLGTSTVVMTASNGGLGLATFYRGMLFLWSTETGPNGDAKWAHINIIQLEKLLPVGIRMSLACLSGFAEDANVIFLSTDDNGIFTIELKSLLTRKVCDMGNVNRVFPYVSFYTPAGTATRVSPIFVWITAICDYSVRHI

SEQ ID NO: 991 - DNA, 1098 bp, Sorghum bicolor
  misc_feature: Ceres ANNOT ID no. 6011867
  misc_feature: Encodes the peptide sequence at SEQ ID NO 992
atggcgccgccgccgccggagctgaaccccgacgccgtctccgagatcctcctccgcctgccgccggaagaccccgcgagcctcgtccgcgcctccgccgtctgcaagccttggctccggaccctcaccgaccccgccttcctccgccgctaccgcgccttccacgggacgccccccgcagcatcgagcgcttcgtccccaccacggggttccgcccggcacgccgctgccgccgccattcttcgcacctgcgacgccgttttcgactgccgccacggccgcgccctcctctacgactgcggctccatggagttcgtcgtctgcgaccccgtcaccggccgcgaacgccggatgttcgacgcggtgcctgaccggtacaactacgctgtgctctgtgccgcgggcgccggctgcgatcactgcaactgccgggggccgttcctactggcctgcgcgggcgtgcacttctcccactgtgacgttttcttcgcccgcttctactcgtctgataccggcacttggagcttagagaccaagctatacatggaggactcccaataccagtactacggatacagattgaaaaaccagccggccgtgctcgtggggggcgcgctctactatgtctgcaacttcagcatcttgctccgttacgacatcctgggcgggcaggatttgtcagtgatcaagcttcccaaggcgaatcattttgaaagtgtcattgtcataccagcagaggacagcgagttgggattggctagcctgtatcgtaatcgtaacagcctctgcctgtggtcgagggagactgaggtgggcagagacgctagctgggtgcagcaaagggttattgatctcaacaagttgctcccagctaccaatctcaagcggccagcatgtttcagtggatttgccgagggtgccaatgttatctttgtgagcacttatcatggtgatgtcttctgcatcgacctaaactctatgggggtgaggaaggtgtgtgagatgggctatggctaccgtatctttccctacgtgtgcttctacactccagctgcttgtgctagaggcgcactgccatcacatgtggagactcagtga

SEQ ID NO: 992 - protein, 365 aa, Sorghum bicolor
  misc_feature: Ceres ANNOT ID no. 6011867
  misc_feature (3)..(53): Pfam Id: F-box Pfam Desc: F-box domain
  misc_feature (5)..(350): NCBI GI: 115470391 NCBI Desc: os07g0122900 [oryza sativa (japonica cultivar-group)]
  misc_feature (5)..(350): NCBI GI: 115437584 NCBI Desc: os01g0557400 [oryza sativa (japonica cultivar-group)]
  misc_feature (1)..(363): NCBI GI: 115475786 NCBI Desc: os08g0299900 [oryza sativa (japonica cultivar-group)]
  misc_feature (104)..(297): NCBI GI: 38567955 NCBI Desc: osjnbb0115i21.11 [oryza sativa (japonica cultivar-group)]
  misc_feature (2)..(59): NCBI GI: 115481344 NCBI Desc: os10g0188000 [oryza sativa (japonica cultivar-group)]
MAPPPPELNPDAVSEILLRLPPEDPASLVRASAVCKPWLRTLTDPAFLRRYRAFHGTPPAASSASSPPRGSARHAAAAAILRTCDAVFDCRHGRALLYDCGSMEFVVCDPVTGRERRMFDAVPDRYNYAVLCAAGAGCDHCNCRGPFLLACAGVHFSHCDVFFARFYSSDTGTWSLETKLYMEDSQYQYYGYRLKNQPAVLVGGALYYVCNFSILLRYDILGGQDLSVIKLPKANHFESVIVIPAEDSELGLASLYRNRNSLCLWSRETEVGRDASWVQQRVIDLNKLLPATNLKRPACFSGFAEGANVIFVSTYHGDVFCIDLNSMGVRKVCEMGYGYRIFPYVCFYTPAACARGALPSHVETQ

SEQ ID NO: 993 - DNA, 1197 bp, Sorghum bicolor
  misc_feature: Ceres ANNOT ID no. 6011872
  misc_feature: Encodes the peptide sequence at SEQ ID NO 994
atggcgtcgccaccgccgccacgaccaccacctgagctgatggacgagcttgtcggcgagatcctcctccgcctcccgccggacgagcccgagcacctcttccgcgccgccctcgtctgcaagccatggctccgcatcctgtgcgacccgggcttcctccgccgctaccgcgcgttccacggagcacctccactcctcggcctcctccacaggctccaagtcagccaaggggacccggctccccgcttcgcctcgaccacgtcgatgcccgacttcccccacccaggctccgacggcgaccgcacgcgccccctcgactgccgccacggtcgcgtcctcatccacatgcttgaagatgagagcctggatctggatctcctcgtctgggaccctatcacgggcgaacgccatgctgtccccgagccggacatcgactggatgatctacaccgccgcagtgctctgtgccgccgacggatgcgaccacctcgactgccacggcggccccttccgcgtggtcttcctggctaccgacgactacgacgcacaagttaaagcgactgtgtattcatcggtgacaggtgtgtggagtgcgccagtatctattcacgatggctgtgaattctatgccaagcacaagcgtgaaataactgcacaaagagggtactacataccgtatgtcaagccaaggcgagtagccgttatcggagatgaaatctacttcacgctgttgcgaaataccgcgattgtcaagtatgattattgtggcaagaattgcttgtgtgtgattgatccgccaccgccagacacagaagtctactgcactatgattgccctcatggtgatggatggcaattcactgggtctcgctggcattgagggttccaaccttcatctttggacaaggaaggtaaagggagctgctgaatgggtacaatgcagggtcattgacctagacaaaatcatgcccatggccatgcccagtgacagtcatggagcgtatgtggttggtttcgcagagggtttggatgtcatcttcattcagacagatgctggcttattcacgttcggcctcaagtctgggttggtgaagaaggttggcaaacctggggtctgctattccatcttaccctacatgagcttctacactcctgaccgtggtacattcttatcgctggcatctggagaggctcattga

SEQ ID NO: 994 - protein, 398 aa, Sorghum bicolor
  misc_feature: Ceres ANNOT ID no. 6011872
  misc_feature (8)..(58): Pfam Id: F-box Pfam Desc: F-box domain
  misc_feature (9)..(384): NCBI GI: 115475786 NCBI Desc: os08g0299900 [oryza sativa (japonica cultivar-group)]
  misc_feature (10)..(265): NCBI GI: 115470391 NCBI Desc: os07g0122900 [oryza sativa (japonica cultivar-group)]
  misc_feature (74)..(384): NCBI GI: 115437584 NCBI Desc: os01g0557400 [oryza sativa (japonica cultivar-group)]
  misc_feature (3)..(196): NCBI GI: 115481344 NCBI Desc: os10g0188000 [oryza sativa (japonica cultivar-group)]
  misc_feature (4)..(208): NCBI GI: 115481076 NCBI Desc: os10g0137700 [oryza sativa (japonica cultivar-group)]
  misc_feature: The sequence is a functional homolog of SEQ ID NO. 456 in the 11/188,298 US application
MASPPPPRPPPELMDELVGEILLRLPPDEPEHLFRAALVCKPWLRILCDPGFLRRYRAFHGAPPLLGLLHRLQVSQGDPAPRFASTTSMPDFPHPGSDGDRTRPLDCRHGRVLIHMLEDESLDLDLLVWDPITGERHAVPEPDIDWMIYTAAVLCAADGCDHLDCHGGPFRVVFLATDDYDAQVKATVYSSVTGVWSAPVSIHDGCEFYAKHKREITAQRGYYIPYVKPRRVAVIGDEIYFTLLRNTAIVKYDYCGKNCLCVIDPPPPDTEVYCTMIALMVMDGNSLGLAGIEGSNLHLWTRKVKGAAEWVQCRVIDLDKIMPMAMPSDSHGAYVVGFAEGLDVIFIQTDAGLFTFGLKSGLVKKVGKPGVCYSILPYMSFYTPDRGTFLSLASGEAH

SEQ ID NO: 995 - DNA, 2265 bp, Sorghum bicolor
  misc_feature: Ceres ANNOT ID no. 6011888
  misc_feature: Encodes the peptide sequence at SEQ ID NO 996
atggccgagtaccgcctcggactgcagctgcacggccacgccgacgacgttcgtggcatctgtgtgtgtggcgatgctggaatcgcaacatcgtcgagggaccggaccgtgaaattctggacccggaacccagaaaaggagagtgaatatgttctctccaagacacttgcaggacattcgagttttgtcggcccattggcttggatccctccttcggaccgctttcctgaaggtggaatcgtctctggtggaatggatacatttgttttcctctgggatctgcaaaaaggagaagttgttgagacaatgaaggggcacaattcgcaagtcactggacttgctgtggacactaacggtgacatcatctcttcatccatggattgtactgtaagacggtggagaaatggcagtgctatagaggtgtgggaagcgcacaaggttgcagtgcaaactgttctaaagctgcccacaggggaactctttactggttcaagtgattccactattaagctttggaaaggaaggacttgcctacagacattctcaggacatgcagatactgttagatgtttagcctcaatgccaggtctaggaattctttctgcctcacacgacagcactatcaagttatgggcgttgacaggtcagcctctgctggacatgattggtcattcttcccttgtatattctgtggatgcacattcttcaggtcttattgctagtggcagtgaggatcgctctttgaagatatggaaagatggtgtctgcattcaaagcattgaacacccaggatgtatatgggatgctaaattcttgggaaatggggatattgtaactgcttgttctgatggcactacgaggatatggacagcagattctagcaggttctgcagtgatgaggaacttgcagcttatacagatcttatttctcaatacacactcagcagaaagactgttggtgggcttaagttgatggatctaccaggagtggaggcactgcaagttccagggaactctgatggacaaacactaattgttagagaaggggacaatggtgtagcatattcttggaattcagcagagttaaaatgggacaaaattggtgaagtagtggatgggcctggtgatgctgctcaaggccaggttcatgatggtgttcggtatgattttgtttttaatgttgatattggagatggagaacccatacgaaaactaccgtataaccgttcagatgatgcatacacagtcgctgacaagtggctcctgaaagaaaatctgccgttgacatatcgccaacaggttgttgaatttatactgcagaattctggccagaacaactttgttccagatccatcttttcgggatccctatactggggccaacgcatatgtacctgggcaaccatcgtcatcgaatggtaatgctccaaaaccaattttcaagcacataccaaagagtggaatgctattatttgagacagctcagtttgatggaatcctaaagaaagttacagagtttaatgcaagactttcatctgactcggaacagaaacaattatctctgttggagacggagatgtcaagattacctgccatagtgaaagtgttgaaagagacatcattttatcacataagtaaacttgcagatgctgatatggcattgttggtaaagatattgaagtcttggcctccacaaatgatgtttccagttattgattttctgagaatgttcgtgttgcatcctgatggagctgctttacttctcaagaccatcgaaactggaaatgatatacttttggaaacctttcgtaaagctgttgcgccgcctgtacagccagcaaatttgcttacagttcttaaagctgtgacaaacttgtttgacaactcatgcttgcaccagtggttgaggatccactgtgctgagatcattgattccttgtctaactgcaaatcttcttttagcaagaatgcacacttggcatatgccacgcttctactgaactatgctgttctttcaattgaatcaaaggaagaacaaagtcaggcgcaaattctttccgccgcccttgaaatcgctgaagatgacactcaagattttgactcaaaataccgggcacttgttgcaatcggttctcttatgctcaagggcctcgtgaagtcccttgctctcgaccttgatgttaagagcgtcgcgagcagcgcaaagtcttctatggacacgaaggttgcagaagttggaggtgatatcgaatcactaacaagatga

SEQ ID NO: 996 - protein, 754 aa, Sorghum bicolor
  misc_feature: Ceres ANNOT ID no. 6011888
  misc_feature (481)..(749): Pfam Id: PUL Pfam Desc: PUL domain
  misc_feature (334)..(448): Pfam Id: PFU Pfam Desc: PFU (PLAA family ubiquitin binding)
  misc_feature (4)..(41): Pfam Id: WD40 Pfam Desc: WD domain, G-beta repeat
  misc_feature (50)..(93): Pfam Id: WD40 Pfam Desc: WD domain, G-beta repeat
  misc_feature (97)..(134): Pfam Id: WD40 Pfam Desc: WD domain, G-beta repeat
  misc_feature (175)..(212): Pfam Id: WD40 Pfam Desc: WD domain, G-beta repeat
  misc_feature (215)..(252): Pfam Id: WD40 Pfam Desc: WD domain, G-beta repeat
  misc_feature (3)..(754): NCBI GI: 30685107 NCBI Desc: transducin family protein / wd-40 repeat family protein [arabidopsis thaliana]
  misc_feature (103)..(600): NCBI GI: 115470401 NCBI Desc: os07g0123700 [oryza sativa (japonica cultivar-group)]
  misc_feature (56)..(472): NCBI GI: 4758934 NCBI Desc: phospholipase a2-activating protein [homo sapiens]
  misc_feature (2)..(559): NCBI GI: 108935870 NCBI Desc: phospholipase a-2-activating protein (plap)
  misc_feature (2)..(559): NCBI GI: 123227970 NCBI Desc: phospholipase a2, activating protein [mus musculus]
  misc_feature: The sequence is a functional homolog of SEQ ID NO. 485 in the 11/188,298 US application
MAEYRLGLQLHGHADDVRGICVCGDAGIATSSRDRTVKFWTRNPEKESEYVLSKTLAGHSSFVGPLAWIPPSDRFPEGGIVSGGMDTFVFLWDLQKGEVVETMKGHNSQVTGLAVDTNGDIISSSMDCTVRRWRNGSAIEVWEAHKVAVQTVLKLPTGELFTGSSDSTIKLWKGRTCLQTFSGHADTVRCLASMPGLGILSASHDSTIKLWALTGQPLLDMIGHSSLVYSVDAHSSGLIASGSEDRSLKIWKDGVCIQSIEHPGCIWDAKFLGNGDIVTACSDGTTRIWTADSSRFCSDEELAAYTDLISQYTLSRKTVGGLKLMDLPGVEALQVPGNSDGQTLIVREGDNGVAYSWNSAELKWDKIGEVVDGPGDAAQGQVHDGVRYDFVFNVDIGDGEPIRKLPYNRSDDAYTVADKWLLKENLPLTYRQQVVEFILQNSGQNNFVPDPSFRDPYTGANAYVPGQPSSSNGNAPKPIFKHIPKSGMLLFETAQFDGILKKVTEFNARLSSDSEQKQLSLLETEMSRLPAIVKVLKETSFYHISKLADADMALLVKILKSWPPQMMFPVIDFLRMFVLHPDGAALLLKTIETGNDILLETFRKAVAPPVQPANLLTVLKAVTNLFDNSCLHQWLRIHCAEIIDSLSNCKSSFSKNAHLAYATLLLNYAVLSIESKEEQSQAQILSAALEIAEDDTQDFDSKYRALVAIGSLMLKGLVKSLALDLDVKSVASSAKSSMDTKVAEVGGDIESLTR

SEQ ID NO: 997 - DNA, 1125 bp, Sorghum bicolor
  misc_feature: Ceres ANNOT ID no. 6011896
  misc_feature: Encodes the peptide sequence at SEQ ID NO 998
atggcgccgcggcgcccgccgccggagttgatcaacgacgccatcggagagatcctcctccgcctcccaccggacgagcccgagtgcctgttccgcgcctccctcgtctgcaggccctggcgccgcatcctcaccgacgccgccttcctccgccggtaccgccgcttccacaaaacacctccgctgctcgggctcttcttcatcggtaacgaccgtgtccaaactgaaaccctccctcgcttcgttcccaccacatcagcctccccgttcccccagcctatgatgagctgccgcccctgggtcgccatcgactgtcgccatgggcgtgttctccttcaaaagatgaaggggggcagattcattgtctgggacccaatcaccggtgtccggagggagctggaccacccctgcatcccgttcgagtccttctctctttcgttgctctgcgccgtgcccgggtgcgaccacctcgactgccacggcggcccattcctcgtcgtctgggtgtgcactgatgatgttgagggcacggaggggcacctggcgcgggcgtgcgtgtactcatcgcaagtgggttcctggggcacgtcggtttctgttcccataggtctttttgatttcatgaaccagagtcgtgctgcacttgctggagacggtgtctacttcatgcttgggacgggtgataggatccttgagtataacttggtcaagcatggcttgtctgtcattgataccccggaagcgaacgagaagggctttttaattgtgccaactgaggatggtttgcttggggttgccgccatcaagggtaccagcctttacctgtggtcgaggaaggtgaatgcagagggggttgaaggatggacgcaatacagggtgatcgagctacagcctctgttaccagatgtcaagcttttacatgaggctattgtgattgcttttgctgagggtgtccgtgccatcttcctggacacatctagtggtatctgcattattgacctcaactcagagcaggcgaggacggtaagcgaacctgggacccactatgtggttgtacccttcacgaattgtgcctgcgggaaattgccattaccagcaaagacaaatgaatcgttggcaagctaa

SEQ ID NO: 998 - protein, 374 aa, Sorghum bicolor
  misc_feature: Ceres ANNOT ID no. 6011896
  misc_feature (5)..(55): Pfam Id: F-box Pfam Desc: F-box domain
  misc_feature (4)..(356): NCBI GI: 115437584 NCBI Desc: os01g0557400 [oryza sativa (japonica cultivar-group)]
  misc_feature (7)..(354): NCBI GI: 115470391 NCBI Desc: os07g0122900 [oryza sativa (japonica cultivar-group)]
  misc_feature (6)..(354): NCBI GI: 115475786 NCBI Desc: os08g0299900 [oryza sativa (japonica cultivar-group)]
  misc_feature (23)..(314): NCBI GI: 115481210 NCBI Desc: os10g0158700 [oryza sativa (japonica cultivar-group)]
  misc_feature (6)..(153): NCBI GI: 38567955 NCBI Desc: osjnbb0115i21.11 [oryza sativa (japonica cultivar-group)]
MAPRRPPPELINDAIGEILLRLPPDEPECLFRASLVCRPWRRILTDAAFLRRYRRFHKTPPLLGLFFIGNDRVQTETLPRFVPTTSASPFPQPMMSCRPWVAIDCRHGRVLLQKMKGGRFIVWDPITGVRRELDHPCIPFESFSLSLLCAVPGCDHLDCHGGPFLVVWVCTDDVEGTEGHLARACVYSSQVGSWGTSVSVPIGLFDFMNQSRAALAGDGVYFMLGTGDRILEYNLVKHGLSVIDTPEANEKGFLIVPTEDGLLGVAAIKGTSLYLWSRKVNAEGVEGWTQYRVIELQPLLPDVKLLHEAIVIAFAEGVRAIFLDTSSGICIIDLNSEQARTVSEPGTHYVVVPFTNCACGKLPLPAKTNESLAS

SEQ ID NO: 999 - DNA, 1389 bp, Sorghum bicolor
  misc_feature: Ceres ANNOT ID no. 6011936
  misc_feature: Encodes the peptide sequence at SEQ ID NO 1000
atggcctcctcgtcggagaacacgggcgcgccgccggaggaggagcagccccaggccccgccgacgccgaacccggagcctaccgaggcggcggcgcctggcgaggcggaggaggagccgcaaaccctagagcgggcgcaggagctcttcgaccggggcgccaaggccatcgaggacgaggacttcgtcgaagccgtcgactgcctcagccaagcgctcgagatcaggacttcacattatggagagctcgcgccagagtgtgccagcacatacttcaaatatggatgcgctctgctatacaaagctcaggaggaaagtgattttttgggaaatgttcccaagagcgtgccaaacgaagaatcagtgaagagtacagcttctaaagatgatagtggaacctcaaaggtctctggtaccaatgcggaggatgccgtgtcttcggagaaagctgatgctgaagaaggtcaaaactcaaatggcaaagatcaggagaatgggaatggtgaagttgagaaggatgatgatgatgacgacgatgatgagaagatgggagatgaagaggataatgatttggatctttcctggaaaatgttggacattgctagggcaatagttgagaagaccccagataacactatggagaaagtaaaaatatattctgctcttgctgaagtcgcaacagaaagagaggacatagacaactcactcactgactacatgaaagctttatccatgttggagcatttggttgaacctgatcatcgtcgagttgtggaattaaacttccgcatatgtttggtttatgagctagtttccaagattggagatgcgattccgtactgtgcaaaagcgatttcgctatgcaagtcgcgcatacagagcctgaaaagttccaaggatgctttgttggctggtaaagatggtgatgcatctgctgctaaggctgaaggaggctcagaaaactctgacgctgaaaaagagctagagcagcttactagcatattgcctgatcttgagaagaagcttgaggacctggagcaagcaaacccaagccctgccatggatgagatgttgaagacaattgcatccagggtaactgacgggatgccaagagctgcatcttttacttcttcccagatggcaacctcgagcaatggattcgactcctcggttctgtctacggcagcaacaactggaagcactggaagcactgtgactgacctcggggttgttggcagaggtgtcaaacgagctagcatcaagccgatatctgctgaacctgctgcgaagaaacctgcacttgattcaccatctctccaaggtgatagcagcatcaactctgaggttgtccctgcaacacagaatggtgatgagtccatacctaagtag

SEQ ID NO: 1000 - protein, 462 aa, Sorghum bicolor
  misc_feature: Ceres ANNOT ID no. 6011936
  misc_feature (1)..(462): NCBI GI: 38175649 NCBI Desc: tetratricopeptide repeat-containing protein-like [oryza sativa (japonica cultivar-group)]
  misc_feature (24)..(341): NCBI GI: 42573205 NCBI Desc: tetratricopeptide repeat (tpr)-containing protein [arabidopsis thaliana]
  misc_feature (29)..(301): NCBI GI: 4104353 NCBI Desc: nuclear autoantigenic sperm protein autosomal variant [homo sapiens]
  misc_feature (101)..(450): NCBI GI: 41054255 NCBI Desc: nuclear autoantigenic sperm protein (histone-binding) [danio rerio]
  misc_feature (29)..(301): NCBI GI: 60655379 NCBI Desc: nuclear autoantigenic sperm protein [synthetic construct]
MASSSENTGAPPEEEQPQAPPTPNPEPTEAAAPGEAEEEPQTLERAQELFDRGAKAIEDEDFVEAVDCLSQALEIRTSHYGELAPECASTYFKYGCALLYKAQEESDFLGNVPKSVPNEESVKSTASKDDSGTSKVSGTNAEDAVSSEKADAEEGQNSNGKDQENGNGEVEKDDDDDDDDEKMGDEEDNDLDLSWKMLDIARAIVEKTPDNTMEKVKIYSALAEVATEREDIDNSLTDYMKALSMLEHLVEPDHRRVVELNFRICLVYELVSKIGDAIPYCAKAISLCKSRIQSLKSSKDALLAGKDGDASAAKAEGGSENSDAEKELEQLTSILPDLEKKLEDLEQANPSPAMDEMLKTIASRVTDGMPRAASFTSSQMATSSNGFDSSVLSTAATTGSTGSTVTDLGVVGRGVKRASIKPISAEPAAKKPALDSPSLQGDSSINSEVVPATQNGDESIPK

SEQ ID NO: 1001 - DNA, 1080 bp, Sorghum bicolor
  misc_feature: Ceres ANNOT ID no. 6011964
  misc_feature: Encodes the peptide sequence at SEQ ID NO 1002
atggggctcgacgtcgtggagatcgggatgggcgccgatttgagcctggatctgaggcacttcgccaccaaggccgtgaggcagagcaaggacgacgcgcctgcgccggacatggacgcctgcatccgccgcctcgaggaggagcggggcaagatcgagatgttcaagcgggagctccccctctgcgcgcggctcctcgccgacgtgattgatgtcatgaaggaggaggccggtaagaagacgacgaagagaagtgatcgcagcctgccggcggcggaggaggacgaggacggcgccgctggggacaagagcaagtggatgagcacggcgcagctctggacgggcgattccggccgggaggacgcggaatcagagaagcaagacaaggggaggagtttgccggaggccaagtcccgcggcggcgctctcttgccgttcaaggctgctgtgggctccggcgcgccggcgttcgcgtcgctctgcttgagaacggacgacaaggctgcgcgcgtcgggatgccggatctgtccttgctgtcgccgccggcgaccaagagcgccgccgaggagagccggcgccaggtggtggggcttgcgcaggcagcagcgagggcggccgccatggcgccagctgcccctgcgcttggcctccagtcccaatcgcagcagcagacagctcagcagcagcagcagcaggcaaggaaggttcggcgttgctggtcgacggagctgcatcgccagttcgtcgccgccttgaatcaactcggtggcccccaagttgccaccccgaagcaaatcagggagctgatgaaggtggatggcctaacaaacgacgaagtcaagagccatcttcagaaataccggctgcacaaccgaagggcgcctggatcaggcgtggtgagccagccgattatgctcgtgggagggctctggattccccaggagcaaagcagctctcagtctgggtctccccatgggcccctccacttctccaccgcctcaggcatcgccgtctcgtcggcggccaccgtcagctgcgaggaggaagatggccggtcagaaagctatggctggaaatga

SEQ ID NO: 1002 - protein, 359 aa, Sorghum bicolor
  misc_feature: Ceres ANNOT ID no. 6011964
  misc_feature (237)..(288): Pfam Id: Myb_DNA-binding Pfam Desc: Myb-like DNA-binding domain
  misc_feature (25)..(355): NCBI GI: 102139855 NCBI Desc: myb dna-binding domain-containing protein [musa acuminata]
  misc_feature (220)..(354): NCBI GI: 18419989 NCBI Desc: myb family transcription factor [arabidopsis thaliana]
  misc_feature (220)..(354): NCBI GI: 30690890 NCBI Desc: myb family transcription factor [arabidopsis thaliana]
  misc_feature (220)..(354): NCBI GI: 14532434 NCBI Desc: at4g37180/c7a10_180 [arabidopsis thaliana]
  misc_feature (221)..(344): NCBI GI: 46390263 NCBI Desc: myb family transcription factor-like [oryza sativa (japonica cultivar-group)]
  misc_feature: The sequence is a functional homolog of SEQ ID NO 1233 in the 10/666,642US patent application
  misc_feature: The sequence is a functional homolog of SEQ ID NO 1990 in the 11/479,226US patent application
  misc_feature: The sequence is a functional homolog of SEQ ID NO 252 in the 10/666,642US patent application
  misc_feature: The sequence is a functional homolog of SEQ ID NO 933 in the 10/666,642US patent application
  misc_feature: The sequence is a functional homolog of SEQ ID NO 935 in the 10/666,642US patent application
  misc_feature: Useful for making plants with altered Lignin content
  misc_feature: Useful for making plants with modulated growth and phenotype characteristics
  misc_feature: Functional homolog of the protein sequence given in SEQ ID NO 13018
  misc_feature: The sequence is a functional homolog of SEQ ID NO 1990 in the 20070022495 US patent application
  misc_feature: The sequence is a functional homolog of SEQ ID NO 1233 in the 20070033671 US patent application
  misc_feature: The sequence is a functional homolog of SEQ ID NO 252 in the 20070033671 US patent application
  misc_feature: The sequence is a functional homolog of SEQ ID NO 933 in the 20070033671 US patent application
  misc_feature: The sequence is a functional homolog of SEQ ID NO 935 in the 20070033671 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MGLDVVEIGMGADLSLDLRHFATKAVRQSKDDAPAPDMDACIRRLEEERGKIEMFKRELPLCARLLADVIDVMKEEAGKKTTKRSDRSLPAAEEDEDGAAGDKSKWMSTAQLWTGDSGREDAESEKQDKGRSLPEAKSRGGALLPFKAAVGSGAPAFASLCLRTDDKAARVGMPDLSLLSPPATKSAAEESRRQVVGLAQAAARAAAMAPAAPALGLQSQSQQQTAQQQQQQARKVRRCWSTELHRQFVAALNQLGGPQVATPKQIRELMKVDGLTNDEVKSHLQKYRLHNRRAPGSGVVSQPIMLVGGLWIPQEQSSSQSGSPHGPLHFSTASGIAVSSAATVSCEEEDGRSESYGWK

SEQ ID NO: 1003 - DNA, 1140 bp, Sorghum bicolor
  misc_feature: Ceres ANNOT ID no. 6012058
  misc_feature: Encodes the peptide sequence at SEQ ID NO 1004
atgggtgccgcgccgggaggaggccgtgtccctgcccgggccatggcggacgccctggaagacgtgcgctccatcctgctgaaaccgtcggagcgcctcgacgacaagcgcttcacgaggatcgccggcgccgacttcgacgacgcgagcctcggcctcgcggagctgctcgcctcgctcgcgtccacggggttccaggcctctaacctcggcgacgccatcgacgtcgtcaaccagatgttggactggaggttatcccacgagaagccaagcgatgattgtgctgaagctgaacttgatcctgcatatagagagtccgtcaagtgcaagatctttctgggcttcacatctaaccttgtgtcttctggtgttcgggagattatacggtttcttgctcagcatgccatggtggatgttattgttacaactgctgggggtatagaggaggatctcatcaaatgccttgcaccaacttacaaaggtgatttctctttacctggagcgctgctgcggtctaaaggacttaaccggataggaaacctgttggtgcccaatgataactactgcaagtttgagaactggatcatgccaatccttgacaagatgctgctggaacaatccactgaaaatgtttggacaccatcaaaggtgattgctcgtcttggcaaagaaataaatgatgaaagctcctacctttactgggcatacaagaacaacatccctgtgttctgcccagcattgactgacggatcaattggagacatgctattttgccactcggtcaacaatcctggtcttattgttgacattgtacaagatgtacggctgatgaatgcggaaaccatccacgcaaccccaaggaagacagggattataattcttggtggaggccttccaaagcatcatatatgcaatgccaatatgttgcgcaatggtgcagattatgcagtgtatgtcaacacggctcaggagtttgatggtagtgattctggggcacggcctgacgaagcagtttcatggggaaagatcaagagctcagcaaaaactataaaggtgcattgcgatgcaacgattgcttttccgcttcttgtggctgcaacatttgcgcgcaaggttcatggcactaaatcagcaaactga

SEQ ID NO: 1004 - protein, 379 aa, Sorghum bicolor
  misc_feature: Ceres ANNOT ID no. 6012058
  misc_feature (53)..(369): Pfam Id: DS Pfam Desc: Deoxyhypusine synthase
  misc_feature (7)..(371): NCBI GI: 12407779 NCBI Desc: deoxyhypusine synthase [musa acuminata]
  misc_feature (19)..(378): NCBI GI: 53850032 NCBI Desc: deoxyhypusine synthase [symphytum officinale]
  misc_feature (16)..(374): NCBI GI: 52222139 NCBI Desc: deoxyhypusine synthase [lactuca sativa]
  misc_feature (19)..(379): NCBI GI: 53850006 NCBI Desc: deoxyhypusine synthase [cynoglossum officinale]
  misc_feature (8)..(373): NCBI GI: 53850016 NCBI Desc: deoxyhypusine synthase [heliotropium indicum]
  misc_feature (7)..(371): SWISSPROT Homolog: EC 2.5.1.46 Deoxyhypusine synthase
  misc_feature (12)..(379): SWISSPROT Homolog: EC 2.5.1.45 Homospermidine synthase 1
  misc_feature: The sequence is a functional homolog of SEQ ID NO 2 in the 6,538,182 US patent
  misc_feature: The sequence is a functional homolog of SEQ ID NO 6 in US patent 7217866
MGAAPGGGRVPARAMADALEDVRSILLKPSERLDDKRFTRIAGADFDDASLGLAELLASLASTGFQASNLGDAIDVVNQMLDWRLSHEKPSDDCAEAELDPAYRESVKCKIFLGFTSNLVSSGVREIIRFLAQHAMVDVIVTTAGGIEEDLIKCLAPTYKGDFSLPGALLRSKGLNRIGNLLVPNDNYCKFENWIMPILDKMLLEQSTENVWTPSKVIARLGKEINDESSYLYWAYKNNIPVFCPALTDGSIGDMLFCHSVNNPGLIVDIVQDVRLMNAETIHATPRKTGIIILGGGLPKHHICNANMLRNGADYAVYVNTAQEFDGSDSGARPDEAVSWGKIKSSAKTIKVHCDATIAFPLLVAATFARKVHGTKSAN

SEQ ID NO: 1005 - DNA, 1272 bp, Sorghum bicolor
  misc_feature: Ceres ANNOT ID no. 6012105
  misc_feature: Encodes the peptide sequence at SEQ ID NO 1006
atggagagcccgcggagccccgaggcggagatcggccaccgcgtggaggacctctgggaggtggcggagccgcagctgtcgccgtcggagaagctcaactcctgcttcgaggacatccccgtcgcgtccttcccgcgcacacacccgtcgcaagtcattgagattccttcagatgcaagtcttgctgaaactgtagaaatattatccaaaaacaaaatcttgagtgcacctataagaaatgttgaggctccagaagacgctagttggatggacaaatacatcggcattgtggaatttgctggtattgccatgtggttgctcagtcagtctgatgctgcggttaatgggacagttggttcgggagcaggatcacctgtctccaatctagtttctaggctgggctcattcacattcagtaggacatcatctggccgggtagaaactgctactgattctgaatcagatgaagcagcgtcagttggtgggagcttttttgaaaccctaacttcctctgagttctacaagaatacaaaggttggcgatatctcagggagcttccgctgggcaccatttcttgcactgcagacatctgacacattccttaccatgttgctgcttctatccaagtacagaatgaagagcctgccagttgtagaagtgggaggagataagattgagaacattatcacacaatcctctgtcgtacacatgcttgcagagtgtgttgggctctcctggtttgagagctggggaactaagaaactctctgagctggggcttcctatcatgaaaccatcaaaacttgtcaaggtaaacgaagatcagccagttctgaaagctttccaactgatgagggaaaagggagttggtggcctgccagtcatggacacaagtggagcaaaagcaattggtaatattagcatcagagatgtccagtatcttttaaccgctcccaagatatacaaagagcacaggtcaatcacgacaaaggatttccttagtgctgttcgacaccatctccaggagcagtgtgaggcctcaccattgctgcatgatgtaatcacttgcaaaaaggatgatacaattaaggacatcatactgaagctggactctgagaagatccacaggatctacgttgtagatgacaaagggaacaccgagggagtcatcaccttgagggacataatctccaaactggtgcatgagccgcgccattactttggggatttctttgatggtgttgttcccctgcctgcaaacagcactgtatga

SEQ ID NO: 1006 - protein, 423 aa, Sorghum bicolor
  misc_feature: Ceres ANNOT ID no. 6012105
  misc_feature (46)..(239): Pfam Id: CBS Pfam Desc: CBS domain pair
  misc_feature (262)..(400): Pfam Id: CBS Pfam Desc: CBS domain pair
  misc_feature (1)..(423): NCBI GI: 38346640 NCBI Desc: osjnba0072d21.10 [oryza sativa (japonica cultivar-group)]
  misc_feature (1)..(423): NCBI GI: 116309289 NCBI Desc: osigba0092e09.6 [oryza sativa (indica cultivar-group)]
  misc_feature (2)..(423): NCBI GI: 32364482 NCBI Desc: akin gamma [medicago truncatula]
  misc_feature (98)..(407): NCBI GI: 145327199 NCBI Desc: cbs domain-containing protein [arabidopsis thaliana]
  misc_feature (98)..(411): NCBI GI: 92867066 NCBI Desc: cbs [medicago truncatula]
MESPRSPEAEIGHRVEDLWEVAEPQLSPSEKLNSCFEDIPVASFPRTHPSQVIEIPSDASLAETVEILSKNKILSAPIRNVEAPEDASWMDKYIGIVEFAGIAMWLLSQSDAAVNGTVGSGAGSPVSNLVSRLGSFTFSRTSSGRVETATDSESDEAASVGGSFFETLTSSEFYKNTKVGDISGSFRWAPFLALQTSDTFLTMLLLLSKYRMKSLPVVEVGGDKIENIITQSSVVHMLAECVGLSWFESWGTKKLSELGLPIMKPSKLVKVNEDQPVLKAFQLMREKGVGGLPVMDTSGAKAIGNISIRDVQYLLTAPKIYKEHRSITTKDFLSAVRHHLQEQCEASPLLHDVITCKKDDTIKDIILKLDSEKIHRIYVVDDKGNTEGVITLRDIISKLVHEPRHYFGDFFDGVVPLPANSTV

SEQ ID NO: 1007 - DNA, 888 bp, Sorghum bicolor
  misc_feature: Ceres ANNOT ID no. 6012178
  misc_feature: Encodes the peptide sequence at SEQ ID NO 1008
atggccaccgccaccctcgccgctcctcctctctttctcttctcacgaccggcgccagcgcaggcgcggacggcgaggaggaggacagcgaggcccttcctccgccccgcttgcgcctacgctctgcaagagggccagtcccgccgcttccaccgcttgccgtgcggcctcgacctcgaggtcatcgcgcagtgcccgccggcggcgggagagcgcccgccgctggtgttcgtgcacgggagcttccacgcggcctggtgctgggctgagcactggcttcccttcttctcgcgggccgggttcccctgctacgccctcagcctccgcgcgcagggtgaaagcagtgttccacaagaggcagtggcaggcactcttgagaaggagctccccttgccacctgtactaattggacattcattcggaggcttgattgtgcagcaatatacatcatgctttgggttggtatggcgttaccttttgactaaaccaatagctgcagtcaaggtgactctcagcttggctgcaaaagcatatgcaaattcattgtcgctctgtaaggaaacatttttctcagcacaaatggatgatgaacttgtgttaaggtaccaagcattaatgaaggagagctcaaaattgccactgtttgacttacggaagctaaatgcatcactgcctgtaccttctgtgccagaaattaccacagaaattcttgtcatgggtgcaagaaatgatttcattattgattctgaagggctttatgaaacttcaagattttacggagtgcaaccagtatgtgtggaaggtgtagctcatgacatgatgttagattgctcctgggataaaggagctgaaataatcttgacgtggttagagaaactcacaccatga

SEQ ID NO: 1008 - protein, 295 aa, Sorghum bicolor
  misc_feature: Ceres ANNOT ID no. 6012178
  misc_feature (153)..(295): NCBI GI: 116309285 NCBI Desc: osigba0092e09.2 [oryza sativa (indica cultivar-group)]
  misc_feature (153)..(295): NCBI GI: 38346635 NCBI Desc: osjnba0072d21.5 [oryza sativa (japonica cultivar-group)]
  misc_feature (2)..(295): NCBI GI: 115458004 NCBI Desc: os04g0381400 [oryza sativa (japonica cultivar-group)]
  misc_feature (1)..(148): NCBI GI: 56461754 NCBI Desc: at5g38360 [arabidopsis thaliana]
  misc_feature (1)..(148): NCBI GI: 79527286 NCBI Desc: catalytic [arabidopsis thaliana]
MATATLAAPPLFLFSRPAPAQARTARRRTARPFLRPACAYALQEGQSRRFHRLPCGLDLEVIAQCPPAAGERPPLVFVHGSFHAAWCWAEHWLPFFSRAGFPCYALSLRAQGESSVPQEAVAGTLEKELPLPPVLIGHSFGGLIVQQYTSCFGLVWRYLLTKPIAAVKVTLSLAAKAYANSLSLCKETFFSAQMDDELVLRYQALMKESSKLPLFDLRKLNASLPVPSVPEITTEILVMGARNDFIIDSEGLYETSRFYGVQPVCVEGVAHDMMLDCSWDKGAEIILTWLEKLTP

SEQ ID NO: 1009 - DNA, 558 bp, Sorghum bicolor
  misc_feature: Ceres ANNOT ID no. 6012298
  misc_feature: Encodes the peptide sequence at SEQ ID NO 1010
atggcggctaacgattccttggttactgctcatgtgataggagatgtcttggaccccttctatacaaccgttgatatgatgatcctattcgatggtactcctattatcagcggcatggagttgcgtgctccggcggtttctgacaggccaagggttgagattggaggagatgattatcgagttgcatatactctggtgatggtcgatcctgatgctcctaacccaagcaacccaaccttgagggagtacttgcactggatggtgactgacatcccagcatcaactgataatacatacggccgtgagatgatgtgctacgagccccctgccccgtccacgggcatccaccggatggtgctggtgctattccagcagcttggccgtgacacggtgttcgcggcgccgtccaggcgccacaacttcaacacccgtgccttcgcccgccgctacaacctcggcgcgcccgtcgccgccatgttcttcaactgccagcgccagaccggctccggtggccccaggttcaccgggccctacaccagccgccgtcgtgcgggctga

SEQ ID NO: 1010 - protein, 185 aa, Sorghum bicolor
  misc_feature: Ceres ANNOT ID no. 6012298
  misc_feature (18)..(164): Pfam Id: PBP Pfam Desc: Phosphatidylethanolamine-binding protein
  misc_feature (3)..(175): NCBI GI: 89514803 NCBI Desc: ft-like protein 4 [hordeum vulgare subsp. vulgare]
  misc_feature (5)..(173): NCBI GI: 56694632 NCBI Desc: flowering locus t [triticum aestivum]
  misc_feature (5)..(173): NCBI GI: 71648402 NCBI Desc: ft-like protein [hordeum vulgare subsp. vulgare]
  misc_feature (5)..(173): NCBI GI: 113412806 NCBI Desc: ft [aegilops tauschii]
  misc_feature (5)..(173): NCBI GI: 116237308 NCBI Desc: ft [hordeum vulgare subsp. spontaneum]
  misc_feature: Useful for making plants with modulated flowering time
  misc_feature: Functional homolog of the protein sequence given in SEQ ID NO 13388
  misc_feature: Functional homolog of the protein sequence given in SEQ ID NO 13391
  misc_feature: Useful for making plants with modulated flowering time
  misc_feature: Functional homolog of the protein sequence given in SEQ ID NO 13388
  misc_feature: The sequence is a functional homolog of SEQ ID NO 2 in US patent 7196246
  misc_feature: The sequence is a functional homolog of SEQ ID NO 2 in US patent 7208653
MAANDSLVTAHVIGDVLDPFYTTVDMMILFDGTPIISGMELRAPAVSDRPRVEIGGDDYRVAYTLVMVDPDAPNPSNPTLREYLHWMVTDIPASTDNTYGREMMCYEPPAPSTGIHRMVLVLFQQLGRDTVFAAPSRRHNFNTRAFARRYNLGAPVAAMFFNCQRQTGSGGPRFTGPYTSRRRAG

SEQ ID NO: 1011 - DNA, 1119 bp, Sorghum bicolor
  misc_feature: Ceres ANNOT ID no. 6012355
  misc_feature: Encodes the peptide sequence at SEQ ID NO 1012
atgcttgcacttgttggagcaagagcaggtcctgttcactcacagacgtgcctcggtgctacaatgcggctcatgttaccagccgagcaaaatgtcccctccaagacgatgacccaaatgccgaatgattattcatacagctcgctgatacctggtctgccagaagatgtggcaaagatatgccttgctcttgtttctcggagctatttccctgtcatgggtgctgtgtcaaagaggtggatgacgttcattgggagcagagaattcatcgccgttcggaaggaggttgggaagcttgaagagtggatttatgtcctgaccgctgaagcaggcagaaagggaagaagttgttgggaggtgttgaggagcccggatcagaagaagagaaggcttcctcctatgcctggtccaaacaaagctgggtttggtgtggtggttcttgatggaaagctttttgtcatggctggctatgctgctgaccatgggaaagagtttgtttctgatgaggtttactgctatcatgcctgtctgaacaggtggactgcacttgccaagctgaatgttgcgcggcacgactttgcctgcgcagaggtcaagggagtcatatatgtagctggtggacttggacttgctggcgttagcctgaacagcgtggaagcatacaatccacagcagaacaaatggacactgataaagagtcttcgcaggccgaggtggggctgctttggttgtgggttcagtgacaagttgtacataatgggtgggcgttctagcttcactattggtaatacacgctctgtcgacgtgtatgaacctgatcgccacacttgggaggagctcaagagaggctgtgtgatgtggaagaatcagcggtcactcgcaacatttaacccagcagacaactcttggcagaggatcctgttgccccatactggcagttccagcactaagttttgccttagggtttttggcatgaaggttcttctattctcactggaggaggaacctgggtaccaaacactgatgtatgatcctgcagcacccacaggatatgagtggcagacaactaagctcaagccttcagggtcgtgcatatgcagtgtgagcattgaagtttga

SEQ ID NO: 1012 - protein, 372 aa, Sorghum bicolor
  misc_feature: Ceres ANNOT ID no. 6012355
  misc_feature (138)..(187): Pfam Id: Kelch_1 Pfam Desc: Kelch motif
  misc_feature (189)..(235): Pfam Id: Kelch_1 Pfam Desc: Kelch motif
  misc_feature (237)..(284): Pfam Id: Kelch_1 Pfam Desc: Kelch motif
  misc_feature (189)..(235): Pfam Id: Kelch_2 Pfam Desc: Kelch motif
  misc_feature (1)..(370): NCBI GI: 48716191 NCBI Desc: kelch repeat-containing f-box protein-like [oryza sativa (japonica cultivar-group)]
  misc_feature (38)..(370): NCBI GI: 3176664 NCBI Desc: contains similarity to beta scruin gbz47541 from limulus polyphemus. ests gbt04493 and gbaa585955 come from this gene. [arabidopsis thaliana]
  misc_feature (45)..(370): NCBI GI: 15223520 NCBI Desc: kelch repeat-containing f-box family protein [arabidopsis thaliana]
  misc_feature (40)..(233): NCBI GI: 115443779 NCBI Desc: os02g0114600 [oryza sativa (japonica cultivar-group)]
  misc_feature (49)..(289): NCBI GI: 115444911 NCBI Desc: os02g0202900 [oryza sativa (japonica cultivar-group)]
  misc_feature: The sequence is a functional homolog of SEQ ID NO. 315 in the 11/188,298 US application
  misc_feature: The sequence is a functional homolog of SEQ ID NO. 440 in the 11/188,298 US application
MLALVGARAGPVHSQTCLGATMRLMLPAEQNVPSKTMTQMPNDYSYSSLIPGLPEDVAKICLALVSRSYFPVMGAVSKRWMTFIGSREFIAVRKEVGKLEEWIYVLTAEAGRKGRSCWEVLRSPDQKKRRLPPMPGPNKAGFGVVVLDGKLFVMAGYAADHGKEFVSDEVYCYHACLNRWTALAKLNVARHDFACAEVKGVIYVAGGLGLAGVSLNSVEAYNPQQNKWTLIKSLRRPRWGCFGCGFSDKLYIMGGRSSFTIGNTRSVDVYEPDRHTWEELKRGCVMWKNQRSLATFNPADNSWQRILLPHTGSSSTKFCLRVFGMKVLLFSLEEEPGYQTLMYDPAAPTGYEWQTTKLKPSGSCICSVSIEV

SEQ ID NO: 1013 - DNA, 1893 bp, Sorghum bicolor
  misc_feature: Ceres ANNOT ID no. 6012682
  misc_feature: Encodes the peptide sequence at SEQ ID NO 1014
atgagggaaagggggttctcgccggcggggagaccgatcctcttcgtgtccctccacttcctcttcctctttaccgccgccgcggcgtctgcggcggcgcctgaggaggagaaattcacggaggagctgctcctgcggccgctcccggaccgcaaggcgctggcccacttccacttccgctcctctgcgccccccgctgcctccgttggtcggcaccaccacctcttccccaaggccatctcccagctggttaaaaaatatcatattagcgagttggagctatctttcacccagggaagatggaactatgagcagtggggtggatttgaacctatgtcaactaataatgcaaagcctcctggtgttgagctgtgggcagtttttgatcttcctttgtctgaaattgatgcaacatggaagaacctgacacatacactctctggcctgttttgtgcatccatcaactttttggagtcttcaactgcattttcttcccctcgttggggatttaaattgaatgaaggcaatttgcgatatggtgcattgcctcgtgaagcagtatgcactgagaatctgacaccttggttgaaacttcttccatgtcgtgacaaatctgggatagctgctttgctgtacaggccttcaatttacaaaggatattaccattcgcaaaaactgaaactgagatcctcccagtcacttggtattattcttgatcaaactctgactgttgtgctgcaaccaaatagtgtaagtggcgaacagctacattccaatcatggtcaacttcagcccaactggtccatgagacatcttttcaacagaaagttgtcagggaaatgccttgtttctaaatccagcagagtattcattgaggttgataaaggcattgttgacaaagttaacaaatctggaagtgatctttcttggagtaatgaattctttgtattgtctaatagcccggacaagttgatcaaaggtcaaaatcacttaattcaatcttcttctttatatgtatatgatgcaagtaactacagtgacgaaaaacctttggatgtgggcataacttggaagcttcccctgatatggacttgcaccccatcaccttttcacgcaagcagatttcttatgggcagtggaaatgaaagagggtcaattgctctgtcgtttatgtccactaatcttcataagcagatatctggcaacccaactgattgttcaataaaggcagttattttccaggttgttccatggaagactgtgtcagaagtagttgacaagattcatgtcattccttcagaagacaagcttttgcctggtaccctggagatgctactaagattcccttgcagtatgcagtcaggaactctgacattggattttgacaaggggttcctgcatatagatgaatatcctcctgatgctaatcaaggatttgacattccttcagctttggttagctttcctgagttcagttctgctcgaagttaccctgaaattgatccagtacttgaatctcctttactagaaaatttccaggaaaatagtgttgtgaagtcgtatacagaagtattgctcgttcccctgacaactcctgatttcagcatgccatacaatgtcatcaccttcacatgcactgtcttagctctttactttggctcattattgaatgctctgagacgaagaattggcgaggaagagagggagttgaagaaaacagccacaaggcgtggactcattcctcagttgctagctaagttaagggggcagaaggtggatccaacagagtcagggtcttcatctgaatcgagtggatcaaagaagctgctattcaaggttgtatttgttgcagtagcggcagttctatttcactatttctcaaacaacagttga

SEQ ID NO: 1014 - protein, 630 aa, Sorghum bicolor
  misc_feature: Ceres ANNOT ID no. 6012682
  misc_feature (17)..(588): Pfam Id: Gpi16 Pfam Desc: Gpi16 subunit, GPI transamidase component
  misc_feature (8)..(629): NCBI GI: 77550830 NCBI Desc: gpi16 subunit, gpi transamidase component [oryza sativa (japonica cultivar-group)]
  misc_feature (28)..(418): NCBI GI: 30680143 NCBI Desc: gpi transamidase component gpi16 subunit family protein [arabidopsis thaliana]
  misc_feature (16)..(589): NCBI GI: 134093061 NCBI Desc: phosphatidylinositol glycan anchor biosynthesis, class t precursor [papio anubis]
  misc_feature (16)..(589): NCBI GI: 84569994 NCBI Desc: pigt protein [homo sapiens]
  misc_feature (16)..(589): NCBI GI: 134093139 NCBI Desc: phosphatidylinositol glycan anchor biosynthesis, class t precursor [pongo pygmaeus]
MRERGFSPAGRPILFVSLHFLFLFTAAAASAAAPEEEKFTEELLLRPLPDRKALAHFHFRSSAPPAASVGRHHHLFPKAISQLVKKYHISELELSFTQGRWNYEQWGGFEPMSTNNAKPPGVELWAVFDLPLSEIDATWKNLTHTLSGLFCASINFLESSTAFSSPRWGFKLNEGNLRYGALPREAVCTENLTPWLKLLPCRDKSGIAALLYRPSIYKGYYHSQKLKLRSSQSLGIILDQTLTVVLQPNSVSGEQLHSNHGQLQPNWSMRHLFNRKLSGKCLVSKSSRVFIEVDKGIVDKVNKSGSDLSWSNEFFVLSNSPDKLIKGQNHLIQSSSLYVYDASNYSDEKPLDVGITWKLPLIWTCTPSPFHASRFLMGSGNERGSIALSFMSTNLHKQISGNPTDCSIKAVIFQVVPWKTVSEVVDKIHVIPSEDKLLPGTLEMLLRFPCSMQSGTLTLDFDKGFLHIDEYPPDANQGFDIPSALVSFPEFSSARSYPEIDPVLESPLLENFQENSVVKSYTEVLLVPLTTPDFSMPYNVITFTCTVLALYFGSLLNALRRRIGEEERELKKTATRRGLIPQLLAKLRGQKVDPTESGSSSESSGSKKLLFKVVFVAVAAVLFHYFSNNS

SEQ ID NO: 1015 - DNA, 1839 bp, Sorghum bicolor
  misc_feature: Ceres ANNOT ID no. 6012686
  misc_feature: Encodes the peptide sequence at SEQ ID NO 1016
atggcgatggccggcgccgccgccgccggtcgctgcctcctgctctcccgcccgtcccctttccggctccgcctcctccgcgccgccctctccaccgctgcccccaccatcggccccacctccactcccgctccccctccgcggcacgagctcctcctcgagcgcctccgcctccgccacctcaaggacgcctcctcctcccccggcgccccggcgcccgcctcgcggggcgcggagcggagctcgcagcagggaaaggggaagagggtcgaggccgcggagagcttcgaggagctcggccttggggaggaggtgatggccgctctcggggagatgggcatctccaagcccacggagatccagtgcgttggtgtgccggcggtgctggccggcaccagcgtcgtgctcggctcccacactggctctgggaagacgctggcctacttgctccctcttgttcagctacttcggcgtgatgaagcaatgctggggatatcaatgaagccaaggcggccaagagcagtagtactctgccccactagggagctcactgagcaggtttatcgagttgcaaagtctatcagccatcatgcacgttttcggtcaacgatggttagtggaggcacccgtctaaggccccaggaagattctttgaacatgcccgttgatatggttgttggtactcctggaaggattcttgatcatatcaaggatggtaacatggtttatggcgatattaagtatctggttctggatgaggcagatacaatgtttgatcaaggctttggaccagacatacggaagttccttgctccattgaagaatcgtgctgcaaagcctggtgatcaaggtttccaaacagtattagtcactgccactatgacaaaggctgtgcaaaagttgattgatgaggaatttgaaggtattgtccatttgcggacatcatcatttcaaaagagagtttcaacagcacggcatgactttatcaaactttctggagcagaaaacaaacttgaggctcttctgcaggttcttgagccaagcttggcaaagggaaacaaagttatggtgttctgcaatactttgaattcaagtcgtgcagtggaccattttctaactgaaaatcagatatccactgttaactatcatggagaggttccagctgaagagagagttgagaacctgaacaaattccgtaatgaagagggggactgcccaacattagtatgcactgatctggcagctagaggcctggacctggatgttgaccatgtcatcatgtttgacttcccatcaaattcgattgactaccttcacagaactggaagaactgcacgcatgggagccaaagggaaagttacaagcattgtggctaagaaggacgtagctttagctacacggatcgaagaggccatgaagaaaaatgagagcttggaagctctgacgactaacaatgttagaagggcagccagcccgcagagtgtgagcaccaaaggaaggccctcaaggttggttaagacttcaaatgctcttaaagttgtcaatcagaagggtagaaggggggttgcgctatctagcaagtcatcccggactcccaaggatacaacttcaacccgaaggcgctcaccgctgaagagccaggccaagacaacaaaatcggcagccccgcggaaagccaagccgttgaaaccttctcagagcagcacaaaggcctcgaagagcaaagcaaaacctgagggtcgaagatcaaagagtgatgctctgaacaagctcggaactaagctcagtgtggtcggattcagaggacgcagctcaggcaaatcagcacaatcttcataa

SEQ ID NO: 1016 - protein, 612 aa, Sorghum bicolor
  misc_feature: Ceres ANNOT ID no. 6012686
  misc_feature (118)..(301): Pfam Id: DEAD Pfam Desc: DEAD/DEAH box helicase
  misc_feature (371)..(448): Pfam Id: Helicase_C Pfam Desc: Helicase conserved C-terminal domain
  misc_feature (95)..(481): NCBI GI: 121608317 NCBI Desc: dead/deah box helicase domain protein [verminephrobacter eiseniae ef01-2]
  misc_feature (95)..(509): NCBI GI: 91787410 NCBI Desc: dead/deah box helicase-like [polaromonas sp. js666]
  misc_feature (95)..(481): NCBI GI: 89901799 NCBI Desc: dead/deah box helicase-like [rhodoferax ferrireducens dsm 15236]
  misc_feature (95)..(487): NCBI GI: 120609836 NCBI Desc: dead/deah box helicase domain protein [acidovorax avenae subsp. citrulli aac00-1]
  misc_feature (92)..(553): NCBI GI: 94311518 NCBI Desc: dead/deah box helicase-like protein [ralstonia metallidurans ch34]
MAMAGAAAAGRCLLLSRPSPFRLRLLRAALSTAAPTIGPTSTPAPPPRHELLLERLRLRHLKDASSSPGAPAPASRGAERSSQQGKGKRVEAAESFEELGLGEEVMAALGEMGISKPTEIQCVGVPAVLAGTSVVLGSHTGSGKTLAYLLPLVQLLRRDEAMLGISMKPRRPRAVVLCPTRELTEQVYRVAKSISHHARFRSTMVSGGTRLRPQEDSLNMPVDMVVGTPGRILDHIKDGNMVYGDIKYLVLDEADTMFDQGFGPDIRKFLAPLKNRAAKPGDQGFQTVLVTATMTKAVQKLIDEEFEGIVHLRTSSFQKRVSTARHDFIKLSGAENKLEALLQVLEPSLAKGNKVMVFCNTLNSSRAVDHFLTENQISTVNYHGEVPAEERVENLNKFRNEEGDCPTLVCTDLAARGLDLDVDHVIMFDFPSNSIDYLHRTGRTARMGAKGKVTSIVAKKDVALATRIEEAMKKNESLEALTTNNVRRAASPQSVSTKGRPSRLVKTSNALKVVNQKGRRGVALSSKSSRTPKDTTSTRRRSPLKSQAKTTKSAAPRKAKPLKPSQSSTKASKSKAKPEGRRSKSDALNKLGTKLSVVGFRGRSSGKSAQSS

SEQ ID NO: 1017 - DNA, 1167 bp, Sorghum bicolor
  misc_feature: Ceres ANNOT ID no. 6012689
  misc_feature: Encodes the peptide sequence at SEQ ID NO 1018
  misc_feature: Up-regulated in shoot tissues in response to aminocyclopropane carboxylic treatment
atggccggcacccgcgcgacgccgacgcggacaccgccgcggtcgtcttccccggcggcccgctccgaggtggtagtcccgtcggactgggcctgcgttgtaacgaccgtctcctccgaccccacgcccccggtggtcgtcgtgtgcgggcccaagaacagcggcaagtccaccttctcccgcgtcctcctcaacgcgctgctccccaggcacggtaaggttggttatctggacaccgacatggggcagccggagtttgggctgccggggtgcctctcgttcaatgtcgttgacgaacctatcacagatttgctgaacccaactctacgggaagctgaaaggtgctacttctttggtgacacttcttcgaaaagagatccagaagcatatctgaattgcctatttcatttgtatgactactttgttggaaaatatcgatgtgataagaatgaaatgctgcctctaattgtcaatactcctggatgggtaaaaggtgctggtttcgatatgcttgtagagttgctaaggtatatctgccccacaatagttgttcagatacgcatcacaatgcagagcaagaatctccctgatggagtgttttggctagatggtgggcaaacaggacctaagatgattaacatcggtgctgcatttcatgatgcctcgaatagatcgttgttaattcagaaagattcatgtggaatgcgtgaacggcgacttgtggagtacttgaagcaatgttttctgagtaacatatctctatcaactaataaggagcttgcttatgccctagcttcacttccaccttatcaagtaccattttcagatgttgcagttgtgcatcttcattgcaaggtacctgctggtgaggtatggcgtagtcttaacgcaaccatagttggattggcagtttccaatgcatctgagggaaccagatcaatcccttgctgtgttgggctaggcattgtaaggggtgtcgatattcaaaaaggcctgttatatgtaataactcctgtccctctccagcgccttcaaagcgttgatcttttgcaacagggtctcattgagatacctactactattttgcaggtccgcggatgcgtgtcgccgtacatgtcgacaaatgtgcttcacaaaatatcagaaagggatttatatgctgggtga

SEQ ID NO: 1018 - protein, 388 aa, Sorghum bicolor
  misc_feature: Ceres ANNOT ID no. 6012689
  misc_feature (235)..(362): Pfam Id: NUC156 Pfam Desc: NUC156 domain
  misc_feature (26)..(321): NCBI GI: 15724270 NCBI Desc: at5g11010/t30n20_280 [arabidopsis thaliana]
  misc_feature (29)..(364): NCBI GI: 115436470 NCBI Desc: os01g0354700 [oryza sativa (japonica cultivar-group)]
  misc_feature (44)..(197): NCBI GI: 39795264 NCBI Desc: flj23323 protein [homo sapiens]
  misc_feature (44)..(197): NCBI GI: 39644857 NCBI Desc: flj23323 protein [homo sapiens]
  misc_feature (44)..(197): NCBI GI: 73921242 NCBI Desc: nucleolar protein 9
  misc_feature: Up-regulated in shoot tissues in response to aminocyclopropane carboxylic treatment
MAGTRATPTRTPPRSSSPAARSEVVVPSDWACVVTTVSSDPTPPVVVVCGPKNSGKSTFSRVLLNALLPRHGKVGYLDTDMGQPEFGLPGCLSFNVVDEPITDLLNPTLREAERCYFFGDTSSKRDPEAYLNCLFHLYDYFVGKYRCDKNEMLPLIVNTPGWVKGAGFDMLVELLRYICPTIVVQIRITMQSKNLPDGVFWLDGGQTGPKMINIGAAFHDASNRSLLIQKDSCGMRERRLVEYLKQCFLSNISLSTNKELAYALASLPPYQVPFSDVAVVHLHCKVPAGEVWRSLNATIVGLAVSNASEGTRSIPCCVGLGIVRGVDIQKGLLYVITPVPLQRLQSVDLLQQGLIEIPTTILQVRGCVSPYMSTNVLHKISERDLYAG

SEQ ID NO: 1019 - DNA, 1461 bp, Sorghum bicolor
  misc_feature: Ceres ANNOT ID no. 6012696
  misc_feature: Encodes the peptide sequence at SEQ ID NO 1020
atggcggcgtggtcgtcgccgccgtcgcttcgccacctcctcctcctccgcccgcgcttgcccctcagccccacctgcctcggaggctccttctcgcgccgccacatccacagccgctgccgtctcttctcctccgccgcatcctcgtcgacgctgacccacggcgacgccgcctcgacgaacggtgatgctgatggcgtcgtcgacgtcaaccctccgcgcggaactagggacttcccgccggaggacatgcggctccgcacctggctcttcgaccaattcagggaagtctcccgcctcatggccttcgaggaggtggacttccccgtcctagagtcggaggctctcttcatccggaaggcaggggaagagattacgcagcagctctacaactttgaggataaagggggtcgccgtgtcgttctcaggcccgaaatcaccccttccctcgcgcgcctagtcataaagcaaggaaaatcagtctcccttccactgaaatggtttactataggacaatgctggcgatatgagcgcatgaccagaggaagaaggcgggaacattaccaatggaatatggatatatttggtgtgcctaaagttcgggctgaggctgagcttcttaatgctattgttctcttatttcaacatcttggaattacatcttcagatgtggggatcagggtgtccagccgtaaggttcttcaggctgtgttgaacatgtactccatcccagaacatttattcactgaagtttgtgtcattgtcgataaattgggtaaaatgactagggaagaaattgagaaggaacttatttctactgggctgtcatctgaagctgtccagggtatcattgatgtgctttcgctcaagtcattgtccaaacttgaagaggtggtaggctctgatgttgaagctgttgctgacttgaagaaactcttctcctttgcggagcagtatggttatgctgattggatttgttttgatgcatcagtggtccgtggccttgcatactacacaggaattgtatttgaggcatttgatagagaaggaaaactaagagcaatttgtggtggtggaaggtatgatagattgctttcaacatttggaagtgaagatataccggcttgtggctttggatttggagatgctgttatagtggaactgctgaaggaaaagggtctcttgcctgatatgtcacgccaaattgacgacattgtcttccctttggacgaagaacttgaagggccagcatccagtattgctgcctctctgaggaagaaaggccgatctgttgaccttgtagaagacaaacgtctcaaatgggtatttaagcatgcggagaggatcaacgctagcaggctgattttggttggaaattctgagtgggagcgaggcatggttcgcgtaaagatactttcaaccagggaagaattcgaggtgaaggcaggtgaactagagtga

SEQ ID NO: 1020 - protein, 486 aa, Sorghum bicolor
  misc_feature: Ceres ANNOT ID no. 6012696
  misc_feature (86)..(251): Pfam Id: tRNA-synt_2b Pfam Desc: tRNA synthetase class II core domain (G, H, P, S and T)
  misc_feature (68)..(260): NCBI GI: 7378622 NCBI Desc: histidyl-trna synthetase-like protein [arabidopsis thaliana]
  misc_feature (68)..(261): NCBI GI: 79326851 NCBI Desc: atp binding / trna ligase [arabidopsis thaliana]
  misc_feature (280)..(486): NCBI GI: 62319601 NCBI Desc: histidyl-trna synthetase [arabidopsis thaliana]
  misc_feature (74)..(477): NCBI GI: 110619820 NCBI Desc: histidyl-trna synthetase (histidine--trna ligase) (hisrs) [uncultured methanogenic archaeon rc-i]
  misc_feature (74)..(480): NCBI GI: 16081268 NCBI Desc: probable histidyl-trna synthetase [thermoplasma acidophilum dsm 1728]
MAAWSSPPSLRHLLLLRPRLPLSPTCLGGSFSRRHIHSRCRLFSSAASSSTLTHGDAASTNGDADGVVDVNPPRGTRDFPPEDMRLRTWLFDQFREVSRLMAFEEVDFPVLESEALFIRKAGEEITQQLYNFEDKGGRRVVLRPEITPSLARLVIKQGKSVSLPLKWFTIGQCWRYERMTRGRRREHYQWNMDIFGVPKVRAEAELLNAIVLLFQHLGITSSDVGIRVSSRKVLQAVLNMYSIPEHLFTEVCVIVDKLGKMTREEIEKELISTGLSSEAVQGIIDVLSLKSLSKLEEVVGSDVEAVADLKKLFSFAEQYGYADWICFDASVVRGLAYYTGIVFEAFDREGKLRAICGGGRYDRLLSTFGSEDIPACGFGFGDAVIVELLKEKGLLPDMSRQIDDIVFPLDEELEGPASSIAASLRKKGRSVDLVEDKRLKWVFKHAERINASRLILVGNSEWERGMVRVKILSTREEFEVKAGELE

SEQ ID NO: 1021 - DNA, 1083 bp, Sorghum bicolor
  misc_feature: Ceres ANNOT ID no. 6012707
  misc_feature: Encodes the peptide sequence at SEQ ID NO 1022
atggccgccgtggacccgccgccgcgcggcgaggccgcgcccgcgcccgcgcccgtgctgaagcggagcaccagcatcgaccggatccctgaggacgcgcgccgcatcctgcaccgcctcgccggcgacctctggggcagcgacgtggaccccagcgcgctcaccgtgtcccagctcaagggcgccatgaccaacgaggtcttccggatcacctggcccggcggcgagggcgacccgcgcaaggtgctcgtgcgcatctacggccgcggcgtcgaggtcttcttcgaccgcgccgacgaggtccgcaccttcgagtgcatgtcgcgccacggccaggggccccgcctcctcggccgctttgccaacggccgcgtcgaggagttcatctacgccaggacgctctctgcggcggatctgcgcgacccggagatatccgcgctgattgccaagaagctgcgggagtttcacgatctcgacatgcctggacctagggatgtgtcattgtggcagaggctcaggaggtggcttgaggaggctcgtggcaggtgttctgagcaagagtttaaccaatttcagctggataagctaggcgatgagattgcagtgctggagaagacgctctcgggggtcgaacagtccgtaggattttgccataatgatttgcagtatgggaatattatgatagatgaagagaccagacaagtcaccttgattgactatgaatatgcgagttttaacccaatcgcatttgacattgctaatcacttttgtgagatggctgctgattaccatacagcaacaccacacgagttggattttacaaaatatcctggcattgaggaacagagaagatttgttcagacatacctttgctctgcaggtgaaaagccatcagatggggaagttgaaaaactactagggttgattgcaaagtacactcctgcaagccatctcttttggggcctgtggggaataatctcggcacatgtaaacaataatatcgacttcgagtacaaggaatatgcaaggcaacgcttggatcagtactggcaaacaaagcctggaatgcttgggcccaactga

SEQ ID NO: 1022 - protein, 360 aa, Sorghum bicolor
  misc_feature: Ceres ANNOT ID no. 6012707
  misc_feature (78)..(281): Pfam Id: Choline_kinase Pfam Desc: Choline/ethanolamine kinase
  misc_feature (55)..(279): Pfam Id: APH Pfam Desc: Phosphotransferase enzyme family
  misc_feature (3)..(357): NCBI GI: 1438883 NCBI Desc: gmck3p
  misc_feature (31)..(353): NCBI GI: 12311795 NCBI Desc: choline kinase [pisum sativum]
  misc_feature (26)..(360): NCBI GI: 92872421 NCBI Desc: choline kinase, n-terminal; protein kinase-like [medicago truncatula]
  misc_feature (31)..(357): NCBI GI: 1438881 NCBI Desc: gmck2p
  misc_feature (31)..(357): NCBI GI: 1438879 NCBI Desc: gmck1p
MAAVDPPPRGEAAPAPAPVLKRSTSIDRIPEDARRILHRLAGDLWGSDVDPSALTVSQLKGAMTNEVFRITWPGGEGDPRKVLVRIYGRGVEVFFDRADEVRTFECMSRHGQGPRLLGRFANGRVEEFIYARTLSAADLRDPEISALIAKKLREFHDLDMPGPRDVSLWQRLRRWLEEARGRCSEQEFNQFQLDKLGDEIAVLEKTLSGVEQSVGFCHNDLQYGNIMIDEETRQVTLIDYEYASFNPIAFDIANHFCEMAADYHTATPHELDFTKYPGIEEQRRFVQTYLCSAGEKPSDGEVEKLLGLIAKYTPASHLFWGLWGIISAHVNNNIDFEYKEYARQRLDQYWQTKPGMLGPN

SEQ ID NO: 1023 - DNA, 3489 bp, Sorghum bicolor
  misc_feature: Ceres ANNOT ID no. 6012713
  misc_feature: Encodes the peptide sequence at SEQ ID NO 1024
atgtcagattcaaatgtgaagtggattgatggtctccagttcacatcattgtactggcctccaccccaggatgtggagcagaagcaggcacaaattttggcctatgttgagtactttggccagtttacagctgacagcgagcaattccctgaagatgtagctcagctcattcaaagttcctatccatcaaaagaaagtcgcttggtagatgaagtattggcaacttttgttcttcatcatccggagcatggtcatgctgttgtacatccaattctttcacgcatcatagatgggacgctgtgctatgataggcatggtcccccattcagctccttcatctctttatttagccatacttctgagcaagagtactcagagcagtgggccttggcctgtggagaaattcttagagtcttaactcactataataggccaatattcaaagttgagcgccaacatagtgaagctgaatgtagcagcacatctgatcaggcaacatctagtgattcgaccgataagaaatctaataattctccaggaaatgaatctgaccggaaaccattgaggccactaaccccgtggatcactgacatattgctagctgcacctttgggcattcgaagcgactattttcgatggtgtgggggtgtaatgggaaaatatgctgctggtggagaattgaagcctccaactactgcttgcagccgaggatctgggaagcacccacagcttatgccttccacccctagatgggctgttgctaatggagctggagttatattaagtgtctgtgatgaggaggtagctcgttatgagacagcaaatttaacagcagcagctgttcctgcacttctgctacctccaccaacaacacccttggacgagcatttggtggctggcctgccccctcttgaaccatatgctcgcttgttccatagatactatgcaattgctacaccaagtgctacacaaaggttgctttttggtcttctcgaagcaccaccatcatgggctccggacgcacttgatgcagcagtacagctagttgagctacttagagcagccgaagattatgcttctggcatgcggcttccaaagaactggatgcatctgcatttcttgcgtgcgattggaactgcaatgtcaatgagagctggtattgctgctgatacagcagctgctttgcttttccgaatactttcccaaccaacgctgctttttccaccactgagacatgccgaaggagttgaagtacaccatgaaccactgggtggctatgtatcatcatataagaagcagttggaagttcctgcatctgaggccactatcgatgccactgcacaaggcattgcttctttgttgtgtgctcatggccctgatgttgagtggagaatatgtaccatctgggaagctgcctatggtttgctaccgctaagttcatcagcagttgatttacctgaaattgttgtagctgctccgcttcagccacctacactgtcatggagcctgtacttaccattattaaaagtattcgagtatctacctcgtggaagtccatctgaagcatgcctgatgaggatatttgtggcaacagttgaagctatacttaggagagcttttccttctgaaacatcagagcaatctagaaagccaagaagtcaatctaagaaccttgctgttgctgaacttcacacaatgatacattcactctttgttgaatcttgtgcctcaatggaccttgcctcccgattgctatttgtggtgttaaccgtttgtgtcagccatcaagctttgccagggggcagcaaaagaccaactggtagtgataaccattcccacgaggaagccactgagcattcaagattaacaaatggaagaagcagatgtaagaagagacaaggccctgttgctacgtttgattcatatgttctagctgcagttgttgccttatcttgtgagctcgacctgttcccttgcatttctaagaatggatcgcattcaaatctaaaggattccctgaagattatcatacctggaaaaaacaatgggatcaataatgagccacgcagtagcatcagctcagcaattcttcatactcgcagaattcttggcatcttggaagcccttttctccctgaagccatcatcagttggtacctcatggagctatagctcaaatgaaatagttgcagcagctatggttgccgctcatgtttctgagttgtttcgtcggtctaggccgtgccttacttcactctctgcaatgatgagatgtaagcgggatgctgagatttctaccagggcatcatccctctaccatttgattgacttacatggtaaaacagtgtcctccattgtgaacaaagccgagcctcttgaagctcacctgacccttacaccagtaaagaaggataatcaacatcgctgtgaggaaaacaataccagctcatcggatagtgtcaagttggaaaacaagaatggttcaacatcacataagaaaaatggtttctcaagaccactcttgaaatgtgcagaagaggttctactgaatggcgatgttgcaagtacatctgggaaatccattgcaagcttacaggtggaagcatctgatttggcaaacttccttaccatggatcggaatggggggtaccgaggttcacaaactctcttaagatctgtattatctgagaaacaagagctgtgcttctctgttgtctcattgctctggcagaagctcatagcttctcccgaaatgcagatgtctgcagaaagtacatcagctcaccaaggatggaggaaggttgtggatgcactttgtgatgtcgtttcagcctcaccaaccaaggcctcaactgccatcgttctccaggccgataaggacttgcagccttggattgctagagacgatgaacaaggtcagaagatgtggagagtcaaccaacgtatagtgaagcttatagctgagcttatgaggaaccatgacagccctgaagctttggtgatacttgctagtgcctctgaccttctacttcgtgctactgatggaatgcttgttgatggggaagcttgtactttgccacaacttgagcttctcgaagtaactgctcgagcagtgcatcttattattgaatggggagattcaggtttatcggttgctgatggcctttgtaatctgctaaagtgccgtctatcaaccaccatccgctgcctttctcacccaagtgcacacgtccgtgcgctcagcatgtccgtcctccgtgacatcctgaacaacggatccatgaaccccagcaagatcatccaaggggaacagcagcggaatggcatccagaacccgtcctaccggtgcctggccgcaggcatcatcaactggcaagctgacgttgagaggtgcatagaatgggaagcccacagccgccgtgccaccgggctgacgctcgccttcctcagtgcggcggcgaaggagctcggctgccctctcccctgctga

SEQ ID NO: 1024 - protein, 1162 aa, Sorghum bicolor
  misc_feature: Ceres ANNOT ID no. 6012713
  misc_feature (1)..(1162): NCBI GI: 67476983 NCBI Desc: gigantea protein
  misc_feature (1)..(1162): NCBI GI: 50593496 NCBI Desc: gigantea 3 [triticum aestivum]
  misc_feature (1)..(1162): NCBI GI: 58201790 NCBI Desc: gigantea-like protein [hordeum vulgare subsp. vulgare]
  misc_feature (1)..(1162): NCBI GI: 58201788 NCBI Desc: gigantea-like protein [hordeum vulgare]
  misc_feature (1)..(1162): NCBI GI: 50593494 NCBI Desc: gigantea 2 [triticum aestivum]
  misc_feature: Useful for making plants with modulated biomass
  misc_feature: GREAT-hit functional homolog of the protein sequence given in SEQ ID NO 13387
  misc_feature: Useful for making plants with modulated flowering time
  misc_feature: Functional homolog of the protein sequence given in SEQ ID NO 13596
  misc_feature: Useful for making plants with modulated biomass
  misc_feature: Functional homolog of the protein sequence given in SEQ ID NO 13387
MSDSNVKWIDGLQFTSLYWPPPQDVEQKQAQILAYVEYFGQFTADSEQFPEDVAQLIQSSYPSKESRLVDEVLATFVLHHPEHGHAVVHPILSRIIDGTLCYDRHGPPFSSFISLFSHTSEQEYSEQWALACGEILRVLTHYNRPIFKVERQHSEAECSSTSDQATSSDSTDKKSNNSPGNESDRKPLRPLTPWITDILLAAPLGIRSDYFRWCGGVMGKYAAGGELKPPTTACSRGSGKHPQLMPSTPRWAVANGAGVILSVCDEEVARYETANLTAAAVPALLLPPPTTPLDEHLVAGLPPLEPYARLFHRYYAIATPSATQRLLFGLLEAPPSWAPDALDAAVQLVELLRAAEDYASGMRLPKNWMHLHFLRAIGTAMSMRAGIAADTAAALLFRILSQPTLLFPPLRHAEGVEVHHEPLGGYVSSYKKQLEVPASEATIDATAQGIASLLCAHGPDVEWRICTIWEAAYGLLPLSSSAVDLPEIVVAAPLQPPTLSWSLYLPLLKVFEYLPRGSPSEACLMRIFVATVEAILRRAFPSETSEQSRKPRSQSKNLAVAELHTMIHSLFVESCASMDLASRLLFVVLTVCVSHQALPGGSKRPTGSDNHSHEEATEHSRLTNGRSRCKKRQGPVATFDSYVLAAVVALSCELDLFPCISKNGSHSNLKDSLKIIIPGKNNGINNEPRSSISSAILHTRRILGILEALFSLKPSSVGTSWSYSSNEIVAAAMVAAHVSELFRRSRPCLTSLSAMMRCKRDAEISTRASSLYHLIDLHGKTVSSIVNKAEPLEAHLTLTPVKKDNQHRCEENNTSSSDSVKLENKNGSTSHKKNGFSRPLLKCAEEVLLNGDVASTSGKSIASLQVEASDLANFLTMDRNGGYRGSQTLLRSVLSEKQELCFSVVSLLWQKLIASPEMQMSAESTSAHQGWRKVVDALCDVVSASPTKASTAIVLQADKDLQPWIARDDEQGQKMWRVNQRIVKLIAELMRNHDSPEALVILASASDLLLRATDGMLVDGEACTLPQLELLEVTARAVHLIIEWGDSGLSVADGLCNLLKCRLSTTIRCLSHPSAHVRALSMSVLRDILNNGSMNPSKIIQGEQQRNGIQNPSYRCLAAGIINWQADVERCIEWEAHSRRATGLTLAFLSAAAKELGCPLPC

SEQ ID NO: 1025 - DNA, 1743 bp, Sorghum bicolor
  misc_feature: Ceres ANNOT ID no. 6012719
  misc_feature: Encodes the peptide sequence at SEQ ID NO 1026
atgaagggaaattttaatgctagtgccatgttgctactgattttaataactaattctccaggaaagatgagcttgatatcccagaacgcggtccagaagcgccgcctcaggaagagtgaaggtgatgatgacaatgacgaggacattggctctccgacctccatagatgcagagggtgggaaggaagcaaagttgaagaatcacagtaaggaaaggaagaagaaaaggactaaggtccaggagtcccagcagaacaaagaggaagaggagatgcggcagctggagagctcattgtttggttccctttatgcaccactggagtttggcactgaggttggggctgcagtagtagctcctgaccgggatgcgcctttgtttttcacagataggtctgctggtggtggtggcatggattattttcctatatatgaggaggatatttcccatgaggatgaggaagacgtggtgggtatcaaggggaggaagcctgtatgggtggatgaggaggaagaaaggacagaggtggacatcgtgaaggtttcaaggttgaggaagctgagaaaagaggaagatcagcatttgatttcagggaaagagtatgaggccaggctgcgtgggcagcatgccaaattgaaccccttcactggctgggctgatatggaccggaaaacttctcttcctgttgcgtcagatggtgagtctgatgatgagggttgtgtcgatgatatccttcagaataacgatgagcttgttgtcaaggatactgtcaagctcttacctgggatgctggagttctcaaggctcgttgatgccaatatccaggatccgtcaaatggtcctatccattcagtgcagtttcataggaatgggcaactgatgcttgctgcaggtctggacaagcatctcaggtttttccagattgatggaaagagaaaccccaagatccagagcatatttattgaggactgtccagtacacaaggcctcatttctacctgatggctctgaggtgatcctatcaggcaggagaaagttcttctactcatttgacctggtgaatgctgctgttagcaagattggacctttgacagggcgtgaggagaaaagcctggagagctttgagatatcacctgattcgagaaccattgcttttgtcggtaacgaagggtacatccttcttatttctgccaagacaaagcagctcattggaaccctcaagatgaacggaagcgtgcgttcactggcttttctggatggtggaaaccagctgctgagcagcggtggagatggccatgtttaccactgggatctcggaatgaggaagtgcatccacaaggcttttgacgacggttccctggctggcatttcactttgcacctcgcaggacagctctttgtttgccacaggctccaccagcggcatcgtgaacgtgtacaagggggacgattttcttggcgggaagaggaaaccactgaagacgatcgaaaacctgaccactgacattggcgaaatgaaattcaaccatgatgcccagatcttggcgatcagctcaaggaaagagaggaatgggatgaggcttgtgcacatcccgtcgttcaacgtgttccagaactggccagggcctcggttcagccttcactatccacggtgcctggatttcagccctggcagcgggttcttgtctgttggacatgcaggtggaaaagtcctgctatacaagcttcaccactataaaaacgcatga

SEQ ID NO: 1026 - protein, 580 aa, Sorghum bicolor
  misc_feature: Ceres ANNOT ID no. 6012719
  misc_feature (399)..(436): Pfam Id: WD40 Pfam Desc: WD domain, G-beta repeat
  misc_feature (23)..(580): NCBI GI: 92877705 NCBI Desc: inorganic pyrophosphatase; wd40-like [medicago truncatula]
  misc_feature (23)..(580): NCBI GI: 87240437 NCBI Desc: wd40-like [medicago truncatula]
  misc_feature (55)..(579): NCBI GI: 89269519 NCBI Desc: wd repeat domain 50 [xenopus tropicalis]
  misc_feature (142)..(579): NCBI GI: 62860162 NCBI Desc: wdr50 [xenopus tropicalis]
  misc_feature (142)..(579): NCBI GI: 111309080 NCBI Desc: wdr50 protein [xenopus tropicalis]
MKGNFNASAMLLLILITNSPGKMSLISQNAVQKRRLRKSEGDDDNDEDIGSPTSIDAEGGKEAKLKNHSKERKKKRTKVQESQQNKEEEEMRQLESSLFGSLYAPLEFGTEVGAAVVAPDRDAPLFFTDRSAGGGGMDYFPIYEEDISHEDEEDVVGIKGRKPVWVDEEEERTEVDIVKVSRLRKLRKEEDQHLISGKEYEARLRGQHAKLNPFTGWADMDRKTSLPVASDGESDDEGCVDDILQNNDELVVKDTVKLLPGMLEFSRLVDANIQDPSNGPIHSVQFHRNGQLMLAAGLDKHLRFFQIDGKRNPKIQSIFIEDCPVHKASFLPDGSEVILSGRRKFFYSFDLVNAAVSKIGPLTGREEKSLESFEISPDSRTIAFVGNEGYILLISAKTKQLIGTLKMNGSVRSLAFLDGGNQLLSSGGDGHVYHWDLGMRKCIHKAFDDGSLAGISLCTSQDSSLFATGSTSGIVNVYKGDDFLGGKRKPLKTIENLTTDIGEMKFNHDAQILAISSRKERNGMRLVHIPSFNVFQNWPGPRFSLHYPRCLDFSPGSGFLSVGHAGGKVLLYKLHHYKNA

SEQ ID NO: 1027 - DNA, 3015 bp, Sorghum bicolor
  misc_feature: Ceres ANNOT ID no. 6012732
  misc_feature: Encodes the peptide sequence at SEQ ID NO 1028
atgggggaagaggcggagagcacctgcaagcgcaaggcgccggactcgagcgcggaggagcagccgagttccgcgcctgcgcagtcgcagtcgcaggcggacccggcggccaagcgccggaacctctcccgctcgtgcgtccacgaggtcgccgtcccgaaagggtacgagtcggccaaggacgaggcggtgcacgggacgctcgccaacccggacttcaatggggagatggccaagcagtacccgttcaatctcgaccccttccagagcacctccatcgcgtgcctggagcggaacgagtccgtgcttgtctctgcgcacacttctgcggggaagaccgttgttgctgaatacgccattgcaatggcgttcagggacaagcagagggtcatctacacctccccgctcaaggccctgagcaaccagaagtacagggagctcagccaggagttcacagatgttgggctgatgactggtgacgtcacgctccatcctaatgccacgtgcctggtcatgacgacagaaatcctcagggcgatgctctacaggggttctgaggtgattaaggaggttgcctgggttatatttgatgagatacattacatgaaggatcgtgagagaggagtcgtgtgggaggagagcatcattttcttgccccctgccatcaagatggtcttcctttccgctactatgtcgaatgcgactgagtttgctgagtggatatgcagcctgcacaagcagccttgtcatgttgtgtatacggacttcagaccgacaccattgcagcactatgtgtttccaataggcggttctggtctgtaccttgtagtagatgaaaatggccagtttagagaagataacttttcaaagctacaagactcgtttgcgaagcaaaataatcaactggatggaaggaaaggtggtggacctaaagcgagtggccgaattgcgaaaggtggaagtgcctctgggaattctgacatatacagaattgtcaagatgattatggagcgcaagtttcaaccagtcataattttcagctttagtagaagagaatgtgagcaccatgccatgtctatgtcaaaacttgatttcaacactgaggacgaaaaggaatgcattgagcaggttttccgtaatgctattggttgtttagttgaggaagatagaagtttacctgctatagagttgatgttgccgcttcttaaacgaggtattgcagtacatcattctggacttcttccaataattaaggagcttgttgagttgctctttcaagaaggtcttgtcaaagctctctttgctactgagacatttgccatgggtcttaatatgcctgcaaaaaccgttgttttcacctctgtaaaaaaatgggatggtgataccaaccgctatattggatctggagaatacatacagatgagtggaagagctggccggcgtggcaaggatgaacgtggtatttgtgttataatgatagatgagaagatggaaatgagtgttatcaaggacatggtgttaggcaaaccagcacctcttgtcagtacttttcgactgagctattacactattttgaacttaatgagccgtgtagagggccaatttaccgctgagcatgtgattaggcattcattccatcagtttcagtatgagaaggcattgccagaaataattcaaaagattacacggttggaggatgaagctacctttctcgattcttctggagagactgatcttgctgaatatcacaaattggggcttgatatatctgaactagagaagaaaatcatgtctgagatgattagaccagagagggctttgttgtatttggttcctgggaggctggttagagtgagggatggttcaacagactggggatggggtgtggttgtaaatgtagtgaagaaacctccagtatctgggactctcccccctgcattaagtgcatcacgcagcaataactatatagttgacaccttgcttcactgctcctctaattccagcgagaatggatcacgttcaaagccatgcccgcctcgcccaggggagaagggtgaaatgcatgtggtgcctgtaccattgcctttagtatctggtctaagcagtgttagaatcaacattcctcctgatctacgaccacctgaagcaagacaaaatatactttttgcagtgcaagaactaggaaagcgctacccccaaggccttccgaagctacatccaatcaacgatatgggtattcaagaacctgaactagttgacttggtacataaacttgaggaccttgagcagaaacaatgctctcacagacttcataagtctggtcaaagtgatcaggaactatcttggtaccaaaggaaagcagacttgaatagtgaaattcagcaactcaagtcaaagatgcgggattcacagctacaaaaatttagagatgaacttaagaaccgatcccgcgttctgaagatgcttggtcatattgatgctgatggtgttctccagttaaaaggacgtgctgcctgtttaatagacacaggggatgaactgcttatcactgaacttatgttcaatggtacatttaatgatcttgaccatcatcaagttgcttcccttgctagctgctttgtaccttgtgataaatcaagtgagcagatacgcctaagaaatgaactttctaggccgatgacgcaacttcaggaggctgcaagaaaaatagctgaggtacaaaaagaatgcaaactggaagtaaatgtggaggaatatgttgaatcaacatgcagaccttaccttatggatgtcatatactgctggtcaaggggagccacctttgcagaggtgatggaaatgaccgacatttttgaaggaagtgtcataaggcttgctcgaaggctggatgaatttctgaatcagttgagagctgctgctgaagccgtaggggaggttaaccttgagaagaagttcgagaaggcaagtgagagtttgcgtcggggtatcatgttttccaactcattgtatctgtaa

SEQ ID NO: 1028 - protein, 1004 aa, Sorghum bicolor
  misc_feature: Ceres ANNOT ID no. 6012732
  misc_feature (815)..(1004): Pfam Id: DSHCT Pfam Desc: DSHCT (NUC185) domain
  misc_feature (86)..(237): Pfam Id: DEAD Pfam Desc: DEAD/DEAH box helicase
  misc_feature (398)..(482): Pfam Id: Helicase_C Pfam Desc: Helicase conserved C-terminal domain
  misc_feature (3)..(1004): NCBI GI: 62733691 NCBI Desc: hua enhancer 2 [oryza sativa (japonica cultivar-group)]
  misc_feature (3)..(1004): NCBI GI: 16024936 NCBI Desc: hua enhancer 2 [arabidopsis thaliana]
  misc_feature (4)..(1004): NCBI GI: 140052754 NCBI Desc: ribosomal protein l29; atp-requiring dna helicase recq; dsh, c-terminal [medicago truncatula]
  misc_feature (2)..(1004): NCBI GI: 47550803 NCBI Desc: zgc:63838 [danio rerio]
  misc_feature (45)..(1004): NCBI GI: 116117972 NCBI Desc: ensangp00000020973 [anopheles gambiae str. pest]
MGEEAESTCKRKAPDSSAEEQPSSAPAQSQSQADPAAKRRNLSRSCVHEVAVPKGYESAKDEAVHGTLANPDFNGEMAKQYPFNLDPFQSTSIACLERNESVLVSAHTSAGKTVVAEYAIAMAFRDKQRVIYTSPLKALSNQKYRELSQEFTDVGLMTGDVTLHPNATCLVMTTEILRAMLYRGSEVIKEVAWVIFDEIHYMKDRERGVVWEESIIFLPPAIKMVFLSATMSNATEFAEWICSLHKQPCHVVYTDFRPTPLQHYVFPIGGSGLYLVVDENGQFREDNFSKLQDSFAKQNNQLDGRKGGGPKASGRIAKGGSASGNSDIYRIVKMIMERKFQPVIIFSFSRRECEHHAMSMSKLDFNTEDEKECIEQVFRNAIGCLVEEDRSLPAIELMLPLLKRGIAVHHSGLLPIIKELVELLFQEGLVKALFATETFAMGLNMPAKTVVFTSVKKWDGDTNRYIGSGEYIQMSGRAGRRGKDERGICVIMIDEKMEMSVIKDMVLGKPAPLVSTFRLSYYTILNLMSRVEGQFTAEHVIRHSFHQFQYEKALPEIIQKITRLEDEATFLDSSGETDLAEYHKLGLDISELEKKIMSEMIRPERALLYLVPGRLVRVRDGSTDWGWGVVVNVVKKPPVSGTLPPALSASRSNNYIVDTLLHCSSNSSENGSRSKPCPPRPGEKGEMHVVPVPLPLVSGLSSVRINIPPDLRPPEARQNILFAVQELGKRYPQGLPKLHPINDMGIQEPELVDLVHKLEDLEQKQCSHRLHKSGQSDQELSWYQRKADLNSEIQQLKSKMRDSQLQKFRDELKNRSRVLKMLGHIDADGVLQLKGRAACLIDTGDELLITELMFNGTFNDLDHHQVASLASCFVPCDKSSEQIRLRNELSRPMTQLQEAARKIAEVQKECKLEVNVEEYVESTCRPYLMDVIYCWSRGATFAEVMEMTDIFEGSVIRLARRLDEFLNQLRAAAEAVGEVNLEKKFEKASESLRRGIMFSNSLYL

SEQ ID NO: 1029 - DNA, 993 bp, Sorghum bicolor
  misc_feature: Ceres ANNOT ID no. 6012737
  misc_feature: Encodes the peptide sequence at SEQ ID NO 1030
atggcggaggtgcccgccgtcgtcgccgccgcttccagctgcgaggtcgacctcggcaacctcatggcgtacgacccgtcacaccacgtcgtctccgccgccgccgccgcctccagggaggaactgaggcaggagtgtctacggaaggggacggagctggcgcaggcggtggccgacgctctcttcgcgctgcctcccagcgaggaccgcgacggccccatcgtccacctcccgccgcccaccgtccgactcccgcgcgagaagcatctacccaagcccaagccaccgaccaagtgggagctgtttgcaaaggcgaaaggaataaccaagcgcaagaagaacaagcgcgagtgggatgagcaaactcaatcctggaagcggacttatggctatgaccgtgttaatgatgacaaagacattccaatcgttgaagccaaattgactgatgagcctggtgttgatccctttgcgcaaagaagggatgagaagaagaagagggttgaaaagcaagaaaaaaacagactagagaacttaaagaaagctgcaaagattggcgctttgccaagtcatatacagcttgctgcaaaggccttgcccatcacaggaactaaagctgaccttccaaaaaaatctagaaaagaggatcttgagagtgttgttggcatggcttcatcagcaacagcaagcggtgggaagtttgatgagaagttgcctggcgagaaacctccaaagcactctggcaaacacagaaagttcctcccagttgccgaagggaagggaatgggcagcctggagaaacagcagaatgacaaaatcctgaactctctacttgccagaaactctgatgaaccgcttgatgttggcaaggcaatcacaatgtacaaggtgaaaaaggaaaagcagagaaggaaagagaaagatatgtcatcgaaatctgataagcttaagccccagaagaaaccccacaagaagtcatcgaagaaaaaggcttag

SEQ ID NO: 1030 - protein, 330 aa, Sorghum bicolor
  misc_feature: Ceres ANNOT ID no. 6012737
  misc_feature (4)..(182): Pfam Id: RRS1 Pfam Desc: Ribosome biogenesis regulatory protein (RRS1)
  misc_feature (1)..(330): NCBI GI: 32488712 NCBI Desc: osjnba0088h09.13 [oryza sativa (japonica cultivar-group)]
  misc_feature (30)..(168): NCBI GI: 90399144 NCBI Desc: h0913c04.9 [oryza sativa (indica cultivar-group)]
  misc_feature (15)..(324): NCBI GI: 47940235 NCBI Desc: mgc78981 protein [xenopus laevis]
  misc_feature (15)..(275): NCBI GI: 41056045 NCBI Desc: ribosome biogenesis regulatory protein homolog [danio rerio]
  misc_feature (15)..(329): NCBI GI: 49022822 NCBI Desc: mkiaa0112 protein [mus musculus]
MAEVPAVVAAASSCEVDLGNLMAYDPSHHVVSAAAAASREELRQECLRKGTELAQAVADALFALPPSEDRDGPIVHLPPPTVRLPREKHLPKPKPPTKWELFAKAKGITKRKKNKREWDEQTQSWKRTYGYDRVNDDKDIPIVEAKLTDEPGVDPFAQRRDEKKKRVEKQEKNRLENLKKAAKIGALPSHIQLAAKALPITGTKADLPKKSRKEDLESVVGMASSATASGGKFDEKLPGEKPPKHSGKHRKFLPVAEGKGMGSLEKQQNDKILNSLLARNSDEPLDVGKAITMYKVKKEKQRRKEKDMSSKSDKLKPQKKPHKKSSKKKA

SEQ ID NO: 1031 - DNA, 1023 bp, Sorghum bicolor
  misc_feature: Ceres ANNOT ID no. 6012743
  misc_feature: Encodes the peptide sequence at SEQ ID NO 1032
atgaacccgacgcggcccgcgcaggcgtcgttccgtgaccgcaccaacgagttccgcgccgccgtcgagagcgcgcgccgccagtcgtcggcccccgcggcggcgagcagcagctctaccgggcccctcgatgggttgatggcggccacgtcggctcgctcggagttcaacaaccgcgcgtccaagatcgggctcgggatccaccagacctcccagaagctaagccgccttgccaaattggcaaagagaacatctgtttttgatgaccccacagtggagattcaagagttgactgcagttatcaagaaggatatcacggctttgaatactgctgttgtagacctacaagctatctgcaattcacaaaatgagagtggcagtctctccaaggacacaacaaatcattccactacaattgtggacaaccttaaaaatcgtttgatgagtgcaacaaaagaatttaaagaagttcttaccatgcgaacagagaatttgaaggttcatgaaaatagaaggcaaatgttctcatcatcagctgcaaacgatgcgtcaaatccattcatccgccaacgaccccttgttgctagggatccatcagagtcctctgtgcccccagcaccatgggccagcgactctgcatctaccccattattccagaggaaaaagactaatggagaccatggggcatcatcatcatcatctcagccttttgcacagcagcagcaattggctgtacagcaggacagttatatgcagagcagagctgaggctcttcaaaatgtggaatcaacaatccatgagctgagcaacatatttacacaattagcaaccatggtttctcaacagggagagctagcaatcagaattgacgataacatggatgacacactgactaacgtggagggagcacagggccagctcctgaagtacctcaacagcatttcatccaacaggtggctgatgatgaagatattctttgtgctgatggtgttcctcatgatcttcatattcttcgtcgcttga

SEQ ID NO: 1032 - protein, 340 aa, Sorghum bicolor
  misc_feature: Ceres ANNOT ID no. 6012743
  misc_feature (52)..(158): Pfam Id: Syntaxin Pfam Desc: Syntaxin
  misc_feature (253)..(315): Pfam Id: SNARE Pfam Desc: SNARE domain
  misc_feature (9)..(340): NCBI GI: 9759101 NCBI Desc: t-snare sed5 [arabidopsis thaliana]
  misc_feature (9)..(340): NCBI GI: 2981439 NCBI Desc: syntaxin of plants 31 [arabidopsis thaliana]
  misc_feature (238)..(340): NCBI GI: 89268101 NCBI Desc: syntaxin 5a [xenopus tropicalis]
  misc_feature (238)..(340): NCBI GI: 51513291 NCBI Desc: stx5a-prov protein [xenopus tropicalis]
  misc_feature (190)..(340): NCBI GI: 94400932 NCBI Desc: syntaxin 5 [homo sapiens]
MNPTRPAQASFRDRTNEFRAAVESARRQSSAPAAASSSSTGPLDGLMAATSARSEFNNRASKIGLGIHQTSQKLSRLAKLAKRTSVFDDPTVEIQELTAVIKKDITALNTAVVDLQAICNSQNESGSLSKDTTNHSTTIVDNLKNRLMSATKEFKEVLTMRTENLKVHENRRQMFSSSAANDASNPFIRQRPLVARDPSESSVPPAPWASDSASTPLFQRKKTNGDHGASSSSSQPFAQQQQLAVQQDSYMQSRAEALQNVESTIHELSNIFTQLATMVSQQGELAIRIDDNMDDTLTNVEGAQGQLLKYLNSISSNRWLMMKIFFVLMVFLMIFIFFVA

SEQ ID NO: 1033 - DNA, 1335 bp, Sorghum bicolor
  misc_feature: Ceres ANNOT ID no. 6012745
  misc_feature: Encodes the peptide sequence at SEQ ID NO 1034
atggcggcggccaagtccatcgaccggctgccggcgcgcctggtggttccggccgagccgacgccagccggcccgctccacctctcctggctcgaccggtaccccacgcagatggcgctcatcgagtcgctgcacgtcttcaaggcggcccccgccaccgctaccggcggcattgacggcggcgccgccgccagcccggccaggaccatcgagcgcgcgctggcccgcgcattggtccactactaccctctcgcgggccgcctggtcctgtcggagtccggcgcgcagcaggcggtggactgcagcaacgccggcgtgtggttcacggaggccgaggccgcctgcaccctcgaggacgtggactacctggaggccccgctgatgatccccaaggacgacctcctcccgcccacccccgccgcaggcgacgaggaggacgagcgcgcgctcgtcctgctcgtccaggtcacctccttcgcgtgcggcggattcgtcgtcggcttccgcttcagccacgccgtcgccgacggcccgggcgccgcgcagttcatgaacgcggtcggggagctggcacgcggcgccgaaaacgcgttgtcggtggtgccgcagtggggccgcgacgcgatcccggaccccgccgccgcgctggtcgggcgcctcccgactcccgacgccgacagcaagcggctcgagtacctcgccatcgacatctccgccgactacatcaaccacttcaaggcgcagtacagcgcggcgcacgcgggcgccgcgtggtgctccgcgttcgaggtgctcatcgccaaggcgtggcagagccgcacccgcgcggccgggttcgacccggactcccccgtccacctctgcttcgccatgaacgcgcggcccatgctgcacgcctcgctcccgcgtggcggcgccgggttctacggcaactgctactacatcatgcgcgtgtcggcgcccgcggggaaagtggccgggtcctcggtcacggaggtggtgaagatcatcaaggacgggaagcggcggatgcccgcggagttcgcgcggtgggcggcgggggaggtgggcgccgccggcgtcgacccgtaccagatcacgtccgactaccggaccctgctggtgtccgactggacgcgcctcggcttcgcggaggtggactacgggtggggcccgccggcccacgtcgtgccactgacgaacctggactacatcgccacgtgtatcttggtgaagccgtgggcccacaagccaggggcgcggctcatcacgcagtgcgtcaccccggaccgcgtcgccgccttccacgagggcatgctcgacaccagctgttga

SEQ ID NO: 1034 - protein, 444 aa, Sorghum bicolor
  misc_feature: Ceres ANNOT ID no. 6012745
  misc_feature (5)..(442): Pfam Id: Transferase Pfam Desc: Transferase family
  misc_feature (1)..(441): NCBI GI: 115434876 NCBI Desc: os01g0179000 [oryza sativa (japonica cultivar-group)]
  misc_feature (1)..(441): NCBI GI: 115462409 NCBI Desc: os05g0179300 [oryza sativa (japonica cultivar-group)]
  misc_feature (2)..(435): NCBI GI: 11034585 NCBI Desc: 10-deacetylbaccatin iii-10-o-acetyl transferase-like [oryza sativa (japonica cultivar-group)]
  misc_feature (6)..(439): NCBI GI: 96775754 NCBI Desc: acyltransferase [iris x hollandica]
  misc_feature (66)..(439): NCBI GI: 84570492 NCBI Desc: acyltransferase [iris hollandica]
MAAAKSIDRLPARLVVPAEPTPAGPLHLSWLDRYPTQMALIESLHVFKAAPATATGGIDGGAAASPARTIERALARALVHYYPLAGRLVLSESGAQQAVDCSNAGVWFTEAEAACTLEDVDYLEAPLMIPKDDLLPPTPAAGDEEDERALVLLVQVTSFACGGFVVGFRFSHAVADGPGAAQFMNAVGELARGAENALSVVPQWGRDAIPDPAAALVGRLPTPDADSKRLEYLAIDISADYINHFKAQYSAAHAGAAWCSAFEVLIAKAWQSRTRAAGFDPDSPVHLCFAMNARPMLHASLPRGGAGFYGNCYYIMRVSAPAGKVAGSSVTEVVKIIKDGKRRMPAEFARWAAGEVGAAGVDPYQITSDYRTLLVSDWTRLGFAEVDYGWGPPAHVVPLTNLDYIATCILVKPWAHKPGARLITQCVTPDRVAAFHEGMLDTSC

SEQ ID NO: 1035 - DNA, 1503 bp, Sorghum bicolor
  misc_feature: Ceres ANNOT ID no. 6012748
  misc_feature: Encodes the peptide sequence at SEQ ID NO 1036
atggcggcggcccagcatcgtcaggcgtggtggccggggcggatggcggcggcgttcgggccctccttcctctgcctcgtctgcctcatctacttcatccagggtttcaggtctttcgtctggacagctgtctcctaccaaatgaaggacgtgatgaagctatcaccctccacatcacagtttcttgtctcccttgcatatttcccttggagcattaaacctatatatgggatcttgtcagactgcattccaattaagcagaggaagcgtataccctatttgatcatttctagctgcctttctctacttccgtggcttatccttggactatcacaaagtttaaggagctcagccaatatgctaactgccttgctcgtagtacagaatctgggatctgcaatggcagatgttgttatagatgcaatggttgcggaagcagttcgatcagcagggccggagtttgctggtgatctacagtcattatcttggtcatcgatggctgtaggtgggattttcgggagcttgctgggaggatatgcattatccaatctcccaatacatgctatatatgttgttttctcagccctcccattcttgcaactagtttcctgtatgtttgttgaggattctccaaaaggattccacagtgccaatgatgaacacaagtatgcagacaatcagagttctgttactgccttttctgaaaaaggctctagtgaagcacttagatatgagggcactagaaggcggaagggaactcgtaaaaataataaaaggagatcactgtcaaagcgaactgagtctgatgagaaacacaatgggtcaattaattctctgccaagtttgtctctgagatcagccttcttcagtctgtgcacagcttttaagcagccaaacattctgcggcctatggcatggtttttcttttcaaatgtaacaattccaaatatctcaacagtcatgttctattatcaaacagaggacctaaatttggacgcatcctttctagggactgcacgtgtgattggatggttcagtctaatgcttggcacctacacctacaaccgctattttaagcagaagaagctcagaaatattcttgtgtttgctcatgtcggtcttgccgtaattaccctactggacattgttttggtgtcacggttacacgttcagtatggaattgccgataagtacatggtgctgtggggttctgctttgggtgatgcaatcaaccagttcaagatgatgccgttcctgatcctgtcaggacagctttgcccgcctggaatcgagggcacactgtttgctctcttcatgtcaatcaacaaccttggttcaacagtaggttcattcctggggtctgctctggcatcagctttgaacctcaccacaggacagtttgacaatcttgctctgggtttgggtgtacagatgatttgtactctgttaccgattgggttcctatctctgattccaaaggaagtcacaggactaacatcgtag

SEQ ID NO: 1036 - protein, 500 aa, Sorghum bicolor
  misc_feature: Ceres ANNOT ID no. 6012748
  misc_feature (34)..(501): Pfam Id: BT1 Pfam Desc: BT1 family
  misc_feature (27)..(450): Pfam Id: MFS_1 Pfam Desc: Major Facilitator Superfamily
  misc_feature (78)..(500): NCBI GI: 115435608 NCBI Desc: os01g0243200 [oryza sativa (japonica cultivar-group)]
  misc_feature (11)..(500): NCBI GI: 20147215 NCBI Desc: at5g54860/mbg8_12 [arabidopsis thaliana]
  misc_feature (264)..(498): NCBI GI: 115455887 NCBI Desc: os03g0795000 [oryza sativa (japonica cultivar-group)]
  misc_feature (261)..(492): NCBI GI: 30678917 NCBI Desc: integral membrane transporter family protein [arabidopsis thaliana]
  misc_feature (294)..(494): NCBI GI: 86608629 NCBI Desc: transporter, folate-biopterin transporter (fbt) family [cyanobacteria bacterium yellowstone b-prime]
MAAAQHRQAWWPGRMAAAFGPSFLCLVCLIYFIQGFRSFVWTAVSYQMKDVMKLSPSTSQFLVSLAYFPWSIKPIYGILSDCIPIKQRKRIPYLIISSCLSLLPWLILGLSQSLRSSANMLTALLVVQNLGSAMADVVIDAMVAEAVRSAGPEFAGDLQSLSWSSMAVGGIFGSLLGGYALSNLPIHAIYVVFSALPFLQLVSCMFVEDSPKGFHSANDEHKYADNQSSVTAFSEKGSSEALRYEGTRRRKGTRKNNKRRSLSKRTESDEKHNGSINSLPSLSLRSAFFSLCTAFKQPNILRPMAWFFFSNVTIPNISTVMFYYQTEDLNLDASFLGTARVIGWFSLMLGTYTYNRYFKQKKLRNILVFAHVGLAVITLLDIVLVSRLHVQYGIADKYMVLWGSALGDAINQFKMMPFLILSGQLCPPGIEGTLFALFMSINNLGSTVGSFLGSALASALNLTTGQFDNLALGLGVQMICTLLPIGFLSLIPKEVTGLTS

SEQ ID NO: 1037 - DNA, 534 bp, Sorghum bicolor
  misc_feature: Ceres ANNOT ID no. 6012755
  misc_feature: Encodes the peptide sequence at SEQ ID NO 1038
atgagggctgtggtgcagcgcgtcctctcggcgagtgtcgaggtcgatgggcgaatagtgtcggcgatcggccctggactcctcgtcctagtcggcgtccacgaagcagacaccgacgccgacgccgactacatttgtcggaaggtcctgaacatgaggctgtttccaaacgacaagactgaaaaagcatgggatcgaagtgttatgcagcgtaactttgaggtgctattagtcagtcagttcaccttatatggcatcctgaagggtaataagccagattttcatgtggctatgccacctgcaaaagcgaaaccattctatgcttctctagttgagaaatttcgagggtcatacttggctgattcagtgaaagatggtgtttttggagcgatgatgaaggtttctttggtgaatgatggccctgtaacaatgcaaatcgactcaccctcactacaaggtgctgctcagtcgagcaatggtgatgatgatttggttaaagatggtgaagcaagagtacctaaagaggcgtgttaa

SEQ ID NO: 1038 - protein, 177 aa, Sorghum bicolor
  misc_feature: Ceres ANNOT ID no. 6012755
  misc_feature (2)..(148): Pfam Id: Tyr_Deacylase Pfam Desc: D-Tyr-tRNA(Tyr) deacylase
  misc_feature (1)..(149): NCBI GI: 17473902 NCBI Desc: rna helicase - like protein [arabidopsis thaliana]
  misc_feature (1)..(164): NCBI GI: 108861836 NCBI Desc: d-tyrosyl-trna deacylase-like protein [schistosoma mansoni]
  misc_feature (1)..(157): NCBI GI: 29427996 NCBI Desc: probable d-tyrosyl-trna(tyr) deacylase
  misc_feature (1)..(149): NCBI GI: 51010963 NCBI Desc: zgc:92657 [danio rerio]
  misc_feature (1)..(157): NCBI GI: 18033272 NCBI Desc: histidyl-trna synthetase [homo sapiens]
MRAVVQRVLSASVEVDGRIVSAIGPGLLVLVGVHEADTDADADYICRKVLNMRLFPNDKTEKAWDRSVMQRNFEVLLVSQFTLYGILKGNKPDFHVAMPPAKAKPFYASLVEKFRGSYLADSVKDGVFGAMMKVSLVNDGPVTMQIDSPSLQGAAQSSNGDDDLVKDGEARVPKEAC

SEQ ID NO: 1039 - DNA, 663 bp, Sorghum bicolor
  misc_feature: Ceres ANNOT ID no. 6012764
  misc_feature: Encodes the peptide sequence at SEQ ID NO 1040
atgtcggtggagacggagcggagctccaccgagtcctccgcggcctccgggctcgacttcgaggacaccgcgctcacgctcaccctccgcctcccgggctccgcccccgcccccgctgccgtcgcggcctccttgtcctcgtcctcgtcctccgccttccccgacgccgaccgcaagcgcgcctcctccgacgccaaccccgaccgctcctccccgctcgccgcttcctccgacgctgcaccggcacccaaggcgcgggtggtggggtggccgccggtgaggtcgtaccgcaagaacgcgctcgccgacgtcgcgggatccagcaaggcaaaccaggccgccaagttcgtcaaggtggccgtcgacggcgcgccctacctgcggaaagtggacctccaggcgtacgccggctacgaccagctcctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgtttgtggaaacctgccagcgccttcgtctgatgaaaggttcagaggccgttaacttagcaccaagagccgcccgatga

SEQ ID NO: 1040 - protein, 220 aa, Sorghum bicolor
  misc_feature: Ceres ANNOT ID no. 6012764
  misc_feature (18)..(218): Pfam Id: AUX_IAA Pfam Desc: AUX/IAA family
  misc_feature (1)..(219): NCBI GI: 75254479 NCBI Desc: auxin-responsive protein iaa15 (indoleacetic acid-induced protein 15)
  misc_feature (47)..(220): NCBI GI: 75252053 NCBI Desc: auxin-responsive protein iaa1 (indoleacetic acid-induced protein 1)
  misc_feature (1)..(217): NCBI GI: 50404477 NCBI Desc: iaa type protein [elaeis guineensis]
  misc_feature (11)..(218): NCBI GI: 4887022 NCBI Desc: nt-iaa4.1 deduced protein [nicotiana tabacum]
  misc_feature (46)..(217): NCBI GI: 75254412 NCBI Desc: auxin-responsive protein iaa23 (indoleacetic acid-induced protein 23)
  misc_feature: The sequence is a functional homolog of SEQ ID NO 1149 in the 10/412,699US patent application
  misc_feature: The sequence is a functional homolog of SEQ ID NO 2002 in the 10/374,780US patent application
  misc_feature: The sequence is a functional homolog of SEQ ID NO 644 in the 11/479,226US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: Useful for making plants with modulated growth and phenotype characteristics
  misc_feature: The sequence is a functional homolog of SEQ ID NO 1149 in the 20040045049 US patent application
  misc_feature: The sequence is a functional homolog of SEQ ID NO 2002 in the 20060162006 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: Useful for making plants with altered terpenoid content
  misc_feature: Functional homolog of the protein sequence given in SEQ ID NO 13610
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: Useful for making plants with altered alkaloid content
  misc_feature: Functional homolog of the protein sequence given in SEQ ID NO 13611
  misc_feature: The sequence is a functional homolog of SEQ ID NO 648 in the 11/479,226 US patent application
  misc_feature: The sequence is a functional homolog of SEQ ID NO 739 in the 10/374,780 US patent application
  misc_feature: The sequence is a functional homolog of SEQ ID NO 636 in the 11/479,226 US patent application
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with modulated nitrogen use efficiency
  misc_feature: Functional homolog of the protein sequence given in SEQ ID NO 13612
  misc_feature: The sequence is a functional homolog of SEQ ID NO 652 in the 11/479,226 US patent application
  misc_feature: The sequence is a functional homolog of SEQ ID NO 890 in the 10/412,699 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 656 in the 11/479,226 US patent application
  misc_feature: The sequence is a functional homolog of SEQ ID NO 737 in the 10/374,780 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: The sequence is a functional homolog of SEQ ID NO 667 in the 11/479,226 US patent application
MSVETERSSTESSAASGLDFEDTALTLTLRLPGSAPAPAAVAASLSSSSSSAFPDADRKRASSDANPDRSSPLAASSDAAPAPKARVVGWPPVRSYRKNALADVAGSSKANQAAKFVKVAVDGAPYLRKVDLQAYAGYDQLLRALQDKFFSHFTIRKFADDERKLVDAVNGTEYVPTYEDKDGDWMLVGDVPWKMFVETCQRLRLMKGSEAVNLAPRAAR

SEQ ID NO: 1041 - DNA, 1182 bp, Sorghum bicolor
  misc_feature: Ceres ANNOT ID no. 6012770
  misc_feature: Encodes the peptide sequence at SEQ ID NO 1042
atggctgccgccgtccacctccgccctctccactcgtttgccctccctctgtccgcagcaaaggccgcgcccagctggttccccataccggtgaaacccggtgcgcggaggagggggcgcgtagccctgctcctctgctccgcgtctgcccacgcgccagcgtctccctcgccctcgggcggggacggcgccgcggcgtcggccgcggcaaagtgggtggagtggatcccgcgcgccgcggcaggcgccgggtcggtagcgggccccgagcaggtgctcaggctcatctcaggcgccgcggccacgcccatctgccagttcgtcgacagcccgcgcaccttccttcattccgtcgacccgcgcgtcaagctggtgtggctgttggcccttgttgtcctaccagccagatcaaatatttatatgcggtttggtttggtagtattcctggcccttctttcaatgtggattttaccaaaacatgtttggaaggatcaacttggaagggttgctctcctttcaggattcttattcatcatgctgggatttggtgctgatggtgcgccttcattagtccagacgagaacgcctccaccttctgttgtaggcataccgaacattccttgctccacaagtgggtattcttacacaatcttgaaactgggaccactgcaatttacaaggaaaggcctatctgtagcaagtacttcagcaagcctctcctttgcaatattccaaagtgcaagtctctgcttgacaacaaccactcccgagcagcttgcctctgctctgtggtggtttatgattccactgaagcatattggtgtgccagtacctgagataatacttacactactactgtcattgaggttcatcaatttagtatttgatgaggttcgcaactcagctctagcgattgtagcacgccggataaattggaaaaagctgacagctatggaaactatagatattttcttcaactatgtccggcggatattcaaaaatatatttgatcacgcagagcaaatatccaaggcaatggtagctcgaggatttcgtggcaatccaagcaatcacaagatctactttctttcagaatcatcatttggaattgcggatctcttttcattgctttgcttatttgctgtagtgagcttggcttccttttctgaccagttggtttga

SEQ ID NO: 1042 - protein, 393 aa, Sorghum bicolor
  misc_feature: Ceres ANNOT ID no. 6012770
  misc_feature (111)..(360): Pfam Id: CbiQ Pfam Desc: Cobalt transport protein
  misc_feature (103)..(360): NCBI GI: 145355825 NCBI Desc: abc(membrane) family transporter: cobalt ion [ostreococcus lucimarinus cce9901]
  misc_feature (103)..(351): NCBI GI: 119513021 NCBI Desc: cobalt transport protein [nodularia spumigena ccy9414]
  misc_feature (103)..(360): NCBI GI: 75909107 NCBI Desc: cobalt transport protein [anabaena variabilis atcc 29413]
  misc_feature (103)..(360): NCBI GI: 23126949 NCBI Desc: cog0619: abc-type cobalt transport system, permease component cbiq and related transporters [nostoc punctiforme pcc 73102]
  misc_feature (103)..(360): NCBI GI: 67922788 NCBI Desc: cobalt transport protein [crocosphaera watsonii wh 8501]
MAAAVHLRPLHSFALPLSAAKAAPSWFPIPVKPGARRRGRVALLLCSASAHAPASPSPSGGDGAAASAAAKWVEWIPRAAAGAGSVAGPEQVLRLISGAAATPICQFVDSPRTFLHSVDPRVKLVWLLALVVLPARSNIYMRFGLVVFLALLSMWILPKHVWKDQLGRVALLSGFLFIMLGFGADGAPSLVQTRTPPPSVVGIPNIPCSTSGYSYTILKLGPLQFTRKGLSVASTSASLSFAIFQSASLCLTTTTPEQLASALWWFMIPLKHIGVPVPEIILTLLLSLRFINLVFDEVRNSALAIVARRINWKKLTAMETIDIFFNYVRRIFKNIFDHAEQISKAMVARGFRGNPSNHKIYFLSESSFGIADLFSLLCLFAVVSLASFSDQLV

SEQ ID NO: 1043 - DNA, 2355 bp, Sorghum bicolor
  misc_feature: Ceres ANNOT ID no. 6012780
  misc_feature: Encodes the peptide sequence at SEQ ID NO 1044
atggatctcctgcgttctcatctccacaaggtccggatcccggagcccaccaaccgcatccacaaggacgagtgctgcgtctccttcgacaccccgaggtcagagggaggcctgtatgtggacatgagctcgttcctgggcttcgggagggagtacgtggagtggaacttcgagaagacggggaaccccgtgtacctccacatcgtgcagcgccggaagccggagcccgacgaggcggatcgcccgcttaagaagcccaccctcctcgctataggtgtggaaggaggttttggtgatcaagaaccagaatatgatgatacttttgaaattgtcatcttacctgattttgtctctcttccatttccatcagttgatttgccagagaaggttaggcttgcggttgataaagttttacttgctgaaagtgctgataggaaagaacaattggctgcttgggttgctgacaagaagaacattagtgcatatgctatggacctgcaacagctagacaatggtgttgttgtgcctcctactggatggaagtgtagcaaatgcgataaaactgagaacctctggatgaatttaactgatggtatgatcctttgtgggaggaagctttgggatgggagtggtgggaataatcatgccattgaacactatgaacagactaaataccctcttgcggtaaagcttgggacaattactgctgatctggaagcagcagatgttttctcataccctgaagatgatagcgttgaagatccactattagctcagcacttatcacatttcggtatcgatttttcttcacttcaaaagactgagatgactactgctgagagagaacttgatgccaacactaattatgactggaatagaatacaagaaagtggaaaagatgctgaacttttgtttggacctggctatacaggtcttgcgaatcttgagaatagttgctatatggcttctataatgcaagtcatgttttcaacccatcctttcatatcaagatactttgagaaacagagtttgaaagctgcatttgcaactgctccagctgatccaacagtagacctaaacatgcaaatgacaaaactaggacatggtttgctctctggtaaatattctgcaccagcaaaggaggggcaggaagggatacgtcctcgcatgtttaagtcagttattgccgcgaaccatcctgaattttctagcatgagacaacaggatgccctcgacttcttcctccaccttattgacagagttgagaaggcaaaccctgggaaccatgagctaaatccttgttccggtttcaagttcattgttgaagagagggtccagtgcccttctgggaaagtttcctacaacaaacggtctgactatattctttctttgagcataccactgcatgaggcaacaaataaagagcagctagaagcttttaatgagaagaaagctgcaatggacttggatggaaaagaagtgcctagagtcccattggaggcttgcttagcgagtttttcagggccagaggaaatcccggatttttatagcactgcattaaattcgaagactaccgccactaagactgctggtttcaacacctttcctgattaccttgtgttgcacatgcgcaagtttgtaatggaagcaggatgggtgccaaagaaactcgatgtgccagatacgattgatatcacacatatgcgcagcaaaggtgtacagcctggggaagagctactacctgaaggaggttctggtgacaacagtgctgagcctgctcaccctgttgccagtgaggatattgtgtcccaacttgcaagcatgggcttcaactaccttcattgtcagaaagctgctattaacacatcaaacacaggagttgaggaggcgatgaattggctcctctctcacatggatgatccagatataaatgacccaatatcaaaagattcacgtgcttctgagccgtctgttgatgaagcaagtgttcaaactctcatttcctttggatttcaggaagatgttgccataaaggccctgaaagcttctggcggtaatattgagaaagcaaccgactggattttcagccaccccgaagcatcgagctcagcatctgctgattcttccactagcaatgcaaatgctgatgacgcatacattccagatggaagtggcagatacaagctgatggcgtttgtgagccatatgggcacctctacccactgcgggcactacgtagctcatgtcctcaaagacgggaggtggacaatcttcaacgacagcaaggtcgcagcatcagttgacctgcccaaggaaatgggctacctctatttctttcagaggattagcaactag

SEQ ID NO: 1044 - protein, 784 aa, Sorghum bicolor
  misc_feature: Ceres ANNOT ID no. 6012780
  misc_feature (307)..(779): Pfam Id: UCH Pfam Desc: Ubiquitin carboxyl-terminal hydrolase
  misc_feature (182)..(259): Pfam Id: zf-UBP Pfam Desc: Zn-finger in ubiquitin-hydrolases and other protein
  misc_feature (597)..(634): Pfam Id: UBA Pfam Desc: UBA/TS-N domain
  misc_feature (658)..(694): Pfam Id: UBA Pfam Desc: UBA/TS-N domain
  misc_feature (1)..(782): NCBI GI: 11994150 NCBI Desc: ubiquitin isopeptidase t [arabidopsis thaliana]
  misc_feature (1)..(782): NCBI GI: 11993473 NCBI Desc: ubiquitin-specific protease 14 [arabidopsis thaliana]
  misc_feature (376)..(741): NCBI GI: 144923223 NCBI Desc: ubiquitin-associated; peptidase c19, ubiquitin carboxyl-terminal hydrolase 2; zinc finger, ubp-type [medicago truncatula]
  misc_feature (2)..(559): NCBI GI: 1585128 NCBI Desc: isopeptidase t
  misc_feature (2)..(559): NCBI GI: 4507855 NCBI Desc: ubiquitin isopeptidase t [homo sapiens]
  misc_feature (1)..(782): SWISSPROT Homolog: EC 3.1.2.15 Ubiquitin carboxyl-terminal hydrolase 14
MDLLRSHLHKVRIPEPTNRIHKDECCVSFDTPRSEGGLYVDMSSFLGFGREYVEWNFEKTGNPVYLHIVQRRKPEPDEADRPLKKPTLLAIGVEGGFGDQEPEYDDTFEIVILPDFVSLPFPSVDLPEKVRLAVDKVLLAESADRKEQLAAWVADKKNISAYAMDLQQLDNGVVVPPTGWKCSKCDKTENLWMNLTDGMILCGRKLWDGSGGNNHAIEHYEQTKYPLAVKLGTITADLEAADVFSYPEDDSVEDPLLAQHLSHFGIDFSSLQKTEMTTAERELDANTNYDWNRIQESGKDAELLFGPGYTGLANLENSCYMASIMQVMFSTHPFISRYFEKQSLKAAFATAPADPTVDLNMQMTKLGHGLLSGKYSAPAKEGQEGIRPRMFKSVIAANHPEFSSMRQQDALDFFLHLIDRVEKANPGNHELNPCSGFKFIVEERVQCPSGKVSYNKRSDYILSLSIPLHEATNKEQLEAFNEKKAAMDLDGKEVPRVPLEACLASFSGPEEIPDFYSTALNSKTTATKTAGFNTFPDYLVLHMRKFVMEAGWVPKKLDVPDTIDITHMRSKGVQPGEELLPEGGSGDNSAEPAHPVASEDIVSQLASMGFNYLHCQKAAINTSNTGVEEAMNWLLSHMDDPDINDPISKDSRASEPSVDEASVQTLISFGFQEDVAIKALKASGGNIEKATDWIFSHPEASSSASADSSTSNANADDAYIPDGSGRYKLMAFVSHMGTSTHCGHYVAHVLKDGRWTIFNDSKVAASVDLPKEMGYLYFFQRISN

SEQ ID NO: 1045 - DNA, 2013 bp, Sorghum bicolor
  misc_feature: Ceres ANNOT ID no. 6012805
  misc_feature: Encodes the peptide sequence at SEQ ID NO 1046
atggatctgctaaggcatcccttcaagggagttgtcactgatatcaaaggaagggccacttggtacaagcatgattgggttgcaggagtccactctggctttaggatattggcacctaccatgtatatcttctttgcctctgctcttcctgtcattgccttcggagcacaactgagcacagcaacaaatggtatactcacaacagttgaaacattggcatcgactgcgatatgtggcatcatacattcaattcttggagggcagcctttactgattgttggagttgctgaaccaactattatcatgtacacttatctctacaactttgccaagaatcaacaagctctgggtgagaagctatatttggcgtgggctggatgggtctgcatctggactgccatcatgttgtttcttttggcaatgttcaatgcttccaacgttattagcagatttacaagggttgcaggagaactttttggcatgttaatcactgttctgttcttgcaagaagctatcaagggaatgattagcgaatttagtgtgcccgaagatgctgacagcagttcaccaatataccaattccagtggctgtatgtcaatggcctacttggtgtcatattttcaattggcttgctgtatactgcattgaggaccaggcgggcaaggtcatggctatatgggcggcttagaagctttatagctgattacggcgtcccacttatggtgattgtgtggacagcattgtcgtatacactgccaggcaagctgccttcaggagtccccaggaggcttttctctccacttccctgggagtcaagttcacagggacactggaccatagcaagggatttgttttccgtccctccagcgtatatacttgcagccattctgcctgctttgatggttgcaggactttacttctttgatcatagcgtagcttcacagttggcacagcaaaaggagtataatttgaagaagccttctgcctaccactatgacattttggtccttggaatcatggtcctgctgtgcggtttgcttggcatccctccatctaatggagtccttcctcagtctcccatgcacacaaaaagtcttgctgtccttaagaggcagttgctaagcaaaaagatggttgatactgccaaggatagcatagggagaagtgctaccactttggaaatatatggcaagatggaagaaattttcatcgaaatggatagcgaacagaatactggttctgttgacaaggagttgaagaactttaaggatgctgttctgcaagaaggcaatgaagaagggaaattggctagagaatttgaccctcggaaacatatagaagcccacttgccggttcgagtgaatgaacagagattgagtaatctgctgcaatccatattggttggtggttgtgttggagctatgccagttatcaggatgataccaacatcggttctctggggttactttgcctacatggccattgacagtctaccagggaatcagttctgggagaggatacagcttttgttcgttgcagaaagccgactctacaaggttcttgaaggtccccatgcatcttttgtggagtcagtggttcccaaaacaataaccatcttcacgatctttcagttggtttacctcctaatatgctttggaataacatggataccgatagccgggatcctgttcccagtgcctttctttctaatgattctcatcaggcagtatctcctccccaaattttttgatcccatcgtcttgagggaactcgatgcagctgagtatgaagaacttgatgggatcgcccttgaacacaatctggaagatgaagtatctgaggtagcaagctgtcctagccgtcctgatgcagagatattggatgaactcacaaccaatcggggagaggtaaaacacagaacttcaagcctgcgtgaagaaagaccaattcaggtaacaatgagcacacatatggcactgcagttagttttcaaaggattagatgtgatgtag

SEQ ID NO: 1046 - protein, 670 aa, Sorghum bicolor
  misc_feature: Ceres ANNOT ID no. 6012805
  misc_feature (2)..(543): Pfam Id: HCO3_cotransp Pfam Desc: HCO3- transporter family
  misc_feature (1)..(652): NCBI GI: 89892352 NCBI Desc: boron transporter [oryza sativa (japonica cultivar-group)]
  misc_feature (1)..(648): NCBI GI: 115434832 NCBI Desc: os01g0175600 [oryza sativa (japonica cultivar-group)]
  misc_feature (1)..(652): NCBI GI: 55295941 NCBI Desc: band 3 anion transport protein -like [oryza sativa (japonica cultivar-group)]
  misc_feature (41)..(652): NCBI GI: 115434834 NCBI Desc: os01g0175700 [oryza sativa (japonica cultivar-group)]
  misc_feature (4)..(662): NCBI GI: 89892354 NCBI Desc: boron transporter [oryza sativa (japonica cultivar-group)]
MDLLRHPFKGVVTDIKGRATWYKHDWVAGVHSGFRILAPTMYIFFASALPVIAFGAQLSTATNGILTTVETLASTAICGIIHSILGGQPLLIVGVAEPTIIMYTYLYNFAKNQQALGEKLYLAWAGWVCIWTAIMLFLLAMFNASNVISRFTRVAGELFGMLITVLFLQEAIKGMISEFSVPEDADSSSPIYQFQWLYVNGLLGVIFSIGLLYTALRTRRARSWLYGRLRSFIADYGVPLMVIVWTALSYTLPGKLPSGVPRRLFSPLPWESSSQGHWTIARDLFSVPPAYILAAILPALMVAGLYFFDHSVASQLAQQKEYNLKKPSAYHYDILVLGIMVLLCGLLGIPPSNGVLPQSPMHTKSLAVLKRQLLSKKMVDTAKDSIGRSATTLEIYGKMEEIFIEMDSEQNTGSVDKELKNFKDAVLQEGNEEGKLAREFDPRKHIEAHLPVRVNEQRLSNLLQSILVGGCVGAMPVIRMIPTSVLWGYFAYMAIDSLPGNQFWERIQLLFVAESRLYKVLEGPHASFVESVVPKTITIFTIFQLVYLLICFGITWIPIAGILFPVPFFLMILIRQYLLPKFFDPIVLRELDAAEYEELDGIALEHNLEDEVSEVASCPSRPDAEILDELTTNRGEVKHRTSSLREERPIQVTMSTHMALQLVFKGLDVM

SEQ ID NO: 1047 - DNA, 555 bp, Sorghum bicolor
  misc_feature: Ceres ANNOT ID no. 6012821
  misc_feature: Encodes the peptide sequence at SEQ ID NO 1048
atggcgagattactctccaccgccctcgcgaagggacttatgagatcgtcccgcgcatggacaccagctgtgtcacgaccagctatccagcagtttatgaactactcatcaggtcttggcggtgctcctaatacaaatggggactcaatggcaacacgagtagctgctgatcacgatacacatcaagattttcagccaacaagtaaaagttcagacatgtctttcagtgacattgttgctcaggatgtcaaggagcaccctgtcgtcatctatatgaagggttatcctgatgctcctaggtgtggattcagtgcattagcagtgaaggtcctccagcaatatggtgtccccatcagtgctagagatattctttcagatctcaagctcaaagaaagtgttaaagcatacagtaactggcctacgtttccacaaatatttatcaaaggagagtttgttgggggctctgatatcatactcaccatgcaccagaagggtgaactgaaggaactgcttggtgatattgcacaaaaaggcgaacaaagtggttcgtcatga

SEQ ID NO: 1048 - protein, 184 aa, Sorghum bicolor
  misc_feature: Ceres ANNOT ID no. 6012821
  misc_feature (88)..(152): Pfam Id: Glutaredoxin Pfam Desc: Glutaredoxin
  misc_feature (1)..(184): NCBI GI: 115437210 NCBI Desc: os01g0530400 [oryza sativa (japonica cultivar-group)]
  misc_feature (1)..(184): NCBI GI: 122064226 NCBI Desc: monothiol glutaredoxin-s4 precursor
  misc_feature (1)..(184): NCBI GI: 55296797 NCBI Desc: glutaredoxin-related protein -like [oryza sativa (japonica cultivar-group)]
  misc_feature (1)..(184): NCBI GI: 115434818 NCBI Desc: os01g0174900 [oryza sativa (japonica cultivar-group)]
  misc_feature (1)..(184): NCBI GI: 122064224 NCBI Desc: montothiol glutaredoxin-s1, mitochondrial precursor
MARLLSTALAKGLMRSSRAWTPAVSRPAIQQFMNYSSGLGGAPNTNGDSMATRVAADHDTHQDFQPTSKSSDMSFSDIVAQDVKEHPVVIYMKGYPDAPRCGFSALAVKVLQQYGVPISARDILSDLKLKESVKAYSNWPTFPQIFIKGEFVGGSDIILTMHQKGELKELLGDIAQKGEQSGSS

SEQ ID NO: 1049 - DNA, 4521 bp, Sorghum bicolor
  misc_feature: Ceres ANNOT ID no. 6012834
  misc_feature: Encodes the peptide sequence at SEQ ID NO 1050
atgcccgtgtccactgccgcgacgccttacgcggcgcccgcgatggcggcgacgccggcgggcgaaggccccctcttctacttcttcttccccttggagccgctcgtcctccacggcgtggacgctgcggtccacgtcctcctcgcgcttgccgtcgcggggcggtttctgttccgccactgcggcctctccgtcgccaaggacggggaggaggcgcgtggaggcggcccccgcggtggaggccggttccggtgccacggtgtcgcggcctgtgccacgtgggccctggcggcggccgaggtcctgctcgcggcctactcgtgctacctgggcgccacctccggctccgggttgtcgcgtgacgcggtggtgggtctcgtggacgcggccgcgcgcgcggtggcgtggctgctgctcgccgcgtacctgcagttcgacttcgggcggcggcgcgaggagcggttcccggcgtcgctcaggctctggtgggcgttcttcctcctgctctccctcgtgaccgtggctgaccacgtggcgacgagcctcgatgggttcctggtgcccgcgctctcgtgggtgttcgacgccgtctcggttgctgctgccgtggtcctgctctgcgctgggttcgtaggcaggagggagggaggcggctctgctgccgaggagcctctgctcaacggtgctcatgagacggcggacggtaacggccgcagcgatgccgaggcgtccaagttcaccggcgctggcttcttcagcgtgctcaccttctcgtggatggggcctcttctcgccgtcggccacaagaagaccctcggcctggacgacgtccctgagctcgaccccggggacagtgtctccagcttgctcccgacgttcaaggccaacctcgaggcgctggccggcggcgtctccggctccggccggaaggccgtcacggcgttgaagctcactaaggccctgttgcgcaccgtgtggtggcacgtcgcggtgaccgcgttctacgcgctggtctacaacgtctccacctacgtcggcccgtacctcatcgactccctggtgcagtacctcaacggcgacgagaggtacgcgagcaaggggcagctccttgtcctcgcgttcattgtcgccaaggtattcgagtgcctgtcgcagcgccactggttcttccggctgcagcaggcggggatacgcgcgcgttccacgcttgttgccgtcgtgtaccagaagggcctcgcgctgtcaagtcagtccaggcagagccgcacgagcggcgagatgatcaacatcatcagcgtcgacgccgaccgcgtcgggatcttctcatggtacatgcacgacctctggctggtaccgttgcaagtcggcatggcgctgttcattctgtactccaccctcgggctcgcttccctcgccgcacttggcgccaccgtggtcgtcatgcttgccaatgtgcctcctgggcaaatgcaggagaagttccagcagaagctcatggactgcaaggatgtcaggatgaaggcaacgtccgagatcctgcgcaacatgcggattctgaagctgcaggggtgggagatgaagttcttgtccaagatcattgagctgaggaagacagagacaaattggctgaagaaatacctctacacaacgactttggttacctttgtgttctggggggccccgactttcgttgctgtggtgacctttggggcgtgcatgctcatggggattccattggagtcagggaaagtgctttctgctttggccacgttccgcgtgctgcaggagccaatatacaaccttcctgacacgatttcgatggtgatccagaccaaggtgtctcttgacaggatagcatccttcctatgtcttgaggaattgccgactgattctgtacagaggctgccaaatggtagttcagatgttgcaattgaggtcaccaacgggtgcttctcctgggatgcctcaccggaattgccaacgctgaaggacctgaacttccaagctcagcgaggcatgcgtgttgcagtttgtgggacagtgggctctggtaaatcgagcttgctatcttgcattcttggtgagatcccaaagttatcaggagaggttaagatttgcgggatgacggcttatgtcagccagtcagcatggatacagagtggcaaaattcaggagaacatattgtttggcaaggagatggacaaggacaaatatgaaagagtccttgagtcgtgttcactgaagaaagacttagagatattgccattcggtgaccaaactgtcattggagagcgagggatcaacctgagtggtggacagaaacaaaggattcagatagcccgtgctttgtatcaggaagcagacatctatttgttcgatgacccattcagtgctgttgatgctcatacaggatcccaccttttcaaggaatgcttgctcggggctttgtcttcaaaaacagtagtttatgttactcatcagattgaattcctaccagcagctgaccttattttggtgatgaaagatggcaaaatagcacaagcaggaaaatacaatgaaatacttggttcaggagaagagttcatggagctagttggtgcacacagggatgcactcgcagaattggacacaatcgatgctgcaaacagaagcagcgagggatccccttccagtggcacagcaaaattgatcagatctctatcatcagctgagaagaaagataaacaggacgaagggaacaatcagagtggacagctggtgcaggaagaagaaagagagaaaggcagggttgggttttgggtctactggaagtatctcaccttagcttataagggtgcacttgtaccgttagtgttgcttgcacagctacttttccaagtcctacaaattgggagcaattactggatggcttgggctgctcccgtttcaaaggacgttgagcctccagtgagcatgtcaacactgatatatgtctatattgcattggctgttggaagctcgttctgcgtcctcctaagagcgttgtttcttgtaacagcctcatacaagacagcgactctattattcgacaagatgcacatgtccatatttagagctcctatgtctttctttgattccactccgagtgggcgcatcttgaacagagcttccactgatcaaagcgaagtggacaccaacattgcaccccagatgggctctgttgcatttgctgtcatacaacttgttggaatcattgcagtgatgtctcaggttgcatggcaggtgtttgttgttttcattcctgtagttgctacctgtttctggtatcagcgatactacattgatacagccagggagctgcaaaggctagtaggtgtttgcaaagctccaatcatacagcattttgcagaatcaataacaggatcaactaccatcagaagttttggcaaggaaaatcagtttgtatcagcaaatagccatctaatggatgcctactccagaccgaagttctacaatgctggagcgatggaatggctttgctttcgcctggatgtgctgtcatctcttacatttgcattctctttgatattcttgatcaatctgcccccgggtttcatcgatccagtcacatatgggcttaacctgaacatgctgcaagcatgggttgtctggagcatgtgcaatttggagaacaagattatatcagtagagagaatcctgcaatatataagcattcctgcagagccccctctttccatgtcagaagataagctagctctggctcataactggccatccgaaggagaaattcaactccacgatctccatgtgaaatacgccccgcagctgccatttgttctgaagggacttacagtcaccttccctggaggcctgaagactggtattgttggaagaacaggaagcggaaaatcaacccttatacaggctcttttccgtatcgtggacccaactattggccaaatactaatagatggcgtcgacatttgcaccattggtctgcacgatctgaggtctagactgagcatcattccacaagagccaaccatgttcgagggtaccgtaagaagtaaccttgaccctcttggggagtacacagacagtcaaatctgggaggccttggattgctgccagttaggtgacgaggtcaggaggaaggagcacaagcttgactcaccagtgatagagaacggcgagaactggagcgtgggtcagcgtcagcttgtatgcctaggtagggtaatcctgaagcggagcaagatcctcgtcctggacgaagccaccgcttcagtagacaccgcgacagacaacctgatccagaagactcttcggcagcaattctcggaggcgacggtcatcacaatcgcccacaggatcacgtcggtcctcgacagcgacatggtcctcctccttgacaacggtgtggccgtggagcgcgacacgccggccaagctgctggaggacaagtcgtcgctcttctccaagctcgtcgcggaatacacgatgaggtcgacgcacacgtag

SEQ ID NO: 1050 - protein, 1506 aa, Sorghum bicolor
  misc_feature: Ceres ANNOT ID no. 6012834
  misc_feature (672)..(843): Pfam Id: ABC_tran Pfam Desc: ABC transporter
  misc_feature (1290)..(1473): Pfam Id: ABC_tran Pfam Desc: ABC transporter
  misc_feature (326)..(598): Pfam Id: ABC_membrane Pfam Desc: ABC transporter transmembrane region
  misc_feature (945)..(1219): Pfam Id: ABC_membrane Pfam Desc: ABC transporter transmembrane region
  misc_feature (1)..(1506): NCBI GI: 115434802 NCBI Desc: os01g0173900 [oryza sativa (japonica cultivar-group)]
  misc_feature (81)..(1506): NCBI GI: 33329359 NCBI Desc: multidrug resistance associated protein mrp2 [triticum aestivum]
  misc_feature (24)..(1504): NCBI GI: 10172595 NCBI Desc: multidrug resistance-associated protein (mrp); abc-transoprter [arabidopsis thaliana]
  misc_feature (30)..(1504): NCBI GI: 42733544 NCBI Desc: multidrug resistance-associated protein [thlaspi caerulescens]
  misc_feature (24)..(1504): NCBI GI: 2316016 NCBI Desc: mrp-like abc transporter [arabidopsis thaliana]
  misc_feature (24)..(1504): SWISSPROT Homolog: EC 3.6.3.44 Multidrug resistance-associated protein 3
MPVSTAATPYAAPAMAATPAGEGPLFYFFFPLEPLVLHGVDAAVHVLLALAVAGRFLFRHCGLSVAKDGEEARGGGPRGGGRFRCHGVAACATWALAAAEVLLAAYSCYLGATSGSGLSRDAVVGLVDAAARAVAWLLLAAYLQFDFGRRREERFPASLRLWWAFFLLLSLVTVADHVATSLDGFLVPALSWVFDAVSVAAAVVLLCAGFVGRREGGGSAAEEPLLNGAHETADGNGRSDAEASKFTGAGFFSVLTFSWMGPLLAVGHKKTLGLDDVPELDPGDSVSSLLPTFKANLEALAGGVSGSGRKAVTALKLTKALLRTVWWHVAVTAFYALVYNVSTYVGPYLIDSLVQYLNGDERYASKGQLLVLAFIVAKVFECLSQRHWFFRLQQAGIRARSTLVAVVYQKGLALSSQSRQSRTSGEMINIISVDADRVGIFSWYMHDLWLVPLQVGMALFILYSTLGLASLAALGATVVVMLANVPPGQMQEKFQQKLMDCKDVRMKATSEILRNMRILKLQGWEMKFLSKIIELRKTETNWLKKYLYTTTLVTFVFWGAPTFVAVVTFGACMLMGIPLESGKVLSALATFRVLQEPIYNLPDTISMVIQTKVSLDRIASFLCLEELPTDSVQRLPNGSSDVAIEVTNGCFSWDASPELPTLKDLNFQAQRGMRVAVCGTVGSGKSSLLSCILGEIPKLSGEVKICGMTAYVSQSAWIQSGKIQENILFGKEMDKDKYERVLESCSLKKDLEILPFGDQTVIGERGINLSGGQKQRIQIARALYQEADIYLFDDPFSAVDAHTGSHLFKECLLGALSSKTVVYVTHQIEFLPAADLILVMKDGKIAQAGKYNEILGSGEEFMELVGAHRDALAELDTIDAANRSSEGSPSSGTAKLIRSLSSAEKKDKQDEGNNQSGQLVQEEEREKGRVGFWVYWKYLTLAYKGALVPLVLLAQLLFQVLQIGSNYWMAWAAPVSKDVEPPVSMSTLIYVYIALAVGSSFCVLLRALFLVTASYKTATLLFDKMHMSIFRAPMSFFDSTPSGRILNRASTDQSEVDTNIAPQMGSVAFAVIQLVGIIAVMSQVAWQVFVVFIPVVATCFWYQRYYIDTARELQRLVGVCKAPIIQHFAESITGSTTIRSFGKENQFVSANSHLMDAYSRPKFYNAGAMEWLCFRLDVLSSLTFAFSLIFLINLPPGFIDPVTYGLNLNMLQAWVVWSMCNLENKIISVERILQYISIPAEPPLSMSEDKLALAHNWPSEGEIQLHDLHVKYAPQLPFVLKGLTVTFPGGLKTGIVGRTGSGKSTLIQALFRIVDPTIGQILIDGVDICTIGLHDLRSRLSIIPQEPTMFEGTVRSNLDPLGEYTDSQIWEALDCCQLGDEVRRKEHKLDSPVIENGENWSVGQRQLVCLGRVILKRSKILVLDEATASVDTATDNLIQKTLRQQFSEATVITIAHRITSVLDSDMVLLLDNGVAVERDTPAKLLEDKSSLFSKLVAEYTMRSTHT

SEQ ID NO: 1051 - DNA, 3219 bp, Sorghum bicolor
  misc_feature: Ceres ANNOT ID no. 6012836
  misc_feature: Encodes the peptide sequence at SEQ ID NO 1052
  misc_feature: Up-regulated in shoot tissues in response to methyl jasmonate treatment
atggaggcgaaccgggggatggtggctggctcccgcggcggggtcgtcactatccggcacgatggcgacggcgccgcggctaagcagttgaagaatgtgaatgaacaaatatgtcaaatctgcggtgacactgtcgggctctcagcaacaggcgatgtctttgttgcatgcaacgaatgtgccttcccggtgtgtcgtccgtgctatgagtatgagcgtaaggaggggaatcagtgctgccctcaatgcaagactagatacaagaggcacaaaggaagccctcgggttcgtggagatgaggaggaggatggagttgatgatttggacaacgaattcaactatacacaaggcaatgtccaaggtcctcagtggcagctgcagggacatagggaagatgttgatctctcttcatcttctcgacatgaaccccatcacagaattccacgtctgacaactgggcagcagatgtccggagatatccctgatgcatctcctgaccggcattctattcgcagcccaacaccaagttatgttgatccaagcattccagtacctgtgaggattgtggacccctcaaaggatttgaattcttatggagttggaagtgttgactggaaagaaagagtcgagagctggaaagttagacaggacaaaaatatgatacaggtgactcataaatatccagcagaagggaaaggggatattgaagggactggctcaaatggtgaagatctggctgacgatgcacggctacctctaagtcgcatagtgcctatatctccaaacgagcttaacctttatcgaatcgtgattgttctccggcttatcatcctatgtttcttctttcagtatcgtataactcatccagtgactgatgcttatggattgtggcttgtatctgttatttgtgaagtttggtttgccttgtcttggcttctagatcagttcccaaagtggtatcctatcaaccgggaaacttacctcgatagacttgcattgagatatgatagggagggtgagccatctcagttggctccaattgatgtctttgtcagtacagtggatccactcaaggagccacctctaattactgccaacactgtcctgtccattcttgctgtggattaccccgttgacaaagtatcatgctatgtttctgatgacggttcagctatgttgacttttgaagcgctatctgaaactgcagagtttgcaaggaaatgggttcccttttgcaagaaacacaacattgaacctagggctccagagttttactttgctcaaaagatagattacctaaaggacaaaatacaaccttcttttgtgaaagaaaggcgagctatgaagagggagtatgaagagttcaaagtacggatcaatgcccttgtagcaaaagcgcaaaaaatacctgaggagggctggaccatggctgatggcactccttggcctgggaataacccaagagatcatccaggaatgatccaggtattcttgggccatagtggtgggcttgacactgatggaaatgagttgccacggcttgtttatgtttctcgtgaaaagaggccaggcttccagcaccacaagaaggctggtgccatgaatgctttgatacgcgtatcagctgtcctgacaaatggtgcttatcttcttaatgtggattgtgatcactacttcaacagcagcaaagctcttagagaggctatgtgttttatgatggatccagcactaggaaggaaaacttgctacgttcagtttccacaaagatttgatggcatagactcacatgatcgttatgcaaaccggaacattgtcttctttgatattaatatgaagggtttagatggcattcaaggacctgtttatgtgggaacaggatgctgtttcaataggcaggccttgtatggttatgatcctgtattgacagaagctgatttggagcctaacattatcattaaaagttgctgtggcggcagaaaaaggaaggacaagagctatattgattccaaaaaccgtgatatgaagagaacagaatcttcggctcccatcttcaacatggaagatatagaagagggatttgaaggttacgaggatgaaaggtcactgctcatgtcccagaagagcttggagaaacgctttggccagtccccaatttttattgcatccacctttatgactcaaggtggcatacccccttcaacaaacccagcttccctgctaaaggaagctatacatgtcattagttgtggatatgaggacaagacagaatgggggaaagagatcggatggatatatggatctgttactgaagatattttaactggtttcaagatgcatgcaaggggttggatatccatctactgcatgccacttcggccttgcttcaagggttctgctccaattaacctttctgatcgtctcaaccaagtgctacgctgggctcttggttcagttgaaattctacttagcagacactgtcctatctggtatggttacaatggaaggctaaagcttctggagagactggcatacatcaacaccattgtttatccaattacatctatcccactaatagcctactgtgtccttcctgctatctgtttactcaccaacaaatttattattcctgagattagcaattatgctggggcattcttcatcctgctttttgcttccatcttcgccactggtattttggagcttcgatggagtggtgttggcattgaggactggtggagaaatgaacagttttgggtcattggtggtacctctgcgcatctctttgctgtgttccaaggtctcttaaaagtgctggcagggatcgacacaaacttcacggtcacatcaaaggcaaccgatgatgatggtgattttgctgagctatatgtgttcaagtggacaagtcttctgattcccccgaccactgtgcttgtgataaacctggttggtatagtggctggagtatcatatgctatcaacagtggctaccaatcatggggtccactcttcggaaagctgttctttgcaatctgggtgatcctccacctctaccctttcctgaagggtctcatggggaaacagaaccgtacaccgaccatcgtcatcgtttggtccatcctccttgcttccatattctcgctgctgtgggtgaagatcgatcccttcatatcacctactcagaaagctatttcccgggggcagtgcggtgtaaactgctga

SEQ ID NO: 1052 - protein, 1072 aa, Sorghum bicolor
  misc_feature: Ceres ANNOT ID no. 6012836
  misc_feature (252)..(1067): Pfam Id: Cellulose_synt Pfam Desc: Cellulose synthase
  misc_feature (1)..(1072): NCBI GI: 66269682 NCBI Desc: cellulose synthase bocesa2 [bambusa oldhamii]
  misc_feature (1)..(1072): NCBI GI: 66269696 NCBI Desc: cellulose synthase bocesa3b [bambusa oldhamii]
  misc_feature (1)..(1072): NCBI GI: 66269678 NCBI Desc: cellulose synthase bocesa1a [bambusa oldhamii]
  misc_feature (1)..(1072): NCBI GI: 66269680 NCBI Desc: cellulose synthase bocesa1b [bambusa oldhamii]
  misc_feature (1)..(1072): NCBI GI: 66269684 NCBI Desc: cellulose synthase bocesa3a [bambusa oldhamii]
  misc_feature (1)..(1070): SWISSPROT Homolog: EC 2.4.1.12 Cellulose synthase A catalytic subunit 1 [UDP-forming]
  misc_feature: Useful for making plants with altered cell wall content and/or composition
  misc_feature: GREAT-hit functional homolog of the protein sequence encoded by LOCUS at2g25540
  misc_feature: GREAT-hit functional homolog of the protein sequence encoded by LOCUS at4g32410
  misc_feature: Useful for making plants with altered cell wall content and/or composition
  misc_feature: Useful for making plants with modulated biomass
  misc_feature: Functional homolog of the protein sequence given in SEQ ID NO 13627
  misc_feature: The sequence is a functional homolog of SEQ ID NO 26 in US patent 7312377
  misc_feature: The sequence is a functional homolog of SEQ ID NO 6 in US patent 7285702
  misc_feature: Useful for making plants with altered carbohydrate content
  misc_feature: Functional homolog of the protein sequence given in SEQ ID NO 13628
  misc_feature: The sequence is a functional homolog of SEQ ID NO 2 in US patent 7049481
  misc_feature: Useful for making plants with modulated plant growth and development
  misc_feature: Functional homolog of the protein sequence given in SEQ ID NO 13629
  misc_feature: Up-regulated in shoot tissues in response to methyl jasmonate treatment
MEANRGMVAGSRGGVVTIRHDGDGAAAKQLKNVNEQICQICGDTVGLSATGDVFVACNECAFPVCRPCYEYERKEGNQCCPQCKTRYKRHKGSPRVRGDEEEDGVDDLDNEFNYTQGNVQGPQWQLQGHREDVDLSSSSRHEPHHRIPRLTTGQQMSGDIPDASPDRHSIRSPTPSYVDPSIPVPVRIVDPSKDLNSYGVGSVDWKERVESWKVRQDKNMIQVTHKYPAEGKGDIEGTGSNGEDLADDARLPLSRIVPISPNELNLYRIVIVLRLIILCFFFQYRITHPVTDAYGLWLVSVICEVWFALSWLLDQFPKWYPINRETYLDRLALRYDREGEPSQLAPIDVFVSTVDPLKEPPLITANTVLSILAVDYPVDKVSCYVSDDGSAMLTFEALSETAEFARKWVPFCKKHNIEPRAPEFYFAQKIDYLKDKIQPSFVKERRAMKREYEEFKVRINALVAKAQKIPEEGWTMADGTPWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDSHDRYANRNIVFFDINMKGLDGIQGPVYVGTGCCFNRQALYGYDPVLTEADLEPNIIIKSCCGGRKRKDKSYIDSKNRDMKRTESSAPIFNMEDIEEGFEGYEDERSLLMSQKSLEKRFGQSPIFIASTFMTQGGIPPSTNPASLLKEAIHVISCGYEDKTEWGKEIGWIYGSVTEDILTGFKMHARGWISIYCMPLRPCFKGSAPINLSDRLNQVLRWALGSVEILLSRHCPIWYGYNGRLKLLERLAYINTIVYPITSIPLIAYCVLPAICLLTNKFIIPEISNYAGAFFILLFASIFATGILELRWSGVGIEDWWRNEQFWVIGGTSAHLFAVFQGLLKVLAGIDTNFTVTSKATDDDGDFAELYVFKWTSLLIPPTTVLVINLVGIVAGVSYAINSGYQSWGPLFGKLFFAIWVILHLYPFLKGLMGKQNRTPTIVIVWSILLASIFSLLWVKIDPFISPTQKAISRGQCGVNC

SEQ ID NO: 1053 - DNA, 996 bp, Sorghum bicolor
  misc_feature: Ceres ANNOT ID no. 6012843
  misc_feature: Encodes the peptide sequence at SEQ ID NO 1054
atggcagcaccagaaatggcagctcttctcctgctttcgttcactgttatactgctgagaagttcctctgttcgtagtcaaggactgcagatcgggttctacgactcctactgtcctgacgccgaggatatcgtgaggtcgactgtcgagcagtactacgacagggatgccaccatcgccccaggcttgctcaggctacacttccatgactgctttgttcaggggtgcgacgcatcagtcttgatctctggatcatcttcagaaaggagtgcaccacagaattttgggctcagggggtttgaggtgatagatgacgccaagtcccagctagaagccgtgtgccctggggtggtgtcatgcgctgatatccttgctctcgccgcgcgtgacgctgttgatctgactggtgggccaagctggtcagtgccgctggggagaagagacgggagactctcgtcagcttctggcgccaacgccttgccatcgcctgccgatcctgtatccgttcagaggaagaagttcgcggaccagggactgacagaccacgacctcgtcacattggtaggcgctcacacgatcgggcagaccgattgccagttcttcagctaccggctgtacaacttcacggcgacgggcaacgcggacccgaccatcagccaggcgtcgctggcgcagctccgggcgctgtgcccaccgcccagcggcggcgacccggccgggcggcgggtggcgctggaccagggtagccctggcgcgttcgacgtgagcttcttcaagaacgtccgcgacggcggcgcggtcctggagtcggaccagcggctgtggagcgacgccgccacgcagggcgtggtgcagaagtacgccggcaatgttcggggactcttcggcctcaggttcgggtacgagctccccaaggccatggtgaggatgagcagcatcggggtgaagaccggcgggcagggcgagatcaggaggaggtgctccagggtcaactga

SEQ ID NO: 1054 - protein, 331 aa, Sorghum bicolor
  misc_feature: Ceres ANNOT ID no. 6012843
  misc_feature (45)..(290): Pfam Id: peroxidase Pfam Desc: Peroxidase
  misc_feature (21)..(331): NCBI GI: 1781334 NCBI Desc: peroxidase [spinacia oleracea]
  misc_feature (11)..(331): NCBI GI: 145360874 NCBI Desc: peroxidase [arabidopsis thaliana]
  misc_feature (10)..(331): NCBI GI: 19698452 NCBI Desc: bacterial-induced class iii peroxidase [gossypium hirsutum]
  misc_feature (5)..(331): NCBI GI: 1161566 NCBI Desc: peroxidase precursor [lycopersicon esculentum]
  misc_feature (5)..(331): NCBI GI: 83318804 NCBI Desc: cationic peroxidase [lycopersicon esculentum]
  misc_feature (11)..(331): SWISSPROT Homolog: EC 1.11.1.7 Peroxidase 25 precursor
  misc_feature: Useful for making plants with altered cell wall content and/or composition
  misc_feature: GREAT-hit functional homolog of the protein sequence encoded by LOCUS at2g41480
  misc_feature: Functional homolog of the protein sequence encoded by LOCUS at5g24070
  misc_feature: Functional homolog of the protein sequence encoded by LOCUS at5g39580
  misc_feature: Functional homolog of the protein sequence encoded by LOCUS at5g64100
  misc_feature: Functional homolog of the protein sequence encoded by LOCUS at5g64110
  misc_feature: Functional homolog of the protein sequence encoded by LOCUS at5g64120
  misc_feature: Useful for making plants with altered cell wall content and/or composition
  misc_feature: Functional homolog of the protein sequence given in SEQ ID NO 13630
  misc_feature: Useful for making plants with altered carbohydrate content
  misc_feature: Functional homolog of the protein sequence given in SEQ ID NO 13631
MAAPEMAALLLLSFTVILLRSSSVRSQGLQIGFYDSYCPDAEDIVRSTVEQYYDRDATIAPGLLRLHFHDCFVQGCDASVLISGSSSERSAPQNFGLRGFEVIDDAKSQLEAVCPGVVSCADILALAARDAVDLTGGPSWSVPLGRRDGRLSSASGANALPSPADPVSVQRKKFADQGLTDHDLVTLVGAHTIGQTDCQFFSYRLYNFTATGNADPTISQASLAQLRALCPPPSGGDPAGRRVALDQGSPGAFDVSFFKNVRDGGAVLESDQRLWSDAATQGVVQKYAGNVRGLFGLRFGYELPKAMVRMSSIGVKTGGQGEIRRRCSRVN

SEQ ID NO: 1055 - DNA, 1275 bp, Sorghum bicolor
  misc_feature: Ceres ANNOT ID no. 6012850
  misc_feature: Encodes the peptide sequence at SEQ ID NO 1056
atggcgcgggcggagaagaggcgcgccgcgagcacggaggcggcggagatgccagccaggtcggcggatcaccggagggcgctctacttcgccgcgttcctggtgctcgccgacgctgcgctcgtcgccctcatcatcgccttcgtcccgtataccaagatcgactgggacgcctacatgtctcaggtggacgtttttctggagggggagagggactacaccaagatcgagggagacacagggccattggtctacccgggcggcttcctctacatctactccgccattaagttccttaccggaggccatgtcttccctgctcagattttgttcggcgtattatacattgtcaacttgagcctcgttcttctgctttacgtcaagaccgaagtgcttccatggtgggctttaggtttgctttgtttgtccaagagggttcactccatatttgttctccgccttttcaatgattgcttcgccatgacattgcttcacgctgctatggtactgatcatatatcacaagtggtaccttggtctaatagttttcagtggagctgtctcagttaagatgaatgtccttcttttcgctccttctttgcttctactgatggtcaaggccatgagcatcaaaggagtcttctttgccttgttgggagctgctgttgtacaggttttgttgggtatgccattcttgctctcacatccagttgagtacatctcaagagcattcaatcttggccgtgtgtttatccatttctggtctgtgaactttaaattcgtcccagagaaggtgtttatatcgaaagagcttgctattgcgttgttgattcttcacctcaccacccttctgatatttgcacactacaagtggttaaagcatgaaggaggtctattcggtttcttgcattccagatttaaagatgccaaatcaatcaaacagcttgtttccagccggcccagatcatccattctcagcatagaacatattgtaactgttatgtttattggcaacttcattggcattgtgtatgcccgatcattacactaccaattctattcctggtacttctattccttgccttttctattgtggaaaacacgttttcagacacctttgaggatcattctatttctcgctgtggagttctgctggaacatttacccttctagtgcctattcatcactccttttgctattttcgcacttgtgcattttgtttggtatatggtttgcacctgctgagtacccctatgtcatcaataaagagacataa

SEQ ID NO: 1056 - protein, 424 aa, Sorghum bicolor
  misc_feature: Ceres ANNOT ID no. 6012850
  misc_feature (30)..(395): Pfam Id: ALG3 Pfam Desc: ALG3 protein
  misc_feature (4)..(422): NCBI GI: 3738289 NCBI Desc: not56-like protein [arabidopsis thaliana]
  misc_feature (4)..(422): NCBI GI: 30725280 NCBI Desc: at2g47760/f17a22.15 [arabidopsis thaliana]
  misc_feature (4)..(422): NCBI GI: 79324943 NCBI Desc: catalytic/ mannosyltransferase [arabidopsis thaliana]
  misc_feature (4)..(374): NCBI GI: 79324945 NCBI Desc: catalytic/ mannosyltransferase [arabidopsis thaliana]
  misc_feature (25)..(417): NCBI GI: 22122365 NCBI Desc: alpha-1,3-mannosyltransferase alg3 [mus musculus]
  misc_feature: Useful for making plants with altered carbohydrate content
  misc_feature: Functional homolog of the protein sequence given in SEQ ID NO 13632
MARAEKRRAASTEAAEMPARSADHRRALYFAAFLVLADAALVALIIAFVPYTKIDWDAYMSQVDVFLEGERDYTKIEGDTGPLVYPGGFLYIYSAIKFLTGGHVFPAQILFGVLYIVNLSLVLLLYVKTEVLPWWALGLLCLSKRVHSIFVLRLFNDCFAMTLLHAAMVLIIYHKWYLGLIVFSGAVSVKMNVLLFAPSLLLLMVKAMSIKGVFFALLGAAVVQVLLGMPFLLSHPVEYISRAFNLGRVFIHFWSVNFKFVPEKVFISKELAIALLILHLTTLLIFAHYKWLKHEGGLFGFLHSRFKDAKSIKQLVSSRPRSSILSIEHIVTVMFIGNFIGIVYARSLHYQFYSWYFYSLPFLLWKTRFQTPLRIILFLAVEFCWNIYPSSAYSSLLLLFSHLCILFGIWFAPAEYPYVINKET

SEQ ID NO: 1057 - DNA, 246 bp, Sorghum bicolor
  misc_feature: Ceres ANNOT ID no. 6012857
  misc_feature: Encodes the peptide sequence at SEQ ID NO 1058
atgtcgacgacggcgcacaaggtggcgacgcacgccgccgccgcgacggccaggggaaggcggcggcggccgccgagcgtgctgagggagatcgtgtacggcatgagcctgggcctctttgcggggtacctgtggaagctccaccactggagcaaccagcgccgcacccgcgagttctacagcctgctcgaccagggcaagatcaccgtcgtcgccggcgacgacgacgagccgcccggccactga

SEQ ID NO: 1058 - protein, 81 aa, Sorghum bicolor
  misc_feature: Ceres ANNOT ID no. 6012857
  misc_feature (8)..(74): Pfam Id: COX5C Pfam Desc: Cytochrome c oxidase subunit Vc (COX5C)
  misc_feature (6)..(75): NCBI GI: 7340711 NCBI Desc: cytochrome c oxidase subunit 5c-like protein [arabidopsis thaliana]
  misc_feature (6)..(74): NCBI GI: 119720800 NCBI Desc: cytochrome-c oxidase [brassica rapa]
  misc_feature (13)..(71): NCBI GI: 48428177 NCBI Desc: cytochrome c oxidase polypeptide vc (cytochrome c oxidase subunit 5c)
  misc_feature (25)..(75): NCBI GI: 18409602 NCBI Desc: cytochrome c oxidase subunit 5c [helianthus annuus]
  misc_feature (13)..(71): NCBI GI: 2493852 NCBI Desc: cytochrome c oxidase polypeptide vc (cytochrome c oxidase subunit 5c)
MSTTAHKVATHAAAATARGRRRRPPSVLREIVYGMSLGLFAGYLWKLHHWSNQRRTREFYSLLDQGKITVVAGDDDEPPGH

SEQ ID NO: 1059 - DNA, 1305 bp, Sorghum bicolor
  misc_feature: Ceres ANNOT ID no. 6012866
  misc_feature: Encodes the peptide sequence at SEQ ID NO 1060
atgggcgggagcggcgggcccggcgacgacgcggcggagggcgcaggagccgggttcgaatgggatgccgactcccagctctactaccacgccagtactgctttttaccatgaccctgtcgctggatggtactacagcagcagagatggccaatactacatctacaaaaatggaaattacatgccactgacgacagatctggaaaatggacccacagaaaattatccatatgatgaggccaaccaagatatcttggaacactcttgcttggaaacagctacacctgacaatgagaatgaaacactgggaccgccatcagaatggatggaggaaacactgataaacttgtatttgtcaggctactcaaacagtgaagtcaatgctgaaagttcattagggaacacacatacaaacgaggaagacggaattgagacaactgggaacaaactggatagcttgacctcgcacagtgcttcagtatctctgaatgatgctacatcagagcaaactgaatttgaaatggaaacaaagaattccactgatgtgcatgaatctttgggggaagaggaagaaaaatggcttgctcagtatggtcaggtagagaggttaaatgatgatcaacctttacctccaacaattgatatatgggattgggatgtggtccaagatcatgttagcaaaggtcagccggtggttaggcttgtggggtgcttatctaggggttcaagtaagcttcatccttctctgcctgctcgtggtggccttctaaggactgctcctgtgcgtgaagttcatcttgaccttgtgcgagtttcaacagggaagctatacaggctaaggaaccctagcagaaagtacttagcctctttatccacatatgactcctccaacccaacaaaagattgggggtttcctgatatatatgcaaatcctgatattaatttgagtaagcagtccactgcaaagtgccaatctgaagagccaaagacaaaagcttacagggacagagctgccgagagaaggatcctacatcgtggcttaggggtagggcctggacagaagcagagtaacaccaacaatttcgatgaatacgaggaatcaatcgaggacattgattcaatgggaactgtgtcagttgatttgaatttccgttccagcggcttgctttctgctaagagaataatggagaacatgggctggaaggagggagaggcccttggaaaaagcagaaagggtattgtagaacctatacagcctaccatcaacaaacatggtgccggcttgggatggaatcaaacccgctaa

SEQ ID NO: 1060 - protein, 434 aa, Sorghum bicolor
  misc_feature: Ceres ANNOT ID no. 6012866
  misc_feature (385)..(431): Pfam Id: G-patch Pfam Desc: G-patch domain
  misc_feature (1)..(434): NCBI GI: 115434760 NCBI Desc: os01g0170100 [oryza sativa (japonica cultivar-group)]
  misc_feature (128)..(434): NCBI GI: 30689939 NCBI Desc: d111/g-patch domain-containing protein [arabidopsis thaliana]
  misc_feature (116)..(331): NCBI GI: 92870387 NCBI Desc: d111/g-patch [medicago truncatula]
  misc_feature (311)..(429): NCBI GI: 50417508 NCBI Desc: rbm5-prov protein [xenopus laevis]
  misc_feature (316)..(429): NCBI GI: 116487718 NCBI Desc: mgc154798 protein [xenopus laevis]
MGGSGGPGDDAAEGAGAGFEWDADSQLYYHASTAFYHDPVAGWYYSSRDGQYYIYKNGNYMPLTTDLENGPTENYPYDEANQDILEHSCLETATPDNENETLGPPSEWMEETLINLYLSGYSNSEVNAESSLGNTHTNEEDGIETTGNKLDSLTSHSASVSLNDATSEQTEFEMETKNSTDVHESLGEEEEKWLAQYGQVERLNDDQPLPPTIDIWDWDVVQDHVSKGQPVVRLVGCLSRGSSKLHPSLPARGGLLRTAPVREVHLDLVRVSTGKLYRLRNPSRKYLASLSTYDSSNPTKDWGFPDIYANPDINLSKQSTAKCQSEEPKTKAYRDRAAERRILHRGLGVGPGQKQSNTNNFDEYEESIEDIDSMGTVSVDLNFRSSGLLSAKRIMENMGWKEGEALGKSRKGIVEPIQPTINKHGAGLGWNQTR

SEQ ID NO: 1061 - DNA, 1245 bp, Sorghum bicolor
  misc_feature: Ceres ANNOT ID no. 6012889
  misc_feature: Encodes the peptide sequence at SEQ ID NO 1062
atgagctcccaagtctccacatcacggggtcttcaccccccgggcaagcttgggacatttgagtcgccccatgcctggccgctgccagcgcctacagcccagcccgaagcgggccgtggtgatgatcaggaggtcaggctgttgtcggttgcctggaaccaggattgtggatgctttgctgctggtaccagcaacgggttcaggatctttaactgcgaacctttcaaggagactttcaggagggaccttaagagcggcgggttcgggattgtcgagatgctgttccgttgcaacatccttgctcttgtaggcggcggctccaatgtgcagtacccgccgaacaaggtgatgatctgggatgaccaccagagccgttgcattggagagttcgcctttcgctctgatgtccgggcggtaaaattagcaaaggactacatcgtgattgtcctcgagcgcaagatattcgtttacaacttcaccgatttgaagctgctctaccagattgacaccctgtcaaatcccaagggactttgctgcctctctcatcattccaatacttcagttttggcctgccctggggtgcaccaggggcacgttcgcgtggagcatttcgggctgaagatggcgaagacaatcccagctcatgattcacacatctcttgcatgtcactgacaatggatggtcttctactggcaaccgcaagctcgaagggcactttgatcagaatattcaacacaatggatggcactcgcctacaagaggtacgcagaggtcttgacaaagcagaaatatatagcattgcgttgtcaccaaatgtgcagtggttggcagtgtccagcgacaaagggactgttcatattttctccctgagagtcagagttgctggggaggatgcaagcagtgagcaacgcgctcttgaaggtccacggatggatcaccagaattcttcaagttctatcgatcctcttattcaggcgaacactggatccaatgcgagttcatcactgtcttttatgagagggatcctgccgaagtatttcagttcagagtggtcatttgctcagttccatttaccagaagtcactcgttatatagtagcctttggtgcccagaatactgtgatgatggttggcctggatggcaggtgcagctttgaccaagtgaatggagggcagatgttgcagaaggaatatttccggtttcttaagtccgacaacccacctttcaggaccgcagccgcttga

SEQ ID NO: 1062 - protein, 414 aa, Sorghum bicolor
  misc_feature: Ceres ANNOT ID no. 6012889
  misc_feature (36)..(404): NCBI GI: 115462321 NCBI Desc: os05g0169200 [oryza sativa (japonica cultivar-group)]
  misc_feature (7)..(405): NCBI GI: 92882249 NCBI Desc: wd40-like [medicago truncatula]
  misc_feature (47)..(403): NCBI GI: 16323362 NCBI Desc: at3g62770/f26k9_200 [arabidopsis thaliana]
  misc_feature (47)..(291): NCBI GI: 89291191 NCBI Desc: riken cdna 0610008n23-related [tetrahymena thermophila sb210]
  misc_feature (47)..(289): NCBI GI: 122939167 NCBI Desc: wdr45-like [homo sapiens]
MSSQVSTSRGLHPPGKLGTFESPHAWPLPAPTAQPEAGRGDDQEVRLLSVAWNQDCGCFAAGTSNGFRIFNCEPFKETFRRDLKSGGFGIVEMLFRCNILALVGGGSNVQYPPNKVMIWDDHQSRCIGEFAFRSDVRAVKLAKDYIVIVLERKIFVYNFTDLKLLYQIDTLSNPKGLCCLSHHSNTSVLACPGVHQGHVRVEHFGLKMAKTIPAHDSHISCMSLTMDGLLLATASSKGTLIRIFNTMDGTRLQEVRRGLDKAEIYSIALSPNVQWLAVSSDKGTVHIFSLRVRVAGEDASSEQRALEGPRMDHQNSSSSIDPLIQANTGSNASSSLSFMRGILPKYFSSEWSFAQFHLPEVTRYIVAFGAQNTVMMVGLDGRCSFDQVNGGQMLQKEYFRFLKSDNPPFRTAAA

SEQ ID NO: 1063 - DNA, 1158 bp, Sorghum bicolor
  misc_feature: Ceres ANNOT ID no. 6012891
  misc_feature: Encodes the peptide sequence at SEQ ID NO 1064
atggcggccgccctctcctcctcgcggcgcgccctgcacaccctccaccgccgcctcctcctccacccctccccctcaccagccgccgcgcgccgcgccctacccacactcacacccactcgcactcccatccccgcccactcccccacccccactttctccttctcctcctcctcccgattctccaccaccgcgcgccccgatgcgaggctgcggcacggggtgctgccgcagggcccgcagcagcggctcgtgggcggggtcaggtcggtggctagcggcgggtcgaagctggcgccgctgggccagggggtcaaggggctggggcggcccgtggaggcggcgaggagcgccgccgcgcggtaccgcgcggccgtcggcctgcaggtcgaggccttctggcggcgcaactacatggtcctcgtcggcgccggggcagtcatcgtctgcgtcgcgctgtggaggatcatgttcggcatcgccagcaccttcgtcggactctccgagggcatggccaagtacggcttcctcgcccttgccaccgccattgtcgcctttgccggtatgtatgcccggtcaaggttaaccataaacccggacaaggtttaccggctggctatgacaaaactcaatacatctgctgcaatccttgaagttatgggtgcgcccctaacgggtactgatgtcagagcatatgttatgtctggaggaggcccgaaactaaaggacttcaaattcaagcttggcagtaaacggtgcttcctcattttccccatcaaaggatcagaaagaaggggtctcgtaagtgttgaggtcaagaagaaaaaaggacagtatgacatgaagctactagctgttgacataccaatggcatcaggtcctgaccagcggctgttcctcgtcggtgatgaacaagagtacaaggtgggtgggggcttgatatctgagctgcgagacccgatcgtaaaagctatggctgcagagaaggagtttgattatcttgatgaacgagaggatgaggaggacgagcagagagagcgtgaggaggcggagcaagaggcagcagaagcattgaggcgcgaggaggaaagattgcgccaggagggtgaagaacggaggcggcgggaggaggcagagaggctggagaaagctacgtga

SEQ ID NO: 1064 - protein, 385 aa, Sorghum bicolor
  misc_feature: Ceres ANNOT ID no. 6012891
  misc_feature (337)..(383): NCBI GI: 114319405 NCBI Desc: tonb family protein [alkalilimnicola ehrlichei mlhe-1]
  misc_feature (326)..(383): NCBI GI: 16226131 NCBI Desc: smooth muscle caldesmon protein [oryctolagus cuniculus]
  misc_feature (327)..(383): NCBI GI: 17221648 NCBI Desc: prepromp73 [cucurbita maxima]
  misc_feature (326)..(383): NCBI GI: 7581970 NCBI Desc: e-map-115-95; epithelial microtubule-associated protein [homo sapiens]
  misc_feature (326)..(383): NCBI GI: 7581985 NCBI Desc: e-map-115-105; epithelial microtubule-associated protein [homo sapiens]
MAAALSSSRRALHTLHRRLLLHPSPSPAAARRALPTLTPTRTPIPAHSPTPTFSFSSSSRFSTTARPDARLRHGVLPQGPQQRLVGGVRSVASGGSKLAPLGQGVKGLGRPVEAARSAAARYRAAVGLQVEAFWRRNYMVLVGAGAVIVCVALWRIMFGIASTFVGLSEGMAKYGFLALATAIVAFAGMYARSRLTINPDKVYRLAMTKLNTSAAILEVMGAPLTGTDVRAYVMSGGGPKLKDFKFKLGSKRCFLIFPIKGSERRGLVSVEVKKKKGQYDMKLLAVDIPMASGPDQRLFLVGDEQEYKVGGGLISELRDPIVKAMAAEKEFDYLDEREDEEDEQREREEAEQEAAEALRREEERLRQEGEERRRREEAERLEKAT

SEQ ID NO: 1065 - DNA, 1779 bp, Sorghum bicolor
  misc_feature: Ceres ANNOT ID no. 6012895
  misc_feature: Encodes the peptide sequence at SEQ ID NO 1066
atgaagcgcatgcatagaatgcaaacgagaaagtcccattcatggtggtgggacagccatattagcccaaagaactccaaatggctagctgagaatttggaagagatggataagcaagttaaagagatgctgaagctcatagaggatgaaggtgattcttttgcaaagaaggctgagatgtatttccaaagaaggcctcttcttgtaaatcatgtcgagaacttctatcgcatgtaccgtgctcttgctgagcgttatgacaacgtgactggggaattgcgcaagggtcttgcactgcagtctcaaggctctggtatatccgaaactgattcggagacacaatcaattccaccatctccagagcctaacatggaacagaacacagcaaaaccgaagcgcaaaacaagagcagttggcttcgatgtgttccttggttctggtggaagctcagatatttccaagaaggggagtgatggatcatcatcttcttcttcagattctgattcagaggttgatgaggcaagtgaagaaaatggcaatgggatttcttacataatggatggacggattactgagctagaagatgagctacaggaagcaaggcaacaaattgaggcacttgaggcaaagaacttgcactgccaatgtgaaaaacttgaagagaatctcaaacaagttagcaatgaaaaggaagacttggtagctgcaattctggcaagcaagaatgagatcgaggatctaaaaggagagatggcctcgacagcaaagcattttgaagcacaattagtgcaccgtgaccatgagattgagaagcgcaagcaggaggttgagcaagtttctgaaaagtatttccatgagaaatccgctcttgtgtctgaaatcgaaagactccaggaagttgttaagaattttgaacggaacctaacagaagttacaggagaaaaattgcagcttgaggcccaggtaaaggatcttgaacaagtttctaataacttagatgattcttctgcagagattataaagctacaaggaataatcaaggatctgcaagcaagattggaaaatgactcaaatgagaagggtgtacttgaggaacgtgctatggagttggagcaagttcgtaggcagttggaggattcaagggctgaggctagggagctacaagctacaattaaggacctgaaagatgacctagaaaaagctcttcaagagaaagcagaacttcagaatcgtatgaaggatgtggaacaggtaaccagtgacctaaattccttaattgcttcacttgagagcaagttgacagccacagaggcacagcttgaacaacttcacgtggagaaagcagaagcatcccttgagagtgagaaacatttatctcatctgattcaaaccatcgcccatcttaagacggagatcgagctgctgtcttcagagaaggctgcagttgaaaacaaggtgtccgttctgctgattgatgtcactactcgtgatgaaaagctgaaggagatggacaatcacttgcatcagctgcacctggagcatgtcaagctgatcgaagaggcggatattgcatggaaagacatgtcaggcctgcgttcacgcgtgtgtgagctcgaggaagagattgagaagcagaagcttattatatctgacagcgcagaggggaagcgtgaggcgatcaggcagctgtgcttctcgcttgatcactaccgccatgggtaccagcagcttcggcagctcctgcaggaccacaggaggcccgtggtgatggcaacatga

SEQ ID NO: 1066 - protein, 592 aa, Sorghum bicolor
  misc_feature: Ceres ANNOT ID no. 6012895
  misc_feature (14)..(87): Pfam Id: KIP1 Pfam Desc: KIP1-like protein
  misc_feature (2)..(591): NCBI GI: 92898312 NCBI Desc: trna-binding arm [medicago truncatula]
  misc_feature (2)..(520): NCBI GI: 30697046 NCBI Desc: kinase interacting protein-related [arabidopsis thaliana]
  misc_feature (2)..(475): NCBI GI: 145362059 NCBI Desc: kinase interacting protein-related [arabidopsis thaliana]
  misc_feature (3)..(560): NCBI GI: 92871203 NCBI Desc: prefoldin; trna-binding arm; t-snare; protein kinase pkn/prk1, effector [medicago truncatula]
  misc_feature (8)..(579): NCBI GI: 15228859 NCBI Desc: kinase interacting family protein [arabidopsis thaliana]
MKRMHRMQTRKSHSWWWDSHISPKNSKWLAENLEEMDKQVKEMLKLIEDEGDSFAKKAEMYFQRRPLLVNHVENFYRMYRALAERYDNVTGELRKGLALQSQGSGISETDSETQSIPPSPEPNMEQNTAKPKRKTRAVGFDVFLGSGGSSDISKKGSDGSSSSSSDSDSEVDEASEENGNGISYIMDGRITELEDELQEARQQIEALEAKNLHCQCEKLEENLKQVSNEKEDLVAAILASKNEIEDLKGEMASTAKHFEAQLVHRDHEIEKRKQEVEQVSEKYFHEKSALVSEIERLQEVVKNFERNLTEVTGEKLQLEAQVKDLEQVSNNLDDSSAEIIKLQGIIKDLQARLENDSNEKGVLEERAMELEQVRRQLEDSRAEARELQATIKDLKDDLEKALQEKAELQNRMKDVEQVTSDLNSLIASLESKLTATEAQLEQLHVEKAEASLESEKHLSHLIQTIAHLKTEIELLSSEKAAVENKVSVLLIDVTTRDEKLKEMDNHLHQLHLEHVKLIEEADIAWKDMSGLRSRVCELEEEIEKQKLIISDSAEGKREAIRQLCFSLDHYRHGYQQLRQLLQDHRRPVVMAT

SEQ ID NO: 1067 - DNA, 360 bp, Sorghum bicolor
  misc_feature: Ceres ANNOT ID no. 6012905
  misc_feature: Encodes the peptide sequence at SEQ ID NO 1068
atggccgccaccgccgtcgcggcgtctctgtccgtggcccaggggctcgggaagcccctctgcgccggcagcaacgcgtcgtcgctccgggtcctcgcgccgcgtcgttcggcggccaggaggatggccgtcgtcgtccgggcgtccgcgcaacagaagcagcacccggccaaggagtgggcggccgcggctgccgtggcggcggcgctggtgcttcccgaggtcgcggaggccgcgccggggatctcgccgtcgctcaagaacttcctcctcagcatcgtctccggaggggtcgtcctcgtcgccatcgtcggcgccgtcgtcgccgtctctaacttcgatcccgtcaagcggggctga

SEQ ID NO: 1068 - protein, 119 aa, Sorghum bicolor
  misc_feature: Ceres ANNOT ID no. 6012905
  misc_feature (82)..(119): Pfam Id: PsbX Pfam Desc: Photosystem II reaction centre X protein (PsbX)
  misc_feature (46)..(117): NCBI GI: 45356861 NCBI Desc: ultraviolet-b-repressible protein [gossypium hirsutum]
  misc_feature (1)..(118): NCBI GI: 33520421 NCBI Desc: ultraviolet-b-repressible protein [trifolium pratense]
  misc_feature (46)..(118): NCBI GI: 62910995 NCBI Desc: ultraviolet-b-repressible protein [gossypium hirsutum]
  misc_feature (46)..(119): NCBI GI: 18476498 NCBI Desc: ultraviolet-b-repressible protein [pisum sativum]
  misc_feature (61)..(118): NCBI GI: 145342485 NCBI Desc: psbx, psii-x, photosystem ii polypeptide [ostreococcus lucimarinus cce9901]
  misc_feature: Useful for making plants with modulated nitrogen use efficiency
  misc_feature: Functional homolog of the protein sequence given in SEQ ID NO 12937
MAATAVAASLSVAQGLGKPLCAGSNASSLRVLAPRRSAARRMAVVVRASAQQKQHPAKEWAAAAAVAAALVLPEVAEAAPGISPSLKNFLLSIVSGGVVLVAIVGAVVAVSNFDPVKRG

SEQ ID NO: 1069 - DNA, 1071 bp, Sorghum bicolor
  misc_feature: Ceres ANNOT ID no. 6012909
  misc_feature: Encodes the peptide sequence at SEQ ID NO 1070
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
atgggggtggcgggggagaagttccagttggggacggtgggggcgctcagcctctcggtggtgtcctccgtctccatcgtcatctgcaacaaggctctcatgagctccctcggcttcaacttcgccactactttgacaagctggcatctcctggtcacgttttgttctctccatgtggcattatgtatgaagctctttgagcacaaacctttcgatgcaaggaccgtcatgggatttggagtgctcaatggcatatcgattggacttcttaacttgagtctgggtttcaattctgttggtttctatcagatgacaaagctggctattattccctgtactgttatattggagacccttttcttcaggaagaaatttagtcggaatatcaaactctcccttagcgtgctccttgttggtgttggtgttgcaactgtaactgatctgcaactcaacactgtgggatctgtactgtcactgctggcaatcatcacaacctgtattgctcagattatgacaaatacaatacagaagaagttcaaggtatcttcaacgcagcttctgtaccaatcttgcccataccaagcattgactttgttccttatcggtccattccttgatggatttttgactaaccaaaatgtctttgctttcgattacacaactcaagttctgtttttcatcgtgttgtcatgcctgatttcagtctcagtaaacttcagtacttttctcgtgattgggaagacatctcctgtaacttaccaagttcttggccatctgaaaacatgcttggttctcacctttggctatgttctgcttcacgatccgtttagctggagaaacatacttggaatcctaattgcggtaattgggatggttttgtattcatacttctgcactagagagactcagcaaaaaccagcagaagtctccccacaagtaattcaggcgaaagagggtgaatcaaaccctctgatctcagactccctgagcgctgctgaaaacgggggcagtgccaccgacgacgaacctctgaaggtaccaatgtggagctcaaagtactcgaaggcgtga

SEQ ID NO: 1070 - protein, 356 aa, Sorghum bicolor
  misc_feature: Ceres ANNOT ID no. 6012909
  misc_feature (154)..(296): Pfam Id: TPT Pfam Desc: Triose-phosphate Transporter family
  misc_feature (8)..(326): NCBI GI: 48717036 NCBI Desc: phosphate translocator-like [oryza sativa (japonica cultivar-group)]
  misc_feature (8)..(224): NCBI GI: 115468244 NCBI Desc: os06g0506200 [oryza sativa (japonica cultivar-group)]
  misc_feature (104)..(325): NCBI GI: 42570326 NCBI Desc: transporter-related [arabidopsis thaliana]
  misc_feature (15)..(295): NCBI GI: 145355238 NCBI Desc: dmt family transporter: glucose-6-phosphate/phosphate [ostreococcus lucimarinus cce9901]
  misc_feature (11)..(173): NCBI GI: 115440755 NCBI Desc: os01g0823200 [oryza sativa (japonica cultivar-group)]
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
  misc_feature: The sequence is a functional homolog of SEQ ID NO. 484 in the 11/188,298 US application
  misc_feature: The sequence is a functional homolog of SEQ ID NO. 360 in the 11/188,298 US application
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLVGVGVATVTDLQLNTVGSVLSLLAIITTCIAQIMTNTIQKKFKVSSTQLLYQSCPYQALTLFLIGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEVSPQVIQAKEGESNPLISDSLSAAENGGSATDDEPLKVPMWSSKYSKA

SEQ ID NO: 1071 - DNA, 1176 bp, Sorghum bicolor
  misc_feature: Ceres ANNOT ID no. 6012933
  misc_feature: Encodes the peptide sequence at SEQ ID NO 1072
  misc_feature: Down-regulated in shoot tissues in response to salicylic acid treatment
atgtcggagactgaatcggcggcagtggccgcggcgctggacccggcggctacagcggagccgaagcctcggcggctgcgggggcacaagaagggcgccgtcacctgctgcgtcgcctcctccgcccgcccgggcgtcgtcgcgtcctccggcgaggatggatgtctttgctggtttgatctgcgcaccaaagatgtacttttgaccatggaagcagcaaataaaccaatttcttcaatttgctttaaaccaggaaatgaagattgtgtgtatatctctgctggaaatgaaatattgtcctttgatgttcgtatgggagctcaatcaaagccattagagacgtataactacaatagagatgaaatcaatcagattgctgtcagctctaaaggttttctcgctgctgcagatgatagtggggatgttaagattgtcaataccattcagaagtgcctgtataaaagattaagggaagcccacacaagtatttgcagcagcgtgcaattcattccttggagaccttggacagcaattactggtggccttgactcaaagctcgttgcatgggatttctccaaaggacgaacactgttttctattgattatggatcacctgaattgcaaaatggcaattcttccggtagtgcagggcaatgtttcaaccctgcttttgttcattcagtagcagtttctgaagagggtattttgggagggctctacaaggtttgtgctgttgcaaggggggatggtgctgttgatgtgattgatcttgagtatgaactggctcctgcgaaatcgaagggacctcctcgggcagctatttcaaaaaagagttcaaaaggagctgaacttggagatgggagctgtaatcaaagtcaagcgaaaagaatccatcttgactacacgatgggtggccataccgcagctgtatcttgtgtagcattttcagtatttggtgagaaggggaagttcctcgtttctggcggcaatgatgcatcagtgaagctgtgggattggtcgaaaggattttcgtctgaaacaaacagcaaagttgaattggttttgaatattgatgtaaagaaaaaggtaaattggctgtgtactgctccaactgattcagataacttgattgtgtgtgacacatccaaggtggtcaaagtatataatttccggtag

SEQ ID NO: 1072 - protein, 391 aa, Sorghum bicolor
  misc_feature: Ceres ANNOT ID no. 6012933
  misc_feature (297)..(338): Pfam Id: WD40 Pfam Desc: WD domain, G-beta repeat
  misc_feature (17)..(175): NCBI GI: 42573592 NCBI Desc: transducin family protein / wd-40 repeat family protein [arabidopsis thaliana]
  misc_feature (17)..(279): NCBI GI: 18422588 NCBI Desc: transducin family protein / wd-40 repeat family protein [arabidopsis thaliana]
  misc_feature (28)..(234): NCBI GI: 119574030 NCBI Desc: wd repeat domain 53, isoform cra_a [homo sapiens]
  misc_feature (24)..(372): NCBI GI: 126658553 NCBI Desc: peptidase c14, caspase catalytic subunit p20 [cyanothece sp. ccy0110]
  misc_feature (24)..(197): NCBI GI: 75907778 NCBI Desc: wd-40 repeat [anabaena variabilis atcc 29413]
  misc_feature: Down-regulated in shoot tissues in response to salicylic acid treatment
MSETESAAVAAALDPAATAEPKPRRLRGHKKGAVTCCVASSARPGVVASSGEDGCLCWFDLRTKDVLLTMEAANKPISSICFKPGNEDCVYISAGNEILSFDVRMGAQSKPLETYNYNRDEINQIAVSSKGFLAAADDSGDVKIVNTIQKCLYKRLREAHTSICSSVQFIPWRPWTAITGGLDSKLVAWDFSKGRTLFSIDYGSPELQNGNSSGSAGQCFNPAFVHSVAVSEEGILGGLYKVCAVARGDGAVDVIDLEYELAPAKSKGPPRAAISKKSSKGAELGDGSCNQSQAKRIHLDYTMGGHTAAVSCVAFSVFGEKGKFLVSGGNDASVKLWDWSKGFSSETNSKVELVLNIDVKKKVNWLCTAPTDSDNLIVCDTSKVVKVYNFR

SEQ ID NO: 1073 - DNA, 969 bp, Sorghum bicolor
  misc_feature: Ceres ANNOT ID no. 6012943
  misc_feature: Encodes the peptide sequence at SEQ ID NO 1074
atggcaaccattactgttcctcgagttgtcccttctcctgctgaagatgccgctgctctcttgaaggctttccaaggatggggcaccgacgagcaggcagtgatatccatcctagctcaccgcgacgccactcagaggaagcagatcgcgctggagtacgaacacaagtacagcgagagcctaatccagcgcctgcactctgagctctccggcgatttcgagagagcagtgtaccactggatgcttgaccccgccgagaggcaggctgtgatggcgaacgccgccacggaatgcatccaggaggagtaccctgtcctcgtcgagatcgcgtgcgccaacaactccgccgcggagctcgtcgccgtcaagaaggcctaccatgccctctacaagcgctccctggaagaagacgtcgccgctcgtgccacgggcaaccttcgcactctcctgctcgccgtggtgagcacgtacaggtacgacggcgacgacaacgtggacatggagctagcgcggtcagaggcgaagatcgtgcacgaggccgtgcggaacggcggcggcggggcggcgggtgggcacgacgagctcatcagggtggtgggcaccaggagcaaggcgcagctcagggccacgttcgcctgcttcaaggacgagcaccggagcagcgtcaccaaggcgctgccgcgtggcgacgaccccacggggtacccccgcgcgctgcggacggcggcgcggtgcgtcgcggatcccagcaagtacttcgccaaggtgctgaggcacgcgacgcgcgagtctgcggggaccgacgaggatagcctgaccagggtggtggtggtgcacgcggagaaggacgacatgggagccatctgcgccgcgttccagaagagggcgtcgtgcaccttggaacaggccatcgccaaggaaacctcgggggactacaggagcttcctgctggctcttcttggaagctaa

SEQ ID NO: 1074 - protein, 322 aa, Sorghum bicolor
  misc_feature: Ceres ANNOT ID no. 6012943
  misc_feature (15)..(80): Pfam Id: Annexin Pfam Desc: Annexin
  misc_feature (87)..(153): Pfam Id: Annexin Pfam Desc: Annexin
  misc_feature (252)..(319): Pfam Id: Annexin Pfam Desc: Annexin
  misc_feature (1)..(321): NCBI GI: 6010777 NCBI Desc: annexin [fragaria x ananassa]
  misc_feature (1)..(321): NCBI GI: 6272285 NCBI Desc: annexin p33 [zea mays]
  misc_feature (1)..(321): NCBI GI: 1621539 NCBI Desc: annexin-like protein
  misc_feature (1)..(321): NCBI GI: 7960742 NCBI Desc: annexin-like protein [arabidopsis thaliana]
  misc_feature (1)..(321): NCBI GI: 7960741 NCBI Desc: annexin-like protein [arabidopsis thaliana]
MATITVPRVVPSPAEDAAALLKAFQGWGTDEQAVISILAHRDATQRKQIALEYEHKYSESLIQRLHSELSGDFERAVYHWMLDPAERQAVMANAATECIQEEYPVLVEIACANNSAAELVAVKKAYHALYKRSLEEDVAARATGNLRTLLLAVVSTYRYDGDDNVDMELARSEAKIVHEAVRNGGGGAAGGHDELIRVVGTRSKAQLRATFACFKDEHRSSVTKALPRGDDPTGYPRALRTAARCVADPSKYFAKVLRHATRESAGTDEDSLTRVVVVHAEKDDMGAICAAFQKRASCTLEQAIAKETSGDYRSFLLALLGS

SEQ ID NO: 1075 - DNA, 1935 bp, Sorghum bicolor
  misc_feature: Ceres ANNOT ID no. 6012948
  misc_feature: Encodes the peptide sequence at SEQ ID NO 1076
atggccgcatccacggcggtggcggcggctgctgccgcgcggaagggcgcgctgacggatcagaggttctcggagctgtcccccgcgctgtccccggaggtggtggaggccctggaccgcggaggtttccagcggtgcacgcccgtgcaggcggcggccatcccgcacctgctctcgcacaaggacgtagccgtcgacgccgccaccggctccgggaagacccttgccttcatcgtccccgtcgttgagatcctccgccgccgctcctcccggcccaagtcccacgaggttcttgctctcattatctctcccacgagagaattgtcctcgcagatattcaatgtggcccagcccttcttcgcgaccctgaatggcgtgtcatccatgctcctggttggtgggctggatatcaaagcagagctgaagaaggtagaggaagagggcgcaaacatattggtgggcactcctgggaagctgtgtgatataatgcacacggatgctctagagtacaagaatcttgagattttgatcctggatgaggctgataggctcttggatatgggattccagaaacatattaacttcatactttcaatgttgccgaagctgaggaggactgggcttttctcagctacccagacgaaagctgttgcggacctatccaaagcagggttgagaaatcctataagggttgaagttaagacagaggcaaagtccacaagcaaagatgctggtcagcaagagcttggttcatcaaaaacaccactggggcttcggttggagtatatgatatgtgaagcatcaaagaagtcatctcagcttgttgatttccttgtgcagaatagtgggaagaaaataatggtatattttgcaacatgtgcttgtgtagattattgggccgttgttcttccactgattaactcgcttaaaggttctccaataattgcttaccatggaaagatgaaacagggccttcgagagaaagctttggcatcattttctgccctttcaagtggcgttctagtctgcactgatgttgcagcaaggggtcttgacataccaagtgttgatcttattgtgcagtatgatccaccacaagatccgaacgttttcatacatagagctggccgtacagcacgttatgatcaagaaggggatgctattgtgtttctcttaccaaaggaggatacttatgttgagttcttgaaacttcgaggtgttcctctcacagaaagggaatgccccgcaaacactgatgatgtcatacagcagattagaagtgctgcgctcgaagatcgtaatgtcatggagaaaggacttagagcatttgtctcgtttgttcgagcatacaaggagcaccactgctcttacatttttaggtggaaagatctcgagattggaaaactagctatggagtatggtttactccagatcccatccatgccagaagtgaagcatcattctctttcactggagggatttattcctgttgatgttgatattacagaaatcaagtacaaggataaagctagagagaaacaacgcaagaaggcactgaaaaggaaagcagaagaggaagctcaaaatccaaagccagacaggaagagggctccagagaagccggagaaaccaaagcggaagaagacaggcaagcagcgtcagtcaatccaaaccaaggaggacctggatgagctggcgcatgagtaccggcttctgaagaagcttaaacgtggagacatcgatgaagaggagtacgagaaactcactgggtttggagattctgatggtgaagcttctgatggggatgcgagcaacttggatgagaggaaggagaagggcaacaaggcgcaaaagaagctcaagcagagaggaaaatgcaaaggtgggtctaagaagtttgaagggaggagtaaaatgaggagcaaaaggagatag

SEQ ID NO: 1076 - protein, 644 aa, Sorghum bicolor
  misc_feature: Ceres ANNOT ID no. 6012948
  misc_feature (47)..(220): Pfam Id: DEAD Pfam Desc: DEAD/DEAH box helicase
  misc_feature (306)..(382): Pfam Id: Helicase_C Pfam Desc: Helicase conserved C-terminal domain
  misc_feature (17)..(528): NCBI GI: 110736442 NCBI Desc: atp-dependent rna helicase-like protein [arabidopsis thaliana]
  misc_feature (18)..(608): NCBI GI: 37360468 NCBI Desc: mkiaa1595 protein [mus musculus]
  misc_feature (18)..(608): NCBI GI: 109734859 NCBI Desc: ddx55 protein [mus musculus]
  misc_feature (18)..(608): NCBI GI: 20987604 NCBI Desc: dead (asp-glu-ala-asp) box polypeptide 55 [homo sapiens]
  misc_feature (18)..(608): NCBI GI: 41327779 NCBI Desc: dead (asp-glu-ala-asp) box polypeptide 55 [homo sapiens]
  misc_feature: Useful for making plants with altered alkaloid content
  misc_feature: GREAT-hit functional homolog of the protein sequence given in SEQ ID NO 12903
  misc_feature: Useful for making plants with altered alkaloid content
  misc_feature: Functional homolog of the protein sequence given in SEQ ID NO 12903
MAASTAVAAAAAARKGALTDQRFSELSPALSPEVVEALDRGGFQRCTPVQAAAIPHLLSHKDVAVDAATGSGKTLAFIVPVVEILRRRSSRPKSHEVLALIISPTRELSSQIFNVAQPFFATLNGVSSMLLVGGLDIKAELKKVEEEGANILVGTPGKLCDIMHTDALEYKNLEILILDEADRLLDMGFQKHINFILSMLPKLRRTGLFSATQTKAVADLSKAGLRNPIRVEVKTEAKSTSKDAGQQELGSSKTPLGLRLEYMICEASKKSSQLVDFLVQNSGKKIMVYFATCACVDYWAVVLPLINSLKGSPIIAYHGKMKQGLREKALASFSALSSGVLVCTDVAARGLDIPSVDLIVQYDPPQDPNVFIHRAGRTARYDQEGDAIVFLLPKEDTYVEFLKLRGVPLTERECPANTDDVIQQIRSAALEDRNVMEKGLRAFVSFVRAYKEHHCSYIFRWKDLEIGKLAMEYGLLQIPSMPEVKHHSLSLEGFIPVDVDITEIKYKDKAREKQRKKALKRKAEEEAQNPKPDRKRAPEKPEKPKRKKTGKQRQSIQTKEDLDELAHEYRLLKKLKRGDIDEEEYEKLTGFGDSDGEASDGDASNLDERKEKGNKAQKKLKQRGKCKGGSKKFEGRSKMRSKRR

SEQ ID NO: 1077 - DNA, 900 bp, Sorghum bicolor
  misc_feature: Ceres ANNOT ID no. 6012954
  misc_feature: Encodes the peptide sequence at SEQ ID NO 1078
atgggggctccaaaacagaggtggacttctgaggaagaggctgctcttagagctggagtagcgagacatggagttggaaactggcgtatgatattgaatgatccagaacttggctccacactgcgctaccgctcaaatgttgacctaaaggacaaatggcgcaacatgaatgtaattgtcacttcatcgagtgctcgtgacagggggagaacttccacgaggagaacccgagctgctcctaagaatagtgatcagtcgttgccaatgagcacagttacttctgatgttgatgatgagattgttgatgtaaaccctatagcatcagtagtgcctgttgaatcgtggaatacttcaaattcaaagaaatctcactcaaggctagataatattataatggaggctataaagaacttgaatgagcctacagggtcacacagaactactattgctaattacatagaggagcaatattggccacctagtgattttgatcacttattgtctgcaaaactgaaggatttagctaccagtgggaaattgttaaaggtgaatcggaagtacaggatagcacctagttcaccacgcttagagggccgaagccccaaaatgatgctgctggaagacgtgcaaggagaacccttgaaattagggagtgatgctagtagaacccttacgagatcccaaattgatgctgaattggttcgtatggcaactatgaccgccgaggcagctgcggctgctgctgctcatgcagttgcagaggcagaggctatcatggcagaagctgaagcagctgctagggaagcagaggctgcagaagcagaggcccgagctgcacaggccttcgctgaagcagcagttttgacactgaagaacagaaatgctgcgaaattggtataa

SEQ ID NO: 1078 - protein, 299 aa, Sorghum bicolor
  misc_feature: Ceres ANNOT ID no. 6012954
  misc_feature (5)..(57): Pfam Id: Myb_DNA-binding Pfam Desc: Myb-like DNA-binding domain
  misc_feature (123)..(191): Pfam Id: Linker_histone Pfam Desc: linker histone H1 and H5 family
  misc_feature (1)..(299): NCBI GI: 34105719 NCBI Desc: single myb histone 5 [zea mays]
  misc_feature (1)..(299): NCBI GI: 34105723 NCBI Desc: single myb histone 6 [zea mays]
  misc_feature (6)..(299): NCBI GI: 42733516 NCBI Desc: bri1-kd interacting protein 127 [oryza sativa (japonica cultivar-group)]
  misc_feature (1)..(296): NCBI GI: 115438036 NCBI Desc: os01g0589300 [oryza sativa (japonica cultivar-group)]
  misc_feature (1)..(299): NCBI GI: 110931654 NCBI Desc: myb transcription factor myb55 [glycine max]
  misc_feature: The sequence is a functional homolog of SEQ ID NO 1219 in the 10/666,642US patent application
  misc_feature: The sequence is a functional homolog of SEQ ID NO 1220 in the 10/666,642US patent application
  misc_feature: The sequence is a functional homolog of SEQ ID NO 1221 in the 10/666,642US patent application
  misc_feature: The sequence is a functional homolog of SEQ ID NO 1374 in the 10/666,642US patent application
  misc_feature: The sequence is a functional homolog of SEQ ID NO 1526 in the 10/666,642US patent application
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13122
  misc_feature: The sequence is a functional homolog of SEQ ID NO 1219 in the 20070033671 US patent application
  misc_feature: The sequence is a functional homolog of SEQ ID NO 1220 in the 20070033671 US patent application
  misc_feature: The sequence is a functional homolog of SEQ ID NO 1221 in the 20070033671 US patent application
  misc_feature: The sequence is a functional homolog of SEQ ID NO 1374 in the 20070033671 US patent application
  misc_feature: The sequence is a functional homolog of SEQ ID NO 1526 in the 20070033671 US patent application
MGAPKQRWTSEEEAALRAGVARHGVGNWRMILNDPELGSTLRYRSNVDLKDKWRNMNVIVTSSSARDRGRTSTRRTRAAPKNSDQSLPMSTVTSDVDDEIVDVNPIASVVPVESWNTSNSKKSHSRLDNIIMEAIKNLNEPTGSHRTTIANYIEEQYWPPSDFDHLLSAKLKDLATSGKLLKVNRKYRIAPSSPRLEGRSPKMMLLEDVQGEPLKLGSDASRTLTRSQIDAELVRMATMTAEAAAAAAAHAVAEAEAIMAEAEAAAREAEAAEAEARAAQAFAEAAVLTLKNRNAAKLV

SEQ ID NO: 1079 - DNA, 1533 bp, Sorghum bicolor
  misc_feature: Ceres ANNOT ID no. 6012983
  misc_feature: Encodes the peptide sequence at SEQ ID NO 1080
atggagagggtgctcaaggatgacgccgtccaggagaagggcgagcgcgccaggatggcatcgtttattggggccatggcaatcgcagatttgattaagaccacattgggaccaaaaggaatggacaagatcctgcaatcaactggcagagggcgtaatgttactgttacaaatgatggggctaccattctgaagtcacttcacattgacaatcctgctgcaaaggtccttgttgacatctcgaaagttcaagatgatgaagttggtgatgggacaacttctgtcgttgttctagctggagaacttttgaaggaggctgagaagttagttaacatgaaaattcatccaatgactattattgcaggttacagaatggctctcgagtgtgccagagatactttgctacaaaagaccatggacaacaaagaaaatacagataagttcagaactgatctcatgaatattgctatgactactcttagttcaaaaattctttcccaagacaaggagtactttgctgaacttgcggttgatgctgtcttgaggcttaagggtagcaccaacttggaatctattcaaattctgaagaaacctggaggatctcttaaggattcctttttggacgaagggttcattcttgacaagaaaattggcattgggcagccaaagcgcattgagaatgccaaaattttggttgcaaacactgctatggacacagataaagttgcagatattgaagctgctgagaagcagaaaatgagagagaaagtccaaaagatcataggtcacggaatcaactgtttcgtcaacaggcagttaatctataacttccctgaggaactctttgctgacgctggcatacttgcaattgagcatgctgactttgagggaattgaacggctagctcttgttactggtggtgagattgcatcaacttttgataacccagagtctgttaagcttggtcactgcaaggttattgaagagattatgattggtgaggacaggctaattcatttctctggggttgcgatggggcaggcttgcaccattgttctaagaggggctagcgagcatgtacttgatgaggctgagaggtcattgcatgatgccttgtgtgtgctgtcccagacagtaaatgatactcgtgtcttgtttggaggcggatggcctgagatggtgatggccaaagaagtagatgaacttgcaaggaagacccctgggaagaaatctcatgctattgatgctttctcgcgtgctctgcaagccatcccaacaatcatagctgataatgctggtttggatagcgctgagttgatctctcagctccgagctgagcaccacaaagagaactgcactgctggaattgatgtcatcacaggctctgttggggatatgcaaaagctggggattcaagagtcgttcaaggtgaagcaggccatccttctgtctgcgacagaggctgcagagatgatcctcagggtcgatgagatcataacatgtgccccgcgcagaagagaggataggatgtga

SEQ ID NO: 1080 - protein, 510 aa, Sorghum bicolor
  misc_feature: Ceres ANNOT ID no. 6012983
  misc_feature (28)..(503): Pfam Id: Cpn60_TCP1 Pfam Desc: TCP-1/cpn60 chaperonin family
  misc_feature (4)..(510): NCBI GI: 92891163 NCBI Desc: protein kinase; groel-like chaperone, atpase [medicago truncatula]
  misc_feature (4)..(506): NCBI GI: 27503862 NCBI Desc: cct2-prov protein [xenopus laevis]
  misc_feature (4)..(506): NCBI GI: 49522488 NCBI Desc: chaperonin containing tcp1, subunit 2 (beta) [xenopus tropicalis]
  misc_feature (4)..(506): NCBI GI: 61368892 NCBI Desc: chaperonin containing tcp1 subunit 2 [synthetic construct]
  misc_feature (3)..(507): NCBI GI: 17066722 NCBI Desc: cct chaperonin beta subunit [physarum polycephalum]
MERVLKDDAVQEKGERARMASFIGAMAIADLIKTTLGPKGMDKILQSTGRGRNVTVTNDGATILKSLHIDNPAAKVLVDISKVQDDEVGDGTTSVVVLAGELLKEAEKLVNMKIHPMTIIAGYRMALECARDTLLQKTMDNKENTDKFRTDLMNIAMTTLSSKILSQDKEYFAELAVDAVLRLKGSTNLESIQILKKPGGSLKDSFLDEGFILDKKIGIGQPKRIENAKILVANTAMDTDKVADIEAAEKQKMREKVQKIIGHGINCFVNRQLIYNFPEELFADAGILAIEHADFEGIERLALVTGGEIASTFDNPESVKLGHCKVIEEIMIGEDRLIHFSGVAMGQACTIVLRGASEHVLDEAERSLHDALCVLSQTVNDTRVLFGGGWPEMVMAKEVDELARKTPGKKSHAIDAFSRALQAIPTIIADNAGLDSAELISQLRAEHHKENCTAGIDVITGSVGDMQKLGIQESFKVKQAILLSATEAAEMILRVDEIITCAPRRREDRM

SEQ ID NO: 1081 - DNA, 1509 bp, Sorghum bicolor
  misc_feature: Ceres ANNOT ID no. 6012999
  misc_feature: Encodes the peptide sequence at SEQ ID NO 1082
atggatcatattcaacccaagaacatcccacacaatgaatcactgcctctaggccagaagcttctactgcatcatggaagtgatgcgccccttagaattggtcattctactcatgggaatatgggacatagaataaatgatcttccatcttcaagtcgcactgtgcaaactctaggttatagagttgggaacccaggaacctcacacgctccctttgttcactaccatgctggaagttccagtagccatttaccagcagaacctgctgtggattatctacataggtctgaggaaggctttgctccagtgggttcccatatagacaacagaagggctgcaatgaagcgaaaagatcccagtgtacaccctgcggggatcagtgctactggttattatgttggaagttgttccaatactcagccatctaactttgtgcagccaaatcctgctccacttgctgagcccttgcttcatcaaatacctttaagcattgaccaaagtggttgggatggccaacacttaattcatcaagaaggattccagaggaatgtgagagcacgccacagtcataatatttcattagaacccagatcagcttcaacctacccactaaacagtgctcacatgtcgtcatttggttcaactgcaagtgcttcctcaagtacatcagtcgaaaggaaccaagcacctgtttctctgccaacaagaactgttccatcaggtgcaccaggtatcactagcagggccctgacagggagggcctactatcctgtggttggaagcagcagcccaagtgttggtgctgtcccaactatccatggatcatctggcactgcaatatttgctaatggtggctatgctcctagtactgctcatactggaactgttcctatctaccctaatggagctcctgctacttcatctggctctagagccatgccccatcagatggtcattcagaatcatccacatgctacctctgcagcaacctctacatccatgcgtgacagaattgctgcggcttctagacatgcaagacatgtatcagtagggcatgctaacaatggaaggtacagaagggctaggagctcttactacagtcttcatccattgatggtagaggcagagcggttcatgatggaccagttagtcttttacgaatcaagagcagcagctgctgacccccacagggacatgagactggacattgacaacatgagttatgaggacctgttggctttgggagaatctatgggtaacgtcagcacaggcttggctgatgaaaaaatttcgaagtgtgtgaaagaagtggtctgttgcagttctggccagatgcaaattgatgaagatgaccaagatgatggaagctgcatcatttgcctggagggttacaaagacaaggatatgctggggatactgaaatgcaggcatgacttccatgccgactgcatcaagaagtggttgcagacgaagaattcatgcccggtgtgcaaagcagccgctgcttag

SEQ ID NO: 1082 - protein, 502 aa, Sorghum bicolor
  misc_feature: Ceres ANNOT ID no. 6012999
  misc_feature (457)..(497): Pfam Id: zf-C3HC4 Pfam Desc: Zinc finger, C3HC4 type (RING finger)
  misc_feature (4)..(502): NCBI GI: 115434650 NCBI Desc: os01g0159300 [oryza sativa (japonica cultivar-group)]
  misc_feature (111)..(500): NCBI GI: 1771195 NCBI Desc: ring-finger protein [lotus corniculatus var. japonicus]
  misc_feature (119)..(500): NCBI GI: 4240031 NCBI Desc: dna binding zinc finger protein (pspzf) [pisum sativum]
  misc_feature (175)..(501): NCBI GI: 558543 NCBI Desc: c-terminal zinc-finger [glycine max]
  misc_feature (342)..(501): NCBI GI: 92868263 NCBI Desc: zinc finger, ring-type; ringv [medicago truncatula]
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 424 in the 11/188,298 US application
MDHIQPKNIPHNESLPLGQKLLLHHGSDAPLRIGHSTHGNMGHRINDLPSSSRTVQTLGYRVGNPGTSHAPFVHYHAGSSSSHLPAEPAVDYLHRSEEGFAPVGSHIDNRRAAMKRKDPSVHPAGISATGYYVGSCSNTQPSNFVQPNPAPLAEPLLHQIPLSIDQSGWDGQHLIHQEGFQRNVRARHSHNISLEPRSASTYPLNSAHMSSFGSTASASSSTSVERNQAPVSLPTRTVPSGAPGITSRALTGRAYYPVVGSSSPSVGAVPTIHGSSGTAIFANGGYAPSTAHTGTVPIYPNGAPATSSGSRAMPHQMVIQNHPHATSAATSTSMRDRIAAASRHARHVSVGHANNGRYRRARSSYYSLHPLMVEAERFMMDQLVFYESRAAAADPHRDMRLDIDNMSYEDLLALGESMGNVSTGLADEKISKCVKEVVCCSSGQMQIDEDDQDDGSCIICLEGYKDKDMLGILKCRHDFHADCIKKWLQTKNSCPVCKAAAA

SEQ ID NO: 1083 - DNA, 2739 bp, Sorghum bicolor
  misc_feature: Ceres ANNOT ID no. 6013004
  misc_feature: Encodes the peptide sequence at SEQ ID NO 1084
atgccgtcctcctacgccgccgccgctgccggatcctcttcccgcaagccgaatcgcacctccaacgctgccgcatccactgctcgcccaccagcaccctcaccgtcgcgggcacccgctgccccggcggtgaaccctagcgtcatctccgattccgacccctcctcctactcatcttcctcggcggacgaggccgatctcaccgcctccgactccgcaactgcctctgttgtttccgcctacctctcggttgctggtgagggggccgacctctcgaaagttggcattttcctttcctccgccgcgcgccgccgatcgccgccgtgcctgatctgcttcgatcctatccgcccctctgacccagtctggtcatgctcctcctcctgctttgccatcctccacctcccctgcatccagtcatgggctcaccagtcagcatccggcgccgccgtgccgtgcccaacctggggatgccccaagtgccgcttcgcctaccccaagtccgagaccccatcctcctacgtctgcttctgcaccaaaacagtagacccggctccggacccctggatcctcccccactcttgcggcgacgtctgtggccgccgtcttgatgccaatctcgactctggatgtgagcatacctgcctactgctgtgccacccagggccgtgcccgccatgcccggccgttgttcctaatgcgcggtgcttctgtggagcgcacagggagcctcgacgctgtgcacatcagcgttactcttgtgggcgaaaatgtaacaaacgtcttagctgtggactccaccgctgtccagtggattgtcatgatggcccctgcccgccgtgtgcagtgcaggggagtcacaaatgtgagtgtggagagacaatggaggagaaattgtgctttgaaaggattttccagtgcaagagggagtgtggtgggatgttagattgcgggaagcataggtgtgagagggggtgccatgggggcaagtgtggggaatgcccactccgtggtcgtcgcacttgcccatgtgggaagaaggattatccaaggttggagtgtgatgcagaggctgccacatgtggatcgacatgtgagaaggtgcttgggtgtggacgacacaggtgcccagagaggtgccatcgtggttcatgtgatgagacttgccgtcttgtgatcacaaaggcctgccgttgtgggggtctgaagaaggaggtgccgtgctaccaagaattgacgtgtgaaagaaaatgtcaacgttcgagaaactgtggtcgccatgcttgtaaacgacgctgctgtgctagggattgcccaccctgctccgagacttgtgataagaagctcagatgcggcaatcataaatgcctctcaccatgccacagaggtgtttgttcaccttgtcctctgatgaagaccattccttgcgcctgtgggaaaacatgttttgaggttccttgtgggactgagaagaaccagaaaccacccaaatgctcaaagaaatgcagtatacctcgcctatgccgacacaagcttgaatgccgggaagctatcctgccccacaaatgccactatggagcctgcccaccttgcaagctgacctgtggggaagaactttcttgtggccacacgtgtaaagaaaggtgtcatggccctatttctcctccaaaccccgagttcacactgaaaccgacaaaaaagaaaatgggaaagcacatagagtgtacacccgggacaccatgcccgccatgcaaagaggtggttttggtgccatgctttgggcagcatcttggccaagaacgcgctatgccttgttgcaaatggaggccttttccctgtgaaaatttatgtgggaatcctctcctctgtggcaaccattattgtacaaaatcttgccatgtgttagaagtcccattgaatcaacctgaaggagatcgtatagcatctatcagtaaagcaaacacacttgctgagccttgtgaacaatgcaatcttccttgtcaaagggttagggagcctcgttgttcacatccttgccctttgccatgccatctgagcgattgtccatcttgtaaagtccttgttaaaagaccatgccattgtggtgctatggtgcatgcttttgaatgtgtatattttaacaacttaaatgcaaaggaacagattaaagtaaggacgtgtggcggcccatgtcatagaaaactaccaaattgcccccatctgtgctcagaagtatgtcaccctggtatatgcccatcggttgatcagtgcatgaaaaaggtcaacatccgctgtgcatgcaacactctgaaacaagagtggctatgtcaagatgtcctcaaggaataccgtaagtctggtcgcgatccaaaagaagtacctaaaagtcaatttggagttggcttgcttgcctgcggtgaagactgcaagaagaagctgaaggctccagattcagagttgcatctccggaaaagtcaggagaacaagagccctgctgtggaagtcgtaaatgtgcccaaacgcaggaagcggcgtgagcgtggacaggaagttaaaatctccaaattccaggaagtcaagacttacgtgctgagagtgctactgattattttgctgtcaataatcgttgctgctggtctgtacctgttgtggaaaggcatattctggctttctgactggatgaacgaaatggaagagcagagggcgagacaaaggcatccgaggggtgcaatgttgtaa

SEQ ID NO: 1084 - protein, 912 aa, Sorghum bicolor
  misc_feature: Ceres ANNOT ID no. 6013004
  misc_feature (264)..(283): Pfam Id: zf-NF-X1 Pfam Desc: NF-X1 type zinc finger
  misc_feature (317)..(336): Pfam Id: zf-NF-X1 Pfam Desc: NF-X1 type zinc finger
  misc_feature (371)..(391): Pfam Id: zf-NF-X1 Pfam Desc: NF-X1 type zinc finger
  misc_feature (451)..(470): Pfam Id: zf-NF-X1 Pfam Desc: NF-X1 type zinc finger
  misc_feature (37)..(908): NCBI GI: 145357676 NCBI Desc: transcription factor [arabidopsis thaliana]
  misc_feature (1)..(535): NCBI GI: 13359295 NCBI Desc: similar to arabidopsis thaliana chromosome v p1 mjj3; mjj3.6 (ab005237) [oryza sativa (japonica cultivar-group)]
  misc_feature (55)..(835): NCBI GI: 124301201 NCBI Desc: ovarian zinc finger protein [mus musculus]
  misc_feature (2)..(835): NCBI GI: 89363020 NCBI Desc: nuclear transcription factor, x-box binding-like 1 [homo sapiens]
  misc_feature (2)..(792): NCBI GI: 119613449 NCBI Desc: nuclear transcription factor, x-box binding-like 1, isoform cra_c [homo sapiens]
MPSSYAAAAAGSSSRKPNRTSNAAASTARPPAPSPSRAPAAPAVNPSVISDSDPSSYSSSSADEADLTASDSATASVVSAYLSVAGEGADLSKVGIFLSSAARRRSPPCLICFDPIRPSDPVWSCSSSCFAILHLPCIQSWAHQSASGAAVPCPTWGCPKCRFAYPKSETPSSYVCFCTKTVDPAPDPWILPHSCGDVCGRRLDANLDSGCEHTCLLLCHPGPCPPCPAVVPNARCFCGAHREPRRCAHQRYSCGRKCNKRLSCGLHRCPVDCHDGPCPPCAVQGSHKCECGETMEEKLCFERIFQCKRECGGMLDCGKHRCERGCHGGKCGECPLRGRRTCPCGKKDYPRLECDAEAATCGSTCEKVLGCGRHRCPERCHRGSCDETCRLVITKACRCGGLKKEVPCYQELTCERKCQRSRNCGRHACKRRCCARDCPPCSETCDKKLRCGNHKCLSPCHRGVCSPCPLMKTIPCACGKTCFEVPCGTEKNQKPPKCSKKCSIPRLCRHKLECREAILPHKCHYGACPPCKLTCGEELSCGHTCKERCHGPISPPNPEFTLKPTKKKMGKHIECTPGTPCPPCKEVVLVPCFGQHLGQERAMPCCKWRPFPCENLCGNPLLCGNHYCTKSCHVLEVPLNQPEGDRIASISKANTLAEPCEQCNLPCQRVREPRCSHPCPLPCHLSDCPSCKVLVKRPCHCGAMVHAFECVYFNNLNAKEQIKVRTCGGPCHRKLPNCPHLCSEVCHPGICPSVDQCMKKVNIRCACNTLKQEWLCQDVLKEYRKSGRDPKEVPKSQFGVGLLACGEDCKKKLKAPDSELHLRKSQENKSPAVEVVNVPKRRKRRERGQEVKISKFQEVKTYVLRVLLIILLSIIVAAGLYLLWKGIFWLSDWMNEMEEQRARQRHPRGAML

SEQ ID NO: 1085 - DNA, 729 bp, Sorghum bicolor
  misc_feature: Ceres ANNOT ID no. 6013005
  misc_feature: Encodes the peptide sequence at SEQ ID NO 1086
atgggggacgccgcctccggccgcggccacgtcgtctaccctccccgctccgccgaggacatcttcaaggactaccgcgcccgccgctccgccatcctccgcgccctcactcacgaggtcgaggtcttctacgcgcagtgcgatccagacaaggagaacctgtgcctgtacggctacgcgaacgaggcgtgggaggtggcgctgccggcggaggaggtgcccacggagctgccggagcctgcgctcgggatcaacttcgcgcgcgacgggatgaaccgccgcgactggcttgcgctcgtcgccgtccactccgactcctggctcctctccgtcgccttttactatgccgctcgcctcaatcgtaatgaccggaagcgcttatttggcatgattaatgaattgcaaactgtttttgaagttgtctccggtgcaagacaacagcaatctaaagagaggtccagtatggacaatggtggtagatccaagcctgtaaagatagaaaataatggaaaagccacagacgaagcatatggagaagatgacagtgatcacggtgaaaccctatgcggaacctgtggtgggatatacagtgcggatgagttctggattgggtgcgacatgtgcgagaggtggtaccatggcaagtgtgtcaagataactcccgccaaggcggatagcataaagcattacaaatgcccgagctgcagctccaagagggcgaggcagtag

SEQ ID NO: 1086 - protein, 242 aa, Sorghum bicolor
  misc_feature: Ceres ANNOT ID no. 6013005
  misc_feature (188)..(238): Pfam Id: PHD Pfam Desc: PHD-finger
  misc_feature (15)..(239): NCBI GI: 116563481 NCBI Desc: phd4 [medicago truncatula]
  misc_feature (15)..(242): NCBI GI: 21536795 NCBI Desc: nucleic acid binding protein-like [arabidopsis thaliana]
  misc_feature (13)..(241): NCBI GI: 45387429 NCBI Desc: nucleic acid-binding protein [lycopersicon esculentum]
  misc_feature (13)..(162): NCBI GI: 116563475 NCBI Desc: phd1 [medicago truncatula]
  misc_feature (6)..(241): NCBI GI: 115394658 NCBI Desc: phd6 [glycine max]
  misc_feature: Useful for making plants with altered Lignin content
  misc_feature: Useful for making plants with modulated drought sensitivity
  misc_feature: Useful for making plants with modulated flowering time
  misc_feature: Functional homolog of the protein sequence given in SEQ ID NO 13472
  misc_feature: Functional homolog of the protein sequence given in SEQ ID NO 13473
  misc_feature: Useful for making plants with altered lignin content
  misc_feature: Useful for making plants with modulated flowering time
  misc_feature: Functional homolog of the protein sequence given in SEQ ID NO 13473
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Useful for making plants with altered alkaloid content
  misc_feature: Functional homolog of the protein sequence given in SEQ ID NO 13176
  misc_feature: The sequence is a functional homolog of SEQ ID NO 1981 in the 11/479,226 US patent application
  misc_feature: The sequence is a functional homolog of SEQ ID NO. 482 in the 11/188,298 US application
MGDAASGRGHVVYPPRSAEDIFKDYRARRSAILRALTHEVEVFYAQCDPDKENLCLYGYANEAWEVALPAEEVPTELPEPALGINFARDGMNRRDWLALVAVHSDSWLLSVAFYYAARLNRNDRKRLFGMINELQTVFEVVSGARQQQSKERSSMDNGGRSKPVKIENNGKATDEAYGEDDSDHGETLCGTCGGIYSADEFWIGCDMCERWYHGKCVKITPAKADSIKHYKCPSCSSKRARQ

SEQ ID NO: 1087 - DNA, 1587 bp, Sorghum bicolor
  misc_feature: Ceres ANNOT ID no. 6013012
  misc_feature: Encodes the peptide sequence at SEQ ID NO 1088
atggccgacggcagcgcctccgcgtcgccgccctccgtttctccgcaccaccagtaccaccgcgacgccatcaagtcctcagtgcgcaatacagctgctaaccggaggagggagcaggctcttgcaatagggaaggaaagaagggaagctttgatgcgtgcaaagcgtgtgtgtcgagctcctctttctggcagtgatgaggctgcagcagaagatggtgacatggttactgatgaggggaaagcagatcttgaggctagaacgactcaggctgttgaggaactgaaatctgctttgtcaagccagggaaaaggggcacagaagaggaagacagaggtgcttcgtgctttaaggcgtttgttgtctcaatctgaagtacctccagttgatgctgcaattaaagctggagcagtccctctgttagtgcagtatctgtcatttggatcatcagatgaacaattgctagaggcagcttggtgccttacaaacatagcggcaggggaacctgaagaaactaaatccttacttcctgctctaccattgctcattgctcaccttggtgagaagagctccacacttgtcgcggaacaatgtgcatgggccattggtaatgttgctggtgaaggagcagaactgagaagtacattacttgctcaaggtgctttgtggcctcttgcccgtttaatgctgtcaaataagggttctacagcaagaactgctgcttgggcattgtcaaatctcataaaggggcctgattccaaggctgcgaatgagcttattggcattgacggcgtactgaatgcaatcacacggaacttggaaaaagcggatgaagaacttgctactgaggtggcatgggtagtggtctatctttcagcactttcagaaaaagctaccagccaaatagtaagaagttctgtgccactgttgctgatcgggcgccttctagcatctgaaaacttgcagctcctcattccggtacttcgcggtttaggaaatcttgtagctggtgacggttacatggttgattcagtcctaactgttggaaacagtgtcacagatcaagccttggcaagtcttatcaagtgtttgaagagcgacaatagggttctcaagaaggaggcatcatgggccatgtcaaatgtagcagcaggcagtttcgagcataagaaactgatatttgctagtgaggcgactcctttgctgatgcacctcctcaggactgcacaatttgacatccgcagggaagcagcatacaccctgggcaatctgtgtgttgtgccagcaggcagtggtaaccccccaaacataatcgttgatcacttagttgctatcgtagatggtggaggccttccaggatttataaatctggtgaggtcagctgatatagagagtgccagacttgggcttcagttcctggaactggtgatgagaggataccccaacaatcaaggtccaaagcttgtggagagggaggatggcatcgaggctatggagaggttccagttccatgagaacgaggtgatgaggaatatggccaatggtttggttgacaaatactttggtgaagactacggtctcgagtga

SEQ ID NO: 1088 - protein, 528 aa, Sorghum bicolor
  misc_feature: Ceres ANNOT ID no. 6013012
  misc_feature (125)..(166): Pfam Id: Arm Pfam Desc: Armadillo/beta-catenin-like repeat
  misc_feature (209)..(249): Pfam Id: Arm Pfam Desc: Armadillo/beta-catenin-like repeat
  misc_feature (386)..(426): Pfam Id: Arm Pfam Desc: Armadillo/beta-catenin-like repeat
  misc_feature (1)..(528): NCBI GI: 3287494 NCBI Desc: similar to yeast srp1 [oryza sativa (japonica cultivar-group)]
  misc_feature (1)..(528): NCBI GI: 62900329 NCBI Desc: importin alpha-2 subunit
  misc_feature (1)..(528): NCBI GI: 115434632 NCBI Desc: os01g0158000 [oryza sativa (japonica cultivar-group)]
  misc_feature (21)..(528): NCBI GI: 145357578 NCBI Desc: binding [arabidopsis thaliana]
  misc_feature (21)..(388): NCBI GI: 7413584 NCBI Desc: importin alpha-like protein [arabidopsis thaliana]
  misc_feature: The sequence is a functional homolog of SEQ ID NO. 309 in the 11/188,298 US application
MADGSASASPPSVSPHHQYHRDAIKSSVRNTAANRRREQALAIGKERREALMRAKRVCRAPLSGSDEAAAEDGDMVTDEGKADLEARTTQAVEELKSALSSQGKGAQKRKTEVLRALRRLLSQSEVPPVDAAIKAGAVPLLVQYLSFGSSDEQLLEAAWCLTNIAAGEPEETKSLLPALPLLIAHLGEKSSTLVAEQCAWAIGNVAGEGAELRSTLLAQGALWPLARLMLSNKGSTARTAAWALSNLIKGPDSKAANELIGIDGVLNAITRNLEKADEELATEVAWVVVYLSALSEKATSQIVRSSVPLLLIGRLLASENLQLLIPVLRGLGNLVAGDGYMVDSVLTVGNSVTDQALASLIKCLKSDNRVLKKEASWAMSNVAAGSFEHKKLIFASEATPLLMHLLRTAQFDIRREAAYTLGNLCVVPAGSGNPPNIIVDHLVAIVDGGGLPGFINLVRSADIESARLGLQFLELVMRGYPNNQGPKLVEREDGIEAMERFQFHENEVMRNMANGLVDKYFGEDYGLE

SEQ ID NO: 1089 - DNA, 711 bp, Sorghum bicolor
  misc_feature: Ceres ANNOT ID no. 6013015
  misc_feature: Encodes the peptide sequence at SEQ ID NO 1090
atgggcgccgccgccaacagcaaccatgaggaggagtcgagccccctcatcccagctgccgccgccgccgcggacgagaagcccccgcaggctccggctccggcgccggaggccgccaagtgctacgccgacggggtccctgtcgtgatgggcgagcccgtgtcggctcacgccttcggcggcctcccgcgggagagctggaactccgggatcctctcctgccttggccgcaacgacgagttctgcagcagcgacgtcgaagtgtgtcttcttggaaccgtagcaccatgtgtgctctatggtagtaatgttgagaggcttgctgctggacaaggcacatttgcaaacagctgtttgccttacactggcctgtatatgcttgggaactctctctttgggtggaactgccttgccccatggttctctcatcccactcgtaccgctattcgacgacgctacaatcttgagggtaactttgaggctttcaccaggcagtgtgggtgctgcggcagtctggtcgaggacgaggagaggcgcgagcacctagaggctgtctgtgaccttgcgacccactacctctgccacccttgtgccctctgccaggagggacgcgagctgcgccgcagggttccccaccctgggttcaacaatgggcactccgtctttgtcatgatgccacccatggagcagaccatggggcgtggcatgtga

SEQ ID NO: 1090 - protein, 236 aa, Sorghum bicolor
  misc_feature: Ceres ANNOT ID no. 6013015
  misc_feature (67)..(206): Pfam Id: PLAC8 Pfam Desc: PLAC8 family
  misc_feature (8)..(235): NCBI GI: 34485633 NCBI Desc: sat5 [pisum sativum]
  misc_feature (8)..(235): NCBI GI: 92868245 NCBI Desc: uncharacterized cys-rich domain [medicago truncatula]
  misc_feature (183)..(218): NCBI GI: 27414001 NCBI Desc: fw2.2 [lycopersicon esculentum]
  misc_feature (183)..(218): NCBI GI: 27414015 NCBI Desc: fw2.2 [lycopersicon hirsutum]
  misc_feature (183)..(218): NCBI GI: 27414009 NCBI Desc: fw2.2 [lycopersicon pimpinellifolium]
MGAAANSNHEEESSPLIPAAAAAADEKPPQAPAPAPEAAKCYADGVPVVMGEPVSAHAFGGLPRESWNSGILSCLGRNDEFCSSDVEVCLLGTVAPCVLYGSNVERLAAGQGTFANSCLPYTGLYMLGNSLFGWNCLAPWFSHPTRTAIRRRYNLEGNFEAFTRQCGCCGSLVEDEERREHLEAVCDLATHYLCHPCALCQEGRELRRRVPHPGFNNGHSVFVMMPPMEQTMGRGM

SEQ ID NO: 1091 - DNA, 420 bp, Sorghum bicolor
  misc_feature: Ceres ANNOT ID no. 6013016
  misc_feature: Encodes the peptide sequence at SEQ ID NO 1092
atgagcataacagcatattgcatgaaggatcgggtacctcgggttcgggtaattcgggttcggatccgggtaattcgggtacgggctacgccacttatagcaggacttgcagttgcagcaactgctcttgctggtagatatggcatccaagcttggcaagcttataaggcaaggcctattgttcctagaatgcggaaattctatgaaggtggctttcaacctatgatgaaccgacgggaagctgcattaatccttggtgtcagggaaactgccaatgcagagaaggtaaaagaggcgcacaagagggtcatggtcgctaaccatccagatgctggtggaagtcattaccttgcttcaaagattaacgaggcgaaggatgtgttgtcagggaaaacaaaaggaggtggatcggccttttaa

SEQ ID NO: 1092 - protein, 139 aa, Sorghum bicolor
  misc_feature: Ceres ANNOT ID no. 6013016
  misc_feature (80)..(140): Pfam Id: DnaJ Pfam Desc: DnaJ domain
  misc_feature (27)..(139): NCBI GI: 115471001 NCBI Desc: os07g0192300 [oryza sativa (japonica cultivar-group)]
  misc_feature (29)..(139): NCBI GI: 21554024 NCBI Desc: dnaj protein-like [arabidopsis thaliana]
  misc_feature (29)..(133): NCBI GI: 62858503 NCBI Desc: loc549696 [xenopus tropicalis]
  misc_feature (26)..(133): NCBI GI: 50417603 NCBI Desc: mgc89962 protein [xenopus tropicalis]
  misc_feature (29)..(133): NCBI GI: 21687102 NCBI Desc: homolog of yeast tim14 isoform a [homo sapiens]
MSITAYCMKDRVPRVRVIRVRIRVIRVRATPLIAGLAVAATALAGRYGIQAWQAYKARPIVPRMRKFYEGGFQPMMNRREAALILGVRETANAEKVKEAHKRVMVANHPDAGGSHYLASKINEAKDVLSGKTKGGGSAF

SEQ ID NO: 1093 - DNA, 921 bp, Sorghum bicolor
  misc_feature: Ceres ANNOT ID no. 6013033
  misc_feature: Encodes the peptide sequence at SEQ ID NO 1094
atggacagcaacgagatgcccgggaagaaggcgaggaagccctacaccatcaccaagccccgggagcgctggagcaccgaggagcacggccgcttcgtcgacgcgtttgggcgcgactggaagaagatcgaggagcatgtcggcaccaagacaaccatccagatacggagccatgcccagaagtacttcctcaaggtccagaagctcgggctagccgccgggctgccgccgatgtacccgaggcgccacttcgccatgcagcagcaggaacagcagcagaccacggtggccggtagcagcgcggctgcggccgccatgccattgcttcacggcctgcagcagcagcaacctatgtgcgcgccggtcgccatgccaggtctgtccgagtccgacgccgtcgctcacggttcttccatcggctggaacagccccggcgtccttcctgcacccaagatgcaaggcttggactgggcagcaggcccgtcagcttcagggacagcaccactgatgaacaccgacgcgcagagccagattgtgccattggccggtggcggccggttcattggggcgccgagcttgagcagcaccagcatagattgggctggcagtggcagcagcaacgcaagcgaagcgtcagcgatcggtgccgtgcatgatgaaccgatcgagcttccattatcacccgaggatctgccatttgcgcaggtgtacaggttcgtcggcgacatgttcgaccccaacacgccgatcccagtagaaacccatctgcagaaactgaaggagctggacgacatcaccgtcaagacaatcttgctggtgctgagaaacctcgagaacaacctgtcagcgcctcagttcgagcccgtgagaaggttactgtcaacgtatgatccgacaagaggcgtgtctggccaattgtag

SEQ ID NO: 1094 - protein, 306 aa, Sorghum bicolor
  misc_feature: Ceres ANNOT ID no. 6013033
  misc_feature (21)..(63): Pfam Id: Myb_DNA-binding Pfam Desc: Myb-like DNA-binding domain
  misc_feature (3)..(306): NCBI GI: 115434620 NCBI Desc: os01g0156000 [oryza sativa (japonica cultivar-group)]
  misc_feature (5)..(169): NCBI GI: 110931716 NCBI Desc: myb transcription factor myb133 [glycine max]
  misc_feature (4)..(177): NCBI GI: 79324967 NCBI Desc: dna binding / transcription factor [arabidopsis thaliana]
  misc_feature (4)..(177): NCBI GI: 42566225 NCBI Desc: myb family transcription factor [arabidopsis thaliana]
  misc_feature (7)..(147): NCBI GI: 119331598 NCBI Desc: myb transcription factor [catharanthus roseus]
  misc_feature: The sequence is a functional homolog of SEQ ID NO. 514 in the 11/188,298 US application
MDSNEMPGKKARKPYTITKPRERWSTEEHGRFVDAFGRDWKKIEEHVGTKTTIQIRSHAQKYFLKVQKLGLAAGLPPMYPRRHFAMQQQEQQQTTVAGSSAAAAAMPLLHGLQQQQPMCAPVAMPGLSESDAVAHGSSIGWNSPGVLPAPKMQGLDWAAGPSASGTAPLMNTDAQSQIVPLAGGGRFIGAPSLSSTSIDWAGSGSSNASEASAIGAVHDEPIELPLSPEDLPFAQVYRFVGDMFDPNTPIPVETHLQKLKELDDITVKTILLVLRNLENNLSAPQFEPVRRLLSTYDPTRGVSGQL

SEQ ID NO: 1095 - DNA, 381 bp, Sorghum bicolor
  misc_feature: Ceres ANNOT ID no. 6013034
  misc_feature: Encodes the peptide sequence at SEQ ID NO 1096
atgggcggagggcacgacatgcacggccacaacggcggcgtgaagggctacgtgtccaacctcgtccacggcggcggtggcggcggccatggccacggctatggcggcggccatggcggctacggcggccatgggcatggatacggcggccatgggcagggctacggccacgcgtaccctcctccggccgccgccggcgcgtaccctcctccgcacggcggctacccgcccgccgccgcctaccccgcgcactcggcgcactacgggaacatgggatcgtaccacagcagccacagccatggcggcggccaccacggcggctacggcggcaagcacaagggcggcatgttcggcggcggcaagttcaggaagtggaagtga

SEQ ID NO: 1096 - protein, 126 aa, Sorghum bicolor
  misc_feature: Ceres ANNOT ID no. 6013034
  misc_feature (2)..(125): NCBI GI: 295808 NCBI Desc: glycine-rich protein [hordeum vulgare subsp. vulgare]
  misc_feature (2)..(125): NCBI GI: 121644 NCBI Desc: glycine-rich cell wall structural protein precursor
  misc_feature (1)..(120): NCBI GI: 33668156 NCBI Desc: gprp [oryza sativa (indica cultivar-group)]
  misc_feature (1)..(120): NCBI GI: 17821 NCBI Desc: glycine-rich_protein_(aa1-291) [brassica napus]
  misc_feature (2)..(120): NCBI GI: 92869574 NCBI Desc: eggshell protein [medicago truncatula]
MGGGHDMHGHNGGVKGYVSNLVHGGGGGGHGHGYGGGHGGYGGHGHGYGGHGQGYGHAYPPPAAAGAYPPPHGGYPPAAAYPAHSAHYGNMGSYHSSHSHGGGHHGGYGGKHKGGMFGGGKFRKWK

SEQ ID NO: 1097 - DNA, 294 bp, Sorghum bicolor
  misc_feature: Ceres ANNOT ID no. 6013042
  misc_feature: Encodes the peptide sequence at SEQ ID NO 1098
atgcagggacaggaaggtcgattctatgccaacaatgagaagagaaaggagggtattatggctaggaaggataataaggtgccaagagggttcataccagttctgataggacagggggaggagagggagaggatcctcgtgcatatggagcagttcaagcagccatacttcatcgagcttcttgatctggcggtgcaggaattcgggtatgagcagcaggggatcctccatatcccctgcacagctgaggccttccgatccatcattggtgccatcagaaagcccaaatcatga

SEQ ID NO: 1098 - protein, 97 aa, Sorghum bicolor
  misc_feature: Ceres ANNOT ID no. 6013042
  misc_feature (1)..(93): Pfam Id: Auxin_inducible Pfam Desc: Auxin responsive protein
  misc_feature (27)..(97): NCBI GI: 92892187 NCBI Desc: auxin responsive saur protein [medicago truncatula]
  misc_feature (26)..(92): NCBI GI: 38345606 NCBI Desc: osjnba0093o08.8 [oryza sativa (japonica cultivar-group)]
  misc_feature (26)..(92): NCBI GI: 90399384 NCBI Desc: h0818e11.4 [oryza sativa (indica cultivar-group)]
  misc_feature (27)..(97): NCBI GI: 92897061 NCBI Desc: auxin responsive saur protein [medicago truncatula]
  misc_feature (25)..(93): NCBI GI: 3152585 NCBI Desc: contains similarity to auxin-induced protein tm018a10.6 from a. thaliana bac gbaf013294. [arabidopsis thaliana]
  misc_feature: The sequence is a functional homolog of SEQ ID NO. 402 in the 11/188,298 US application
  misc_feature: The sequence is a functional homolog of SEQ ID NO. 505 in the 11/188,298 US application
MQGQEGRFYANNEKRKEGIMARKDNKVPRGFIPVLIGQGEERERILVHMEQFKQPYFIELLDLAVQEFGYEQQGILHIPCTAEAFRSIIGAIRKPKS

SEQ ID NO: 1099 - DNA, 450 bp, Sorghum bicolor
  misc_feature: Ceres ANNOT ID no. 6013066
  misc_feature: Encodes the peptide sequence at SEQ ID NO 1100
atggcgcccaaggcggagaagaagccggcggcgaagaagcccgcggaggaggagcccgcggccgagaaggccccggcggggaagaagcccaaggcggagaagcgcctccccgcgggcaagtctgccggcaaggagggcggcgacaagaagggcaagaagaaggccaagaagtcggtggagacctacaagatctacatcttcaaggtgctcaagcaggtgcaccccgacatcggcatctcctccaaggccatgtccatcatgaactccttcatcaacgacatcttcgagaagctcgccggcgaggccgccaagctcgcccgctacaacaagaagcccaccatcacctccagggagatccagacgtcggtgcgcctcgtcctcccaggcgagctcgccaagcacgccgtgtccgagggcaccaaggccgttaccaagttcacctcatcttag

SEQ ID NO: 1100 - protein, 149 aa, Sorghum bicolor
  misc_feature: Ceres ANNOT ID no. 6013066
  misc_feature (56)..(126): Pfam Id: Histone Pfam Desc: Core histone H2A/H2B/H3/H4
  misc_feature (1)..(149): NCBI GI: 21801 NCBI Desc: histone h2b [triticum aestivum]
  misc_feature (1)..(149): NCBI GI: 22325 NCBI Desc: h2b histone [zea mays]
  misc_feature (1)..(149): NCBI GI: 1708107 NCBI Desc: histone h2b
  misc_feature (1)..(149): NCBI GI: 577825 NCBI Desc: h2b histone [zea mays]
  misc_feature (1)..(149): NCBI GI: 22323 NCBI Desc: h2b histone [zea mays]
  misc_feature: No seed is being produced by the plant
  misc_feature: The plant flowers significantly late compared to wild-type.
  misc_feature: Useful for biocontainment applications
  misc_feature: Useful for making plants with modulated flowering time
  misc_feature: GREAT-hit functional homolog of the protein sequence given in SEQ ID NO 13102
  misc_feature: Useful for biocontainment applications
  misc_feature: Useful for making plants with modulated flowering time
  misc_feature: Functional homolog of the protein sequence given in SEQ ID NO 13102
  misc_feature: The sequence is a functional homolog of SEQ ID NO. 490 in the 11/188,298 US application
MAPKAEKKPAAKKPAEEEPAAEKAPAGKKPKAEKRLPAGKSAGKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 1101 - DNA, 450 bp, Sorghum bicolor
  misc_feature: Ceres ANNOT ID no. 6013067
  misc_feature: Encodes the peptide sequence at SEQ ID NO 1102
atggcgcccaaggcggagaagaagccggcggcgaagaagcccgcggaggaggagcccgcggccgagaaggcgccggcggggaagaagcccaaggcggagaagcgcctcccggcgggcaagtcggccggcaaggaggggggcgacaagaagggcaagaagaaggctaagaagtcggtggagacctacaagatctacatcttcaaggtgctgaagcaggtccaccccgacaccggcatctcctccaaggccatgtccatcatgaattccttcatcaacgatatcttcgagaagctcgccggcgaagccgccaagctcgcgcgctacaacaaaaagcccaccatcacctccagggagatccagacctccgtccgcctcgtcctccccggcgagctcgccaagcacgccgtctccgagggcaccaaggccgttaccaagttcacctcatcttag

SEQ ID NO: 1102 - protein, 149 aa, Sorghum bicolor
  misc_feature: Ceres ANNOT ID no. 6013067
  misc_feature (56)..(126): Pfam Id: Histone Pfam Desc: Core histone H2A/H2B/H3/H4
  misc_feature (1)..(149): NCBI GI: 21801 NCBI Desc: histone h2b [triticum aestivum]
  misc_feature (1)..(149): NCBI GI: 22325 NCBI Desc: h2b histone [zea mays]
  misc_feature (1)..(149): NCBI GI: 1708107 NCBI Desc: histone h2b
  misc_feature (1)..(149): NCBI GI: 577825 NCBI Desc: h2b histone [zea mays]
  misc_feature (1)..(149): NCBI GI: 22323 NCBI Desc: h2b histone [zea mays]
  misc_feature: No seed is being produced by the plant
  misc_feature: The plant flowers significantly late compared to wild-type.
  misc_feature: Useful for biocontainment applications
  misc_feature: Useful for making plants with modulated flowering time
  misc_feature: GREAT-hit functional homolog of the protein sequence given in SEQ ID NO 13102
  misc_feature: Useful for biocontainment applications
  misc_feature: Useful for making plants with modulated flowering time
  misc_feature: Functional homolog of the protein sequence given in SEQ ID NO 13102
  misc_feature: The sequence is a functional homolog of SEQ ID NO. 490 in the 11/188,298 US application
MAPKAEKKPAAKKPAEEEPAAEKAPAGKKPKAEKRLPAGKSAGKEGGDKKGKKKAKKSVETYKIYIFKVLKQVHPDTGISSKAMSIMNSFINDIFEKLAGEAAKLARYNKKPTITSREIQTSVRLVLPGELAKHAVSEGTKAVTKFTSS

SEQ ID NO: 1103 - DNA, 1350 bp, Sorghum bicolor
  misc_feature: Ceres ANNOT ID no. 6013080
  misc_feature: Encodes the peptide sequence at SEQ ID NO 1104
atgggtttcgaggtgcaggtgatagagtcgtcgtttgtaacgcccagcgagccggcaccgaggaaggggctctggctgtcctccttggacctctggctggccaaccaaggccacactccgacgatctatctgtatagcagctccaacgatgctgctgcggctgatcatttcttcgacgtggctaggctcaaggaggctatggccagagccttggtggccttctaccccctcgccggccgcctcggcgtcaacgacgccgacggcaggatagagatcagctgtaatggcgaaggtgcactctttgttgtcgctcgagctgatgatttcactgccaatgacgtaaagaaattcaagccgtcgccagagcttaggaggctgtttgttccactcattgagccattgtccatcattttggccgtacaggtgacattcttgaagtgtggtggggtggtgttagggacagctctccaccatgccgctgttgacgccttaagtgcgttccacttctttcagacatggtcggccttctccaagcatggcgaccgagctactttggagctcccatgccatgaccgtgacctactccgtgcacggtctccgcccacagtccaccccgatgcactcttgacgttctaccctaagcacaccttcttcgacctgtcaggacctcttgccattaaagtctttactatttccagggaccaggtcgcctccttaaagtacctttgcggtggcggcacgagcaccttctgtgccgtgagtgctctcgtgtggcagtgcacgtgcattgcacgtcggctctcacctgattctgaagcacgtctcacgttcccggctgacctccgacaaaggatgaggccgcccctcccaagcagctacatcggcaatgcggtattttatctaggcatcaccagcacagggcaagatattgccacggaggtgttgggatccgtcgctggccgcatcagaggcgccatcgatcagatggatgacgagctagtgcgctccgctatcgattactttgagatggccgagatggatagccgacctccaaggggcaccttgtcgcagacggtcctgcatattttcagctggttgggcagaccacaatacgatgcagattttgggtgggggaagccagagttgatgtcactggcggagagccaatgcgggggatttgtgaacttgatgaacgatgacgatggtgctggcaacggtggcgtccgtttgcacatgtgcatggaggctgtaaatataaaggagatggagcaactactttatgcaaagctagctctagcagcttttgctactaggaaaggtacttcatacgatgattacctgtctcgataa

SEQ ID NO: 1104 - protein, 449 aa, Sorghum bicolor
  misc_feature: Ceres ANNOT ID no. 6013080
  misc_feature (3)..(426): Pfam Id: Transferase Pfam Desc: Transferase family
  misc_feature (2)..(429): NCBI GI: 62734082 NCBI Desc: transferase family [oryza sativa (japonica cultivar-group)]
  misc_feature (4)..(329): NCBI GI: 115475267 NCBI Desc: os08g0205000 [oryza sativa (japonica cultivar-group)]
  misc_feature (4)..(427): NCBI GI: 40644899 NCBI Desc: hydroxycinnamoyl coa quinate transferase [nicotiana tabacum]
  misc_feature (4)..(427): NCBI GI: 133873117 NCBI Desc: hydroxycinnamoyl-coa shikimate/quinate hydroxycinnamoyltransferase [coffea arabica]
  misc_feature (1)..(427): NCBI GI: 82568711 NCBI Desc: alcohol acyl-transferase [prunus mume]
  misc_feature: Useful for making plants with altered Lignin content
  misc_feature: Useful for making plants with altered cell wall content and/or composition
  misc_feature: Functional homolog of the protein sequence given in SEQ ID NO 12900
MGFEVQVIESSFVTPSEPAPRKGLWLSSLDLWLANQGHTPTIYLYSSSNDAAAADHFFDVARLKEAMARALVAFYPLAGRLGVNDADGRIEISCNGEGALFVVARADDFTANDVKKFKPSPELRRLFVPLIEPLSIILAVQVTFLKCGGVVLGTALHHAAVDALSAFHFFQTWSAFSKHGDRATLELPCHDRDLLRARSPPTVHPDALLTFYPKHTFFDLSGPLAIKVFTISRDQVASLKYLCGGGTSTFCAVSALVWQCTCIARRLSPDSEARLTFPADLRQRMRPPLPSSYIGNAVFYLGITSTGQDIATEVLGSVAGRIRGAIDQMDDELVRSAIDYFEMAEMDSRPPRGTLSQTVLHIFSWLGRPQYDADFGWGKPELMSLAESQCGGFVNLMNDDDGAGNGGVRLHMCMEAVNIKEMEQLLYAKLALAAFATRKGTSYDDYLSR

SEQ ID NO: 1105 - DNA, 537 bp, Sorghum bicolor
  misc_feature: Ceres ANNOT ID no. 6013369
  misc_feature: Encodes the peptide sequence at SEQ ID NO 1106
atggctgcgccagcgccgcatcaggggcaggggcagcagggcgaccaccaccagccgaagctgcagaaggtgatggtggcggtggacgagagcgagtgcagcggccacgcgctggagtgggtgctgcggaacctggcgcccacgctggcgccgccgctgctggtgctcaccgtgcagccgcacttccccctcggctatgtctccgccgcggcctttggcgcacctctgggcaccgttcctccggtagctccggagctcatcaagtcgatgcaggagcagcagaggcagctcacgcaggcgctcctcgacaaggtcgtggccatctgcgctgagcatggggttgctgtagagacaattgttgaggtaggagatgcaaaagagatgatatgtgaggcagctgagatgaaaaatgttgatctgctggttcttggaagccacagtcgtgggccaatacaaaggttgtttcttgggagcgtcagtaactactgcgtacaccattcaaagcgtccagttcttgttgtgaagaaccaaggctga

SEQ ID NO: 1106 - protein, 178 aa, Sorghum bicolor
  misc_feature: Ceres ANNOT ID no. 6013369
  misc_feature (20)..(175): Pfam Id: Usp Pfam Desc: Universal stress protein family
  misc_feature (20)..(175): NCBI GI: 5669654 NCBI Desc: er6 protein [lycopersicon esculentum]
  misc_feature (22)..(175): NCBI GI: 18399413 NCBI Desc: universal stress protein (usp) family protein [arabidopsis thaliana]
  misc_feature (22)..(165): NCBI GI: 30681959 NCBI Desc: universal stress protein (usp) family protein [arabidopsis thaliana]
  misc_feature (21)..(175): NCBI GI: 2160182 NCBI Desc: ests gbatts1236,gbt43334,gbn97019,gbaa395203 come from this gene. [arabidopsis thaliana]
  misc_feature (22)..(175): NCBI GI: 92886356 NCBI Desc: universal stress protein (usp) [medicago truncatula]
  misc_feature: The plant is abnormally small.
  misc_feature: Useful for making plants with modulated biomass
  misc_feature: GREAT-hit functional homolog of the protein sequence given in SEQ ID NO 13239
  misc_feature: Useful for making plants with modulated biomass
  misc_feature: Functional homolog of the protein sequence given in SEQ ID NO 13239
MAAPAPHQGQGQQGDHHQPKLQKVMVAVDESECSGHALEWVLRNLAPTLAPPLLVLTVQPHFPLGYVSAAAFGAPLGTVPPVAPELIKSMQEQQRQLTQALLDKVVAICAEHGVAVETIVEVGDAKEMICEAAEMKNVDLLVLGSHSRGPIQRLFLGSVSNYCVHHSKRPVLVVKNQG

SEQ ID NO: 1107 - DNA, 756 bp, Sorghum bicolor
  misc_feature: Ceres ANNOT ID no. 6013371
  misc_feature: Encodes the peptide sequence at SEQ ID NO 1108
atggactcggagcactggatctcgcgcctggccgccgccaagcgctactacgcggcgcagctcggccacgtcgacgatgtgcccgggatggggacggaggaggtggagatggagatggagatggaggacgacggcgacatggagatggagatggagatggagatggcgctggagctcggggacgcgacgtggccggaggttgcctgcccctactgctacgaggaccatgacgtcgcgtccctctgcgtccacctcgaggaggaccacccctacgagccccacgccgcgccctgccccatttgctcccaaaggattacaagagatatgcttaaccatatcaccatgcaacatggttacttgttcaagaatggtcacaggtctcgcagatttattattcctgagagagatgcgatttctttattgagccgagatctgcgtggtactcatttacatgctcttctagggggtgttcatggccacagaacaaataatgcagtggccacaaacatttccagtgatcctcttctttcatcttttggcctgaacttctcaacatcagatgcaccagaaccatcaaaatcagcatcttctattccagatggtgcctcaatacgtaaggagataccagttcagccttgggaatcaagtattgattcatctctgacaagcgaggaaagggagcaaaagcggaaacaagctaccgacagagcaacctttgtgcaaggcctagtgctgtctactctattcggagattga

SEQ ID NO: 1108 - protein, 251 aa, Sorghum bicolor
  misc_feature: Ceres ANNOT ID no. 6013371
  misc_feature (40)..(248): Pfam Id: Di19 Pfam Desc: Drought induced 19 protein (Di19)
  misc_feature (1)..(251): NCBI GI: 56201905 NCBI Desc: fiber protein fb2-like [oryza sativa (japonica cultivar-group)]
  misc_feature (66)..(251): NCBI GI: 45752696 NCBI Desc: at5g26990 [arabidopsis thaliana]
  misc_feature (43)..(251): NCBI GI: 115463401 NCBI Desc: os05g0358000 [oryza sativa (japonica cultivar-group)]
  misc_feature (52)..(251): NCBI GI: 469110 NCBI Desc: di19 [arabidopsis thaliana]
  misc_feature (38)..(251): NCBI GI: 25992529 NCBI Desc: fiber protein fb2 [gossypium barbadense]
MDSEHWISRLAAAKRYYAAQLGHVDDVPGMGTEEVEMEMEMEDDGDMEMEMEMEMALELGDATWPEVACPYCYEDHDVASLCVHLEEDHPYEPHAAPCPICSQRITRDMLNHITMQHGYLFKNGHRSRRFIIPERDAISLLSRDLRGTHLHALLGGVHGHRTNNAVATNISSDPLLSSFGLNFSTSDAPEPSKSASSIPDGASIRKEIPVQPWESSIDSSLTSEEREQKRKQATDRATFVQGLVLSTLFGD

SEQ ID NO: 1109 - DNA, 1212 bp, Sorghum bicolor
  misc_feature: Ceres ANNOT ID no. 6013376
  misc_feature: Encodes the peptide sequence at SEQ ID NO 1110
atggccgacggcgagccttccctcacccgctggaccttcgaggatttcgtggtgtactacgagacgcgcctcggcatccggcgcgaggccaacggcgatgatggcgacgagggcccaacgccgcgcggatccgatcatgcggccggccaccgccccgccgctgcccgcgccaacggcggcggcgcggacctcgccgtcttcgagcagttcgagcggatggagaggaaggtggagatacgcaatggggctatagaggatggtccaccgcagaaacctctacttccttcatttgaatctgcagaaatgcgcaacttagctgagacattgttgagggatataattcgtgggagtccagatgttaaatgggaaagcataaaaggtctggagaatgcaaagcgtcttctcaaagaagcagttgtcatgcccattaaatatcccaaatacttcactggtctgttatcaccttggaaaggcatattactatttggtccacctggaacaggaaagacaatgctagccaaagctgttgctaccgagtgcaaaacaacctttttcaatatttctgcctcatcgattgtgagcaagtggcgtggtgactcggagaaactagtgaaagtattattcgagcttgcaaggcatcatgcaccatctaccattttccttgatgagattgatgctatcattagtcaacgtggtgaagctcgtagcgaacatgaagctagccggcgattgaaaacggagctattaatacagatggatgggttgactaagacagatgagcttgtttttgttctagcagcaacaaatttaccatgggagttggatgcagcaatgctgcgtcggctggagaagcgtattcttgttccattgccagagccagatgctagacaagctatgtttgaagagctcctgccatctacacctggcaaaatggagattccctataatgttcttgtggagaaaactgaaggatattctggctctgatattcgccttgtatgcaaggaagcagcaatgcagcccctaagacggttaatgacagttcttgagcgcaggcaagaagaggtccctgaggatgagttgcctgaagttggcccagtaactacagaagatattgaacttgctttgaggaatacaagaccgtctgctcatcttcatgcacatagatacgaaaagtttaaccaagattatggcagtcatgtccatggctaa

SEQ ID NO: 1110 - protein, 403 aa, Sorghum bicolor
  misc_feature: Ceres ANNOT ID no. 6013376
  misc_feature (158)..(343): Pfam Id: AAA Pfam Desc: ATPase family associated with various cellular activities(AAA)
  misc_feature (2)..(401): NCBI GI: 56201915 NCBI Desc: vacuolar protein sorting factor 4b-like [oryza sativa (japonica cultivar-group)]
  misc_feature (40)..(401): NCBI GI: 115439107 NCBI Desc: os01g0673500 [oryza sativa (japonica cultivar-group)]
  misc_feature (15)..(401): NCBI GI: 32352152 NCBI Desc: katanin [oryza sativa (japonica cultivar-group)]
  misc_feature (2)..(401): NCBI GI: 92889962 NCBI Desc: aaa atpase [medicago truncatula]
  misc_feature (94)..(356): NCBI GI: 89288960 NCBI Desc: atpase, aaa family protein [tetrahymena thermophila sb210]
  misc_feature (123)..(383): SWISSPROT Homolog: EC 3.6.4.3 Meiotic spindle formation protein mei-1
  misc_feature: The sequence is a functional homolog of SEQ ID NO. 471 in the 11/188,298 US application
  misc_feature: The sequence is a functional homolog of SEQ ID NO. 462 in the 11/188,298 US application
MADGEPSLTRWTFEDFVVYYETRLGIRREANGDDGDEGPTPRGSDHAAGHRPAAARANGGGADLAVFEQFERMERKVEIRNGAIEDGPPQKPLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEPDARQAMFEELLPSTPGKMEIPYNVLVEKTEGYSGSDIRLVCKEAAMQPLRRLMTVLERRQEEVPEDELPEVGPVTTEDIELALRNTRPSAHLHAHRYEKFNQDYGSHVHG

SEQ ID NO: 1111 - DNA, 1347 bp, Sorghum bicolor
  misc_feature: Ceres ANNOT ID no. 6013396
  misc_feature: Encodes the peptide sequence at SEQ ID NO 1112
atggcccgaagaaatgccggcgcaatgcagcgggagggttcggcggggtcggttaaggactggtcggaattcgacccctcgccgtcccccaagctggcgtactcgcagtcctacgtcgccatgagagggctgttgacgtcggtggcttctctggaccctgtcctgatgtccagcagcctcaagtctctgtgggcggcactgtcatcgcacaggcacgctcggtccttggagaggccaaagtacaagggggtgaactggaagaggcccatgttccatctgcttgtgtgcttcttggtgggagttttcattggattcacaccactcttctctctcgatttatccaacaacatagattctgaaaacgagacgcttccgttcgatggagatgtggttgacagacaaatgctggagcttaaaagtacaaagttggagccgtttgtggctgcggcagagagtgaagccaccgaagaacaactggttgatgagagtcctccagttcctgcgatgttggatgatgaggcggacttcatcgaagcgtcgcatgtccaaccttctgctaatgactctgactttgttgcgaggaagcagctgataattgtgacgacaacctctgttcgaccacaccaggcatattacttgaatcgtctggctcatgtgttaaaaaatgtgccgccgcctctactgtggattgtggcggagtggccatatcagtcccgtgaaacagcggagatcctgaggtcttctggggttatgtacagacatcttatctgcaatcggaacagcacaaacataaggaagattattgtctgccagaagaacaatgcgatttttcatataaagaagcaccgtttagatggtatagtacattttgctgatgaggagcgagtgtactcagttgatttatttgaagacatgcgaaaaatcaggcgctttggtacgtggccagtagcaacacatgttggagccaggtacaaggtgattttggaaggacccgtttgtaggggtaatcaagtcattggatggcatacaaaccagagaaggggtgtacctcgacgatttccaattggtttttctgggtttgcttttaacagcactatactttgggatccccagagatggaacagccccactttagagtctattatactccattcaggtggcagaggtggcttgcaggagtcaagattcattgagaagcttgtcgaggacgagactcaaatggaaggcctcacagacaactgcactcgggttatggtctggaatttcgacttggaacctccacagctgaattaccctactggctggctgctgcagaagaacctagacataatcgtgcctataacctaa

SEQ ID NO: 1112 - protein, 448 aa, Sorghum bicolor
  misc_feature: Ceres ANNOT ID no. 6013396
  misc_feature (216)..(426): Pfam Id: Glyco_transf_43 Pfam Desc: Glycosyltransferase family 43
  misc_feature (2)..(448): NCBI GI: 63087728 NCBI Desc: glycosyltransferase [saccharum officinarum]
  misc_feature (90)..(442): NCBI GI: 31979313 NCBI Desc: 3-beta-glucuronosyltransferase [hordeum vulgare]
  misc_feature (2)..(432): NCBI GI: 66347206 NCBI Desc: glycosyltransferase [saccharum officinarum]
  misc_feature (120)..(442): NCBI GI: 63087730 NCBI Desc: glycosyltransferase [triticum aestivum]
  misc_feature (74)..(443): NCBI GI: 31979311 NCBI Desc: 3-beta-glucuronosyltransferase [hordeum vulgare]
  misc_feature: Useful for making plants with altered carbohydrate content
  misc_feature: Functional homolog of the protein sequence given in SEQ ID NO 13661
MARRNAGAMQREGSAGSVKDWSEFDPSPSPKLAYSQSYVAMRGLLTSVASLDPVLMSSSLKSLWAALSSHRHARSLERPKYKGVNWKRPMFHLLVCFLVGVFIGFTPLFSLDLSNNIDSENETLPFDGDVVDRQMLELKSTKLEPFVAAAESEATEEQLVDESPPVPAMLDDEADFIEASHVQPSANDSDFVARKQLIIVTTTSVRPHQAYYLNRLAHVLKNVPPPLLWIVAEWPYQSRETAEILRSSGVMYRHLICNRNSTNIRKIIVCQKNNAIFHIKKHRLDGIVHFADEERVYSVDLFEDMRKIRRFGTWPVATHVGARYKVILEGPVCRGNQVIGWHTNQRRGVPRRFPIGFSGFAFNSTILWDPQRWNSPTLESIILHSGGRGGLQESRFIEKLVEDETQMEGLTDNCTRVMVWNFDLEPPQLNYPTGWLLQKNLDIIVPIT

SEQ ID NO: 1113 - DNA, 1299 bp, Sorghum bicolor
  misc_feature: Ceres ANNOT ID no. 6013413
  misc_feature: Encodes the peptide sequence at SEQ ID NO 1114
atggcggagggctcttccaggggttacccatccggctccggggacgggtggagattggtgctccacgaccccgacgtcgtcgaggtgtcggcggagactgccgttgaatggagctcttcccgttcccgtcgcaagaagctgaagctgccccaggttattccttctgacataattgaacttgatgatgatgatcctgatggagttatgataattggtgagaagatatcaaatcagaagaatgagcaagaagttgttcatatggattggccagagcatacaacggaactacagagcggtatgtctacaaatttggctggcccaattttaccatgggggtacatgccttcaactgagatgccacatcagcccagtcaaactaaggttgtcaatactgaaattgatgaaaagtataagacatttaaacagtttgatactgttagtgactacagtgacaatttctacgcattgacaggccaaaggaatgttcatgctgttaagaagccatcaaaggcctgggtgaagcggattcaacatgagtggaaagtcttagagaaggatttgccagagacaatatatgtacgagtttatgaggatagaatggacttgcttagagctgtcatcgttggaccagcaggcactccatatcatgatgggcttttcttctttgatgtctatttcccttctcgatatccaagtaaacctccgctagtgaattaccgatctgggggattgcggcttaacccaaatctctatgagtgtggtaaagtctgccttagcctcttaaacacctggtctggtactggatgcgagatgtggaacccatctaattcaaccatgttgcaagtcctggtctctattcaggccttagtgttgaattccaaaccttatttcaatgaacctgggtatgcaatgcatgctaacacttctcaaggcgagaagcaatcaatggcgtacaatgaagaaacgtttctgctgtcctgcagaacaatgcagtactctcttcggaatccaccaaagcattttgaggacttcattattggccatttccgcaattatgggcgcaaaatcctgaaaggatgcaagtcatacatggctggtgcccaagttggttgccttgtcggagacggcgtgcaggatgttgacgagggtgacaaaagttgctccaacaacttcaaggcctcacttaagccattattcgaggacctactgaaggaattcaccaatataggagtcaactgtgatgaattccggaatcctggaggtactaacattgaagcagacaccatactgaagttatag

SEQ ID NO: 1114 - protein, 432 aa, Sorghum bicolor
  misc_feature: Ceres ANNOT ID no. 6013413
  misc_feature (175)..(324): Pfam Id: UQ_con Pfam Desc: Ubiquitin-conjugating enzyme
  misc_feature (18)..(432): NCBI GI: 50726452 NCBI Desc: ubiquitin-conjugating enzyme-like protein [oryza sativa (japonica cultivar-group)]
  misc_feature (66)..(432): NCBI GI: 55783585 NCBI Desc: ubiquitin-conjugating enzyme e2 [zea mays]
  misc_feature (110)..(416): NCBI GI: 92881363 NCBI Desc: ubiquitin-conjugating enzyme, e2 [medicago truncatula]
  misc_feature (134)..(411): NCBI GI: 15219165 NCBI Desc: ubiquitin-conjugating enzyme family protein [arabidopsis thaliana]
  misc_feature (50)..(404): NCBI GI: 115462765 NCBI Desc: os05g0232500 [oryza sativa (japonica cultivar-group)]
MAEGSSRGYPSGSGDGWRLVLHDPDVVEVSAETAVEWSSSRSRRKKLKLPQVIPSDIIELDDDDPDGVMIIGEKISNQKNEQEVVHMDWPEHTTELQSGMSTNLAGPILPWGYMPSTEMPHQPSQTKVVNTEIDEKYKTFKQFDTVSDYSDNFYALTGQRNVHAVKKPSKAWVKRIQHEWKVLEKDLPETIYVRVYEDRMDLLRAVIVGPAGTPYHDGLFFFDVYFPSRYPSKPPLVNYRSGGLRLNPNLYECGKVCLSLLNTWSGTGCEMWNPSNSTMLQVLVSIQALVLNSKPYFNEPGYAMHANTSQGEKQSMAYNEETFLLSCRTMQYSLRNPPKHFEDFIIGHFRNYGRKILKGCKSYMAGAQVGCLVGDGVQDVDEGDKSCSNNFKASLKPLFEDLLKEFTNIGVNCDEFRNPGGTNIEADTILKL

SEQ ID NO: 1115 - DNA, 2256 bp, Sorghum bicolor
  misc_feature: Ceres ANNOT ID no. 6013419
  misc_feature: Encodes the peptide sequence at SEQ ID NO 1116
atggcggaagtggaggcgccgctcatcgccgaggtggagggggaggagggccttggtggcttccgcgggggctccgcgtccgccggagggggccgctctggcctcggcaacggcgtgcgcggcgcgaggcagtaccaccgccgctcggacgcgctcgcctacggcgaccggtaccagaaggcggcagcgctcgtcgacctcgtcgaagatggtgttggtatccctgaggatgtcttgaatgacacaaggtttgagagggccatgcggttttatttcgtgtatctccgattggattggctctggtcacttaacctatttgctttgattctattgaatttcctagagaagcctctctggtgccaaaaatacgccacacatacttgtgaccaaagggatctttactttcttgggcagctgccatacttaagcaaaacagaatcactcatatatgaggtgcttacccttgtcattcttgtcttggatatcttctacccactttcctatgaaggtttaaatatattctggaagaactccatgaacaaattgaaggttcttcttctcttcatcttagcatgcgacatacttgtgtttatgcttaatcctggacctttcagagtagctccgtacattcgtgttgtatttctaattatgacgatcagggaactgcgaatgtgtgctgttacgctggttggtattgttgggacataccttaatgttttggctctgtcactgttgttcctattatttgcaagctggctagcctatgtaacatttgaggacacgccacaaggaaagatcattttcacatcatacggtacaacgttatatcagatgtttgtcctgttcaccacatccaataatcctgatgtatgggtccctgcttacaagagctctcgttggaacgccctctttattgttatttatgtgctgttaggagtttacttcctaacaaatttaattcttgctgtcatttatgatagctttaaagagcagcttgcaaaacaagttgctcaaatggactctataaggaaaagtattctacagaaggcatttgatctcatcgacactaatggtcagggctaccttaacaaggaacaatgcatatcattacttgatgagctaaataagtacaggtcgttgcccaaaacctcaaaggaagattttgaactaatctttgccgagcttgatcggagtggtgatttcaaggttacctccgaggaatttgctgacctgtgcaatactattgcaataaaattccagaaagaaccaccaccttcatatctggagaagtacccatctttctaccattcaccacagtgtgaaaagttgaagtcctttgtacggagtcgcctgtttgagtatattgttgtctttgttcttctggtgaacctaattgctgtcattattgaaacaacgctagatatagagaacagctcttcacagaaagtgtggcaagaagttgaatttgtctttggatggatctatgttgtggagatggcactcaaaatattttcattaggatttggcgcctattggatggagggtcaaaataagtttgattttgtgcttacttggactatctttattggagagaccctgacatttgcctccccatcaacgcttccttttctttcaaatggagaatggattcgatatcttctccttggaaggatgttgcgtttaacaagaattttgttgcaagttcagcgtttcagagcatttgttgcgacattctttaccctcatgtctagcttgttgccatacttggggattgtgttttgtatactctgtgtatactgctccattggtttacagtttttcggtggcatcgtgtatgcaggaaactcgaagttggaagaaacagatctctacgggaacgattatcttcttttcaacttcaatgactacccaagtggtatggttactctgttcaatttgttagtgatgggcaattggcaaatctggatggagagctatgcacacctgactggaagttcttggagcctggtttattttgtcagtttttaccttatttcagtattactgctgcttaatctgattgtggcatttgtgttggaggcattttttgctgagatggaactagagaaagctggagaagctgatatgcaggattctacccccgaaggaagaaacaagcggcgatccatgcgtgtgaggacgaagggtacgatggttgatattcttctgcaccatatgttgagcaatgaacttgatggatcccaaaactcggattga

SEQ ID NO: 1116 - protein, 751 aa, Sorghum bicolor
  misc_feature: Ceres ANNOT ID no. 6013419
  misc_feature (150)..(324): Pfam Id: Ion_trans Pfam Desc: Ion transport protein
  misc_feature (487)..(691): Pfam Id: Ion_trans Pfam Desc: Ion transport protein
  misc_feature (1)..(751): NCBI GI: 33235553 NCBI Desc: calcium channel [oryza sativa (japonica cultivar-group)]
  misc_feature (1)..(750): NCBI GI: 39545849 NCBI Desc: two-pore calcium channel [hordeum vulgare]
  misc_feature (48)..(751): NCBI GI: 46275794 NCBI Desc: two-pore calcium channel [nicotiana tabacum]
  misc_feature (30)..(751): NCBI GI: 46275792 NCBI Desc: two-pore calcium channel [nicotiana tabacum]
  misc_feature (31)..(744): NCBI GI: 14041819 NCBI Desc: two-pore calcium channel [arabidopsis thaliana]
  misc_feature: Useful for making plants with modulated drought sensitivity
  misc_feature: GREAT-hit functional homolog of the protein sequence given in SEQ ID NO 13367
  misc_feature: Useful for making plants with modulated drought sensitivity
  misc_feature: Functional homolog of the protein sequence given in SEQ ID NO 13367
MAEVEAPLIAEVEGEEGLGGFRGGSASAGGGRSGLGNGVRGARQYHRRSDALAYGDRYQKAAALVDLVEDGVGIPEDVLNDTRFERAMRFYFVYLRLDWLWSLNLFALILLNFLEKPLWCQKYATHTCDQRDLYFLGQLPYLSKTESLIYEVLTLVILVLDIFYPLSYEGLNIFWKNSMNKLKVLLLFILACDILVFMLNPGPFRVAPYIRVVFLIMTIRELRMCAVTLVGIVGTYLNVLALSLLFLLFASWLAYVTFEDTPQGKIIFTSYGTTLYQMFVLFTTSNNPDVWVPAYKSSRWNALFIVIYVLLGVYFLTNLILAVIYDSFKEQLAKQVAQMDSIRKSILQKAFDLIDTNGQGYLNKEQCISLLDELNKYRSLPKTSKEDFELIFAELDRSGDFKVTSEEFADLCNTIAIKFQKEPPPSYLEKYPSFYHSPQCEKLKSFVRSRLFEYIVVFVLLVNLIAVIIETTLDIENSSSQKVWQEVEFVFGWIYVVEMALKIFSLGFGAYWMEGQNKFDFVLTWTIFIGETLTFASPSTLPFLSNGEWIRYLLLGRMLRLTRILLQVQRFRAFVATFFTLMSSLLPYLGIVFCILCVYCSIGLQFFGGIVYAGNSKLEETDLYGNDYLLFNFNDYPSGMVTLFNLLVMGNWQIWMESYAHLTGSSWSLVYFVSFYLISVLLLLNLIVAFVLEAFFAEMELEKAGEADMQDSTPEGRNKRRSMRVRTKGTMVDILLHHMLSNELDGSQNSD

SEQ ID NO: 1117 - DNA, 459 bp, Sorghum bicolor
  misc_feature: Ceres ANNOT ID no. 6013422
  misc_feature: Encodes the peptide sequence at SEQ ID NO 1118
atgaagatagtgcttaaggtggccatcacctgcaagaagtgcaaaacctgcgtccttgggatcgcctcgaaagttaaagggatcaagtccctgacatacgacgaggagaagagcactctcacggtggtcggagacgtggacgtggtggtcatcgtggagcatctgcgcaaggcgaagcatccggcagaggtggtgtcggtgatcgacgagaagaaggagaaggaggccgaggaggcgaagaagaagaaggaggccgaggagaagaagaagaaggaggaggaagagaagaagaagaaagaggaggaggaagaggagaggaggaagaaaaggtgctgccttccgcctccgtgcacgccgtgccctccgccgccgtgcccgccgccgtacccgtacccgtaccccaagccgtgctacatccccgtcgaggacgagtaccccgggccctgcaccatcgtctga

SEQ ID NO: 1118 - protein, 152 aa, Sorghum bicolor
  misc_feature: Ceres ANNOT ID no. 6013422
  misc_feature (3)..(64): Pfam Id: HMA Pfam Desc: Heavy-metal-associated domain
  misc_feature (2)..(125): NCBI GI: 144923987 NCBI Desc: heavy metal transport/detoxification protein [medicago truncatula]
  misc_feature (4)..(110): NCBI GI: 10764865 NCBI Desc: f1k23.4 [arabidopsis thaliana]
  misc_feature (2)..(139): NCBI GI: 116310363 NCBI Desc: osigba0128p10.10 [oryza sativa (indica cultivar-group)]
  misc_feature (27)..(114): NCBI GI: 115478282 NCBI Desc: os09g0271100 [oryza sativa (japonica cultivar-group)]
  misc_feature (2)..(78): NCBI GI: 115458830 NCBI Desc: os04g0464100 [oryza sativa (japonica cultivar-group)]
MKIVLKVAITCKKCKTCVLGIASKVKGIKSLTYDEEKSTLTVVGDVDVVVIVEHLRKAKHPAEVVSVIDEKKEKEAEEAKKKKEAEEKKKKEEEEKKKKEEEEEERRKKRCCLPPPCTPCPPPPCPPPYPYPYPKPCYIPVEDEYPGPCTIV

SEQ ID NO: 1119 - DNA, 1176 bp, Sorghum bicolor
  misc_feature: Ceres ANNOT ID no. 6013437
  misc_feature: Encodes the peptide sequence at SEQ ID NO 1120
atgcccactaccaccccggcccccctcctcgacatgccagcgccgtcgacggacgccacggccactaataatggcgtggcgagtcggcggcggcggcggcggctgctgctgtgcgccaactacgccgcgcttctcggcggctccgtggcttccagcctgctgtcccggtactacttcgcgcacggcgggtgcgatcggtgggtggccacgctggtgcagtcggtcgggttcccggtcctgctcgtgcccgtctatgccggccggtgccggtccgcctcccagtcccagccccggccgttcgcgtggttcacgcggcggctgctggccgcgtgcgtcgtcatcggcgtcctcatgggcgtcaacaacctgctcttctcctacagctcctcgtacctgcccgtgtccacctcctcgctgctgctgtccacgcagctggccttcacgctcgtgctcgccgctgtcatcgtgcgccacccgctcaccttctccaacctcaatgccgtggtgctcctcacgctcagctccgtgctgctggcgctccgatcgtccgactcggccgagcgccccgacggcgggagccgggccaggtacttcgtgggcttcgccgtcacgctcggcgccgcggggctcttcgccgcctacctgccggtgatggagctggtgtaccgcagggccgtgtccggcggcttccgcatggcggtggaggtgcaggtgatcatgcaggccgccgcgacggccctggcggtcgccgggctggccgcggctggtgggtggcgggaggagctggcgcgctgggacctctcgccggccgcgtactgggcggtggtggccgcgctggtggtgacgtggcaggcctgcttcatgggcaccgccgggatggtgtacctgacgtcgtcgctgcacagcggcgtgtgcatgaccgccgtgctgaccgccaacgtgatcggcggcgtggtcgtgttccgcgacccgttcggctgggagaaggccgtggcctcggtgctctgcgtctggggcttctcctcctacctctacggtgagtacagcagcacgcagcaggcgcaggaaggcgacggaaaggtggcggcggccgccggcgatgggcacaagagtgttgctagtggtggtggtggtggtgtgggaggaggaggaggaggtgcagttgaaaccgtctga

SEQ ID NO: 1120 - protein, 391 aa, Sorghum bicolor
  misc_feature: Ceres ANNOT ID no. 6013437
  misc_feature (200)..(345): Pfam Id: TPT Pfam Desc: Triose-phosphate Transporter family
  misc_feature (3)..(387): NCBI GI: 56202284 NCBI Desc: purine permease-like protein [oryza sativa (japonica cultivar-group)]
  misc_feature (28)..(358): NCBI GI: 56201644 NCBI Desc: purine permease-like protein [oryza sativa (japonica cultivar-group)]
  misc_feature (35)..(357): NCBI GI: 42571763 NCBI Desc: purine permease family protein [arabidopsis thaliana]
  misc_feature (36)..(350): NCBI GI: 7620007 NCBI Desc: purine permease [arabidopsis thaliana]
  misc_feature (10)..(358): NCBI GI: 38605752 NCBI Desc: osjnbb0016d16.5 [oryza sativa (japonica cultivar-group)]
MPTTTPAPLLDMPAPSTDATATNNGVASRRRRRRLLLCANYAALLGGSVASSLLSRYYFAHGGCDRWVATLVQSVGFPVLLVPVYAGRCRSASQSQPRPFAWFTRRLLAACVVIGVLMGVNNLLFSYSSSYLPVSTSSLLLSTQLAFTLVLAAVIVRHPLTFSNLNAVVLLTLSSVLLALRSSDSAERPDGGSRARYFVGFAVTLGAAGLFAAYLPVMELVYRRAVSGGFRMAVEVQVIMQAAATALAVAGLAAAGGWREELARWDLSPAAYWAVVAALVVTWQACFMGTAGMVYLTSSLHSGVCMTAVLTANVIGGVVVFRDPFGWEKAVASVLCVWGFSSYLYGEYSSTQQAQEGDGKVAAAAGDGHKSVASGGGGGVGGGGGGAVETV

SEQ ID NO: 1121 - DNA, 612 bp, Sorghum bicolor
  misc_feature: Ceres ANNOT ID no. 6013439
  misc_feature: Encodes the peptide sequence at SEQ ID NO 1122
atgaaggacccgttcgaggcggccgtcgaggagcaggactcgccgccggagtcgccggcgccggccgaggaggaacccggcgccgcgggccccgcggacgaccccgaggactacgacggcggcggcccgcggggcctggccccgcgccagccgtcggccccggcgtcgcacgcagccgccgccgcggctaaggccaagggccgggtccagagggagcagcaggaggatgacgacgatgaggaggaccagatggaggtcgacctcgagaagctgcccagcagcactggcgaccccgacaagctcgccaagatgaatgctatactgtcccaatttacagaacagcagatgaaccgttatgagtcattccgaagatctggatttcagaaatctaacatgaaaaggctgttggtaggcatcactggaagtcagaagatttctatccctacatcaattgtggtatcaggaatagcaaaaatgtttgttgcaagagtagttatgactgagaggaaggattcaggacccattaggccttgccacatcagggaagcatacagaagattgaagcttgaaggcaagatcccacggcgatctgttcctaggctcttccgctag

SEQ ID NO: 1122 - protein, 203 aa, Sorghum bicolor
  misc_feature: Ceres ANNOT ID no. 6013439
  misc_feature (104)..(187): Pfam Id: TAFII28 Pfam Desc: hTAFII28-like protein conserved region
  misc_feature (1)..(203): NCBI GI: 56202287 NCBI Desc: transcription initiation factor iid p30 beta chain-like [oryza sativa (japonica cultivar-group)]
  misc_feature (1)..(203): NCBI GI: 115439185 NCBI Desc: os01g0680400 [oryza sativa (japonica cultivar-group)]
  misc_feature (79)..(203): NCBI GI: 15223727 NCBI Desc: transcription initiation factor iid (tfiid) 28 kda subunit (tafii-28) family protein [arabidopsis thaliana]
  misc_feature (79)..(203): NCBI GI: 8778998 NCBI Desc: contains similarity to pro2134 mrna from homo sapiens gbaf118094. [arabidopsis thaliana]
  misc_feature (21)..(194): NCBI GI: 50540162 NCBI Desc: zgc:92784 [danio rerio]
MKDPFEAAVEEQDSPPESPAPAEEEPGAAGPADDPEDYDGGGPRGLAPRQPSAPASHAAAAAAKAKGRVQREQQEDDDDEEDQMEVDLEKLPSSTGDPDKLAKMNAILSQFTEQQMNRYESFRRSGFQKSNMKRLLVGITGSQKISIPTSIVVSGIAKMFVARVVMTERKDSGPIRPCHIREAYRRLKLEGKIPRRSVPRLFR

SEQ ID NO: 1123 - DNA, 1830 bp, Sorghum bicolor
  misc_feature: Ceres ANNOT ID no. 6013448
  misc_feature: Encodes the peptide sequence at SEQ ID NO 1124
atggagaacctcatctctctcgtcaacaagcttcagcgcgcgtgcaccgccctcggcgaccacggcgaagatagcgcgctccccacactatgggactcgctaccgactatcgcagtcgtcggcggccagagttcgggtaaatcctcggtgttggagagtgtggttgggaaggatttcctacctcggggttcaggaattgttacgaggcgtcccctggttctgcaacttcacaggattgatggggcaggagaatatgcagagttcatgcaccataagaataaaaaattcacagattttgccctagtgaggaaggagattgctgatgaaactgaccgagaaactggccgcacaaagcaaatatcaactgtgcccatttatttgagcatatattccccaaatgttgttaaccttactcttattgatcttcctgggcttactaaggtagctgtagagggacaacctgatagtatcgtgcatgaaattgaaaacatggttcgctcgttcatcgagaagcccaattgcatcattcttgcaatttctccagccaatcaggatcttgcaacatctgatgcaataaagatttcacgtgaagttgatccaaaaggtgaaaggacctttggtgtgcttacaaaaattgacttaatggacaagggcacagatgcagttgatatactagaaggaaggtcctatcgactacaatttccatggattagtgttgtcaatcgttcccaacaagatataaacaagaatgtagacatgattgctgctaggattagagagcgtgaatattttgcaagtctaccagaatataaacaccttgctcacagaatgggatcagagcacttagcaaagatgctttcaaagcatttggaatctgtgattaaatcaagaattccagggatccagtctctaataaccaaggccactgcagatctagaaagtgaactttgtcgtcttggaaaacccattgctgcagatgctggaggaaagctgtacactattatggaaatatgccgcatgtttgacggtatctacaaggagcatctagatggagtgcgttctggtggtgagaagatctactatgtctttgacaaccaatttccagtggctcttaaacggttgcaatttgaaaaacatcttacaatggaaaacataaagaaacttataacacaagctgatggataccaaccacacttaatagctccagagcaaggataccggcgtctaataaagtcctgtctagttagtatgaaaggtccagctgaggcagctgttgatgcggtccatgcaatactcaaggagctagttcacagggctgtaaaggagacacatgagctgaagcagtttccgactcttcgtgtggaagtaagcagtgcagcttttaaagcattggaaagaatgcgggaggagagcaagaaaaatacaatgatgcttgttgatatggagtgcagctatttaactgtagatttctttaggaagcttcctcaggatgttgagaagggtggaagtccaacacactccatctttgatagatacaatgattcgtacctcagacgaattggtagtaatgtacaggcatatgtcaacatggtatgctcaaccttgaggaactccatccccaaatctatcgtttattgccaagtccgtgaggccaagcgctcactactcgatcacttctttacggagttgggagcaagagagaccaagcagctttctaagcttcttgatgaggaccctgaggtcatggagcgcagagctaagcttgcgaagaggttagagctatatcggagcgcccaagcagaaatcgaggcggttgcatgggccaaatag

SEQ ID NO: 1124 - protein, 609 aa, Sorghum bicolor
  misc_feature: Ceres ANNOT ID no. 6013448
  misc_feature (221)..(507): Pfam Id: Dynamin_M Pfam Desc: Dynamin central region
  misc_feature (37)..(212): Pfam Id: Dynamin_N Pfam Desc: Dynamin family
  misc_feature (512)..(605): Pfam Id: GED Pfam Desc: Dynamin GTPase effector domain
  misc_feature (35)..(213): Pfam Id: MMR_HSR1 Pfam Desc: GTPase of unknown function
  misc_feature (1)..(609): NCBI GI: 115465357 NCBI Desc: os05g0556100 [oryza sativa (japonica cultivar-group)]
  misc_feature (1)..(609): NCBI GI: 1218004 NCBI Desc: sdl5a
  misc_feature (1)..(609): NCBI GI: 90995393 NCBI Desc: phragmoplastin [camellia sinensis]
  misc_feature (1)..(609): NCBI GI: 5931765 NCBI Desc: phragmoplastin [nicotiana tabacum]
  misc_feature (1)..(609): NCBI GI: 1217994 NCBI Desc: sdl
MENLISLVNKLQRACTALGDHGEDSALPTLWDSLPTIAVVGGQSSGKSSVLESVVGKDFLPRGSGIVTRRPLVLQLHRIDGAGEYAEFMHHKNKKFTDFALVRKEIADETDRETGRTKQISTVPIYLSIYSPNVVNLTLIDLPGLTKVAVEGQPDSIVHEIENMVRSFIEKPNCIILAISPANQDLATSDAIKISREVDPKGERTFGVLTKIDLMDKGTDAVDILEGRSYRLQFPWISVVNRSQQDINKNVDMIAARIREREYFASLPEYKHLAHRMGSEHLAKMLSKHLESVIKSRIPGIQSLITKATADLESELCRLGKPIAADAGGKLYTIMEICRMFDGIYKEHLDGVRSGGEKIYYVFDNQFPVALKRLQFEKHLTMENIKKLITQADGYQPHLIAPEQGYRRLIKSCLVSMKGPAEAAVDAVHAILKELVHRAVKETHELKQFPTLRVEVSSAAFKALERMREESKKNTMMLVDMECSYLTVDFFRKLPQDVEKGGSPTHSIFDRYNDSYLRRIGSNVQAYVNMVCSTLRNSIPKSIVYCQVREAKRSLLDHFFTELGARETKQLSKLLDEDPEVMERRAKLAKRLELYRSAQAEIEAVAWAK

SEQ ID NO: 1125 - DNA, 1962 bp, Sorghum bicolor
  misc_feature: Ceres ANNOT ID no. 6013450
  misc_feature: Encodes the peptide sequence at SEQ ID NO 1126
atgaagcacctcgtggaggtggagccggcgaaggaggcggcgggtggggcgccgtcggcggggccgacgtaccgatgcgcggccggtgacaactccgcgtcgccgcccgccgtgccggggctcgactgctgctgggacatattccgcatgtccgtcgagaagtaccccgacaacaagatgctgggccgccgcgaaattgtcgacgggaaggctggcagctacacatggctgacttacaagcaggtatacgacaccgtgctcaaggttggggctgccatccggagctgtggcgtcggcaagggcggtcggtgcggcatctatggagccaattctcctgagtgggtcatcagtatgcaggcctgcaatgcccatggcatttactgtgttccactgtatgacacgcttggtgctggggcagtagaatttgtattgtgccatgcagaggtacaaattgcttttgttgaggaaaagaaagttggagagatgctcaagacatttcccaacgcgaccaaatatttgaagacaattgttagcttcggtaaggttgatcccgtgcacaaggaaaaagttgaacagaatggcttgtccatctactcatgggaagagtttctgcaactgggaggtgaagagaagtttgaacttccacccaaggaaaaggatgacatatgcacaataatgtacaccagtgggacaactggtgatcccaagggagtactaatctcgaacaagagcattgttaccattgtttcagcagtagatgagttcctcaacaactcaaacgagcagcttcacggggatgatgtttacatttcatatcttccacttgctcatatctttgaccgggtgattgaggaggtgttcattcgccatggtgcttcaatcggattttggcgtggggatgtcaaactcttggttgaagacattggagaactcaaaccaacagtattttgtgctgttccacgtgttctggacagaatttatggaggattgcaagataaagttacagctggtggtttcttgaagaaaaccttgttcaatgttgcttacaaatacaaacaaggcaatatgttgaagggaagcaagcatgaagaagctgctgcaatctttgatagactggtcttcaccaaggtgaaacggggactaggtggaagggttcgcctgattctatctggcgcagctcccctatctagacatgttgaggagtatctgcgtgtggtgacatgctcccatgtccttcaaggatatggactcacggaaacctgtgctgggtcctttgtttccttgccgaacaacatgtccatgctgggaactgtcggccctccagtcccatacgtcgaagtacgcctggaatctgtccctgagatgggttacgatgcactgtcaagcgagatgcctcgtggggaaatttgcatcagaggggacaccttgttctcggggtactacaagcgagaggacctaaccaacgaagtcttggtcgatggctggttccacacaggagacattggggagtggcagtccgacggaagcatgaagatcattgaccgcaagaagaacattttcaagctctcacaaggagagtacgttgcggttgagaatctggagaacatctttggtcaaactcctggtgttgattcgatttgggtctacggcaacagcttcgagtcaagcctggttgcagttgtgaaccccaacaagcaagcactggaacgttgggcagagtcgaacggggtaaccggagactttgccacgatatgcgaagaccctaaagcgaaagagttcgtcttgggagaacttacaaagatggggaaagaaaagaagctcaaaggcttcgagctcatcagggctgttcatctggaccccgcaccattcgacatggagcgcgatcttatcaccccaacgtacaagaagaagcggcctcagctgctgaaacactatcaggtatgggcgcagtttcaacagtag

SEQ ID NO: 1126 - protein, 653 aa, Sorghum bicolor
  misc_feature: Ceres ANNOT ID no. 6013450
  misc_feature (78)..(548): Pfam Id: AMP-binding Pfam Desc: AMP-binding enzyme
  misc_feature (1)..(646): NCBI GI: 115439199 NCBI Desc: os01g0681200 [oryza sativa (japonica cultivar-group)]
  misc_feature (4)..(646): NCBI GI: 74147576 NCBI Desc: acs-like protein [gossypium hirsutum]
  misc_feature (3)..(646): NCBI GI: 74147588 NCBI Desc: acs-like protein [gossypium hirsutum]
  misc_feature (5)..(646): NCBI GI: 83320523 NCBI Desc: acs1 [ricinus communis]
  misc_feature (2)..(646): NCBI GI: 1617270 NCBI Desc: acyl-coa synthetase [brassica napus]
MKHLVEVEPAKEAAGGAPSAGPTYRCAAGDNSASPPAVPGLDCCWDIFRMSVEKYPDNKMLGRREIVDGKAGSYTWLTYKQVYDTVLKVGAAIRSCGVGKGGRCGIYGANSPEWVISMQACNAHGIYCVPLYDTLGAGAVEFVLCHAEVQIAFVEEKKVGEMLKTFPNATKYLKTIVSFGKVDPVHKEKVEQNGLSIYSWEEFLQLGGEEKFELPPKEKDDICTIMYTSGTTGDPKGVLISNKSIVTIVSAVDEFLNNSNEQLHGDDVYISYLPLAHIFDRVIEEVFIRHGASIGFWRGDVKLLVEDIGELKPTVFCAVPRVLDRIYGGLQDKVTAGGFLKKTLFNVAYKYKQGNMLKGSKHEEAAAIFDRLVFTKVKRGLGGRVRLILSGAAPLSRHVEEYLRVVTCSHVLQGYGLTETCAGSFVSLPNNMSMLGTVGPPVPYVEVRLESVPEMGYDALSSEMPRGEICIRGDTLFSGYYKREDLTNEVLVDGWFHTGDIGEWQSDGSMKIIDRKKNIFKLSQGEYVAVENLENIFGQTPGVDSIWVYGNSFESSLVAVVNPNKQALERWAESNGVTGDFATICEDPKAKEFVLGELTKMGKEKKLKGFELIRAVHLDPAPFDMERDLITPTYKKKRPQLLKHYQVWAQFQQ

SEQ ID NO: 1127 - DNA, 6468 bp, Sorghum bicolor
  misc_feature: Ceres ANNOT ID no. 6013457
  misc_feature: Encodes the peptide sequence at SEQ ID NO 1128
  misc_feature: Down-regulated in root tissues in response to methyl jasmonate treatment
  misc_feature: Up-regulated in shoot tissues in response to salicylic acid treatment
atgtcgacggcgcaagggacagcgttgaagtcggcgccgatggggccaggtcgtcgggcccggcgcggccgccccgtggcggcgccgtaccgttcgggctggcaagcctacggtggcgtttccctcgagggcggcgggttcctcggtggcgtgcagcgcaccgaggagcgcgtcgctccgcgggcgccccgcgcggcggcacgcgacgccgaggtggtgaggccgctctcgaagctcccgaacagcagcattgggctctacaatccctcgttcgagcgcgacgcgtgcggcgttgggtttgtcgctgagctttctggcgattacaagcgcgagactgttaatgatgctattgagatgcttgagagaatggcacaccgtggtgcctgtggctgtgagaagaacacaggagacggtgcgggcatcatggtcgctctaccacatgacttcttcaaagaggtcacaaaggatgctggctttgagctaccgccaccaggcgagtatgctgttggaatgttttttatgccaaccgatgaaaagcgtcgtgagaagggcaaagctgagtttaagaaggtcgcggaatcactgggacatgtaatactcgggtggcgtccggttccaactgataactcagacctgggtgaatctgcactggagactgagccagtcattgagcaggttttcattaccaagagttcaagatcagaggctgagtttgagcaacagctatatatccttaggagactctcaatcatctccgtccgagcagctctgaacattaagcgtggaggagagagggatttctacatgtgttctctgtcttcaaggactattgtttacaagggtcagcttaaaccatgccagcttaaggggtactactatgccgacctaggtcatgaaaacttcacgagttatatggctctggttcactcaaggttctccacaaacacctttcccagctgggaccgtgcacaaccaatgcgcgttttaggtcataatggagagatcaatacccttagaggaaacaagaattggataacagcacgtgagggtctcttagaggctgagaagcttggattatcaaaggagcagctctcaagaattctgccaattgttgatgctacctcttctgattctggcgcattcgataatgttcttgagcttcttgtccgaggtgggcgaagcctgccagaagctgtgatgatgatgatccctgaggcatggcagaatgatggaaacatggatcctgagaagaaagctctctacgagttcctgtcagcacttatggagccttgggatggacctgcactaatatcttttactgatggccgttaccttggagctaccctggaccgtaacggtttgaggcctggtcggttttatgtgacgcacagtgggcgtgtgatcatgggtagtgaggtcggtgttgttgatgttcctcctgaagatgtgctgagaaaaggcaggctaaaccctggaatgatgctattggttgattttgagaatcacactgtagtggacgatgaagctctgaaaacacaatactctaaagctcacccgtatggggaatggcttaaaagacaaaagatacacctcaaggatattgtagaatcagtgccagaaaccgatagagttgctccaagcatttctagctcacttccacaaaagaatgagaacaaggatgatgttggtatcaatgggattttaaccccactgaaggcctttggctacacggtggaagccctggagatgttgctactgccaatggctaaggatggagtggaagctctcggttccatgggaaatgatacaccgcttgcggtgatgtcaaacagggagaaattgacttttgagtacttcaagcagatgtttgcacaagttacaaaccctccgattgaccctattagagagaagattgttacatctatggagtgtatgattggcccagaaggtgacttgttggaaacaactgaaaaacaatgcaaccgccttgcacttaaaggtcccttggtatctattgatgaaatggaggctattaaaaagatggattatcgaggttggcgaagcaaagtgctcgacataacttatccaaaaaagtctggaaggaagggcttggaagaagctttggacagaatttgtgccgaggctcgtgaagccataagcaagggttacactattttggttctctcagatagaggattttcctcggaccgtgttgctaccagttctctcttagcagtgggagcagtgcatcagcaccttgttgcaaatcatgagaggacacgcataggattgttggttgagtcagctgaacctcgtgaagtgcaccatttctgcaccctggttggatttggtgctgatgctatctgcccttatttggctattgaagcaatttggtgcttgcagaatgatggaaagattcctcctaatggtgatggacaactctactcaaaggaagagctggtgaggaagtatttctatgcttctaactatggaatgatgaaagttcttgcgaagatgggaatatccacccttgcatcctacaaaggtgcgcagatttttgaagctcttggtctttcttctgaagtgattggcaagtgttttgaaggcacacctagcagaattgagggtgcaacatttgaaatgcttgcacgggatgctctccgtcttcatgagttagctttcccatcaagaacccctccagctggcagtgcagatgcaaaggcccttcccaacccaggggattaccactggaggaaaaatggtgaaattcatctcaacgacccacttgcaatgggaaaattacaagaagcagctagagtcaacagccgggcagcatacaaagaatattcgaaacgaattcaggagctcaacaaagcgtgcaatctacgtggtatgctgaaatttaaagatatttctgacaagatatctttggatgaggttgaacctgcaagtgagatagtgaaacgcttttgtactggagcgatgagttatggttctatttcattggaagcgcatactgcccttgctattgccatgaacaaacttggaggaaaatctaatacgggtgagggaggggaacagccctctcggatggaaccacttcctgatggctcaatgaacccaagacgaagtgcgatcaagcaagttgctagtggacgttttggagtttccagctattacctgactaatgcagatgagctgcagataaaaatggctcagggtgccaaacctggtgaaggtggtgagcttccaggccacaaggttattggtgacattgctgtcacaagacattccacagctggtgtaggactgattagtccacctccgcatcatgatatctattcgattgaggatcttgcacagcttatacatgatcttaagaattcaaatcctggagcccgtatcagtgtgaaactagtttctgaggctggtgtgggggttgttgctagtggtgttgtaaaaggacacgcagatcatgttcttatttctggccatgatggaggcacaggagcttcaagatggactggtatcaagaatgcgggacttccatgggaactcgggttggctgagacacatcaaactctagtagcaaatgggcttcgtggtcgagcagttctgcaaacagatggacagttgaagactggtagagatgttgctgttgcttgcttgcttggtgcagaggaatttggtttcagcactgcaccactgatcacacttggctgtattatgatgcgaaaatgtcacatgaacacttgtcctgttggtatagctactcaagacccagtgcttcgagaaaagtttgctggagaaccagagcatgtcattaactttttcttcatgcttgctgaggagctaagagaaatcatggcaaaccttgggttccgcaccattactgaaatggttggacgttctgatatgcttgaggttgatccagaagtagtgaagagcaatgagaaacttgagaacattgatctctcactaatcttgaaaccagcttcagagattcgtccaggtgttgctcagtactgtgttgagaagcaagaccacggcctagatatggcgttagataacaaactaatagatttgtcaagaactgctattgaaaagcaagtccgtgttttcattgagactccaatccagaacacgaaccgagcagttggaactatgctcagtcatgaagtcacaaaacgttatcacatgagtggattgcctgctggtacaattcatgtgaagtttactggaagtgctggtcaaagttttggtgcttttctttgtcctggaatcactcttgaactggaaggagacagcaatgattatgtcggtaagggcttatctggtggaaaaattgttgtgtacccaccaaggaacagttcttttgttccagaggataatattgtcattggtaatgtggctctatatggtgctaccaagggagaggcatatttcaatggtatggcagcagaaaggttttgtgttcgcaactcaggtgctcaagcagtggttgaaggaattggagatcatggatgtgagtacatgactggaggtgctgtggttatcctcggaaaaacagggcggaactttgctgctggcatgagtggaggcattgcctatgtttatgatgttgatgggaaattcagtgctcgctgcaacaatgagttagttgacctatatcatgtggaggaagaggatgacatcatcacattgaaaatgatgattgagcaacatcgtcgcaacactgagagtgttttggctagagacatactctccgattttgataatcttcttccaaaatttgtaaaagtatatccaagggattataagagggttttagaaaacatgaaggcggaaaaggctgttgctaagcatgcaaaggagcctaaggtggcaaatggaatttctgtgacaactaagaaagtacaacctgatcagtcagcaagccgaccaacacgtgttgccaatgccaaaaagtatcgaggttttattacatatgagcgagagagtatttcttacagagatccaaaagagcgtgttaaagattggaaggaagttgcaattgaatcaacacctggcccactattaaatacacaatctgctcgttgcatggactgtggcactcctttctgtcatcaggaaagctcaggtgctggttgccctcttggaaataaaatcccagaattcaatgaattagttcaccagaacagatggcgcgaagcattggatcgattacttgagacaaacaacttccctgaatttactggacgagtttgccctgctccttgtgaggggtcatgtgttcttgggatcattgagaatccggtgtctatcaaaagtatagaatgtgcaatcatagacaaaggtttcgaagagggatggatggttccacgacctccacttcaaagaacaggtggaccagctggtttggctgctgcagatcaactaaataaaatgggccatttcgtaactgtgtttgaacgtgcagaccgaattggaggtttaatgatgtatggtgtgcctaacatgaagacagacaagattggcattgtccagcgccgtgttaatttaatggctgaagagggtgtcacatttgtggtgaatgccagtgttggtagtgatcctttgtactcaattgaacgtctacgttctgagaatgatgcagttattttggcttgtggagcaacaaaaccaagagacctcactatccctggacgtgagctatctggagttcattttgcaatggaatttctccatgcaaataccaaaagtttactcgacagcaacctggaggatggtaaatatatatccgcccgtggaaaaaaggtggtggttatcggtggaggtgatacaggcacagattgcattggcacatctattaggcatggttgcaccaaccttgtaaatcttgaactcctgtcaaaaccaccaagcaatagagctgctgacaacccatggccgcagtggccaagaattttccgtgttgactatggtcatcaagaagctgctaccaagtttgggaaggatccaagaacttatgaagtcttgacaaagcgttttattggcgatgaaaatggcaaggtgaaggcccttgaggtagtgcgtgtgaagtgggagaaggtagatggaagatttcaactcaaggagatcgaaggatcagaagagattattgaggctgatctcgtcctcctggctatgggattcttgggtcctgaagcgactatcgctgagaaactgggtttggagaaggacaacagatcaaacttcaaagcgcagtttggagactttgcgaccagtgttgatggtgtgtttgcagccggggactgtagacgtggacaatcactggtggtttgggccatcacggaggggcggcaggctgctgcagcggtagacaagtacttatcaaggtatgatcagaatgctgcaggcgacatcactccctccggggcagggctcgttcagcctgttgcggcataa

SEQ ID NO: 1128 - protein, 2155 aa, Sorghum bicolor
  misc_feature: Ceres ANNOT ID no. 6013457
  misc_feature (924)..(1295): Pfam Id: Glu_synthase Pfam Desc: Conserved region in glutamate synthase
  misc_feature (96)..(473): Pfam Id: GATase_2 Pfam Desc: Glutamine amidotransferases class-II
  misc_feature (567)..(860): Pfam Id: Glu_syn_central Pfam Desc: Glutamate synthase central domain
  misc_feature (1375)..(1571): Pfam Id: GXGXG Pfam Desc: GXGXG motif
  misc_feature (1802)..(2111): Pfam Id: Pyr_redox_2 Pfam Desc: Pyridine nucleotide-disulphide oxidoreductase
  misc_feature (1)..(2155): NCBI GI: 115439209 NCBI Desc: os01g0681900 [oryza sativa (japonica cultivar-group)]
  misc_feature (1)..(2155): NCBI GI: 4008156 NCBI Desc: nadh dependent glutamate synthase [oryza sativa]
  misc_feature (63)..(1645): NCBI GI: 8843775 NCBI Desc: nadh-dependent glutamate synthase [arabidopsis thaliana]
  misc_feature (39)..(1625): NCBI GI: 417073 NCBI Desc: glutamate synthase [nadh], chloroplast precursor (nadh-gogat)
  misc_feature (39)..(1625): NCBI GI: 1066499 NCBI Desc: nadh-dependent glutamate synthase [medicago sativa]
  misc_feature (39)..(1625): SWISSPROT Homolog: EC 1.4.1.14 Glutamate synthase [NADH], chloroplast precursor
  misc_feature (532)..(1614): SWISSPROT Homolog: EC 1.4.7.1 Ferredoxin-dependent glutamate synthase 1
  misc_feature (811)..(1640): SWISSPROT Homolog: EC 1.4.1.13 Glutamate synthase [NADPH] large chain
  misc_feature: Down-regulated in root tissues in response to methyl jasmonate treatment
  misc_feature: Up-regulated in shoot tissues in response to salicylic acid treatment
MSTAQGTALKSAPMGPGRRARRGRPVAAPYRSGWQAYGGVSLEGGGFLGGVQRTEERVAPRAPRAAARDAEVVRPLSKLPNSSIGLYNPSFERDACGVGFVAELSGDYKRETVNDAIEMLERMAHRGACGCEKNTGDGAGIMVALPHDFFKEVTKDAGFELPPPGEYAVGMFFMPTDEKRREKGKAEFKKVAESLGHVILGWRPVPTDNSDLGESALETEPVIEQVFITKSSRSEAEFEQQLYILRRLSIISVRAALNIKRGGERDFYMCSLSSRTIVYKGQLKPCQLKGYYYADLGHENFTSYMALVHSRFSTNTFPSWDRAQPMRVLGHNGEINTLRGNKNWITAREGLLEAEKLGLSKEQLSRILPIVDATSSDSGAFDNVLELLVRGGRSLPEAVMMMIPEAWQNDGNMDPEKKALYEFLSALMEPWDGPALISFTDGRYLGATLDRNGLRPGRFYVTHSGRVIMGSEVGVVDVPPEDVLRKGRLNPGMMLLVDFENHTVVDDEALKTQYSKAHPYGEWLKRQKIHLKDIVESVPETDRVAPSISSSLPQKNENKDDVGINGILTPLKAFGYTVEALEMLLLPMAKDGVEALGSMGNDTPLAVMSNREKLTFEYFKQMFAQVTNPPIDPIREKIVTSMECMIGPEGDLLETTEKQCNRLALKGPLVSIDEMEAIKKMDYRGWRSKVLDITYPKKSGRKGLEEALDRICAEAREAISKGYTILVLSDRGFSSDRVATSSLLAVGAVHQHLVANHERTRIGLLVESAEPREVHHFCTLVGFGADAICPYLAIEAIWCLQNDGKIPPNGDGQLYSKEELVRKYFYASNYGMMKVLAKMGISTLASYKGAQIFEALGLSSEVIGKCFEGTPSRIEGATFEMLARDALRLHELAFPSRTPPAGSADAKALPNPGDYHWRKNGEIHLNDPLAMGKLQEAARVNSRAAYKEYSKRIQELNKACNLRGMLKFKDISDKISLDEVEPASEIVKRFCTGAMSYGSISLEAHTALAIAMNKLGGKSNTGEGGEQPSRMEPLPDGSMNPRRSAIKQVASGRFGVSSYYLTNADELQIKMAQGAKPGEGGELPGHKVIGDIAVTRHSTAGVGLISPPPHHDIYSIEDLAQLIHDLKNSNPGARISVKLVSEAGVGVVASGVVKGHADHVLISGHDGGTGASRWTGIKNAGLPWELGLAETHQTLVANGLRGRAVLQTDGQLKTGRDVAVACLLGAEEFGFSTAPLITLGCIMMRKCHMNTCPVGIATQDPVLREKFAGEPEHVINFFFMLAEELREIMANLGFRTITEMVGRSDMLEVDPEVVKSNEKLENIDLSLILKPASEIRPGVAQYCVEKQDHGLDMALDNKLIDLSRTAIEKQVRVFIETPIQNTNRAVGTMLSHEVTKRYHMSGLPAGTIHVKFTGSAGQSFGAFLCPGITLELEGDSNDYVGKGLSGGKIVVYPPRNSSFVPEDNIVIGNVALYGATKGEAYFNGMAAERFCVRNSGAQAVVEGIGDHGCEYMTGGAVVILGKTGRNFAAGMSGGIAYVYDVDGKFSARCNNELVDLYHVEEEDDIITLKMMIEQHRRNTESVLARDILSDFDNLLPKFVKVYPRDYKRVLENMKAEKAVAKHAKEPKVANGISVTTKKVQPDQSASRPTRVANAKKYRGFITYERESISYRDPKERVKDWKEVAIESTPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMVPRPPLQRTGGPAGLAAADQLNKMGHFVTVFERADRIGGLMMYGVPNMKTDKIGIVQRRVNLMAEEGVTFVVNASVGSDPLYSIERLRSENDAVILACGATKPRDLTIPGRELSGVHFAMEFLHANTKSLLDSNLEDGKYISARGKKVVVIGGGDTGTDCIGTSIRHGCTNLVNLELLSKPPSNRAADNPWPQWPRIFRVDYGHQEAATKFGKDPRTYEVLTKRFIGDENGKVKALEVVRVKWEKVDGRFQLKEIEGSEEIIEADLVLLAMGFLGPEATIAEKLGLEKDNRSNFKAQFGDFATSVDGVFAAGDCRRGQSLVVWAITEGRQAAAAVDKYLSRYDQNAAGDITPSGAGLVQPVAA

SEQ ID NO: 1129 - DNA, 2103 bp, Sorghum bicolor
  misc_feature: Ceres ANNOT ID no. 6013461
  misc_feature: Encodes the peptide sequence at SEQ ID NO 1130
atgaagtcgttagccaagcaagagacacagccaaaaccgcggctcattgtgcgccttggtgcattccttgcgtctcaccacattctcttcagtgttatatgctgctttgcaggcattatcgcactactactccttccatcacttgcaaaaaacacatacctctcggagaatgctcttatacctggctctgccaatccattattttctactgaagatgccatcgaagcaaacagatttatgaaaggaattgaagctgcggctagagactcaagagaagtgtgttaccataagtttctccctcatagcaagaattttcatcctctgaagttcttcacctccatgacaaatgatattgcaattcaacctaatggcacgaccaccaattttgggatgaatactgtcggcattgtacgagctcctcgtggcgatggaaaagaagcaatagtgctggttactccttataattctcaaagagttcagtcaaatgaactattatcgctggctcttggtttctctgtcttctccctcttaagtcgagcagcatggctgtccaaggatgttgtgtggttatccgcagactcacagttcggagagtatgcggcagtctctgcatggttaaaccagtatcataatcctgtgtttttgagtcactcagtgggattgcataccaagatgtatggtgcaaaccatttatatgatgctaattcagaaaaaacggaagtcacagctttcaaacgtgctggaacaatggctgctgctctcatatttaaagttggggaaaccagaagatttagtgacagagatagtgttatgatttatgcagaggcgtctaatggacaaatgccaaacttggaccttctgaatgtggtgcattatttggctgttcatagacaaggttttcgtgtgaacatcgctgcatttagttctttgttgagctctgcatggcttagggttattgccgaaattttacatactcttgggagtgtgttaagaaaaataaatcctgactggaagcttgatattgcagtccctgactatgtggaagggactgcaaacctagctaactctatgtacaaccaggctcttggagtgcccacagggtcccatggtgctttccgtgattatcaagttgatgcggtttctttagaattttcaccaacatttcatgtcaaaaatgagaatgctaaatctttgtttcttctaaggggtggaaggttaattgaaggagtggcacgttctgtgaacaatctgcttgagaagttccaccagtcctttttcctgtacttccttacagctccaagcaagttcatttcggttggtgtgtatatgattccatttgcattgttgctggcacctctcccaatagttgctgctgcccttgctgatggcagtagaagcatggaaaaaacagttgataagctgacagacgacagtaaagcagatgactttgctgatattctgcaaagcaagggtggatcatggaaatggcttcgagctgcaaaagtattgcttgttatccaattatgggcagtacttgtttcactacttccatattacattactcagatacctgatgccacacctatgcaaagcgcactcatttgggctgtgctctccatcgttgtactgatctccctgtctgtcttgtttggctcaccatactcagctggtgttgaatggaaacttctgaaagctaccatgatcacttccatctccatcgggttggggctcatgtcaataataaattttgccactgctcagcttggtgctctgatagtgatcccaatgtgtttgttttctcggcctctgaaggcatcagagatgaatttccttcctcgggcagttttgttggcttcaaatatagcctttgctgtgttgggttttcctccagctgcgttgctgattatgaaaggagtgtccaaggggtcgtggtcgtggacaatagatattggagatttctgggtatggatggagtttctgtgggaatggagcagcgcaacttatctgtacctatttcttgtccatcttccctgctggcttctgtgcatccttgtgttgctgcacccatgtcgccaatcagaatctaagatgaagcaggaatag

SEQ ID NO: 1130 - protein, 700 aa, Sorghum bicolor
  misc_feature: Ceres ANNOT ID no. 6013461
  misc_feature (129)..(689): Pfam Id: Gaa1 Pfam Desc: Gaa1-like, GPI transamidase component
  misc_feature (92)..(669): NCBI GI: 115439211 NCBI Desc: os01g0682200 [oryza sativa (japonica cultivar-group)]
  misc_feature (9)..(690): NCBI GI: 144924584 NCBI Desc: gaa1-like, gpi transamidase component [medicago truncatula]
  misc_feature (12)..(689): NCBI GI: 42573427 NCBI Desc: gpi transamidase component family protein / gaa1-like family protein [arabidopsis thaliana]
  misc_feature (12)..(689): NCBI GI: 30687160 NCBI Desc: gpi transamidase component family protein / gaa1-like family protein [arabidopsis thaliana]
  misc_feature (12)..(689): NCBI GI: 27311615 NCBI Desc: gpaa1 - like protein [arabidopsis thaliana]
MKSLAKQETQPKPRLIVRLGAFLASHHILFSVICCFAGIIALLLLPSLAKNTYLSENALIPGSANPLFSTEDAIEANRFMKGIEAAARDSREVCYHKFLPHSKNFHPLKFFTSMTNDIAIQPNGTTTNFGMNTVGIVRAPRGDGKEAIVLVTPYNSQRVQSNELLSLALGFSVFSLLSRAAWLSKDVVWLSADSQFGEYAAVSAWLNQYHNPVFLSHSVGLHTKMYGANHLYDANSEKTEVTAFKRAGTMAAALIFKVGETRRFSDRDSVMIYAEASNGQMPNLDLLNVVHYLAVHRQGFRVNIAAFSSLLSSAWLRVIAEILHTLGSVLRKINPDWKLDIAVPDYVEGTANLANSMYNQALGVPTGSHGAFRDYQVDAVSLEFSPTFHVKNENAKSLFLLRGGRLIEGVARSVNNLLEKFHQSFFLYFLTAPSKFISVGVYMIPFALLLAPLPIVAAALADGSRSMEKTVDKLTDDSKADDFADILQSKGGSWKWLRAAKVLLVIQLWAVLVSLLPYYITQIPDATPMQSALIWAVLSIVVLISLSVLFGSPYSAGVEWKLLKATMITSISIGLGLMSIINFATAQLGALIVIPMCLFSRPLKASEMNFLPRAVLLASNIAFAVLGFPPAALLIMKGVSKGSWSWTIDIGDFWVWMEFLWEWSSATYLYLFLVHLPCWLLCILVLLHPCRQSESKMKQE

SEQ ID NO: 1131 - DNA, 1002 bp, Sorghum bicolor
  misc_feature: Ceres ANNOT ID no. 6013478
  misc_feature: Encodes the peptide sequence at SEQ ID NO 1132
atgggtcgggcgccgtgctgcgacaagacgagtgtgaagcgggggccgtggtcgccagaggaggacgagctgctgcggagctacgtccacaaccacggcaccggcggcaactggatcgcgctaccgcacaaagcagggctgaaccggtgcggcaagagctgccggctgcggtggctcaactacctgcgcccggacatcaagcacggcggctacacggagcaggaggacaggatcatctgctccctctacaactccatcgggagcaggtggtccatcatcgcgtccaagctgccgggccggacggacaacgacgtcaagaactactggaacaccaagctcaagaagaaggcaatcgccaatatgcagcagcagcaggaggagtactaccaccaccaccagcagcacagctcaggcggcgggcgcggccgccgcggcggtgccgccgccgccgtcacgccgcgcgccgctccgcggagccagcaatgcgcatcatccatgcagccgtctcccgcgtccgcctcgtccgcggtcaccaccgcgagcgccagcgacgcgtgcagcttcggcgccatgtacccttccccgtcgacgacgacgctgcaggctgctgctccggtgctcgcgcgctacgacggcacggcgccagcgccgccactgccgccgccgccgccgcagcagcagcagcagcagcaagcgtctgcgctcgccgagttctcccccgcgccggcaccggccaccgccatcagcggcacctgggccgccgggctgcccctcgacgacatgttcctgcccgagctcctcggggacagcgagttcccgcccggcggcgacttcttcggcaccgggttcgccccgctgctgctgcaagacagggcggcgtcggcgtccctgcaggagctctccgcgtgctactttcccaacgcgcaggccgagatgtgggcggccgcggatcatcacgttcatgtcaagccgccggccggcctctgccacagcctgacatga

SEQ ID NO: 1132 - protein, 333 aa, Sorghum bicolor
  misc_feature: Ceres ANNOT ID no. 6013478
  misc_feature (14)..(62): Pfam Id: Myb_DNA-binding Pfam Desc: Myb-like DNA-binding domain
  misc_feature (68)..(113): Pfam Id: Myb_DNA-binding Pfam Desc: Myb-like DNA-binding domain
  misc_feature (1)..(118): NCBI GI: 50726324 NCBI Desc: r2r3-myb transcription factor-like protein [oryza sativa (japonica cultivar-group)]
  misc_feature (1)..(119): NCBI GI: 71534140 NCBI Desc: myb-like protein [humulus lupulus]
  misc_feature (1)..(119): NCBI GI: 57899538 NCBI Desc: blind-like [oryza sativa (japonica cultivar-group)]
  misc_feature (1)..(275): NCBI GI: 47497161 NCBI Desc: r2r3-myb transcription factor-like [oryza sativa (japonica cultivar-group)]
  misc_feature (1)..(119): NCBI GI: 114384141 NCBI Desc: transcription factor mybj6 [glycine max]
  misc_feature: Useful for making plants with modulated nitrogen use efficiency
  misc_feature: Functional homolog of the protein sequence given in SEQ ID NO 13671
  misc_feature: The sequence is a functional homolog of SEQ ID NO 1004 in the 11/435,388 US patent application
  misc_feature: Useful for making plants with altered alkaloid content
  misc_feature: Useful for making plants with altered lignin content
  misc_feature: Functional homolog of the protein sequence given in SEQ ID NO 13600
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1564 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 126 in the 10/412,699 US patent application
  misc_feature: Useful for making plants with modulated biomass
  misc_feature: Useful for making plants with modulated flowering time
  misc_feature: Functional homolog of the protein sequence given in SEQ ID NO 13601
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MGRAPCCDKTSVKRGPWSPEEDELLRSYVHNHGTGGNWIALPHKAGLNRCGKSCRLRWLNYLRPDIKHGGYTEQEDRIICSLYNSIGSRWSIIASKLPGRTDNDVKNYWNTKLKKKAIANMQQQQEEYYHHHQQHSSGGGRGRRGGAAAAVTPRAAPRSQQCASSMQPSPASASSAVTTASASDACSFGAMYPSPSTTTLQAAAPVLARYDGTAPAPPLPPPPPQQQQQQQASALAEFSPAPAPATAISGTWAAGLPLDDMFLPELLGDSEFPPGGDFFGTGFAPLLLQDRAASASLQELSACYFPNAQAEMWAAADHHVHVKPPAGLCHSLT

SEQ ID NO: 1133 - DNA, 1059 bp, Sorghum bicolor
  misc_feature: Ceres ANNOT ID no. 6013486
  misc_feature: Encodes the peptide sequence at SEQ ID NO 1134
atggccggaataaggcttacgcccgaggagcccgagatgcccgttggcacgccaccccgcccccagctcccaccctccgtcgccggggcaggcggtggcagcggagggctggaaatggcgtcggacgacgagcggtccattgcggcggactcatggtcagtgcggagcgagtacgggagcacgctcgacgacgaccagcgctacgccgacgccgccgaggtgctcgccgcttccgcggcctccgccaacttcccctccgccgcctccgattactgctctgataaggatgatgaagatcctggtgatgttgaaggatcaatgctgggtctccaaagttattgggatgcttcttatttggaagatcttgcaaattttcaggaacatgggcatactggagaaatatggtttggtgcagatgtaatggacacagttgctgtttggacgaaaagtttgtgtagtattattgaaggcaggattccatctggtcaagacagcatcgaaagtgaagtagatgaaaatttattctccaactaccctgttcttgatgttggaactggaaatggccttcttttgcaagcacttgctaagcaggggtttacagacttaaccggaacagattacagtaaaggagctgttgaacttgcaagaaacctagctgctcgtgatggcttctcttcaataaactttttggttgatgatatacttgagacaaagttagataggaaattcaaaattattacagacaaagggacattggatgccattggattgcatccagatggtcgtgcgaaaagaataatatattgggaatctgtatcgaacttggttgaacctggtggcattgtggtcataacatcatgtaatcacacaaaggatgagctcctgcaagaagtagaagatttcaccaagagaaaatttggcaaggagaacgtggatgaaggtgcaggagatgtgtctgagatcttccggtacatagaccatgtccgaacatatcctaccataatgtttggaggaattgagggctctcaagtctgcactgtggcctttcagcgggtgtga

SEQ ID NO: 1134 - protein, 352 aa, Sorghum bicolor
  misc_feature: Ceres ANNOT ID no. 6013486
  misc_feature (181)..(282): Pfam Id: Methyltransf_12 Pfam Desc: Methyltransferase domain
  misc_feature (181)..(284): Pfam Id: Methyltransf_11 Pfam Desc: Methyltransferase domain
  misc_feature (1)..(351): NCBI GI: 92897434 NCBI Desc: sam (and some other nucleotide) binding motif [medicago truncatula]
  misc_feature (39)..(351): NCBI GI: 4760710 NCBI Desc: sll2-s9-protein [brassica rapa]
  misc_feature (39)..(351): NCBI GI: 1518113 NCBI Desc: sll2
  misc_feature (1)..(317): NCBI GI: 1669601 NCBI Desc: ar401 [arabidopsis thaliana]
  misc_feature (61)..(351): NCBI GI: 110736480 NCBI Desc: ar401 [arabidopsis thaliana]
  misc_feature: The sequence is a functional homolog of SEQ ID NO. 415 in the 11/188,298 US application
MAGIRLTPEEPEMPVGTPPRPQLPPSVAGAGGGSGGLEMASDDERSIAADSWSVRSEYGSTLDDDQRYADAAEVLAASAASANFPSAASDYCSDKDDEDPGDVEGSMLGLQSYWDASYLEDLANFQEHGHTGEIWFGADVMDTVAVWTKSLCSIIEGRIPSGQDSIESEVDENLFSNYPVLDVGTGNGLLLQALAKQGFTDLTGTDYSKGAVELARNLAARDGFSSINFLVDDILETKLDRKFKIITDKGTLDAIGLHPDGRAKRIIYWESVSNLVEPGGIVVITSCNHTKDELLQEVEDFTKRKFGKENVDEGAGDVSEIFRYIDHVRTYPTIMFGGIEGSQVCTVAFQRV

SEQ ID NO: 1135 - DNA, 804 bp, Sorghum bicolor
  misc_feature: Ceres ANNOT ID no. 6013487
  misc_feature: Encodes the peptide sequence at SEQ ID NO 1136
atggcggaccacttcgcgctgatgacgggccggctgctcacggagtcgacgctccagtccgctgtccacgaggcctttgccgatgccgccgtagcttccacagccgccggcagctacgaccagaccgatccctccgtcgttcttcctgaagaagatgttcagctgggcaagggcaaggccaagagtggcgtcatggtggagtgcagaatctgccaagaggaaggtgacgaggcttacatggagaccccctgctcctgcaagggcagcttgaagtacgctcaccacagatgcgtccagcggtggtgtaacgagaagggagacaccatatgtgagatatgcttgcagcaattgaaaccaaactacactgctcctttgtttcggcatggaaggaacctaataaatttaagggcagctggagaaatacgagaaaacctcggtgctagttatggtcacacctcggatcaagctgatggcacatcaagcgttgattctcaaagtcccaacctgaaaggcgtcatatattgccgagtaattgccattgctttgatggttttgttggtgctccgtgacgcaatcttgcttatactccacaaccatgaagtgtgctcagtagagctaatcactctgctgatgttcagaacggctggaattgtcataccaatctacatcatcttgatatcaattacggcattgcttcattcgtgcaatcaacgacagatctttagaatccaggctgtgcacgagatgccggcttcagaacttcgtggagcagggggtttgcagcatatcataaacatctggtag

SEQ ID NO: 1136 - protein, 267 aa, Sorghum bicolor
  misc_feature: Ceres ANNOT ID no. 6013487
  misc_feature (68)..(113): Pfam Id: zf-C3HC4 Pfam Desc: Zinc finger, C3HC4 type (RING finger)
  misc_feature (1)..(239): NCBI GI: 115434232 NCBI Desc: os01g0121200 [oryza sativa (japonica cultivar-group)]
  misc_feature (1)..(234): NCBI GI: 79316317 NCBI Desc: protein binding / ubiquitin-protein ligase/ zinc ion binding [arabidopsis thaliana]
  misc_feature (1)..(239): NCBI GI: 30692888 NCBI Desc: zinc finger (c3hc4-type ring finger) family protein [arabidopsis thaliana]
  misc_feature (66)..(255): NCBI GI: 92897430 NCBI Desc: zinc finger, ring-type; ringv [medicago truncatula]
  misc_feature (60)..(262): NCBI GI: 115463379 NCBI Desc: os05g0355300 [oryza sativa (japonica cultivar-group)]
  misc_feature: Useful for making plants with altered terpenoid content
  misc_feature: Functional homolog of the protein sequence given in SEQ ID NO 13104
MADHFALMTGRLLTESTLQSAVHEAFADAAVASTAAGSYDQTDPSVVLPEEDVQLGKGKAKSGVMVECRICQEEGDEAYMETPCSCKGSLKYAHHRCVQRWCNEKGDTICEICLQQLKPNYTAPLFRHGRNLINLRAAGEIRENLGASYGHTSDQADGTSSVDSQSPNLKGVIYCRVIAIALMVLLVLRDAILLILHNHEVCSVELITLLMFRTAGIVIPIYIILISITALLHSCNQRQIFRIQAVHEMPASELRGAGGLQHIINIW

SEQ ID NO: 1137 - DNA, 1083 bp, Sorghum bicolor
  misc_feature: Ceres ANNOT ID no. 6013490
  misc_feature: Encodes the peptide sequence at SEQ ID NO 1138
atggcgcggtactctccaccgtcgctgcgccgcttcttccgctgcgccgccagctccgcctctcgagccggaggcagcggcactgggaagaagaaccttgtattcttgggctcgccgcaggtggccgcctcggtcctggacaagctgctgggcgcgtctggctccccggaatccgcatttaaggtggctgccgtcgtgacgcagccgccggccgccaagaacagggggaggaagctgttgccgtcggccgtcgcgcagttggcgctcgaccgcgggttcccagaggaactcatcttcacgccagaacgagcccgggaggagtcgttcctgtcggccctgaaggaagtggaaccggatgtttgcgtaactgctgcttacgggaacattctgccccagaaatttcttgatatcccatcgtgcggcacagttaatatacacccaagtttgttgcctctatatcgtggtgcagctcctgtgcagagggcactgcaggatggtgttgcagaaacaggtgtttcccttgcatatactgttcgtgcattggattcaggtccagtgattgcgtgtgaaaggttttctgttgatgaatgcattaaggcaccagagctactttctatcctgtttgatttaggatccaagctattgattaatgaactgccatcgattcttgatggttcggctaaagaaaaggcacaaccacaggatgactccaaagctacactagcaccaaagttaaattctgaggagtcatggctatcatttgaccaagaagctaaagtgctccataacaaggtgcgggcatttgcaggatggcctgggacacgtgcaaagctgcaactcgtaaaccaaaacagtgtgcctgatgtgctagagattaaggttatcagcacaaaggtttcaacatcatgtgtcaaagctggagatgaaaatgagatactattctccgggagctcgttgctgattccttgcagtggttcaacctggcttgaggttttggagcttcaactccctggaaagaaagtaacaaaggcacaagatttttggaatggtttgcgtggtcagaagctgatgaaattgccatag

SEQ ID NO: 1138 - protein, 360 aa, Sorghum bicolor
  misc_feature: Ceres ANNOT ID no. 6013490
  misc_feature (31)..(219): Pfam Id: Formyl_trans_N Pfam Desc: Formyl transferase
  misc_feature (244)..(352): Pfam Id: Formyl_trans_C Pfam Desc: Formyl transferase, C-terminal domain
  misc_feature (1)..(360): NCBI GI: 56784449 NCBI Desc: met-trnai formyl transferase-like [oryza sativa (japonica cultivar-group)]
  misc_feature (9)..(359): NCBI GI: 7657875 NCBI Desc: fmt protein [brassica napus var. napus]
  misc_feature (165)..(359): NCBI GI: 6069504 NCBI Desc: s-locus protein 8 [brassica rapa]
  misc_feature (33)..(359): NCBI GI: 52080176 NCBI Desc: methionyl-trna formyltransferase fmt [bacillus licheniformis atcc 14580]
  misc_feature (33)..(350): NCBI GI: 94987208 NCBI Desc: methionyl-trna formyltransferase [lawsonia intracellularis phe/mn1-00]
MARYSPPSLRRFFRCAASSASRAGGSGTGKKNLVFLGSPQVAASVLDKLLGASGSPESAFKVAAVVTQPPAAKNRGRKLLPSAVAQLALDRGFPEELIFTPERAREESFLSALKEVEPDVCVTAAYGNILPQKFLDIPSCGTVNIHPSLLPLYRGAAPVQRALQDGVAETGVSLAYTVRALDSGPVIACERFSVDECIKAPELLSILFDLGSKLLINELPSILDGSAKEKAQPQDDSKATLAPKLNSEESWLSFDQEAKVLHNKVRAFAGWPGTRAKLQLVNQNSVPDVLEIKVISTKVSTSCVKAGDENEILFSGSSLLIPCSGSTWLEVLELQLPGKKVTKAQDFWNGLRGQKLMKLP

SEQ ID NO: 1139 - DNA, 1134 bp, Sorghum bicolor
  misc_feature: Ceres ANNOT ID no. 6013493
  misc_feature: Encodes the peptide sequence at SEQ ID NO 1140
atggcggcgatctcgcaccggatcgcagcagggtcgggcccgcgcgtcgccgttgctgcgccgcctcgcccgcgggccgtggtcgtgggagctgcggcgaagggcgcacatcgggagcggacgctggagggcgcgagcgacgacctgagggccgccgcggcgcagagcctggactgggctcccgcgcggcgccgggtgcgggccgccttcgcgcccgtgctccccacgctcgaccactgcctcttcaagatggctcccaaggaaatccagatggaagagaattaccagaccaattcaaagggcgttgaaatattctggaagagctggctgccaagagagggcactgcaattaaggctgcacttttcttctgccatggatatggggatacctgcactttcttttttgaagggattgctaagaggatagctgctgctggttatgcagtttatgctatggattatcctggttttggcatgtcatatggtctccatggctatattgcaagctttgatggaatggtggaccatgtcattgaacagtatgcacgaataagaggcatgaaggaagtgtgtgagctgccacactttctcttaggacagtcaatgggaggtgcagttgccctgaaagtacacttaaagcaacaaaaagaatgggacggtgtgcttcttgtcgcacctatgtgcaagatttcagaagatgtaacaccacctgcacctgtattgaaggcactgagcatattgtcatgtcttcttcctgaggcgaagttatttccgcagaaagatataggggatttggcatttagagatccaaggaaaaggaaagtagctgagtacaatgccatctcatattctgaccaaatgagattaagaacagcagtcgaacttttaaaagccacgaaggacattgaatcacagttggagaagatctcctccccattgctgattcttcatggagccgcagacatggtaaccgatcctcaagtcagcaaattcctttatgagaaagccagcgcgaaggacaagaccctcaagctctatgaaggcagctaccactcaatcttagagggagagccagatgaacggatttcaactgccattagcgacatcatttcatggctagattcacactgttaa

SEQ ID NO: 1140 - protein, 377 aa, Sorghum bicolor
  misc_feature: Ceres ANNOT ID no. 6013493
  misc_feature (147)..(368): Pfam Id: Abhydrolase_1 Pfam Desc: alpha/beta hydrolase fold
  misc_feature (25)..(377): NCBI GI: 115439277 NCBI Desc: os01g0688200 [oryza sativa (japonica cultivar-group)]
  misc_feature (23)..(377): NCBI GI: 92896563 NCBI Desc: alpha/beta hydrolase [medicago truncatula]
  misc_feature (152)..(377): NCBI GI: 56784453 NCBI Desc: lipase-like [oryza sativa (japonica cultivar-group)]
  misc_feature (40)..(376): NCBI GI: 140063294 NCBI Desc: alpha/beta hydrolase [medicago truncatula]
  misc_feature (26)..(376): NCBI GI: 115481056 NCBI Desc: os10g0135600 [oryza sativa (japonica cultivar-group)]
MAAISHRIAAGSGPRVAVAAPPRPRAVVVGAAAKGAHRERTLEGASDDLRAAAAQSLDWAPARRRVRAAFAPVLPTLDHCLFKMAPKEIQMEENYQTNSKGVEIFWKSWLPREGTAIKAALFFCHGYGDTCTFFFEGIAKRIAAAGYAVYAMDYPGFGMSYGLHGYIASFDGMVDHVIEQYARIRGMKEVCELPHFLLGQSMGGAVALKVHLKQQKEWDGVLLVAPMCKISEDVTPPAPVLKALSILSCLLPEAKLFPQKDIGDLAFRDPRKRKVAEYNAISYSDQMRLRTAVELLKATKDIESQLEKISSPLLILHGAADMVTDPQVSKFLYEKASAKDKTLKLYEGSYHSILEGEPDERISTAISDIISWLDSHC

SEQ ID NO: 1141 - DNA, 318 bp, Sorghum bicolor
  misc_feature: Ceres ANNOT ID no. 6013528
  misc_feature: Encodes the peptide sequence at SEQ ID NO 1142
atgaagctttacgggatgcagcttcttctgctcctcgtggccgtcatcgccgccgccgctccctgctgcacggtggtgcgcgcggcgtcgaggacagcgccggcgaggtgcgacccgctggcgctacgcccgtgcgtcccggcgttcatcctggccgcggccccgtccgacgagtgctgcgccaagctcagggagcagaagccgtgcctgtgcaggtacagcaagaaccccgagctgcgtaggtacatcatcagctctcgggatggcaagaggattgcgcacgcctgtcgcgttcgtgtccggggattcaggtgctag

SEQ ID NO: 1142 - protein, 105 aa, Sorghum bicolor
  misc_feature: Ceres ANNOT ID no. 6013528
  misc_feature (8)..(100): NCBI GI: 1848225 NCBI Desc: nonspecific lipid transfer protein [hordeum vulgare]
  misc_feature (12)..(105): NCBI GI: 9279661 NCBI Desc: lipid transfer protein [arabidopsis thaliana]
  misc_feature (28)..(98): NCBI GI: 3062791 NCBI Desc: lipid transfer protein [brassica rapa]
  misc_feature (12)..(101): NCBI GI: 45925909 NCBI Desc: probable lipid transfer protein family protein [tamarix androssowii]
  misc_feature (1)..(98): NCBI GI: 32395583 NCBI Desc: seed specific protein bn15d80b [brassica napus]
MKLYGMQLLLLLVAVIAAAAPCCTVVRAASRTAPARCDPLALRPCVPAFILAAAPSDECCAKLREQKPCLCRYSKNPELRRYIISSRDGKRIAHACRVRVRGFRC

SEQ ID NO: 1143 - DNA, 294 bp, Sorghum bicolor
  misc_feature: Ceres ANNOT ID no. 6013529
  misc_feature: Encodes the peptide sequence at SEQ ID NO 1144
atgaggccggccgtgctcttcctcgtggcggtgctggtggtcggcatcctcgccagcggggccgcgggcgacttctcggctctggcgccgtgcgacgtgatgcagctgagcccgtgcgcgagcgcgttcgcggggaaggcgtcgcccacgtccgcgtgctgcgtcaggctcaagtcccacgggcccaactgcctgtgccggtacaaggacgacgccaacctgaagcgcctcgtcgacaccaggcacaagcgcagggtgttcaccgcctgcaaggtccccgtcccgagctgctag

SEQ ID NO: 1144 - protein, 97 aa, Sorghum bicolor
  misc_feature: Ceres ANNOT ID no. 6013529
  misc_feature (31)..(97): Pfam Id: Tryp_alpha_amyl Pfam Desc: Protease inhibitor/seed storage/LTP family
  misc_feature (9)..(97): NCBI GI: 1848225 NCBI Desc: nonspecific lipid transfer protein [hordeum vulgare]
  misc_feature (10)..(97): NCBI GI: 498036 NCBI Desc: lipid transfer protein
  misc_feature (6)..(97): NCBI GI: 9279661 NCBI Desc: lipid transfer protein [arabidopsis thaliana]
  misc_feature (9)..(97): NCBI GI: 18893 NCBI Desc: aleurone specific protein [hordeum vulgare]
  misc_feature (11)..(97): NCBI GI: 3062791 NCBI Desc: lipid transfer protein [brassica rapa]
  misc_feature: The sequence is a functional homolog of SEQ ID NO. 364 in the 11/188,298 US application
MRPAVLFLVAVLVVGILASGAAGDFSALAPCDVMQLSPCASAFAGKASPTSACCVRLKSHGPNCLCRYKDDANLKRLVDTRHKRRVFTACKVPVPSC

SEQ ID NO: 1145 - DNA, 636 bp, Sorghum bicolor
  misc_feature: Ceres ANNOT ID no. 6013530
  misc_feature: Encodes the peptide sequence at SEQ ID NO 1146
atgcatccgaatttcccaagcgatcatggcaatggacgagtgggcggccatagacacaaatcgattcataggcttctcggtggagggagagccgcggacattttgctgtggaaggacaggaacttgtcagcaggtgtgcttgttggggccacgttgatatggttcctgttcgaagttgttgagtacaacattataccgctgatttgccagatagccgccctggccatgctcgtgatcttcatctggtcaaatgctgcagcccctccaagaatcccagaagtcatcatctctgaacatgccttccgacaagtagcacagatcatccattacaaactggcacacactgtgtatgctctttatgacattgcatgcgggaaggatctgaagaaattcctcttggtggtcgtgtcactgctaatattgtccgagataggaagttcttacagcttcacaagtctactatatcttggatttctctgcgcccacactttgccagcattgtaccaaagatatgagatagaggttgaccacctagccgcaaggggtagtgaagacatcaagaggttctacaagaggatcgattccaatttcctgaacaaaataccaagaggccctgtcaagacaaaagtcaaataa

SEQ ID NO: 1146 - protein, 211 aa, Sorghum bicolor
  misc_feature: Ceres ANNOT ID no. 6013530
  misc_feature (31)..(209): Pfam Id: Reticulon Pfam Desc: Reticulon
  misc_feature (18)..(209): NCBI GI: 9279659 NCBI Desc: seed maturation protein-like [arabidopsis thaliana]
  misc_feature (18)..(209): NCBI GI: 20160502 NCBI Desc: osjnbb0021a09.5 [oryza sativa (japonica cultivar-group)]
  misc_feature (18)..(210): NCBI GI: 56381963 NCBI Desc: at3g61560 [arabidopsis thaliana]
  misc_feature (21)..(209): NCBI GI: 78714222 NCBI Desc: reticulon [hordeum vulgare]
  misc_feature (18)..(204): NCBI GI: 30681227 NCBI Desc: reticulon family protein [arabidopsis thaliana]
MHPNFPSDHGNGRVGGHRHKSIHRLLGGGRAADILLWKDRNLSAGVLVGATLIWFLFEVVEYNIIPLICQIAALAMLVIFIWSNAAAPPRIPEVIISEHAFRQVAQIIHYKLAHTVYALYDIACGKDLKKFLLVVVSLLILSEIGSSYSFTSLLYLGFLCAHTLPALYQRYEIEVDHLAARGSEDIKRFYKRIDSNFLNKIPRGPVKTKVK

SEQ ID NO: 1147 - DNA, 1152 bp, Sorghum bicolor
  misc_feature: Ceres ANNOT ID no. 6013531
  misc_feature: Encodes the peptide sequence at SEQ ID NO 1148
atggagagctgggtccgcgcggtggtggaggccatccactcctctcgctcccaggccgtcatctacctcgccggcggcgcatctcaggcgctcggctggctcctgtccgtgcccggcgcgtcgggcaccgtcctcgaggtagtcgtgccctactccagggcttccatggcgcagctccttggcaagatgcccctgcaattcacgagcaagcaggctgcagaggacatggcgctggctgcgtacaatcgagcactcaagctttctggaccaggtctgcaagttatgggtgtcggatttactgggtcactggcaagctcacgtccaaaacatggtgaccataggttttatgtgtcaacgtggacacataattgcctcaggacatcacatgttaccttgtcaaagggtttacggagcagagaggaagaagacaaggtttcaagctactttttgcttaaggcaatagcacatacctgcagagtttctgcaaccattcagtcagacattcaggaacctgaaattccagaagaaagcatagaggaatttgatgaagatcaagagctccagcaaattattaatgggcaagtttgcatgaaagtctataattttgctgctccggtggaaaataacttcagcagaaaaataattctacctggttcattcaaccccttgcatgatggtcaccttagattgttggaagttgcatcaagcatgtgtgatgatgggcttccattctttgagatatcagcaattaatgccgataaacctccactatctattgcagaaattaagagacgtgttgagcaatttagaaaagcagggaagaatgtgattatatctaaccagccatacttctataagaaagcggaacttttcccaggaagtgcttttataattggtgcagacactgcagcaaggcttgttaaccctaagtattacggaggagattacaacagaatgctggagatacttctcgaatgtaaaagcacaggtaccacttttcttgttggtggccgaaagatggaaggagatttcaaggtccttgaggatttggacattccagaagagctgagagacatgttcatctccattccggaggaaatgtttcgcatagatatttcatctactgaaataagaaagagccatgggctctga

SEQ ID NO: 1148 - protein, 383 aa, Sorghum bicolor
  misc_feature: Ceres ANNOT ID no. 6013531
  misc_feature (215)..(380): Pfam Id: CTP_transf_2 Pfam Desc: Cytidylyltransferase
  misc_feature (12)..(271): NCBI GI: 91773440 NCBI Desc: cytidyltransferase-related [methanococcoides burtonii dsm 6242]
MESWVRAVVEAIHSSRSQAVIYLAGGASQALGWLLSVPGASGTVLEVVVPYSRASMAQLLGKMPLQFTSKQAAEDMALAAYNRALKLSGPGLQVMGVGFTGSLASSRPKHGDHRFYVSTWTHNCLRTSHVTLSKGLRSREEEDKVSSYFLLKAIAHTCRVSATIQSDIQEPEIPEESIEEFDEDQELQQIINGQVCMKVYNFAAPVENNFSRKIILPGSFNPLHDGHLRLLEVASSMCDDGLPFFEISAINADKPPLSIAEIKRRVEQFRKAGKNVIISNQPYFYKKAELFPGSAFIIGADTAARLVNPKYYGGDYNRMLEILLECKSTGTTFLVGGRKMEGDFKVLEDLDIPEELRDMFISIPEEMFRIDISSTEIRKSHGL

SEQ ID NO: 1149 - DNA, 720 bp, Sorghum bicolor
  misc_feature: Ceres ANNOT ID no. 6013538
  misc_feature: Encodes the peptide sequence at SEQ ID NO 1150
atggcagcggctggaagcggggtaggagatggcgagctgcgtctgctgggcaagtcgtcgagcccgtgggtgttccgggtgagagtggcgctgggactcaggggcctgagctacgagtacatcgaggaggacctcggcaacaagagcgatctcctgctccggtccaacccggtgcacaagaaggtgccggtcctcatcgacggcggccgcccggtgtgcgagtctctcgtgatcctgcagtacatcgacgagatctggcgggggaccggtcctccgctcctcccagccgacccctacgaccgcgccacggcacggttctgggcggccttcgtcgacgacaagtttttcccggcgtttagcgcgctgttcagatcggtgacggacgagcagagagcggcggcgctccagagcgcgctccttgcggtggagacgttggagcgggcgttcagggagtgctccaaggggaaggcgttcttcggcggcgacgccgtcgggatcgtggacatcacgctcgggagccacccgatctggatgagagcggtggacgagacggcaggcaccaaccttctggacggggccaaattcccttgcctggcggcgtgggcggagcggttcatggccgtggacgccgtgaacagggtggtgccggacgccgggaagcttttggagcagtacagggcgtctcgggctagatggactgcagcagctgattctagctga

SEQ ID NO: 1150 - protein, 239 aa, Sorghum bicolor
  misc_feature: Ceres ANNOT ID no. 6013538
  misc_feature (11)..(84): Pfam Id: GST_N Pfam Desc: Glutathione S-transferase, N-terminal domain
  misc_feature (106)..(209): Pfam Id: GST_C Pfam Desc: Glutathione S-transferase, C-terminal domain
  misc_feature (2)..(239): NCBI GI: 115439319 NCBI Desc: os01g0692100 [oryza sativa (japonica cultivar-group)]
  misc_feature (9)..(235): NCBI GI: 57015397 NCBI Desc: probable glutathione s-transferase gstu6 (28 kda cold-induced protein)
  misc_feature (9)..(234): NCBI GI: 20067421 NCBI Desc: glutathione transferase [triticum aestivum]
  misc_feature (9)..(234): NCBI GI: 11385535 NCBI Desc: glutathione s-transferase gst 42 [zea mays]
  misc_feature (9)..(239): NCBI GI: 22038178 NCBI Desc: glutathione-s-transferase 2 [aegilops tauschii]
MAAAGSGVGDGELRLLGKSSSPWVFRVRVALGLRGLSYEYIEEDLGNKSDLLLRSNPVHKKVPVLIDGGRPVCESLVILQYIDEIWRGTGPPLLPADPYDRATARFWAAFVDDKFFPAFSALFRSVTDEQRAAALQSALLAVETLERAFRECSKGKAFFGGDAVGIVDITLGSHPIWMRAVDETAGTNLLDGAKFPCLAAWAERFMAVDAVNRVVPDAGKLLEQYRASRARWTAAADSS

SEQ ID NO: 1151 - DNA, 960 bp, Sorghum bicolor
  misc_feature: Ceres ANNOT ID no. 6013545
  misc_feature: Encodes the peptide sequence at SEQ ID NO 1152
atgccagcaccagcaccatcgattagtctgggagctccaactccctatataacatctcatggatccaaagttgcacgcctacacatgtatgactggattgtgctagttctgctagctgtattggatggagttctcaatataatagaaccattccatcggtttgtcggatcagaaatgatgacagacctcagataccccatgaaggacaacacagtgccattttgggctgtgccgatagttggtatcattgggcctatcattattatgacagtgatatactttaagaagagaaatgtatatgatctgcatcatggaatactaggtctcttgttttcagtgcttatcactgctgttttaactgatgcgatcaaggatggtgttgggcgaccgcgtccagatttcttctggcgttgcttccctgatggaatacctgattataataactttactacaggcgccatatgccatggcgaggcgagtgttattaaagaaggtcacaagagctttccaagtggtcatagttcatggtcttttgctggccttggcttcctttcatggtatctggctggtaaaatcaaagtattcgatcgtaaagggcatgttgcaaaactctgcattgtcctttcccctctgcttcttgcagccttagtggcagtttctcgagttgatgactattggcatcactggcaagatgtatgtactggtggattacttgggttgacagtcgcttccatttgctacctgcagttttttccactaccatctgatgaaaatggattgtggcctcacgcgtatttccgacacattggtgagccagagggtgacaaccaagtgcaacccacgtacatgagccgtcgcagctcgattcataacggttcctttcacagtcctgatgcagtggaaatgaggagcacgagccgagcactggattccatggaagctggtgggagagtccaatga

SEQ ID NO: 1152 - protein, 319 aa, Sorghum bicolor
  misc_feature: Ceres ANNOT ID no. 6013545
  misc_feature (105)..(255): Pfam Id: PAP2 Pfam Desc: PAP2 superfamily
  misc_feature (1)..(319): NCBI GI: 56784972 NCBI Desc: phosphatidic acid phosphatase beta-like [oryza sativa (japonica cultivar-group)]
  misc_feature (1)..(319): NCBI GI: 126165538 NCBI Desc: acid phosphatase acp2 [oryza sativa (japonica cultivar-group)]
  misc_feature (1)..(279): NCBI GI: 56202159 NCBI Desc: phosphatidic acid phosphatase beta-like [oryza sativa (japonica cultivar-group)]
  misc_feature (6)..(291): NCBI GI: 10673973 NCBI Desc: phosphatidic acid phosphatase beta [vigna unguiculata]
  misc_feature (10)..(315): NCBI GI: 145331736 NCBI Desc: lpp3 (lipid phosphate phosphatase 3) [arabidopsis thaliana]
MPAPAPSISLGAPTPYITSHGSKVARLHMYDWIVLVLLAVLDGVLNIIEPFHRFVGSEMMTDLRYPMKDNTVPFWAVPIVGIIGPIIIMTVIYFKKRNVYDLHHGILGLLFSVLITAVLTDAIKDGVGRPRPDFFWRCFPDGIPDYNNFTTGAICHGEASVIKEGHKSFPSGHSSWSFAGLGFLSWYLAGKIKVFDRKGHVAKLCIVLSPLLLAALVAVSRVDDYWHHWQDVCTGGLLGLTVASICYLQFFPLPSDENGLWPHAYFRHIGEPEGDNQVQPTYMSRRSSIHNGSFHSPDAVEMRSTSRALDSMEAGGRVQ

SEQ ID NO: 1153 - DNA, 744 bp, Sorghum bicolor
  misc_feature: Ceres ANNOT ID no. 6013555
  misc_feature: Encodes the peptide sequence at SEQ ID NO 1154
atgcggctgctctctggcgcctcggcgtcccgccttccctcttctctgttctcacacccccgcgcaaggacaagatgcgtcccagcctcctccttcgcctgtcgggcagcctcttcatcagccgcgggcacaggcgacggcggcgcgcggaagccgtggctcttcgtcgggctgggtaaccccggaaaggtgtaccagggaactcgccacaacgttggattcgagatgatcgatgttatagcagaagctgagggtatatctctgagcagtatgcagttcaaggcaatggttggaaaaggccgcattggtgatgcacctattatgcttgccaagccacaaacctttatgaatgcaagtggtgagtctgtcgggcagctggtttcatatttcaaaataccacttaatcaagtcgttgtgatgtatgatgatctggatttaccctttgcaaaactgcgcctgctgccaaagggtgggcatggaggacataatgggatgagaagcatcgtcaaccatttgaaacaaagccgtgattttccacgcctgagaattggcattggacgaccacctgggaagatggatcctgcaaattttgttctccggccttttaacaagaaagagcaagaagagcttgatttcgcgttgcataggggcttggaggcagtgagaataatggtgcttggaggattcaacaagagcgcaacttacgtgaacactgcacagtcatccgaaatgctgaacagatga

SEQ ID NO: 1154 - protein, 247 aa, Sorghum bicolor
  misc_feature: Ceres ANNOT ID no. 6013555
  misc_feature (54)..(237): Pfam Id: Pept_tRNA_hydro Pfam Desc: Peptidyl-tRNA hydrolase
  misc_feature (1)..(247): NCBI GI: 56785144 NCBI Desc: peptidyl-trna hydrolase-like [oryza sativa (japonica cultivar-group)]
  misc_feature (1)..(247): NCBI GI: 75285812 NCBI Desc: peptidyl-trna hydrolase, mitochondrial precursor (m-pth)
  misc_feature (52)..(246): NCBI GI: 30685853 NCBI Desc: peptidyl-trna hydrolase family protein [arabidopsis thaliana]
  misc_feature (36)..(161): NCBI GI: 140057191 NCBI Desc: peptidyl-trna hydrolase [medicago truncatula]
  misc_feature (140)..(217): NCBI GI: 6714302 NCBI Desc: f15h18.8 [arabidopsis thaliana]
  misc_feature (1)..(247): SWISSPROT Homolog: EC 3.1.1.29 Peptidyl-tRNA hydrolase, mitochondrial precursor
MRLLSGASASRLPSSLFSHPRARTRCVPASSFACRAASSSAAGTGDGGARKPWLFVGLGNPGKVYQGTRHNVGFEMIDVIAEAEGISLSSMQFKAMVGKGRIGDAPIMLAKPQTFMNASGESVGQLVSYFKIPLNQVVVMYDDLDLPFAKLRLLPKGGHGGHNGMRSIVNHLKQSRDFPRLRIGIGRPPGKMDPANFVLRPFNKKEQEELDFALHRGLEAVRIMVLGGFNKSATYVNTAQSSEMLNR

SEQ ID NO: 1155 - DNA, 1692 bp, Sorghum bicolor
  misc_feature: Ceres ANNOT ID no. 6013570
  misc_feature: Encodes the peptide sequence at SEQ ID NO 1156
atggcggcgctgcagagctggcgcaaggcgtacggcgcgctcaaggacaccaccaccgtcagcctcgccaacctcaactccgacttcaaggatctggatgtcgcgatcgtgagggccaccaaccacgtggagagcccgcccaaggagcgccacctgcgcaagattgtggcggcgacgtccatcgcgaggccacgggcggacgtcgcctactgcatccatgcgcttgcccggcgactcgccaaaaccaggaactggattgttgccctgaagacacttgtagtgatccataggcttcttcgggaaggtgatcctgcattccgcgaagagtttcttacatttactcagagagtgcaaattttgcagttatcaaacttcaaggatgattccagcccaattgcttgggattgttcttcatgggttcgcacatacggtttatttttggaggaaaaactagaatgcttcagggtcttgaagtatgacattgaagctgagcgtttatcaaagcaaggtcaaggacctgaaaagggccacagtagaaccagggaattgaattctcaggacttgctggagcaattgccagcactgcagcaattattatatcgacttattggttgtcgggcagaaggagctgcaaataacaattatctggtgcagtatgctctagcccaggttcttaaagaaagcttcaaaatttattgtgcaataaatgatggaattatcaaccttgttgacaagttctttgagatgccaaagcatgaagcactaaaagcccttgacatttacaggagggctggccagcaggctggaaacctatctgacttctatgaaagttgtcgaggtttagagctcgcaagaaatttccagtttcccactttgagggagccaccacaaacattcctttcaaccatggaggagtatgtgaaggaggctccacgtatgatgccagttatagagccactggagcttcctgagcagcttcttctgacatacaaaccagaagaagaagaagaagaagaagttcgtgagtctgttcctattgcagaggagaaactgcaagttgttgaagaacctgctccagttccttcctcccaaatagcttcgcctcccaggcctgagattgcagatactggtgatttactggggttaggtgattcaacccatactgtgtcggcaatagaggagagcaacgcattggccttggcaattcttccgacaggtgttgataattcaacaactacacagcaagatagaggatttgatccaacaggatgggaacttgctcttgttactacaagcagcaacatgactccactgtctatggagagtaatttgggtggtggatttgacaagctcacattggacagcctatacgatgatggaacctacaggcagatgcagcaacaacagctatacggctcagcccctcccaatcccttcatggcaagcgatcccttcgccgtgtcaaatcaagtagctcccccaccgtcagttcaaatggcagccatggctccacagccccagcatttgcccatgatgattgaagcaaatcccttcggaccaccacagcagcatcacgcgggcatggctcctgcagcaaaccccttcctcgatgctgggttcggtgcgttcccggcaggaaatggaatgcatccacagaccaaccccttcggaggcgccgcacaacttctctag

SEQ ID NO: 1156 - protein, 563 aa, Sorghum bicolor
  misc_feature: Ceres ANNOT ID no. 6013570
  misc_feature (29)..(310): Pfam Id: ANTH Pfam Desc: ANTH domain
  misc_feature (29)..(157): Pfam Id: ENTH Pfam Desc: ENTH domain
  misc_feature (1)..(563): NCBI GI: 56785152 NCBI Desc: clathrin assembly protein ap180 short form-like [oryza sativa (japonica cultivar-group)]
  misc_feature (1)..(557): NCBI GI: 92877485 NCBI Desc: carbamoyl-phosphate synthase l chain, atp-binding; anth [medicago truncatula]
  misc_feature (6)..(525): NCBI GI: 50251206 NCBI Desc: synaptosomal-associated protein 91-like [oryza sativa (japonica cultivar-group)]
  misc_feature (6)..(558): NCBI GI: 52077380 NCBI Desc: phosphoprotein-like [oryza sativa (japonica cultivar-group)]
  misc_feature (1)..(222): NCBI GI: 140067274 NCBI Desc: carbamoyl-phosphate synthase l chain, atp-binding; anth [medicago truncatula]
MAALQSWRKAYGALKDTTTVSLANLNSDFKDLDVAIVRATNHVESPPKERHLRKIVAATSIARPRADVAYCIHALARRLAKTRNWIVALKTLVVIHRLLREGDPAFREEFLTFTQRVQILQLSNFKDDSSPIAWDCSSWVRTYGLFLEEKLECFRVLKYDIEAERLSKQGQGPEKGHSRTRELNSQDLLEQLPALQQLLYRLIGCRAEGAANNNYLVQYALAQVLKESFKIYCAINDGIINLVDKFFEMPKHEALKALDIYRRAGQQAGNLSDFYESCRGLELARNFQFPTLREPPQTFLSTMEEYVKEAPRMMPVIEPLELPEQLLLTYKPEEEEEEEVRESVPIAEEKLQVVEEPAPVPSSQIASPPRPEIADTGDLLGLGDSTHTVSAIEESNALALAILPTGVDNSTTTQQDRGFDPTGWELALVTTSSNMTPLSMESNLGGGFDKLTLDSLYDDGTYRQMQQQQLYGSAPPNPFMASDPFAVSNQVAPPPSVQMAAMAPQPQHLPMMIEANPFGPPQQHHAGMAPAANPFLDAGFGAFPAGNGMHPQTNPFGGAAQLL

SEQ ID NO: 1157 - DNA, 1500 bp, Sorghum bicolor
  misc_feature: Ceres ANNOT ID no. 6013571
  misc_feature: Encodes the peptide sequence at SEQ ID NO 1158
atggccgccgccgccgccgccgctgtgaatgggagcctagacgtgcatgagaggaaggcgcagaggagctactgggaggagcactctggggagctcaccctcgaggccatgatgcttgactcccgagccgccgaactcgacaaggaggagcgccccgaggttctgtctttacttccttcttatgaaggaaaatctgtactggaactgggagccggaataggtcgctttactggtgaactggctaagacatctgggcatgtttttgcagtggatttcattgaaagtgccattaaaaagaatgaaagtacaaatggtcactacgacaacacatcatttatgtgtgctgatgttacatccccgaacctgatgattgaagcaaactccattgatctgatattttcaaactggttgctgatgtatctttcagatgaggagattgacaagttggtagaaagaatggtaaaatggctgaaggtcggtggctatatcttctttagggaatcttgcttccatcaatctggagatttagaaaggaaagttaacccgacacactatcgagaaccaaggttttataccaaagtatttaaagagtgccaaacctttaatcaggatggcacttccttcaaactttctctggttactttcaaatgcattggagcttatgtaaacatcaagaaagatcaaaaccagatatgttggttatggcaaaaagtaaattcattagaagatgggggatttcaaagttttttagacaatgtgcagtacaaagccactggaatattgcgctatgaacgtatctttggagatggttacgtgagcactggtggagttgagactacaaaagaatttgtggataaactggatcttaagcctggacagaaggtgcttgatgttggttgtggaattgggggaggtgatttttacatggctgagaagtatggtacccatgttgttggtattgacctttccattaacatgatattgtttgcccttgagcgttccattgggcgtaagtgctcagttgagtttgaagtcgctgattgcaccactaagacgtacccagaccacatgtttgatgtcatctacagccgtgacactatccttcatatacaagataaaccctccttgttcaaaagtttcttcaaatggctaaaacctgggggaaaggtcctaatcagtgactactgcaagagtcctgggaaaccatcagaagagtttgcagcatacattaagcagaggggttatgatctccatgatgtagaggcttatggacagatgctcaagaatgctggtttcagtcatgtcattgctgaagaccgaactgaccagttcctcagtgttttacagaaggagctagataaatttgagaagaacaaagatgatttcctgtccgagtttgcccagggggattacgatgatatcgtgaatggatggaaagcaaaactgcagaggacctctgctcgtgagcagaggtgggggctgttcgtcgccaccaagtga

SEQ ID NO: 1158 - protein, 499 aa, Sorghum bicolor
  misc_feature: Ceres ANNOT ID no. 6013571
  misc_feature (67)..(165): Pfam Id: Methyltransf_11 Pfam Desc: Methyltransferase domain
  misc_feature (296)..(392): Pfam Id: Methyltransf_11 Pfam Desc: Methyltransferase domain
  misc_feature (67)..(163): Pfam Id: Methyltransf_12 Pfam Desc: Methyltransferase domain
  misc_feature (296)..(390): Pfam Id: Methyltransf_12 Pfam Desc: Methyltransferase domain
  misc_feature (277)..(499): Pfam Id: CMAS Pfam Desc: Cyclopropane-fatty-acyl-phospholipid synthase
  misc_feature (273)..(443): Pfam Id: Ubie_methyltran Pfam Desc: ubiE/COQ5 methyltransferase family
  misc_feature (1)..(499): NCBI GI: 115439355 NCBI Desc: os01g0695100 [oryza sativa (japonica cultivar-group)]
  misc_feature (1)..(499): NCBI GI: 45272584 NCBI Desc: phosphoethanolamine n-methyltransferase [oryza sativa]
  misc_feature (17)..(499): NCBI GI: 17887465 NCBI Desc: phosphoethanolamine methyltransferase [triticum aestivum]
  misc_feature (17)..(499): NCBI GI: 20147131 NCBI Desc: at3g18000/meb5_22 [arabidopsis thaliana]
  misc_feature (17)..(499): NCBI GI: 32478660 NCBI Desc: phosphoethanolamine n-methyltransferase [brassica napus]
  misc_feature (17)..(499): SWISSPROT Homolog: EC 2.1.1.103 Phosphoethanolamine N-methyltransferase 1
  misc_feature: The sequence is a functional homolog of SEQ ID NO 40 in US patent 7151202
MAAAAAAAVNGSLDVHERKAQRSYWEEHSGELTLEAMMLDSRAAELDKEERPEVLSLLPSYEGKSVLELGAGIGRFTGELAKTSGHVFAVDFIESAIKKNESTNGHYDNTSFMCADVTSPNLMIEANSIDLIFSNWLLMYLSDEEIDKLVERMVKWLKVGGYIFFRESCFHQSGDLERKVNPTHYREPRFYTKVFKECQTFNQDGTSFKLSLVTFKCIGAYVNIKKDQNQICWLWQKVNSLEDGGFQSFLDNVQYKATGILRYERIFGDGYVSTGGVETTKEFVDKLDLKPGQKVLDVGCGIGGGDFYMAEKYGTHVVGIDLSINMILFALERSIGRKCSVEFEVADCTTKTYPDHMFDVIYSRDTILHIQDKPSLFKSFFKWLKPGGKVLISDYCKSPGKPSEEFAAYIKQRGYDLHDVEAYGQMLKNAGFSHVIAEDRTDQFLSVLQKELDKFEKNKDDFLSEFAQGDYDDIVNGWKAKLQRTSAREQRWGLFVATK

SEQ ID NO: 1159 - DNA, 1506 bp, Sorghum bicolor
  misc_feature: Ceres ANNOT ID no. 6013572
  misc_feature: Encodes the peptide sequence at SEQ ID NO 1160
  misc_feature: Down-regulated in shoot tissues in response to methyl jasmonate treatment
  misc_feature: Down-regulated in root tissues in response to aminocyclopropane carboxylic treatment
  misc_feature: Down-regulated in root tissues in response to methyl jasmonate treatment
  misc_feature: Down-regulated in shoot tissues in response to salicylic acid treatment
atgaacgcccccaccgccgccgttgtttctgttaacgggaagatgggggttgaggagaggcaggcgcagaagagctactgggaggagcattccaggaacctcaccgtcgaggccatgatgctggactcccgcgctgccgatctcgacaaggaggagcgccccgaggtcctgtctttgcttccctcattcgaaggaaaatctgtactggagcttggtgctggaataggccgtttcactggagaactcgctaaaacagctgggaatgttcttgctttggattttattgaaagtgcaattaaaaagaatgaaagcattaatggtcactacaagaatgcatcctttatgtgtgctgatgtgacatccgaggacctggtgcttccagctagctccatcgatctgatattttcaaattggttattgatgtatctttcagatgaagaggttgagcagctagttcaaagaatggtaaaatggttgaagattggtggctatatcttctttagggaatcttgcttccatcaatctggagattcaaaaaggaaagttaatccgacacactatcgggaaccgagtttttatactaaggttttcaaagagtgccatacctttgatcaagatgggaattccttcgaactttctctggttacttgcaagtgtattggtgcttatgttaaaaacaagaaaaaccaaaaccagatatgttggctatggcaaaaggttcagtctacagaagacaagggatttcaaagatttttggacaatgtgcagtacaaaactagcggaatattacgttacgagcgcatctttggagaaggttatgtgagcactggtggaattgagactacaaaagaatttgtggataagctggatcttaaacctggacataaggtgcttgatgttggatgtggaattggaggaggtgacttttatatggctgaaaattatgatgctcatgttgttggtattgatctttccataaacatggtatcatttgcacttgagcgtgccattggccgcagttgctcagttgagtttgaagttgctgattgcaccacaaagacatacccagaaaacacatttgatgtcatatacagccgtgatactatccttcatatacaagacaaaccctctttgttcaaaagtttcttcaaatggctgaagcctgggggcaaggtccttatcagcgactactgcaggagtcctgggaaaccatcagaggaatttgcagcgtacatcaagcagagaggttatgacctacatgatgtggaggcttatggacagatgctgaagagtgctggttttcgtgatgtcattgctgaggatcgaactgatcagttccttggtgttttagagaaggaattagctaaatttgaaaagaacaaggatgatttcctgtctgacttcacccaggaggactacgatgatattgtgaatggttggaaggcaaaactgcagaggagttctgctggtgagcagaggtgggggctgttcatcgccaccaaatga

SEQ ID NO: 1160 - protein, 501 aa, Sorghum bicolor
  misc_feature: Ceres ANNOT ID no. 6013572
  misc_feature (69)..(167): Pfam Id: Methyltransf_11 Pfam Desc: Methyltransferase domain
  misc_feature (298)..(394): Pfam Id: Methyltransf_11 Pfam Desc: Methyltransferase domain
  misc_feature (69)..(165): Pfam Id: Methyltransf_12 Pfam Desc: Methyltransferase domain
  misc_feature (298)..(392): Pfam Id: Methyltransf_12 Pfam Desc: Methyltransferase domain
  misc_feature (231)..(472): Pfam Id: CMAS Pfam Desc: Cyclopropane-fatty-acyl-phospholipid synthase
  misc_feature (275)..(452): Pfam Id: Ubie_methyltran Pfam Desc: ubiE/COQ5 methyltransferase family
  misc_feature (6)..(501): NCBI GI: 115439355 NCBI Desc: os01g0695100 [oryza sativa (japonica cultivar-group)]
  misc_feature (6)..(501): NCBI GI: 45272584 NCBI Desc: phosphoethanolamine n-methyltransferase [oryza sativa]
  misc_feature (8)..(501): NCBI GI: 17887465 NCBI Desc: phosphoethanolamine methyltransferase [triticum aestivum]
  misc_feature (19)..(501): NCBI GI: 32478660 NCBI Desc: phosphoethanolamine n-methyltransferase [brassica napus]
  misc_feature (18)..(501): NCBI GI: 20147131 NCBI Desc: at3g18000/meb5_22 [arabidopsis thaliana]
  misc_feature (18)..(501): SWISSPROT Homolog: EC 2.1.1.103 Phosphoethanolamine N-methyltransferase 1
  misc_feature: The sequence is a functional homolog of SEQ ID NO 40 in US patent 7151202
  misc_feature: Down-regulated in shoot tissues in response to methyl jasmonate treatment
  misc_feature: Down-regulated in root tissues in response to aminocyclopropane carboxylic treatment
  misc_feature: Down-regulated in root tissues in response to methyl jasmonate treatment
  misc_feature: Down-regulated in shoot tissues in response to salicylic acid treatment
MNAPTAAVVSVNGKMGVEERQAQKSYWEEHSRNLTVEAMMLDSRAADLDKEERPEVLSLLPSFEGKSVLELGAGIGRFTGELAKTAGNVLALDFIESAIKKNESINGHYKNASFMCADVTSEDLVLPASSIDLIFSNWLLMYLSDEEVEQLVQRMVKWLKIGGYIFFRESCFHQSGDSKRKVNPTHYREPSFYTKVFKECHTFDQDGNSFELSLVTCKCIGAYVKNKKNQNQICWLWQKVQSTEDKGFQRFLDNVQYKTSGILRYERIFGEGYVSTGGIETTKEFVDKLDLKPGHKVLDVGCGIGGGDFYMAENYDAHVVGIDLSINMVSFALERAIGRSCSVEFEVADCTTKTYPENTFDVIYSRDTILHIQDKPSLFKSFFKWLKPGGKVLISDYCRSPGKPSEEFAAYIKQRGYDLHDVEAYGQMLKSAGFRDVIAEDRTDQFLGVLEKELAKFEKNKDDFLSDFTQEDYDDIVNGWKAKLQRSSAGEQRWGLFIATK

SEQ ID NO: 1161 - DNA, 3762 bp, Sorghum bicolor
  misc_feature: Ceres ANNOT ID no. 6013580
  misc_feature: Encodes the peptide sequence at SEQ ID NO 1162
atggatgcgacggctagcagagccggtgaaaatgacgacgacgacaagaagcagggtgcagcgccggccaagaaggtgtcgctgctcggcctgttcaggtacgcggaccgcctggacttgctgctgatggcggtgggcacggtaggggccctggccaacggcgtggccgagcccctcatgaccatcctcttcggcaacgtcatcgactccttcggcgacagcacctcacaggacatcgtccgcagcgtgagaaaggttgttctggatttcgtatatttgggcatcggagcagctgttgtctcatttcttcgagaaaggcagtcagctcgaatccgttctttatacctcaatgctgtcttgagacaggatattgcattcttcgacacagaattgacaacaggccaagcagtttctaggatgtccagtgataccctcgtgattcaggatgctcttggcgagaaggcgggaaagcttatacaactctcatctgccttttttggtggttttataatagcattcacaaaaggctggctcctcaccctcgtcatgttaacatcactaccactaattgcaattgccggtgtagtttctgctcagtttctaacaaatatttctagcaagaaactgacatcttatggagatgctggggacactgttgaacagactatcggagctataagaacagtagtttcctttaacggagagaacaaagccgttgcaatgtacaaaaacttaataaagaaggcatacaggactgatattttggaaggcctgatcaatggttttggcatgggatctgtcttttgcatcttgttctctagctatggcctagctttctggtatggtggaaagctaatcgctgacaaaggctacactggtgggaagatcatcacagttttgttcgctgtgttaactggtgcaatgtctttaggtaatgcaacaccctctgtttcttcaattgctcagggtcaatctgcagcatacagattgtttgaaacgattgagaggaagccagagatagattcaggtgataccagaggtgtcgttttagaagatatgaagggtgatgttgaactaaaagatgttcacttttgctaccctgcaagacccgatcaactgatattatgtggattatcattgcaagtagccagtggaaccacaatggccatagttggagagagtggaagtggcaaatcaactgtcatcagcctagttgaacgattctacgatccacatgatggtgaagttttgatagatggcattaacatcaagaatctaaggcttagttgcattagagagaagatcagtctggtcagtcaagaaccattgctcttcatgacctccattaaagataacataatgtatggtaaaggagacacgacaattgaagaggtcaagagggcagccgagcttgcaaatgcagcaaacttcatcgataagttgccggatggctatgatacaatggttggaccgcatggcgcacagctttctggaggacaaaagcaaagaattgcaattgcaagagccatccttaaagatccaaaaatacttttgctcgatgaagcaacaagtgcattggatgtggaatctgagcggatagttcaggaggcactgaataggataatggtggaaaggactacgcttgttgttgctcatcgtttgagcaccgtaaggaatgttgactgcataacagtacttcgtcaagggaaaatagttgaacaaggccctcatgatgtattggtgaaggatcccaatggggcatactctcagcttattaggctacaagaaactcgtgctgatgaaaggcgtaaaacagcagactctggggtgccagattctagatcaaaaagcaccagtttgtcacttagacggtcaatgaataaagattcttttggtaacagcaacagatattccttcaagaatcccttaggattatcagttgagttacatgagaataggatcataggtggagaggaaacagaagggctctctgatgttgtggtgctaaagaaagcaccaattggacgactttttaagcttaacatgccagaagtgccagttcttctgctaggctctatagcagcatcagtgcacggtgtcgttttcccattgtttggtatattgatgtctggtattataaaatcattttatgaaccaccagataaaatgcgaaaggatactagcttttgggcactgatatctgttgttctgggcattacatgtctgatttcagtcccagcacaatactttttgtttgcggttgctgggggcaagttgatagagcgcattcgtgctttgtcatttcaaagcattgtgcgccaggaaattgcttggtttgataatgcctcaaattccagcggagcacttggtacaaggctctcagttgatgcgttaaatgtccggcgcatagcaggagataacttggccctaataatgcagtctatagctacattgacaactggatttgtcatagcctttgcggcagattggaggcttgcactgatcatcacatgtgtgattcctttggtaggtgcacagggctatgctcaagtgaagttcttgaaggggtttagcgaagatgctaaggagatgtatgaagatgcaagccaagttgcaactgatgctgttggcagtatcagaactgtagcatcattctgtgcagagaaaagagtggtcgcaacatacaatgagaaatgtgaagctctaagaaaacagggaattcgaagtggaattgttggaggacttggttatggattctcatttttaatgttgtatttcacatatggtctttgtttctatgttggtgcacagtttgtacgtcaagggaaaactacttttccagatgtttttaaggttttcttcgcattagttttggcagctattggggtttcgcaggcaagtgcactggcttctgatgcaacaaaagcaagagattctgctatttccatttttagtattctggatagggagtcaaaaattgactcgagtagcgatgatggaatgacactggagaatgtcactggcaacattgatttcaacaatgtcagtttcaagtacccattgcgccctgatgtccagatattcagtgactttaccttgcgcattccttctggaaagacagtggcacttgttggagagagtggtagtggcaagtccacaataattgctttactggagcgtttctatgatccagattctggtagaatatcactagatggcgttgaaattaagagcttaaaaataagctggctaagggatcaaatggggctggtaggccaggagccagtgcttttcaatgacacaattcgtgccaacataacatatgggaaacatggtgatgtaacagaggaagaggttatggctgtagccaaggcagccaatgcccatgaattcatatcaagcttacctcaaggatatgacaccatggtaggcgagaaaggaattcagctatctggtgggcagaaacaacgagtagctattgcaagggccataatcaaggatccaaagatactactccttgatgaggcaaccagtgcccttgatgctgaatcagagcgcattgttcaagacgcattggaccgagtcatggtcagccgtaccaccattgtggtggcacaccgcctctccacgatcaaaggggctgacatgattgctgttctcaaggaaggcaagattgtagagaaaggaaggcatgaagtcctgatgcgcatcaacggtggggcctatgctgccctagtagagctccgctcgaaatctgaatag

SEQ ID NO: 1162 - protein, 1253 aa, Sorghum bicolor
  misc_feature: Ceres ANNOT ID no. 6013580
  misc_feature (385)..(569): Pfam Id: ABC_tran Pfam Desc: ABC transporter
  misc_feature (1038)..(1223): Pfam Id: ABC_tran Pfam Desc: ABC transporter
  misc_feature (43)..(310): Pfam Id: ABC_membrane Pfam Desc: ABC transporter transmembrane region
  misc_feature (688)..(966): Pfam Id: ABC_membrane Pfam Desc: ABC transporter transmembrane region
  misc_feature (1)..(1252): NCBI GI: 19032275 NCBI Desc: multidrug resistance protein 1 homolog [triticum aestivum]
  misc_feature (1)..(1253): NCBI GI: 27368859 NCBI Desc: mdr-like abc transporter [oryza sativa (japonica cultivar-group)]
  misc_feature (6)..(1252): NCBI GI: 27368857 NCBI Desc: mdr-like abc transporter [oryza sativa (japonica cultivar-group)]
  misc_feature (1)..(1252): NCBI GI: 27368855 NCBI Desc: mdr-like abc transporter [oryza sativa (japonica cultivar-group)]
  misc_feature (5)..(1252): NCBI GI: 115439365 NCBI Desc: os01g0695700 [oryza sativa (japonica cultivar-group)]
MDATASRAGENDDDDKKQGAAPAKKVSLLGLFRYADRLDLLLMAVGTVGALANGVAEPLMTILFGNVIDSFGDSTSQDIVRSVRKVVLDFVYLGIGAAVVSFLRERQSARIRSLYLNAVLRQDIAFFDTELTTGQAVSRMSSDTLVIQDALGEKAGKLIQLSSAFFGGFIIAFTKGWLLTLVMLTSLPLIAIAGVVSAQFLTNISSKKLTSYGDAGDTVEQTIGAIRTVVSFNGENKAVAMYKNLIKKAYRTDILEGLINGFGMGSVFCILFSSYGLAFWYGGKLIADKGYTGGKIITVLFAVLTGAMSLGNATPSVSSIAQGQSAAYRLFETIERKPEIDSGDTRGVVLEDMKGDVELKDVHFCYPARPDQLILCGLSLQVASGTTMAIVGESGSGKSTVISLVERFYDPHDGEVLIDGINIKNLRLSCIREKISLVSQEPLLFMTSIKDNIMYGKGDTTIEEVKRAAELANAANFIDKLPDGYDTMVGPHGAQLSGGQKQRIAIARAILKDPKILLLDEATSALDVESERIVQEALNRIMVERTTLVVAHRLSTVRNVDCITVLRQGKIVEQGPHDVLVKDPNGAYSQLIRLQETRADERRKTADSGVPDSRSKSTSLSLRRSMNKDSFGNSNRYSFKNPLGLSVELHENRIIGGEETEGLSDVVVLKKAPIGRLFKLNMPEVPVLLLGSIAASVHGVVFPLFGILMSGIIKSFYEPPDKMRKDTSFWALISVVLGITCLISVPAQYFLFAVAGGKLIERIRALSFQSIVRQEIAWFDNASNSSGALGTRLSVDALNVRRIAGDNLALIMQSIATLTTGFVIAFAADWRLALIITCVIPLVGAQGYAQVKFLKGFSEDAKEMYEDASQVATDAVGSIRTVASFCAEKRVVATYNEKCEALRKQGIRSGIVGGLGYGFSFLMLYFTYGLCFYVGAQFVRQGKTTFPDVFKVFFALVLAAIGVSQASALASDATKARDSAISIFSILDRESKIDSSSDDGMTLENVTGNIDFNNVSFKYPLRPDVQIFSDFTLRIPSGKTVALVGESGSGKSTIIALLERFYDPDSGRISLDGVEIKSLKISWLRDQMGLVGQEPVLFNDTIRANITYGKHGDVTEEEVMAVAKAANAHEFISSLPQGYDTMVGEKGIQLSGGQKQRVAIARAIIKDPKILLLDEATSALDAESERIVQDALDRVMVSRTTIVVAHRLSTIKGADMIAVLKEGKIVEKGRHEVLMRINGGAYAALVELRSKSE

SEQ ID NO: 1163 - DNA, 843 bp, Sorghum bicolor
  misc_feature: Ceres ANNOT ID no. 6013582
  misc_feature: Encodes the peptide sequence at SEQ ID NO 1164
atgacgcggaagccggcggcgcagcagcggggcgtgggcggcgcgggggcgatgaggacgacgctgaagcggggggcgtggacgccggaggaggacgagctgctgtcgcgggccgtggcgaaggagggggaagggcggtggcgcacgctgccgcgccgcgcggggctgctgcgctgcggcaagagctgcaggctccggtggatgaactacctcaggccggacatcaagcgcgggcccatcgccgccgacgaggaggacctcatcctccgcctccaccgcctgctcggcaaccggtggtcgctgatcgccgggcggctgcctgggcgaacggacaacgagatcaagaactactggaactcgcacctcagcaagaagctcatcgcgcggggcatcgacccgcgggcgcacacgcctctgcccggagcagccgcaagcctccactcccactcccagtcccacggcgccgacgcagcagcagcagcggccggttctgccgacaagacgccggcactgccggaagtcgagccacagtttgcgccgccgccgccaccgccaccgccaccgcctgcgcacccgaccttgccgtccggcgccggtgttggcggcgacttcgccaccagcatgatgggtctcggcgccgagggcttcgatggattcgatgatccgttctgtgcaccagacgttgcagctcgtggcgacttcgacttgggctgtcccatcgtggacgacgccgccttctcctcgttcctcgactcgttgatggacgaggagcgcatcgccgattactttggcgatcacaaggatgctgatgatggtgagaacgatcagggtggaccttattag

SEQ ID NO: 1164 - protein, 280 aa, Sorghum bicolor
  misc_feature: Ceres ANNOT ID no. 6013582
  misc_feature (24)..(71): Pfam Id: Myb_DNA-binding Pfam Desc: Myb-like DNA-binding domain
  misc_feature (77)..(122): Pfam Id: Myb_DNA-binding Pfam Desc: Myb-like DNA-binding domain
  misc_feature (1)..(277): NCBI GI: 22535556 NCBI Desc: myb-related protein 4 [oryza sativa (japonica cultivar-group)]
  misc_feature (1)..(277): NCBI GI: 2605623 NCBI Desc: osmyb4 [oryza sativa]
  misc_feature (1)..(172): NCBI GI: 19072770 NCBI Desc: typical p-type r2r3 myb protein [oryza sativa]
  misc_feature (22)..(166): NCBI GI: 140060779 NCBI Desc: homeodomain-related [medicago truncatula]
  misc_feature (22)..(139): NCBI GI: 13346178 NCBI Desc: bnlghi233 [gossypium hirsutum]
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1004 in the 11/435,388 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1564 in the 10/374,780 US patent application
  misc_feature: The sequence is a functional homolog of SEQ ID NO 126 in the 10/412,699 US patent application
  misc_feature: The sequence is a functional homolog of SEQ ID NO 36 in US patent 7193132
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: Useful for making plants with modulated biomass
  misc_feature: Useful for making plants with modulated flowering time
  misc_feature: Functional homolog of the protein sequence given in SEQ ID NO 13601
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO 1088 in the 10/374,780 US patent application
  misc_feature: The sequence is a functional homolog of SEQ ID NO 2167 in the 10/666,642 US patent application
  misc_feature: The sequence is a functional homolog of SEQ ID NO 380 in the 11/435,388 US patent application
  misc_feature: The sequence is a functional homolog of SEQ ID NO 382 in the 10/714,887 US patent application
  misc_feature: The sequence is a functional homolog of SEQ ID NO 1087 in the 10/374,780 US patent application
  misc_feature: The sequence is a functional homolog of SEQ ID NO 2165 in the 10/666,642 US patent application
  misc_feature: The sequence is a functional homolog of SEQ ID NO 378 in the 11/435,388 US patent application
  misc_feature: The sequence is a functional homolog of SEQ ID NO 380 in the 10/714,887 US patent application
  misc_feature: The sequence is a functional homolog of SEQ ID NO 1089 in the 10/374,780 US patent application
  misc_feature: The sequence is a functional homolog of SEQ ID NO 2147 in the 10/666,642 US patent application
  misc_feature: The sequence is a functional homolog of SEQ ID NO 2157 in the 10/666,642 US patent application
  misc_feature: The sequence is a functional homolog of SEQ ID NO 360 in the 11/435,388 US patent application
  misc_feature: The sequence is a functional homolog of SEQ ID NO 362 in the 10/714,887 US patent application
  misc_feature: The sequence is a functional homolog of SEQ ID NO 370 in the 11/435,388 US patent application
  misc_feature: The sequence is a functional homolog of SEQ ID NO 372 in the 10/714,887 US patent application
  misc_feature: The sequence is a functional homolog of SEQ ID NO 1090 in the 10/374,780 US patent application
  misc_feature: The sequence is a functional homolog of SEQ ID NO 1071 in the 11/479,226 US patent application
  misc_feature: The sequence is a functional homolog of SEQ ID NO 1408 in the 10/666,642 US patent application
  misc_feature: The sequence is a functional homolog of SEQ ID NO 148 in the 10/374,780 US patent application
  misc_feature: The sequence is a functional homolog of SEQ ID NO 1808 in the 10/412,699 US patent application
  misc_feature: The sequence is a functional homolog of SEQ ID NO 234 in the 10/714,887 US patent application
  misc_feature: The sequence is a functional homolog of SEQ ID NO 234 in the 11/435,388 US patent application
  misc_feature: The sequence is a functional homolog of SEQ ID NO 286 in the 10/714,887 US patent application
  misc_feature: The sequence is a functional homolog of SEQ ID NO 42 in the 10/225,068 US patent application
  misc_feature: The sequence is a functional homolog of SEQ ID NO 468 in the 10/412,699 US patent application
  misc_feature: The sequence is a functional homolog of SEQ ID NO 758 in the 10/225,066 US patent application
  misc_feature: The sequence is a functional homolog of SEQ ID NO 1083 in the 10/374,780 US patent application
  misc_feature: The sequence is a functional homolog of SEQ ID NO 2159 in the 10/666,642 US patent application
  misc_feature: The sequence is a functional homolog of SEQ ID NO 372 in the 11/435,388 US patent application
  misc_feature: The sequence is a functional homolog of SEQ ID NO 374 in the 10/714,887 US patent application
  misc_feature: The sequence is a functional homolog of SEQ ID NO 1085 in the 10/374,780 US patent application
  misc_feature: The sequence is a functional homolog of SEQ ID NO 1086 in the 10/374,780 US patent application
  misc_feature: The sequence is a functional homolog of SEQ ID NO 2161 in the 10/666,642 US patent application
  misc_feature: The sequence is a functional homolog of SEQ ID NO 2163 in the 10/666,642 US patent application
  misc_feature: The sequence is a functional homolog of SEQ ID NO 374 in the 11/435,388 US patent application
  misc_feature: The sequence is a functional homolog of SEQ ID NO 376 in the 10/714,887 US patent application
  misc_feature: The sequence is a functional homolog of SEQ ID NO 376 in the 11/435,388 US patent application
  misc_feature: The sequence is a functional homolog of SEQ ID NO 378 in the 10/714,887 US patent application
  misc_feature: The sequence is a functional homolog of SEQ ID NO. 395 in the 11/188,298 US application
  misc_feature: The sequence is a functional homolog of SEQ ID NO. 282 in the 11/188,298 US application
MTRKPAAQQRGVGGAGAMRTTLKRGAWTPEEDELLSRAVAKEGEGRWRTLPRRAGLLRCGKSCRLRWMNYLRPDIKRGPIAADEEDLILRLHRLLGNRWSLIAGRLPGRTDNEIKNYWNSHLSKKLIARGIDPRAHTPLPGAAASLHSHSQSHGADAAAAAAGSADKTPALPEVEPQFAPPPPPPPPPPAHPTLPSGAGVGGDFATSMMGLGAEGFDGFDDPFCAPDVAARGDFDLGCPIVDDAAFSSFLDSLMDEERIADYFGDHKDADDGENDQGGPY

SEQ ID NO: 1165 - DNA, 3786 bp, Sorghum bicolor
  misc_feature: Ceres ANNOT ID no. 6013585
  misc_feature: Encodes the peptide sequence at SEQ ID NO 1166
  misc_feature: Up-regulated in shoot tissues in response to salicylic acid treatment
  misc_feature: Up-regulated in root tissues in response to salicylic acid treatment
atggaagcagcgggaggtgcgaaagggagggatggcgtggagaagaaggaagaggagaacggcaacggccacggcggcggcgacgccgtgaagaaggtgccgttcacggggctgttccggtacgccgacggcacggacgtgctgctcatgctcctcggcacggtggggtcggtggccaacggcgtgtcgcagcccgtcatgacgctcatcttcggccaggtcatcaacgccttcggcgacgccaccaccgacgacgtcctccgccgcgtcaaccaggcagttctgaactttgtctacctaggcattgcaacagcggttgtttcctttcttcaggtgtcatgttggacaatgacaggagaaaggcaggcaacacgcatccgatctctatacctaaaatctgtcttgagacaagaaatagcattcttcgatgtagaaatgacaactgggcagatagtttcaaggatgtctggtgataccgtgttagttcaggatgccattggtgagaaggtcggcaagtttcaacagcttgtggcaaccttcgttggtggtttcgtgatagcattcgtaaaaggatggcttctatctcttgtcatgttggcatgcatacctcccgttgtcattgctggtggaattgtctcaaaaatgcttgctaaaatatcaaccaaggggcaagcatcatacagtgatgcaggcaacattgttgaacagacacttgggtctataaaaacagttgtctctttcaatggggagaaacaggctattgcattgtataataaactcatacacaagtcatacaaggctgctgttgaagaaggaatcaccaatggttttggcatgggttctgttttcttcatatttttctcaagctatggtttagccatatggtatggcggaaagttgattcttagcaaaggttactcaggaggagacatcatcaatatcttgtctttaggtaatgcaacaccctgcatggcagcctttgcaggaggacaatctgcggcatacagattgttcacaacgatcaagaggaaaccagagattgacccagatgacccaactggtaagcaactagaagacatcaagggtgatgttgacctaaatgacgtgtacttcagctacccagcgagaccagagcaactagtatttgatgggttctcgctacatgtgtctagcggcactacaatggctatagttggggagagtggaagtggcaagtcaactgtgatcagtcttgtagagagattctatgatccacaagccggtgaggttttgattgatgggattaacatcaagagtttgcagcttgattggataagagggaagattggtcttgttaaccaagagccattgctctttatgacatctatcaaagataatataacatatggaaaagaggatgcaacaattgaggagatcaaaagagcagctgagcttgctaatgcagcaaatttcatcgataagttacccaatggttatgacacgatggttggccaacgtggtgctcagctatcagggggacaaaagcaaaggatcgctattgcaagagcaatcatcaaaaaccccagaattcttttgttagacgaggctactagtgcattggatgtggagtcggagcggattgttcaggaggcactaaataggatcatgctggataggacaacacttgtggttgcacatcgcctaagtactgtgagaaatgctgattgcatatcagttgttcaacaagggaaaatagttgaacaaggtccccacgatgaactgataatgaaccctgatggtgcttattctcaacttattcgtctccaagaaagcaaagaagaagaacagaaattagatcatcacatgtctgattcaaggtctaaaagtagaagcctctcactgaagcgatcaataagcagaggttcagcgggaaacagtagtcggcattctttgaccctcccctttggcatgcctggttcagttgaattgcttgaaggcaatgatgcaaattgggaggatgagaaagaccaggctcgtgatggtgaggccccaaagaaagctccaatgggacggctagctagtctaaacaagccagaggtgccgattcttttgttaggatcgctagctgctggagtccatggagtgcttttcccaatgtttggtctaatgatctccaatgccatcaaaacattctacgagccgccacaccaactaaaaaaggatgcaagcttttggggtttgatgtgtgttgtgttgggtattgtatcaatactatcaataccagtggagtatttcttatttgggatagccggggggaagcttatcgagcgtgtccgtgccatgtcgtttcggagcattgtgcaccaagaagttgcttggtttgatgatcccaaaaattccagtggagcacttggcgcaaggttgtcagttgatgctttgaatgtccgacgtttagtgggtgataacttggccttggcagttcaggtcatctcgacactaattgcaggatttgtcattgcttttgtggcagattggaagctcacattgatcatcctttgtgtgatgccactatcgggtgttcaaggttatgcacaagtgaagttcttgaagggtttcagtgaagatgccaagatactgtatgaagacgcaagtcaagtggccaccgatgcagtcagcagtatcaggactgtagcttctttttctgctgaaaaaagagtgacgacaatttatgaagataaatgtgaagcctcaaagaaacaaggagtcagaacaggaatggttggaggccttggttttggtttctcattcttgatgatgtaccttacatatggactttgtttctacgttggagcacagtttgttcgtcacaacaaatctacttttggagatgttttcaaggtattttttgcactgatgttggcaacaattggaatatctcaaacaagtgcattggcttctgattctacaaaggccaaggattcagctgtctccatattcgcattattggacagaaagtccaaaatcgactcaagcaatgatgaaggttcgacgctacatgaggtcaagggcgacatcgatttccgacatgtcagcttcaagtatccaagccgcccagatattcaaatatttagcgattttaccttgcacattcccgctggcaagactgttgcacttgtgggagagagtggcagtggcaagtcaacggtaatctctttgttggaaagattctacaaccccgactctggtactatctcattggatggagtagagatcaaaagcctaaaagtcacttggttaagggaccaaatgggtctggtgagccaagagcctattctcttcaatgacacaatccgtgccaacatagcttatgggaaacatggggaagtcactgaggaggagctcatcaaggccgcaaaggcagccaatgcacatgagttcgtatcaagccttccccaggggtatgacaccactgttggagagaggggggttcagctatctggtggccagaaacagcgggtagccatagcaagggccatactaaaagatcctaggattctacttcttgacgaggcaacgagtgccttggatgctgagtctgagcgcatagtgcaggatgccttggatcatgtaatggttggcaggacaacagttattgtggcacaccgcctctccacgatcaaaagtgctgacattatcgcagttcttaaggatggtgtgatagtggagaaaggaagacatgaggcactcatgaatatcaaagatggattctatgcttctctagttgaacttcgttcagcctcatcatag

SEQ ID NO: 1166 - protein, 1261 aa, Sorghum bicolor
  misc_feature: Ceres ANNOT ID no. 6013585
  misc_feature (392)..(576): Pfam Id: ABC_tran Pfam Desc: ABC transporter
  misc_feature (1046)..(1231): Pfam Id: ABC_tran Pfam Desc: ABC transporter
  misc_feature (54)..(325): Pfam Id: ABC_membrane Pfam Desc: ABC transporter transmembrane region
  misc_feature (696)..(972): Pfam Id: ABC_membrane Pfam Desc: ABC transporter transmembrane region
  misc_feature (1)..(1261): NCBI GI: 27368857 NCBI Desc: mdr-like abc transporter [oryza sativa (japonica cultivar-group)]
  misc_feature (17)..(1260): NCBI GI: 19032275 NCBI Desc: multidrug resistance protein 1 homolog [triticum aestivum]
  misc_feature (1)..(1260): NCBI GI: 27368859 NCBI Desc: mdr-like abc transporter [oryza sativa (japonica cultivar-group)]
  misc_feature (3)..(1261): NCBI GI: 27368855 NCBI Desc: mdr-like abc transporter [oryza sativa (japonica cultivar-group)]
  misc_feature (3)..(1261): NCBI GI: 115439365 NCBI Desc: os01g0695700 [oryza sativa (japonica cultivar-group)]
  misc_feature: Up-regulated in shoot tissues in response to salicylic acid treatment
  misc_feature: Up-regulated in root tissues in response to salicylic acid treatment
MEAAGGAKGRDGVEKKEEENGNGHGGGDAVKKVPFTGLFRYADGTDVLLMLLGTVGSVANGVSQPVMTLIFGQVINAFGDATTDDVLRRVNQAVLNFVYLGIATAVVSFLQVSCWTMTGERQATRIRSLYLKSVLRQEIAFFDVEMTTGQIVSRMSGDTVLVQDAIGEKVGKFQQLVATFVGGFVIAFVKGWLLSLVMLACIPPVVIAGGIVSKMLAKISTKGQASYSDAGNIVEQTLGSIKTVVSFNGEKQAIALYNKLIHKSYKAAVEEGITNGFGMGSVFFIFFSSYGLAIWYGGKLILSKGYSGGDIINILSLGNATPCMAAFAGGQSAAYRLFTTIKRKPEIDPDDPTGKQLEDIKGDVDLNDVYFSYPARPEQLVFDGFSLHVSSGTTMAIVGESGSGKSTVISLVERFYDPQAGEVLIDGINIKSLQLDWIRGKIGLVNQEPLLFMTSIKDNITYGKEDATIEEIKRAAELANAANFIDKLPNGYDTMVGQRGAQLSGGQKQRIAIARAIIKNPRILLLDEATSALDVESERIVQEALNRIMLDRTTLVVAHRLSTVRNADCISVVQQGKIVEQGPHDELIMNPDGAYSQLIRLQESKEEEQKLDHHMSDSRSKSRSLSLKRSISRGSAGNSSRHSLTLPFGMPGSVELLEGNDANWEDEKDQARDGEAPKKAPMGRLASLNKPEVPILLLGSLAAGVHGVLFPMFGLMISNAIKTFYEPPHQLKKDASFWGLMCVVLGIVSILSIPVEYFLFGIAGGKLIERVRAMSFRSIVHQEVAWFDDPKNSSGALGARLSVDALNVRRLVGDNLALAVQVISTLIAGFVIAFVADWKLTLIILCVMPLSGVQGYAQVKFLKGFSEDAKILYEDASQVATDAVSSIRTVASFSAEKRVTTIYEDKCEASKKQGVRTGMVGGLGFGFSFLMMYLTYGLCFYVGAQFVRHNKSTFGDVFKVFFALMLATIGISQTSALASDSTKAKDSAVSIFALLDRKSKIDSSNDEGSTLHEVKGDIDFRHVSFKYPSRPDIQIFSDFTLHIPAGKTVALVGESGSGKSTVISLLERFYNPDSGTISLDGVEIKSLKVTWLRDQMGLVSQEPILFNDTIRANIAYGKHGEVTEEELIKAAKAANAHEFVSSLPQGYDTTVGERGVQLSGGQKQRVAIARAILKDPRILLLDEATSALDAESERIVQDALDHVMVGRTTVIVAHRLSTIKSADIIAVLKDGVIVEKGRHEALMNIKDGFYASLVELRSASS

SEQ ID NO: 1167 - DNA, 945 bp, Sorghum bicolor
  misc_feature: Ceres ANNOT ID no. 6013622
  misc_feature: Encodes the peptide sequence at SEQ ID NO 1168
atgggacgccacgcggcctccggcggcggcggcggcgtgcagcagaagctgcgcaagggactctggtcgcccgaggaagacgagaagctctacaaccacatcatccgctacggcgtcgggtgctggagctccgtgcccaagctcgcagggctgcagaggtgcggcaagagctgccgacttcggtggatcaactacctgcgccccgacctgaagcggggcagcttctcgcagcaggaggaggacgccatcgtcggcctccacgagatcctggggaacaggtggtcgcagatcgcgtcgcacttgccgggccggacggacaacgagatcaagaacttctggaacagctgcctcaagaagaagctgcgccagcgcggcatcgaccccagcacccacaagcccatctccgccaacacggcggcggcggcattggaacagccggcggcgtcgcaagagcgcaagccgttgtccacagccgccgctgatggcggcttcgacacgaagcaccagcaccagcaggtgttcgacccgttcccgctgaccgacagcttcggcggcggcttcgacgcggcagctggcgccgcattgtatggccacatgggcggcggcggcggcaagcaggacgcgggcgcgttcgtggactacagcagcgtgctggacgtgtcggagaacctgggctacggcgagagctccagcaacagcagcaactggaactgcgcgccggaggcgaacaatgcgctcgacggcggcgacgcgccgctgcactgggcctccgagagcaaggccacgccccacttcgccggctacggcggcggcgaggagcagtcgctggaggagcacaagttcttgctgccctgccacgggcagcaggagcagagcctgccgcatttcgacttcgacatcagccggggcgccgtggtcggcgacttcaacctcgagttcttctga

SEQ ID NO: 1168 - protein, 314 aa, Sorghum bicolor
  misc_feature: Ceres ANNOT ID no. 6013622
  misc_feature (19)..(66): Pfam Id: Myb_DNA-binding Pfam Desc: Myb-like DNA-binding domain
  misc_feature (72)..(117): Pfam Id: Myb_DNA-binding Pfam Desc: Myb-like DNA-binding domain
  misc_feature (1)..(314): NCBI GI: 115439433 NCBI Desc: os01g0702700 [oryza sativa (japonica cultivar-group)]
  misc_feature (1)..(300): NCBI GI: 547958 NCBI Desc: myb-related protein hv33
  misc_feature (1)..(300): NCBI GI: 456214 NCBI Desc: mybhv33 [hordeum vulgare subsp. vulgare]
  misc_feature (1)..(300): NCBI GI: 19059 NCBI Desc: mybhv33 [hordeum vulgare subsp. vulgare]
  misc_feature (1)..(300): NCBI GI: 89145381 NCBI Desc: myb-related protein [triticum aestivum]
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: Useful for making plants with altered lignin content
  misc_feature: Functional homolog of the protein sequence given in SEQ ID NO 13687
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 836 in the 10/412,699 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1004 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1010 in the 11/435,388 US patent application
  misc_feature: Useful for making plants with altered terpenoid content
  misc_feature: Functional homolog of the protein sequence given in SEQ ID NO 13688
  misc_feature: Useful for making plants with altered alkaloid content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 36 in US patent 7193132
  misc_feature: Useful for making plants with enhanced nutritional value
  misc_feature: Useful for making plants with modulated heat sensitivity
  misc_feature: Functional homolog of the protein sequence given in SEQ ID NO 13689
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 126 in the 10/412,699 US patent application
  misc_feature: The sequence is a functional homolog of SEQ ID NO 1564 in the 10/374,780 US patent application
  misc_feature: Useful for making plants with modulated biomass
  misc_feature: Useful for making plants with modulated flowering time
  misc_feature: Functional homolog of the protein sequence given in SEQ ID NO 13601
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MGRHAASGGGGGVQQKLRKGLWSPEEDEKLYNHIIRYGVGCWSSVPKLAGLQRCGKSCRLRWINYLRPDLKRGSFSQQEEDAIVGLHEILGNRWSQIASHLPGRTDNEIKNFWNSCLKKKLRQRGIDPSTHKPISANTAAAALEQPAASQERKPLSTAAADGGFDTKHQHQQVFDPFPLTDSFGGGFDAAAGAALYGHMGGGGGKQDAGAFVDYSSVLDVSENLGYGESSSNSSNWNCAPEANNALDGGDAPLHWASESKATPHFAGYGGGEEQSLEEHKFLLPCHGQQEQSLPHFDFDISRGAVVGDFNLEFF

SEQ ID NO: 1169 - DNA, 909 bp, Sorghum bicolor
  misc_feature: Ceres ANNOT ID no. 6013624
  misc_feature: Encodes the peptide sequence at SEQ ID NO 1170
atggcgggcctggaggcggcggatgtggcgttcacgatgcgcgcggtggcgcggatgtcgagggcccggtggttcatcttcctgcgccgggtgtaccagtaccagaacgggcccaggtccgacctgggctccaaccccttcaactcgcccggctggctcgcgctcgagctcggcgtcatcgtcgcgcagatggtcctgaccaccgccgtcgtcgccacctcctccgccgagcgccccgcgtggccgctccgcctctgggtcgccgcctacaacgtcggcaacgtgctcagcctgcccctcctctattggcgccaccggcattcctccgccggcggccgaggcggcgacgcgctctccggcgacctcgagatgcgcggcgccaatgacgctctgagggacagcaggtcgtatctgatgaacaaggcgcgggcgttcctggagctcttcttcgcgatgtggttcgtgatgggcaacgtgtgggtgttcgacgcgcggctggggtcgctccagcgcgcgccgaggctgtacgcgctctgcatcagcctgctggcctggaacgccgtcgtctactcgctcccgttcctgctcttcctcctgctctgctgcttcgtgcccatggtcggctacgcgctcggctacaacatgaactccgcctccgtcggcaggggcgcctccgacgagcagctcgccgcgctgccccggtggcggttcaaggagcccgggcccgccgccgacgtcccaagggaccgggaccacgatgaccaggagtgctgcatctgcctagcgcagtacagggagaaggaggaggttcggcagctggcgtgcacgcacatgttccacctcaagtgcgtggacaggtggctcaggatcatctcctcttgccctctctgcaagcaagagctcaagtga

SEQ ID NO: 1170 - protein, 302 aa, Sorghum bicolor
  misc_feature: Ceres ANNOT ID no. 6013624
  misc_feature (257)..(297): Pfam Id: zf-C3HC4 Pfam Desc: Zinc finger, C3HC4 type (RING finger)
  misc_feature (10)..(302): NCBI GI: 92888300 NCBI Desc: zinc finger, ring-type; ringv [medicago truncatula]
  misc_feature (146)..(301): NCBI GI: 55296253 NCBI Desc: atp synthetase alpha chain -like [oryza sativa (japonica cultivar-group)]
  misc_feature (146)..(301): NCBI GI: 115462405 NCBI Desc: os05g0179000 [oryza sativa (japonica cultivar-group)]
  misc_feature (138)..(301): NCBI GI: 115449125 NCBI Desc: os02g0787500 [oryza sativa (japonica cultivar-group)]
  misc_feature (108)..(301): NCBI GI: 140059785 NCBI Desc: zinc finger, ring-type [medicago truncatula]
  misc_feature: The plant is abnormally small.
  misc_feature: Useful for making plants with modulated biomass
  misc_feature: GREAT-hit functional homolog of the protein sequence given in SEQ ID NO 12933
  misc_feature: Useful for making plants with modulated biomass
  misc_feature: Functional homolog of the protein sequence given in SEQ ID NO 12933
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MAGLEAADVAFTMRAVARMSRARWFIFLRRVYQYQNGPRSDLGSNPFNSPGWLALELGVIVAQMVLTTAVVATSSAERPAWPLRLWVAAYNVGNVLSLPLLYWRHRHSSAGGRGGDALSGDLEMRGANDALRDSRSYLMNKARAFLELFFAMWFVMGNVWVFDARLGSLQRAPRLYALCISLLAWNAVVYSLPFLLFLLLCCFVPMVGYALGYNMNSASVGRGASDEQLAALPRWRFKEPGPAADVPRDRDHDDQECCICLAQYREKEEVRQLACTHMFHLKCVDRWLRIISSCPLCKQELK

SEQ ID NO: 1171 - DNA, 1071 bp, Sorghum bicolor
  misc_feature: Ceres ANNOT ID no. 6013625
  misc_feature: Encodes the peptide sequence at SEQ ID NO 1172
atggcgacagcggaggtggtggtggtggccaacggctccggcggcgccgacaccaaggccgcgtttaaggagacatacagcaagctcaaggaggagatgctccaggaccccgccttcgagttcaccgacgagtcgctccagtggatcgaccgcatggtggattacaatgtgctcggtggaaagtgcaaccgtgggctctctgtcatcgatagctacaagatattgaagggtgttgatgttctgagcaaggaggagacatttcttgcctgcacccttggctggtgtatcgaatggcttcaagcttattttcttgtgcttgatgatattatggacaactcccagacacggcgtggccagccttgctggtttagagtgccacaggttggccttattgctgtaaatgatgggattatccttcgcaatcatatttcacgaatccttcaacgccacttcaaaggaaagccatattatgttgatcttattgacctattcaatgaggttgagttcaagacagcttcagggcaattgttggatcttatcactacccacgagggtgaaaaggatctaactaaatataacttgacagttcaccgccgcatcgttcagtacaagacagcttattattcattttaccttcctgttgcatgtgcattgctgctggctggtgagaacttggacaactttggtgatgtaaagaacattctcgttgaaatgggaacatactttcaagttcaggatgattatctggattgttttggtgatcctgaattcattggcaagatcggaactgacattgaagactacaaatgttcctggctagttgtgcaagctcttgaacgtgctgatgagaaccaaaagagcattctgtgtgaaaattatggaaagtctgatccagcgtgtgttgcaaaggtgaaggacttgtacaaagagcttaaactggaggaggttttccatgagtacgagagggagagttacaacaagctgattgccgacatcgaggcccagccgagcaaggcagttcagactgttttgaagtccttccttcacaagatctacaagagggacaagtag

SEQ ID NO: 1172 - protein, 356 aa, Sorghum bicolor
  misc_feature: Ceres ANNOT ID no. 6013625
  misc_feature (48)..(319): Pfam Id: polyprenyl_synt Pfam Desc: Polyprenyl synthetase
  misc_feature (11)..(356): NCBI GI: 33340602 NCBI Desc: geranylgeranyl-diphosphate synthase [zea mays]
  misc_feature (17)..(356): NCBI GI: 33340604 NCBI Desc: truncated geranylgeranyl-diphosphate synthase [zea mays]
  misc_feature (3)..(356): NCBI GI: 18958450 NCBI Desc: farnesyl pyrophosphare synthase [musa acuminata]
  misc_feature (16)..(356): NCBI GI: 34013692 NCBI Desc: farnesyl diphosphate synthase [hevea brasiliensis]
  misc_feature (16)..(356): NCBI GI: 1346029 NCBI Desc: farnesyl pyrophosphate synthetase 2 (fpp synthetase 2) (fps 2) (farnesyl diphosphate synthetase 2) [includes: dimethylallyltranstransferase ; geranyltranstransferase ]
  misc_feature: Useful for making plants with modulated salt sensitivity
  misc_feature: GREAT-hit functional homolog of the protein sequence given in SEQ ID NO 13288
  misc_feature: Useful for making plants with modulated salt sensitivity
  misc_feature: Functional homolog of the protein sequence given in SEQ ID NO 13288
MATAEVVVVANGSGGADTKAAFKETYSKLKEEMLQDPAFEFTDESLQWIDRMVDYNVLGGKCNRGLSVIDSYKILKGVDVLSKEETFLACTLGWCIEWLQAYFLVLDDIMDNSQTRRGQPCWFRVPQVGLIAVNDGIILRNHISRILQRHFKGKPYYVDLIDLFNEVEFKTASGQLLDLITTHEGEKDLTKYNLTVHRRIVQYKTAYYSFYLPVACALLLAGENLDNFGDVKNILVEMGTYFQVQDDYLDCFGDPEFIGKIGTDIEDYKCSWLVVQALERADENQKSILCENYGKSDPACVAKVKDLYKELKLEEVFHEYERESYNKLIADIEAQPSKAVQTVLKSFLHKIYKRDK

SEQ ID NO: 1173 - DNA, 2169 bp, Sorghum bicolor
  misc_feature: Ceres ANNOT ID no. 6013639
  misc_feature: Encodes the peptide sequence at SEQ ID NO 1174
atggcgccatccgcagccccctcctccttctcctccacgcgcctcctcctactcgcctcgccccactccccgcccactctcctctgcctccgccgcgcgggcggccgctccctggggctgtcgcggcgcggagggagcgcgcgccttcgagtcgttcgacgagcggtggaggaggacgagagccggggtcaggaggtggaggaggaggccccggaggagccggtggctggtcgcgacctcgtcacgctcgccgcctgcctcgtgggcctcctcaccggcgtctccgtcgtgctcttcaacctctcggttcatgaaatacgtgacgtattttgggacagtattcctttgcgaggcgcttcatggctgagggaggagccgattgatgaagtctggcagagagtgatatttgttccggtcagtggaggtgttatagtaggtggattgaacacactaagaagttctatcaaaactgactcaaatgcccctgtgtccaagataaggagtgcatttagaccattcttgaaagctgtggcagcatctttcacacttggaactggcaattcactgggtcctgagggtcccagtgtggaaattggttctgcaatagccaaaggatttggtaatgtgtttgagtgggacggtgggaaaaggttgtctcttgtggcagctggatcagcagctgggatctcatctggttttaatgctgctgttgctgggtgtttttttgctgtggaatctgttttgtggccttctgcggattcctcatcccttgccaactcgacacctatggtgatactcagttcagttatagcatctgttgtttcagagattggtctaggttctgatcccgctttcactgttccggaatatgattttcgctccccaacagaacttcctctgtaccttttgctgggtgtcttctgtgggttggtatcaattgcattatcaagatgtacatcacttgctatggaggcagttgaaagtttacaaagggcaacagggttacggaaggctgcatctccagctttaggtggcctcattgttggtctccttgcacttttgtaccctgaagtattgtactggggctttgaaaatgttgatatcttgctggaatcacggccatttacaagcggcctctcaacgaccatattggttcagcttattggagtgaaaatattagcaacatctttgtgcagggcttttggattggttggtggttactatgcaccatctctttttattggtgcagctacagggatggcatatggaaaattcatgaggtttacatttactggccctgtaccactgctgcatgtcccattcctagatgtggcatcacctcaagcatatggcctggtaggtatggcagctaccctcgctggtgtatgcaaggtgcctctgacatctgtcctactactttttgagcttacacaagactatcgtatagttctacctttgcttggggctgttgggttatcatcctggattgcttcacctcaaaggttctctaaaagaattaggattaagctggattcctgggaggataaatcaagtattcctcaacaagcaaacaacatgctcactcaaaacaaacaggccacttctatggatgcagctgattcatcaccagaattatgtaaaattgaaagctccctttgtgtctatgatgctaacgaagacaatatcttcaaaaatcttactgttgcagatgccatgaaaactaaatacttctctgtctcaatgacaactccattaattgaggcacttgatcttatgcttgccgagaggcagccctttgttatgataactgcgaataacacatctgtaagaggcttgctggcactagagaatatccaagatttttgcagagctgcaaaaactaaccgagcacaagatgaggtaaaggaactcttgatatctcatgtttgccaagcaggcaagtgtaaatcgtggtctgtgacgcctcagatgccacttactactgcagagaagattatggactctcatggtgtggattaccttcctgtagtttctgaggatgctaatcctcaggacagaggacctttgataggttttgtagacagagaatgcattgccatcgctcgaagggccaccgcaacaaaagaatttttcagttctatgtatgagataaaaaaggaagagaggtag

SEQ ID NO: 1174 - protein, 722 aa, Sorghum bicolor
  misc_feature: Ceres ANNOT ID no. 6013639
  misc_feature (140)..(499): Pfam Id: Voltage_CLC Pfam Desc: Voltage gated chloride channel
  misc_feature (570)..(703): Pfam Id: CBS Pfam Desc: CBS domain pair
  misc_feature (64)..(715): NCBI GI: 41688502 NCBI Desc: chloride channel protein clc-e (atclc-e)
  misc_feature (64)..(715): NCBI GI: 14039799 NCBI Desc: clc-e chloride channel protein [arabidopsis thaliana]
  misc_feature (296)..(718): NCBI GI: 115439455 NCBI Desc: os01g0704700 [oryza sativa (japonica cultivar-group)]
  misc_feature (58)..(621): NCBI GI: 8778501 NCBI Desc: f20n2.5 [arabidopsis thaliana]
  misc_feature (172)..(698): NCBI GI: 30695978 NCBI Desc: voltage-gated chloride channel family protein [arabidopsis thaliana]
MAPSAAPSSFSSTRLLLLASPHSPPTLLCLRRAGGRSLGLSRRGGSARLRVVRRAVEEDESRGQEVEEEAPEEPVAGRDLVTLAACLVGLLTGVSVVLFNLSVHEIRDVFWDSIPLRGASWLREEPIDEVWQRVIFVPVSGGVIVGGLNTLRSSIKTDSNAPVSKIRSAFRPFLKAVAASFTLGTGNSLGPEGPSVEIGSAIAKGFGNVFEWDGGKRLSLVAAGSAAGISSGFNAAVAGCFFAVESVLWPSADSSSLANSTPMVILSSVIASVVSEIGLGSDPAFTVPEYDFRSPTELPLYLLLGVFCGLVSIALSRCTSLAMEAVESLQRATGLRKAASPALGGLIVGLLALLYPEVLYWGFENVDILLESRPFTSGLSTTILVQLIGVKILATSLCRAFGLVGGYYAPSLFIGAATGMAYGKFMRFTFTGPVPLLHVPFLDVASPQAYGLVGMAATLAGVCKVPLTSVLLLFELTQDYRIVLPLLGAVGLSSWIASPQRFSKRIRIKLDSWEDKSSIPQQANNMLTQNKQATSMDAADSSPELCKIESSLCVYDANEDNIFKNLTVADAMKTKYFSVSMTTPLIEALDLMLAERQPFVMITANNTSVRGLLALENIQDFCRAAKTNRAQDEVKELLISHVCQAGKCKSWSVTPQMPLTTAEKIMDSHGVDYLPVVSEDANPQDRGPLIGFVDRECIAIARRATATKEFFSSMYEIKKEER

SEQ ID NO: 1175 - DNA, 561 bp, Sorghum bicolor
  misc_feature: Ceres ANNOT ID no. 6013647
  misc_feature: Encodes the peptide sequence at SEQ ID NO 1176
atggctatggcaatggcttccttcgtcgccgctccgcaccaccacggcagccacctggccgccggcttccccttctccgcgcgagcaggaaggagcgtcggccgcagcggcgccaccatctccatgagagcccagaagaagaagagcaatagtgactccgggagcagtagcggaggtggggacgggcgggccagcagcgggcggcgagtgtggcgtcgtcggaaactgaccaaagaagatgacatgttgcgttacaagttggatcgtatccctttcttagaagagaaggtgagaaaagtaagggagaatgggaagatcatatgcctggacattaatcagctgatgttatctcaagagaatagatttgcgttcaccatggaggtggctgaagaagctaatgcctatcttgagaagaacaggcatgaatatgggttgaagaagcctatactgcatgttctcagtgaccgcatgaatgaagctgggttttctcggcctgagggttacctttatccttatcctatcaagcctggtccttatttcattaaagaggaaggaaactga

SEQ ID NO: 1176 - protein, 186 aa, Sorghum bicolor
  misc_feature: Ceres ANNOT ID no. 6013647
  misc_feature (1)..(186): NCBI GI: 19571083 NCBI Desc: p0692c11.4 [oryza sativa (japonica cultivar-group)]
  misc_feature: Useful for making plants with modulated heat sensitivity
  misc_feature: GREAT-hit functional homolog of the protein sequence encoded by LOCUS at5g24314
  misc_feature: Useful for making plants with modulated heat sensitivity
  misc_feature: Functional homolog of the protein sequence given in SEQ ID NO 13692
MAMAMASFVAAPHHHGSHLAAGFPFSARAGRSVGRSGATISMRAQKKKSNSDSGSSSGGGDGRASSGRRVWRRRKLTKEDDMLRYKLDRIPFLEEKVRKVRENGKIICLDINQLMLSQENRFAFTMEVAEEANAYLEKNRHEYGLKKPILHVLSDRMNEAGFSRPEGYLYPYPIKPGPYFIKEEGN

SEQ ID NO: 1177 - DNA, 1377 bp, Sorghum bicolor
  misc_feature: Ceres ANNOT ID no. 6013648
  misc_feature: Encodes the peptide sequence at SEQ ID NO 1178
atggcgtggtcggagacggacgccgcgctgttcgcggcggtgctggggcgggacgcggcgcaccacctggacctcgtcgagcggggcagcggggcgtggacgtacggcatcttctggcaggagtcccgcgccggcggccgcgccgtgctcggctggggcgacggccactgccgcgacgccagcggcggcggcagcgcctcggcctcgcacgacgacgacgacgatgcggcggagcggagcgtggcgcggaagcgcgcgctgctgcggctgcacgcgctctacggcggcggggacggggacgacgagggagccgactacgcgctccgcctcgaccgggtcaccgccgccgagatgtacttcctcgcgtccatgtacttctccttcccagagggcgcgggcgggccgggccacgcgctcgcgtccggccgccacgcctgggccaccgtggacccccaccacccgcgcggaccgggcgccggtgccgcgcccgcgtggtacgtccgggcgtcgctcgcccagtccgcggggctccgcaccgtcgtcttcctcccgtgcaagggcggcgtcctcgagctcggctccgtcgtgcccgtccgcgagactcccgagacggtgcgcgcaatccagaccgccctcgctgttgcgccgcccccggcacgcgaggaatgcatgagaatcttcggcaaggacctctcccccagcggccgaaccccgcgcagcggcgacaattgggctccacagcagctcggcgtccaagccacggcgtccaaggaagccgccgccgcgagacccaaggctccggagccgccgcccaggagcatagacttcaccaagccgccaggaaagcccgagcagcaggccggtgtcggcgaggagcggaggccgcggaagcgcgggcggaaacccgcgaacgggcgggaggagccactgaaccacgtggaggcggagcggcagcggcgggagaagctgaaccagcggttctacgcgctgcgcgccgtggtccccaagatttccaagatggacaaggcgtcgttgctcagcgacgccatcgcgtacatccaggagctggaggaccggctccgcggcggcggcgggtgctcggcggcgcgcccggagagccccgccgtggaggtgaaggcaatgcaggacgaggtggtgctgcgcgtgacgacgcccctgtacgcgcacccggtctccagggtgttccacgccatcagggacgcccagctgagcgtggcggcgtcggacgtgagcgtggcggacgacgccgtgacgcacacgctcgtgctgcggtcggccgggcccgagcagctcaccgcggagacggtgctcgcggcgatgtcacgggggatgaccagcgccaccccctccccgtga

SEQ ID NO: 1178 - protein, 458 aa, Sorghum bicolor
  misc_feature: Ceres ANNOT ID no. 6013648
  misc_feature (308)..(357): Pfam Id: HLH Pfam Desc: Helix-loop-helix DNA-binding domain
  misc_feature (1)..(458): NCBI GI: 56784918 NCBI Desc: bhlh protein-like [oryza sativa (japonica cultivar-group)]
  misc_feature (245)..(453): NCBI GI: 115435532 NCBI Desc: os01g0235700 [oryza sativa (japonica cultivar-group)]
  misc_feature (251)..(458): NCBI GI: 20453066 NCBI Desc: at2g46510/f13a10.4 [arabidopsis thaliana]
  misc_feature (292)..(360): NCBI GI: 45477841 NCBI Desc: myc protein [oryza sativa]
  misc_feature (284)..(361): NCBI GI: 33339705 NCBI Desc: myc2 [catharanthus roseus]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1238 in the 10/412,699US patent application
  misc_feature: The sequence is a functional homolog of SEQ ID NO 2 in the 10/374,780US patent application
  misc_feature: The sequence is a functional homolog of SEQ ID NO 2366 in the 10/374,780US patent application
  misc_feature: The sequence is a functional homolog of SEQ ID NO 2830 in the 10/374,780US patent application
  misc_feature: The sequence is a functional homolog of SEQ ID NO 42 in the 11/375,241US patent application
  misc_feature: The sequence is a functional homolog of SEQ ID NO 464 in the 11/435,388US patent application
  misc_feature: The sequence is a functional homolog of SEQ ID NO 84 in the 11/375,241US patent application
  misc_feature: The sequence is a functional homolog of SEQ ID NO 92 in the 10/225,066US patent application
  misc_feature: The sequence is a functional homolog of SEQ ID NO 928 in the 10/225,066US patent application
  misc_feature: The sequence is a functional homolog of SEQ ID NO 943 in the 10/374,780US patent application
  misc_feature: The sequence is a functional homolog of SEQ ID NO 96 in the 10/374,780US patent application
  misc_feature: The sequence is a functional homolog of SEQ ID NO 960 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1238 in the 20040045049 US patent application
  misc_feature: The sequence is a functional homolog of SEQ ID NO 92 in the 20050160493 US patent application
  misc_feature: The sequence is a functional homolog of SEQ ID NO 928 in the 20050160493 US patent application
  misc_feature: The sequence is a functional homolog of SEQ ID NO 96 in the 20060162006 US patent application
  misc_feature: The sequence is a functional homolog of SEQ ID NO 960 in the 20060162006 US patent application
  misc_feature: The sequence is a functional homolog of SEQ ID NO. 414 in the 11/188,298 US application
  misc_feature: The sequence is a functional homolog of SEQ ID NO. 483 in the 11/188,298 US application
MAWSETDAALFAAVLGRDAAHHLDLVERGSGAWTYGIFWQESRAGGRAVLGWGDGHCRDASGGGSASASHDDDDDAAERSVARKRALLRLHALYGGGDGDDEGADYALRLDRVTAAEMYFLASMYFSFPEGAGGPGHALASGRHAWATVDPHHPRGPGAGAAPAWYVRASLAQSAGLRTVVFLPCKGGVLELGSVVPVRETPETVRAIQTALAVAPPPAREECMRIFGKDLSPSGRTPRSGDNWAPQQLGVQATASKEAAAARPKAPEPPPRSIDFTKPPGKPEQQAGVGEERRPRKRGRKPANGREEPLNHVEAERQRREKLNQRFYALRAVVPKISKMDKASLLSDAIAYIQELEDRLRGGGGCSAARPESPAVEVKAMQDEVVLRVTTPLYAHPVSRVFHAIRDAQLSVAASDVSVADDAVTHTLVLRSAGPEQLTAETVLAAMSRGMTSATPSP

SEQ ID NO: 1179 - DNA, 189 bp, Sorghum bicolor
  misc_feature: Ceres ANNOT ID no. 6013660
  misc_feature: Encodes the peptide sequence at SEQ ID NO 1180
atggcatccaaggtcttccgcgccgtcgtcgtcgccgcgctcgccgcgtccgccctcgcgggggtcgccatggccgccgacgagcccgcgccgagccccacgtccggtgccgccgccgtctcgtcctcgttcgtcgccgccgtcctctgccccgccgtggcgctcctcttcggcagcctgcgtcactga

SEQ ID NO: 1180 - protein, 62 aa, Sorghum bicolor
  misc_feature: Ceres ANNOT ID no. 6013660
  misc_feature (9)..(59): NCBI GI: 25992536 NCBI Desc: fiber protein fb7 [gossypium barbadense]
  misc_feature (4)..(55): NCBI GI: 115440295 NCBI Desc: os01g0778300 [oryza sativa (japonica cultivar-group)]
  misc_feature: Useful for making plants with altered cell wall content and/or composition
  misc_feature: GREAT-hit functional homolog of the protein sequence encoded by LOCUS at5g11740
MASKVFRAVVVAALAASALAGVAMAADEPAPSPTSGAAAVSSSFVAAVLCPAVALLFGSLRH

SEQ ID NO: 1181 - DNA, 1257 bp, Sorghum bicolor
  misc_feature: Ceres ANNOT ID no. 6013663
  misc_feature: Encodes the peptide sequence at SEQ ID NO 1182
atggacgctacctttggctgggccggcgccggccaccatgttgacgaatacttctcgcgccaggctgctgctggatgcagtcggttcgacatggacgaggccttccttggggtgtgctttgggcagctccagtgcgacggtgcccttattggcggcggcggcggcgacgccggagcatgccaggtgagctcgaatgcgtgtgccatcgaaggcggcggcgcgggtatggacggcgacccgctcgcgttcttgagcgcggggacgggggatgtcttcgacgctggcctactcgacgcggcgctcgccttcacccgggagctcggatacggcggggcggtgtccaacggcggcgccatgctctccagctacagcggtacaaccggcggaaacatatcctccggggagtcaaacaactatagcggcggcggcggcggcggccacgacgccgaggtggtgtcgccgacgtccatcatgtcacaaaccaccacggcgccgccgccgttgacgtttacccacgcgtcatcccactcacagcaggcggcacacggccaccgcgtcaagaggaaggtcgacgtgagcgacgagttcccggcgaccgccatcgcaacaacaacaaccaccgcaccgccaccggcgccgttcccgcggcctgccggcggtggcgcgaagcggcgtgccgcggcgacgagcatcagcttcggcggcggcgcccatgtcgcgcgcgatcccagcgcggggtacgagccggacatggaggcgatggcgcaggtgaaggagatgatctaccgcgcggcggcgatgcggcccgtgaacctgggacccgaggtgatcgccgcggcggccgcggagaagccccggcggaagaacgtgcgcatctcgagcgacccgcagacggtggcggcgcggctgcggcgggagcgcgtgagcgagcgcctgcgcgtgctgcagaagcttgtccccgggggcagcaagatggacacagcgtccatgctggacgaggcggcgagctacctcaagttcctcaagtctcaggtccaggcgctggaaaccctaggcacgaccaacgacacgagcaccagcaacagcacagcaacagcaagcaggtcgcagcaatacaactattacagcagcggcagcaataatcctggtgggttcctcggatttgcagcaggaaggagcagtaacatgatttctccagctgggtatgtaaatccaacaatcggatcgtcgaatactagcagcaaactactgttgtag

SEQ ID NO: 1182 - protein, 418 aa, Sorghum bicolor
  misc_feature: Ceres ANNOT ID no. 6013663
  misc_feature (295)..(342): Pfam Id: HLH Pfam Desc: Helix-loop-helix DNA-binding domain
  misc_feature (80)..(381): NCBI GI: 52076301 NCBI Desc: bhlh transcription-like [oryza sativa (japonica cultivar-group)]
  misc_feature (244)..(387): NCBI GI: 92897159 NCBI Desc: helix-loop-helix dna-binding [medicago truncatula]
  misc_feature (248)..(350): NCBI GI: 140071559 NCBI Desc: helix-loop-helix dna-binding [medicago truncatula]
  misc_feature (197)..(364): NCBI GI: 51536285 NCBI Desc: basic helix-loop-helix (bhlh)-like protein [oryza sativa (japonica cultivar-group)]
  misc_feature (253)..(363): NCBI GI: 83853819 NCBI Desc: bhelix-loop-helix transcription factor [glycine max]
  misc_feature: The sequence is a functional homolog of SEQ ID NO 1208 in the 10/666,642US patent application
  misc_feature: The sequence is a functional homolog of SEQ ID NO 134 in the 10/225,066US patent application
  misc_feature: The sequence is a functional homolog of SEQ ID NO 1561 in the 11/479,226US patent application
  misc_feature: The sequence is a functional homolog of SEQ ID NO 16 in the 10/412,699US patent application
  misc_feature: The sequence is a functional homolog of SEQ ID NO 1658 in the 10/374,780US patent application
  misc_feature: The sequence is a functional homolog of SEQ ID NO 1679 in the 10/412,699US patent application
  misc_feature: The sequence is a functional homolog of SEQ ID NO 1937 in the 10/374,780US patent application
  misc_feature: The sequence is a functional homolog of SEQ ID NO 1938 in the 10/374,780US patent application
  misc_feature: The sequence is a functional homolog of SEQ ID NO 1939 in the 10/374,780US patent application
  misc_feature: The sequence is a functional homolog of SEQ ID NO 2538 in the 10/374,780US patent application
  misc_feature: The sequence is a functional homolog of SEQ ID NO 266 in the 10/225,066US patent application
  misc_feature: The sequence is a functional homolog of SEQ ID NO 448 in the 10/374,780US patent application
  misc_feature: Useful for biocontainment applications
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1679 in the 20040045049 US patent application
  misc_feature: The sequence is a functional homolog of SEQ ID NO 134 in the 20050160493 US patent application
  misc_feature: The sequence is a functional homolog of SEQ ID NO 266 in the 20050160493 US patent application
  misc_feature: The sequence is a functional homolog of SEQ ID NO 1937 in the 20060162006 US patent application
  misc_feature: The sequence is a functional homolog of SEQ ID NO 1938 in the 20060162006 US patent application
  misc_feature: The sequence is a functional homolog of SEQ ID NO 1939 in the 20060162006 US patent application
  misc_feature: The sequence is a functional homolog of SEQ ID NO 1208 in the 20070033671 US patent application
  misc_feature: Functional homolog of the protein sequence given in SEQ ID NO 13582
  misc_feature: The sequence is a functional homolog of SEQ ID NO 1938 in the 10/374,780 US patent application
MDATFGWAGAGHHVDEYFSRQAAAGCSRFDMDEAFLGVCFGQLQCDGALIGGGGGDAGACQVSSNACAIEGGGAGMDGDPLAFLSAGTGDVFDAGLLDAALAFTRELGYGGAVSNGGAMLSSYSGTTGGNISSGESNNYSGGGGGGHDAEVVSPTSIMSQTTTAPPPLTFTHASSHSQQAAHGHRVKRKVDVSDEFPATAIATTTTTAPPPAPFPRPAGGGAKRRAAATSISFGGGAHVARDPSAGYEPDMEAMAQVKEMIYRAAAMRPVNLGPEVIAAAAAEKPRRKNVRISSDPQTVAARLRRERVSERLRVLQKLVPGGSKMDTASMLDEAASYLKFLKSQVQALETLGTTNDTSTSNSTATASRSQQYNYYSSGSNNPGGFLGFAAGRSSNMISPAGYVNPTIGSSNTSSKLLL

SEQ ID NO: 1183 - DNA, 843 bp, Sorghum bicolor
  misc_feature: Ceres ANNOT ID no. 6013665
  misc_feature: Encodes the peptide sequence at SEQ ID NO 1184
atgggcgcgccgaagcagaagtggacgtcggaagaggaggatgcgctccgcgccggcgtgcgcaagcacggcgcaggcaaatggcggaccatccagaaggaccccgagttcagcccggtcctgtcctcccgctccaacatcgacctcaaggacaaatggaggaatttaagtttcagtgcaagtggactgggatcaagtaaagtacgggttccaaggataactggacccacatcttccccatcgcctagtgcacaagctctgcttctcccagcgccaaataaagttactgaagctacactgcctgcagatgctgagaaaaagccacaagatgggaaaactccgccaaagtatggtgtcatgatcatggaagctctttcggaattgaatgagccgaatggttcagatatggctgcaatcctccgcttcatagaggaaaggcatgtggtgcaaccgacctttagaagatttctaacctcaaagttacggcgacttgcagactcaaacaaaattgtaaagatcgataagtcttataggctcccagattcctttgcaacaaggactccagctccaaaacagaaggatccatcaaagccatcgaaggtgtcaaagaccataggattatttactgcctccagccctgcactagaggcagcgatggcagctgctgtcaaggtggctgacgcggaggcaaaagcacatgacgcacatgatcagatgatggaggcagaaaggatcctcaagatggctgaggatactgagtctctcctcacaattgcagtagagatctatgaccgatgtttaaggggagagataaccacaatagtggcgcaaagggatgtttga

SEQ ID NO: 1184 - protein, 280 aa, Sorghum bicolor
  misc_feature: Ceres ANNOT ID no. 6013665
  misc_feature (113)..(181): Pfam Id: Linker_histone Pfam Desc: linker histone H1 and H5 family
  misc_feature (5)..(57): Pfam Id: Myb_DNA-binding Pfam Desc: Myb-like DNA-binding domain
  misc_feature (1)..(280): NCBI GI: 18463961 NCBI Desc: histone h1-like protein [zea mays]
  misc_feature (1)..(280): NCBI GI: 34105721 NCBI Desc: single myb histone 4 [zea mays]
  misc_feature (1)..(279): NCBI GI: 34105717 NCBI Desc: single myb histone 3 [zea mays]
  misc_feature (1)..(277): NCBI GI: 27125811 NCBI Desc: myb28 protein [oryza sativa (japonica cultivar-group)]
  misc_feature (51)..(277): NCBI GI: 56784760 NCBI Desc: dna-binding protein myb1-like [oryza sativa (japonica cultivar-group)]
  misc_feature: The plant produces a reduced number of seeds.
  misc_feature: The sequence is a functional homolog of SEQ ID NO 1219 in the 10/666,642US patent application
  misc_feature: The sequence is a functional homolog of SEQ ID NO 1220 in the 10/666,642US patent application
  misc_feature: The sequence is a functional homolog of SEQ ID NO 1221 in the 10/666,642US patent application
  misc_feature: The sequence is a functional homolog of SEQ ID NO 388 in the 10/666,642US patent application
  misc_feature: Useful for biocontainment applications
  misc_feature: Useful for making plants with modulated growth and phenotype characteristics
  misc_feature: GREAT-hit functional homolog of the protein sequence given in SEQ ID NO 12962
  misc_feature: The sequence is a functional homolog of SEQ ID NO 1219 in the 20070033671 US patent application
  misc_feature: The sequence is a functional homolog of SEQ ID NO 1220 in the 20070033671 US patent application
  misc_feature: The sequence is a functional homolog of SEQ ID NO 1221 in the 20070033671 US patent application
  misc_feature: The sequence is a functional homolog of SEQ ID NO 388 in the 20070033671 US patent application
  misc_feature: Useful for biocontainment applications
  misc_feature: Functional homolog of the protein sequence given in SEQ ID NO 12962
  misc_feature: The sequence is a functional homolog of SEQ ID NO. 395 in the 11/188,298 US application
MGAPKQKWTSEEEDALRAGVRKHGAGKWRTIQKDPEFSPVLSSRSNIDLKDKWRNLSFSASGLGSSKVRVPRITGPTSSPSPSAQALLLPAPNKVTEATLPADAEKKPQDGKTPPKYGVMIMEALSELNEPNGSDMAAILRFIEERHVVQPTFRRFLTSKLRRLADSNKIVKIDKSYRLPDSFATRTPAPKQKDPSKPSKVSKTIGLFTASSPALEAAMAAAVKVADAEAKAHDAHDQMMEAERILKMAEDTESLLTIAVEIYDRCLRGEITTIVAQRDV

SEQ ID NO: 1185 - DNA, 1413 bp, Sorghum bicolor
  misc_feature: Ceres ANNOT ID no. 6013669
  misc_feature: Encodes the peptide sequence at SEQ ID NO 1186
atggagccgagggttgggaacaagttccggcttggccgcaagatcgggagcggctctttcggggagatctacctcggcaccaatatccagacgaacgaggaggttgcgattaagctggaaaatgtgaagacaaagcatcctcagttgctctatgaatcaaagatttataggattctgcaaggaggaactggaataccgaacgtcagatggtttggtgtagaaggagactacaatgtcttggttatggatttacttggaccaagccttgaggatctattcaatttctgcagcaggaaattgtctctgaagactgtacttatgctcgctgatcagatgataaatcgagtggaatttgttcattccaagtcttttctgcatcgagatattaagcctgataatttcctcatgggtcttggcagacgagctaatcaggtctacgttatagactttggccttgctaaaaaatacagggatacctcgacgcatcagcacatcccatacagggagaacaagaacttgacaggaactgcaagatatgctagtgtcaacacccatcttggcattgaacaaagccgaagagatgacttggaatctcttggatatgtgcttatgtacttcctgaggggcagccttccttggcaaggtcttaaagcaggaacaaagaagcaaaagtatgagaaaattagtgagaagaaagttgcaacatcaattgaggctctatgccgtgggtatcctactgagtttgcatcatatttccattattgccgctcactacggtttgatgacaagcctgactattcatacctcaagcgattattccgtgaccttttcattcgcgaaggttttcagtttgactatgtatttgactggacaatactgaagtaccaacaatctcaaatagccactgctccaccccgtgtgggccatggcgcggggccttctgggttggcacctgcattacagaatgacaggcaatcaggccctgaggaagcaaggactagtggttggtcatcaatggaccggcgtcgtgccccactaccaattacaagcgtggggacattatctaagcagaaagcaccagtagggaatgatgctactgtttctagagatgctgtgatatctggaccaaactttctgggaaggtcaagtggatcttcaaggaggcctgttatttcaactagccgtgatgtggtggccactgatagttctgagccttcacgagcacgtacaactgatgcaagccctggggcattccgcagagcctcaggtccccagagaagctcacctgtccattctgcagaacaaaagcgctcatcctcaggccggcatccatctaatgtgaagaactatgattctgctctcaaaggcattgaaggtcttaattttgatggtgacgagagggttcagtactag

SEQ ID NO: 1186 - protein, 470 aa, Sorghum bicolor
  misc_feature: Ceres ANNOT ID no. 6013669
  misc_feature (9)..(278): Pfam Id: Pkinase Pfam Desc: Protein kinase domain
  misc_feature (9)..(273): Pfam Id: Pkinase_Tyr Pfam Desc: Protein tyrosine kinase
  misc_feature (1)..(470): NCBI GI: 92873006 NCBI Desc: protein kinase [medicago truncatula]
  misc_feature (1)..(468): NCBI GI: 121501708 NCBI Desc: casein kinase [beta vulgaris]
  misc_feature (1)..(456): NCBI GI: 115439493 NCBI Desc: os01g0708400 [oryza sativa (japonica cultivar-group)]
  misc_feature (1)..(460): NCBI GI: 124361134 NCBI Desc: protein kinase [medicago truncatula]
  misc_feature (40)..(462): NCBI GI: 6635385 NCBI Desc: casein kinase i-like protein [brassica oleracea]
  misc_feature (1)..(452): SWISSPROT Homolog: EC 2.7.11.1 Casein kinase I isoform delta-like
  misc_feature: The sequence is a functional homolog of SEQ ID NO 32 in US patent 7179962
  misc_feature: The sequence is a functional homolog of SEQ ID NO. 310 in the 11/188,298 US application
  misc_feature: The sequence is a functional homolog of SEQ ID NO. 332 in the 11/188,298 US application
  misc_feature: The sequence is a functional homolog of SEQ ID NO. 498 in the 11/188,298 US application
  misc_feature: The sequence is a functional homolog of SEQ ID NO. 311 in the 11/188,298 US application
  misc_feature: The sequence is a functional homolog of SEQ ID NO. 358 in the 11/188,298 US application
  misc_feature: The sequence is a functional homolog of SEQ ID NO. 312 in the 11/188,298 US application
  misc_feature: The sequence is a functional homolog of SEQ ID NO. 399 in the 11/188,298 US application
  misc_feature: The sequence is a functional homolog of SEQ ID NO. 520 in the 11/188,298 US application
  misc_feature: The sequence is a functional homolog of SEQ ID NO. 464 in the 11/188,298 US application
  misc_feature: The sequence is a functional homolog of SEQ ID NO. 323 in the 11/188,298 US application
  misc_feature: The sequence is a functional homolog of SEQ ID NO. 495 in the 11/188,298 US application
  misc_feature: The sequence is a functional homolog of SEQ ID NO. 441 in the 11/188,298 US application
  misc_feature: The sequence is a functional homolog of SEQ ID NO. 340 in the 11/188,298 US application
  misc_feature: The sequence is a functional homolog of SEQ ID NO. 366 in the 11/188,298 US application
MEPRVGNKFRLGRKIGSGSFGEIYLGTNIQTNEEVAIKLENVKTKHPQLLYESKIYRILQGGTGIPNVRWFGVEGDYNVLVMDLLGPSLEDLFNFCSRKLSLKTVLMLADQMINRVEFVHSKSFLHRDIKPDNFLMGLGRRANQVYVIDFGLAKKYRDTSTHQHIPYRENKNLTGTARYASVNTHLGIEQSRRDDLESLGYVLMYFLRGSLPWQGLKAGTKKQKYEKISEKKVATSIEALCRGYPTEFASYFHYCRSLRFDDKPDYSYLKRLFRDLFIREGFQFDYVFDWTILKYQQSQIATAPPRVGHGAGPSGLAPALQNDRQSGPEEARTSGWSSMDRRRAPLPITSVGTLSKQKAPVGNDATVSRDAVISGPNFLGRSSGSSRRPVISTSRDVVATDSSEPSRARTTDASPGAFRRASGPQRSSPVHSAEQKRSSSGRHPSNVKNYDSALKGIEGLNFDGDERVQY

SEQ ID NO: 1187 - DNA, 1227 bp, Sorghum bicolor
  misc_feature: Ceres ANNOT ID no. 6013676
  misc_feature: Encodes the peptide sequence at SEQ ID NO 1188
atggagtcgacctccggcgaggacgctccgaagcgcaacccgctcccggccgcgctcgtctccaacctccagtccgtgctcgccgcacgccgcccgcccggggccgaggtcagcactgaggcgtcggctccggaggcggaggcttccgatgtacccgcgggagatggggcgccggcgaggcccatcgtgctgctgacctgtgccggggggatccggtccgcgggtctcgcggcgctcgtcgacgccctcgttgccagcggccgctgcgatgtccacgtgtgtgcccccgaatcggacaagccagcctgtggccactcaattaccatccgtgaaaccatcaccgcgacatccgtggatttcacaggtgctaaagcttttgagatatcaggcacgccggttgactgtgtctcgttggccttatctgggaggctgtttccttggtcgtctcctgctttggtgatcagtggtatcaacacaggactaaattgtggatatgagatgttccattcttctgccattgctgctgcaagggaagccttagtgtatggggtgccttcaattgcaatctcattgaattggaagaaggatgaaaccaaagacagtgacttcaaggatgcagctcaggcctgtttaccattgataaatgctgccttggatgacattgtgaaaggaactttcctcagaggatgcctactgaatattggaattccaagtgcaccatctgcaaataagggtttcaagttgaccaaacagagtggatacagtcctgctcaaagttggcaagctgtgtcagcaagcaggccctcatctgctactcacttcatgggcatgcatcaaagcctcggtattcagctggcgcagcttgggaaggatgcatctgcagcaggagctgcacgtagagttagtgcccaacgaaagacggttgaggttgagtctgttgcagcttctggtaaacaagagattcgagaagtagtgaagaagttattccgtgctgagtttgtcgagaagcaacatgaaggtttagatgaggatatcgatttgagagctttggagaatggatttatatctgtcacccctctgaatgttcatgggcaagtggagcctgaaatgggagccccagcttcagattggctctctgcagctgtatctctagataaagaaaaggacgctgctccagctgcagctgagcaacaagatgttgcagctgaggaaaaagaagctccttag

SEQ ID NO: 1188 - protein, 408 aa, Sorghum bicolor
  misc_feature: Ceres ANNOT ID no. 6013676
  misc_feature (61)..(258): Pfam Id: SurE Pfam Desc: Survival protein SurE
  misc_feature (1)..(408): NCBI GI: 115439507 NCBI Desc: os01g0709400 [oryza sativa (japonica cultivar-group)]
  misc_feature (161)..(382): NCBI GI: 144923338 NCBI Desc: survival protein sure [medicago truncatula]
  misc_feature (15)..(382): NCBI GI: 92872744 NCBI Desc: survival protein sure [medicago truncatula]
  misc_feature (55)..(265): NCBI GI: 92893321 NCBI Desc: survival protein sure [medicago truncatula]
  misc_feature (63)..(265): NCBI GI: 140056998 NCBI Desc: survival protein sure [medicago truncatula]
MESTSGEDAPKRNPLPAALVSNLQSVLAARRPPGAEVSTEASAPEAEASDVPAGDGAPARPIVLLTCAGGIRSAGLAALVDALVASGRCDVHVCAPESDKPACGHSITIRETITATSVDFTGAKAFEISGTPVDCVSLALSGRLFPWSSPALVISGINTGLNCGYEMFHSSAIAAAREALVYGVPSIAISLNWKKDETKDSDFKDAAQACLPLINAALDDIVKGTFLRGCLLNIGIPSAPSANKGFKLTKQSGYSPAQSWQAVSASRPSSATHFMGMHQSLGIQLAQLGKDASAAGAARRVSAQRKTVEVESVAASGKQEIREVVKKLFRAEFVEKQHEGLDEDIDLRALENGFISVTPLNVHGQVEPEMGAPASDWLSAAVSLDKEKDAAPAAAEQQDVAAEEKEAP

SEQ ID NO: 1189 - DNA, 1362 bp, Sorghum bicolor
  misc_feature: Ceres ANNOT ID no. 6013678
  misc_feature: Encodes the peptide sequence at SEQ ID NO 1190
atgaaggagagaagcggctccagggcggcggtggacgagcgctacgcgcagtggaagtcgctcatccccgtcctctacgactggtttgctaaccacaacctcgtctggccatccctctcctgccggtgggggccacagtttgagaaagctacctacaagaatcgtcaacgcctttacctatctgagcagacggatgggagtgtgcctaatactctagttatcgcaaactgtgaagttgtgaagccacgggttgcagctgctgaacatatctcgcagtttaacgaggaagcacgatcaccttttgttaagaagtacaagaccatagttcatcctggtgaagttaacagaatcagggagcttccacagaacagtaagatcatagccactcacactgacagtccagatgtacttatttgggatgttgaagcacagccaaatagacatgccgtcctaggagcttctgaatctcgccctgatctgatattaacgggacataaggaaaatgcggaatttgcgcttgctatgtgcccagcagaaccatatgtcctatcaggaggaaaggacaaatctgttgtcttgtggagcatccaagaccacatatctgcccttggggattcctcgtcttctcctggagcatctggcagcaagcagtctggtaaatctgcaactgaaaaggagagccctaaagttgatcctagaggtatattccacggacatgacagcactgttgaagatgttcagttctgcccttccagtgcgcaggagttttgtagtgtgggtgatgatgcttgtcttattctgtgggatgctcgaactggcactggcccagctgttaaggttgagaaagctcacagtggagatgttcattgtgttgattggaatccccttgacgttaactatatcttaactggttctgccgataactctgtccgaatgtgggatcgtcgtaagctgggttcgggaggagctagttctccaattcataaatttgagggccataaagctgctgttctttgtgttcagtggtcacctgacagagcatctgtttttggaagttctgcggaagatggtttcttaaacgtgtgggatcatgagaaggttgggactaagaaaaatactaatgtcccagctgggcttttcttccagcatgctggtcatagggataagattgtagacttccactggaattcgtcagatccttggacaattgtcagtgtatctgatgatggtgagagcactggtggaggcggaacactgcagatatggcgcatgagtgatttgatctaccgccctgaggatgaagttcttacagaactggagaatttcaaggctcacttggccagctgtgctccaaggacttga

SEQ ID NO: 1190 - protein, 453 aa, Sorghum bicolor
  misc_feature: Ceres ANNOT ID no. 6013678
  misc_feature (230)..(269): Pfam Id: WD40 Pfam Desc: WD domain, G-beta repeat
  misc_feature (275)..(314): Pfam Id: WD40 Pfam Desc: WD domain, G-beta repeat
  misc_feature (324)..(363): Pfam Id: WD40 Pfam Desc: WD domain, G-beta repeat
  misc_feature (1)..(452): NCBI GI: 14550114 NCBI Desc: nucleosome/chromatin assembly factor c [zea mays]
  misc_feature (1)..(452): NCBI GI: 21898564 NCBI Desc: nucleosome/chromatin assembly factor group c [zea mays]
  misc_feature (1)..(452): NCBI GI: 9716495 NCBI Desc: wd-repeat protein rbap1 [zea mays]
  misc_feature (2)..(453): NCBI GI: 61611729 NCBI Desc: fve [pisum sativum]
  misc_feature (1)..(452): NCBI GI: 2599092 NCBI Desc: wd-40 repeat protein msi4 [arabidopsis thaliana]
  misc_feature: Useful for making plants with modulated flowering time
  misc_feature: GREAT-hit functional homolog of the protein sequence given in SEQ ID NO 13386
  misc_feature: Useful for making plants with modulated flowering time
  misc_feature: Functional homolog of the protein sequence given in SEQ ID NO 13386
  misc_feature: The sequence is a functional homolog of SEQ ID NO. 502 in the 11/188,298 US application
  misc_feature: The sequence is a functional homolog of SEQ ID NO. 485 in the 11/188,298 US application
MKERSGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGASESRPDLILTGHKENAEFALAMCPAEPYVLSGGKDKSVVLWSIQDHISALGDSSSSPGASGSKQSGKSATEKESPKVDPRGIFHGHDSTVEDVQFCPSSAQEFCSVGDDACLILWDARTGTGPAVKVEKAHSGDVHCVDWNPLDVNYILTGSADNSVRMWDRRKLGSGGASSPIHKFEGHKAAVLCVQWSPDRASVFGSSAEDGFLNVWDHEKVGTKKNTNVPAGLFFQHAGHRDKIVDFHWNSSDPWTIVSVSDDGESTGGGGTLQIWRMSDLIYRPEDEVLTELENFKAHLASCAPRT

SEQ ID NO: 1191 - DNA, 1422 bp, Sorghum bicolor
  misc_feature: Ceres ANNOT ID no. 6013681
  misc_feature: Encodes the peptide sequence at SEQ ID NO 1192
atggacgcgagccagggcgtcctcctgtccagctccctggtcggcggcgccaagggctccgcgtcatggccggagctgctcggctccgcgcactgggagggcctcctggaccctctcgacctcacgctccgccgcctcatcctgctctgcggcgacctctgccaggtcacctacgactccttcaactccgacccccactccaagtactccggcagctgccgctactccaggtccacgctcttcgctcgcacgctgttcccggccgccgccgacatctccccggccgcgtacctctacgcgacctcccagtcgtcgttcccgggcggcatcatggtgttctcgctctcccgcgaggcgtggagcaaggagtccaactggatcggctacgtctccgtgtccacggacgccgccgcggccgccacgggccagcgcgtcatctacgtggcgtggcgcggcaccatccggacgctggagtgggtcgacgtgctcaagccggagctcgtctcccccgacgccatcctgccggagggggacccgtcccggggccaggctcgcgtgatggaggggtggtacctcatctacacctccagcgacgagcggtcgcccttctccaggtacagcgcgcgggagcagctgctcgccgcggtgcgcgagctggtggcccggtacaaggacaaggacgagagcctcagcatcgtgtgcacgggccacagcctcggcgcgtcgctggccacgctctgcgcgttcgacatcgcggtgaacggcgtgtccagggtgggcggcgccgacatccccgtcacggccatcgtgttcgggagcccgcagatcgggaacccggagttcaagaagaggttcgaggagctgcccaacctgcgggcgctgcacgtcaggaacacgcccgacctgatcccgctgtacccgagcggcctcctgggctacgccaacgccggcgacgtcctggccgtggactccaagaagtcgccgtacgtgaaagacgactccaccaacctcggggactaccacaacctgcagggcatcctgcacacggtggcgggctggaacggcaaggacggcgagttcaagctgcaggtgcagcgcagcgtggcgctggtgaacaagtcgtccgccttcctcaaggacgacaacctcgtgccggagtcatggtgggtggagcggaacaaggggatggtcatcggagaaaccgggctgtgggagctcgagcctcctgccgaggagaaccttcccgtaccgccagtcgtgaccgggaacgggaaggtcatcggtgacgatgacgctgctgccaccactaccactaccactgctacggcggctagtatggagacaaagacaccggcgaaggataagaaggggcctgggaccaagcttttctcagcatgctttagagttagaggggtcaattaa

SEQ ID NO: 1192 - protein, 473 aa, Sorghum bicolor
  misc_feature: Ceres ANNOT ID no. 6013681
  misc_feature (147)..(311): Pfam Id: Lipase_3 Pfam Desc: Lipase (class 3)
  misc_feature (1)..(464): NCBI GI: 56784140 NCBI Desc: lipase-like [oryza sativa (japonica cultivar-group)]
  misc_feature (153)..(415): NCBI GI: 4103627 NCBI Desc: lipase [dianthus caryophyllus]
  misc_feature (23)..(406): NCBI GI: 7268648 NCBI Desc: lipase-like protein [arabidopsis thaliana]
  misc_feature (7)..(414): NCBI GI: 20146431 NCBI Desc: lipase-like [oryza sativa (japonica cultivar-group)]
  misc_feature (23)..(407): NCBI GI: 21537306 NCBI Desc: lipase-like protein [arabidopsis thaliana]
MDASQGVLLSSSLVGGAKGSASWPELLGSAHWEGLLDPLDLTLRRLILLCGDLCQVTYDSFNSDPHSKYSGSCRYSRSTLFARTLFPAAADISPAAYLYATSQSSFPGGIMVFSLSREAWSKESNWIGYVSVSTDAAAAATGQRVIYVAWRGTIRTLEWVDVLKPELVSPDAILPEGDPSRGQARVMEGWYLIYTSSDERSPFSRYSAREQLLAAVRELVARYKDKDESLSIVCTGHSLGASLATLCAFDIAVNGVSRVGGADIPVTAIVFGSPQIGNPEFKKRFEELPNLRALHVRNTPDLIPLYPSGLLGYANAGDVLAVDSKKSPYVKDDSTNLGDYHNLQGILHTVAGWNGKDGEFKLQVQRSVALVNKSSAFLKDDNLVPESWWVERNKGMVIGETGLWELEPPAEENLPVPPVVTGNGKVIGDDDAAATTTTTTATAASMETKTPAKDKKGPGTKLFSACFRVRGVN

SEQ ID NO: 1193 - DNA, 1551 bp, Sorghum bicolor
  misc_feature: Ceres ANNOT ID no. 6014067
  misc_feature: Encodes the peptide sequence at SEQ ID NO 1194
atgacgagtgcggagacccatctcctctgccgcgtgcgactcgcgcttctcctcctcctcgtttgctcttggtggctcctcccccggtccgatgccaggaggacgctggtggcgccggggcttcccatccgcgctgtgaacctcggcggctggctcctgacggagggctggatattgccatccctcttcgatgacattccgaacaaagacctactggatggcacccagctccagttcaagtccgtgacacagaacaggtacctcgtcgctgaccagggcggcggcgcggccatcctcgccgaccgggtccaggcgtccggctgggagaccttcaagctgtggaggattaacgagaccacgttcaacttgcgcgtcttcggcaaccagttcgtgggcgtcaacagcaccgccggagtcgtggcgacggccaacacgccggggccctcggagacgttccagctcgtgcgctggaacagcgacaagagccgagtgcgcatcagggcgcccaatggcctcttcttgcaggccaagaccatggaatcggtgacagcagaccacaaagaggacacagactggggtgacgatgacccatcagtttttctgacgaataatgtgggcggcttacaaggggagtaccagatatgcaacggctatggcataacagaggcgacacaagtactcaggaaccactggagcacatacataaatgagagcgactttagcttcgtcgcatcaagcggactgaacgcggtgagaatcccagtgggatggtggattgccagtgacccctaccctccacatcctttcgttggaggatctctccaggccttggataacgcattcagctgggcagagaagtacaagttgggtgttattgtggacttgcacgctgcaccggggtcacagaacccgtttgagcacagcgcaaccagagacgggtcgcaggagtggggcaccaccgatgcaaacatcgctcagacagtgcaagtcatcgatttcctcgcgtcaaggtatgcgagcagccctagcctcctggcagtggagctactgaacgagccattggcgccgggcgccaccctgtccagcctgaccaagtactaccaggaaggctacaacgccgtgcggcggcacacatccgcggcgtatgtgatcatgtccaacaggctatccgcagacgcgacggagctcctccagttcgccggaggcttctcgggcgccgtcctcgacgtgcactactacaacctgtttagcagcgtcttcaacagcctcacggtggagcagaacatcgacttcgtgaggaacaaccgctccaccgacatcgccaccgtcaccaaccagaatggacgccctctcacgttcgtgggggagtgggtagccgagtgggacgtgcaaggtgcgaataagacggactaccagaggtttgcgcaagtgcagcaggatgtatacgggcgagctacttttggatggtcctattggacgctcaagaatgtcaataaccattggagtatgcagtggatgatccaaaatggatacatctcacttaaaagctag

SEQ ID NO: 1194 - protein, 516 aa, Sorghum bicolor
  misc_feature: Ceres ANNOT ID no. 6014067
  misc_feature (213)..(502): Pfam Id: Cellulase Pfam Desc: Cellulase (glycosyl hydrolase family 5)
  misc_feature (42)..(514): NCBI GI: 144924148 NCBI Desc: glycoside hydrolase, family 5 [medicago truncatula]
  misc_feature (35)..(514): NCBI GI: 144924149 NCBI Desc: glycoside hydrolase, family 5; n-6 adenine-specific dna methylase [medicago truncatula]
  misc_feature (87)..(514): NCBI GI: 144924146 NCBI Desc: glycoside hydrolase, family 5; actin-crosslinking proteins [medicago truncatula]
  misc_feature (40)..(514): NCBI GI: 144923843 NCBI Desc: glycoside hydrolase, family 5 [medicago truncatula]
  misc_feature (39)..(337): NCBI GI: 23396187 NCBI Desc: putataive glucan 1,3-beta-glucosidase precursor [oryza sativa (japonica cultivar-group)]
MTSAETHLLCRVRLALLLLLVCSWWLLPRSDARRTLVAPGLPIRAVNLGGWLLTEGWILPSLFDDIPNKDLLDGTQLQFKSVTQNRYLVADQGGGAAILADRVQASGWETFKLWRINETTFNLRVFGNQFVGVNSTAGVVATANTPGPSETFQLVRWNSDKSRVRIRAPNGLFLQAKTMESVTADHKEDTDWGDDDPSVFLTNNVGGLQGEYQICNGYGITEATQVLRNHWSTYINESDFSFVASSGLNAVRIPVGWWIASDPYPPHPFVGGSLQALDNAFSWAEKYKLGVIVDLHAAPGSQNPFEHSATRDGSQEWGTTDANIAQTVQVIDFLASRYASSPSLLAVELLNEPLAPGATLSSLTKYYQEGYNAVRRHTSAAYVIMSNRLSADATELLQFAGGFSGAVLDVHYYNLFSSVFNSLTVEQNIDFVRNNRSTDIATVTNQNGRPLTFVGEWVAEWDVQGANKTDYQRFAQVQQDVYGRATFGWSYWTLKNVNNHWSMQWMIQNGYISLKS

SEQ ID NO: 1195 - DNA, 2886 bp, Sorghum bicolor
  misc_feature: Ceres ANNOT ID no. 6014396
  misc_feature: Encodes the peptide sequence at SEQ ID NO 1196
atggaggcgcaggcgacggcgacggtgaaggaggcgctcgcggcactgtaccaccacccggacgacgccatccgcaccgccgccgaccgctggcttcaggagttccagcacacgctcgacgcctggcaggtagctgacagtttacttcatgatgaaagcagtaatttggaaactctcatcttttgttctcagaccctcagaagcaaggtacaaagggactttgaagagttaccctcggaagcttttcgatcgttacaggattctttatatgtattgctgaaaaagtttaataagggaccacaaaaagttagaacacagatttgcattgcaattgctgctctggctgtgcatgtaccagtagaggactggggagctggtggaattgtgaattggctaagcgatgaaatgaaagctcatccagaatttattccaggcttccttgaactgcttatagttttgccgcaggaaacttccagttataaaatcgcggctcgtcctgaaaggcgcagacaatttgagattgatctttgttcgtctgctaatgttgctattggtttattaactgcttgcatggccattgatcagctgaaagaacaggttttggagggtttttcttcttggcttcgtttctgtcatggaatctctgcctctgaactcgcatcacatcctttggtccatgtggcactctcttcattgaactctgatcaattcttggaggcagctgtaaatgttacttctgaactgatacatgctactgtatctcatggttctggtactattgctgagcaaatgccgctcattcaaattcttgtccctcatattatgggtctgaaagagcagctcaaagatccatctaaggatgaagaagatgtaaaagctattgctcgtttatatgcagacatgggtgaatcctatgttgacttgattgccacaggttcagatgattcaattcaaatagtaaactcattgctagaagttacttctcatctggaatttgatatttcctctatgacgtttaatttctggcaccgtcttaagcgtaacctgatcaggagggactcttatgtatcctatggatcagaggtggcaatcgaagctgagaaaaacagaagattacaaatatttcgtccaaagtttgaaactctggtgtctttggtcagtttccgagttgaataccctgaggactaccacaccttttccgaggaagaccgcagggattttagacatgttagatatgctgttagtgatgtgctacttgatgcaactgaagttcttgggggtgacttgacgctaaaactactttccaccaagctagctcaggcatatgggagctgcaacaatgagcagaaccccaagtggcaacctgtagaggctgccctgttctgtatacaagcaattgcaagatcagtctcaattgaggagcgagaaattttaccacaggttatgtcactgcttccctgccttcctcaccatgagctgttgctacaaacagtttgttcgaccattggagcattttcaaaatggattgatgctgcaccagctgaattatctattctaccacctctagttgatattctcaataagggtatgaatacatcagaggatacagctgcggctgcttctatggcctttaagtacatatgtgaagactgtaggacaaagttctcagggtccctggatagcctcttccagatataccatattgcaatcagtggagttggtggttataaagtttcttcagaggattcgttgcatttggttgaagccctaagtgtggttattacaacgcttccaccagaatctgctagtaaagccctggagttgatctgccagccagtaataaatcccttgcaacaaggtgatcaggtttttcaacaagtccctgctcggcatttaactgtacatatagacagactatcaagcattttcagcaatgtgaaacaaccagaactagttgctgaagctgtatatagatattggccgacactcaagagtatctttgatcaacgagcatgggatacccgcaccatggagtcaatatgccgatcttgcaaatttgctgtaaggacatgtggaagggtcatgggaacgacgattggtgcaatgcttgaagaaatccaaactctataccaacaacacaaacagtcttgcttcctttacttgtccagtgaagttatcaagatttttggatctgatccatcttgtgcgggctatcttactagcttgatacaaatactcttcagccatacagtgcagcttctcagaacgattcaagattttacagccagaccagatatagctgatgattgctatttgttagcatcaagatgtattcgctactgtcctgatctatttatacctacagaaatgtttcaaagattggttgactgcgcaatggctggtataactatacagcacagggaagcctgtaaatcgatattgtcttttctatctgatgtcattgaccttccaaactcatctgacgggggacagtaccgtgaagttattaacacaatcatacttcagcgtggtgcaacccttactagaataatgattgctgccttaacaggggcgctaccatctggtcgtctggaggaggtttcttatgttctgctgtcacttagcagagcctttggtgggaacatgctgaactgggcaagggaaagcattaatcttataccaccacaagccctaacagatgcagaacgtttgcgtttcttcaacatcatatctgatgctgcttccgggtctagtctccataccataacagacagatttggagaaatctcagatgtttgtagacgaaacaaaacagtgcaagacctagttcaaagtgccttgcggcctcacgatttgaccttcacggttgctccacaacagatttga

SEQ ID NO: 1196 - protein, 961 aa, Sorghum bicolor
  misc_feature: Ceres ANNOT ID no. 6014396
  misc_feature (100)..(245): Pfam Id: Xpo1 Pfam Desc: Exportin 1-like protein
  misc_feature (28)..(95): Pfam Id: IBN_N Pfam Desc: Importin-beta N-terminal domain
  misc_feature (1)..(959): NCBI GI: 68036606 NCBI Desc: nuclear transportin [triticum aestivum]
  misc_feature (1)..(626): NCBI GI: 115482530 NCBI Desc: os10g0477800 [oryza sativa (japonica cultivar-group)]
  misc_feature (374)..(901): NCBI GI: 54312056 NCBI Desc: transportin 3 [mus musculus]
  misc_feature (374)..(901): NCBI GI: 49522537 NCBI Desc: transportin 3 [mus musculus]
  misc_feature (374)..(901): NCBI GI: 6912734 NCBI Desc: transportin 3 [homo sapiens]
MEAQATATVKEALAALYHHPDDAIRTAADRWLQEFQHTLDAWQVADSLLHDESSNLETLIFCSQTLRSKVQRDFEELPSEAFRSLQDSLYVLLKKFNKGPQKVRTQICIAIAALAVHVPVEDWGAGGIVNWLSDEMKAHPEFIPGFLELLIVLPQETSSYKIAARPERRRQFEIDLCSSANVAIGLLTACMAIDQLKEQVLEGFSSWLRFCHGISASELASHPLVHVALSSLNSDQFLEAAVNVTSELIHATVSHGSGTIAEQMPLIQILVPHIMGLKEQLKDPSKDEEDVKAIARLYADMGESYVDLIATGSDDSIQIVNSLLEVTSHLEFDISSMTFNFWHRLKRNLIRRDSYVSYGSEVAIEAEKNRRLQIFRPKFETLVSLVSFRVEYPEDYHTFSEEDRRDFRHVRYAVSDVLLDATEVLGGDLTLKLLSTKLAQAYGSCNNEQNPKWQPVEAALFCIQAIARSVSIEEREILPQVMSLLPCLPHHELLLQTVCSTIGAFSKWIDAAPAELSILPPLVDILNKGMNTSEDTAAAASMAFKYICEDCRTKFSGSLDSLFQIYHIAISGVGGYKVSSEDSLHLVEALSVVITTLPPESASKALELICQPVINPLQQGDQVFQQVPARHLTVHIDRLSSIFSNVKQPELVAEAVYRYWPTLKSIFDQRAWDTRTMESICRSCKFAVRTCGRVMGTTIGAMLEEIQTLYQQHKQSCFLYLSSEVIKIFGSDPSCAGYLTSLIQILFSHTVQLLRTIQDFTARPDIADDCYLLASRCIRYCPDLFIPTEMFQRLVDCAMAGITIQHREACKSILSFLSDVIDLPNSSDGGQYREVINTIILQRGATLTRIMIAALTGALPSGRLEEVSYVLLSLSRAFGGNMLNWARESINLIPPQALTDAERLRFFNIISDAASGSSLHTITDRFGEISDVCRRNKTVQDLVQSALRPHDLTFTVAPQQI

SEQ ID NO: 1197 - DNA, 618 bp, Sorghum bicolor
  misc_feature: Ceres ANNOT ID no. 6014454
  misc_feature: Encodes the peptide sequence at SEQ ID NO 1198
atgaggcagtcgaggttcaagaggatctgcgtcttctgcggcagcagccaggggaagaagcggagctaccatgacgccgccattgagctcggcaacgagctggtggcccggagcgtcgacctggtgtacggaggcggcagcatcgggctgatgggcctcgtctcccaggccgtctacgacggcggccgccacgtcatcggggtcattcccaagacgctcatgacaccagagataagtggcgagacagtcggggaggtgcgcccggtggccgacatgcaccagaggaaagcagagatggcgcggcagtccgacgcattcatcgccctgcctggagggtatgggacgctggaggagctgctcgaggtcatcacgtgggcgcagctgggcatccaccacaagccggttgggctgctgaacgtggacggctactacaactcgctgctgaccttcatcgacaaggccgtggaggagggcttcatcaaccccagcgcccgccgcatcatcgtcctcgcgcccaccgcgcaggagctcatggacaagctcgaggagtacgagccctaccacgacagggtggcgtccacgctcaactgggagatgggccaccagctgggctactga

SEQ ID NO: 1198 - protein, 205 aa, Sorghum bicolor
  misc_feature: Ceres ANNOT ID no. 6014454
  misc_feature (51)..(184): Pfam Id: Lysine_decarbox Pfam Desc: Possible lysine decarboxylase
  misc_feature (3)..(205): NCBI GI: 32487858 NCBI Desc: osjnbb0061c13.8 [oryza sativa (japonica cultivar-group)]
  misc_feature (3)..(205): NCBI GI: 115459456 NCBI Desc: os04g0518800 [oryza sativa (japonica cultivar-group)]
  misc_feature (2)..(205): NCBI GI: 73536067 NCBI Desc: chain b, x-ray structure of a lysine decarboxylase-like protein from arabidopsis thaliana gene at2g37210
  misc_feature (3)..(204): NCBI GI: 19548083 NCBI Desc: t3b23.2/t3b23.2 [arabidopsis thaliana]
  misc_feature (3)..(205): NCBI GI: 79507209 NCBI Desc: carboxy-lyase [arabidopsis thaliana]
MRQSRFKRICVFCGSSQGKKRSYHDAAIELGNELVARSVDLVYGGGSIGLMGLVSQAVYDGGRHVIGVIPKTLMTPEISGETVGEVRPVADMHQRKAEMARQSDAFIALPGGYGTLEELLEVITWAQLGIHHKPVGLLNVDGYYNSLLTFIDKAVEEGFINPSARRIIVLAPTAQELMDKLEEYEPYHDRVASTLNWEMGHQLGY

SEQ ID NO: 1199 - DNA, 2517 bp, Sorghum bicolor
  misc_feature: Ceres ANNOT ID no. 6014465
  misc_feature: Encodes the peptide sequence at SEQ ID NO 1200
atggcagcagccgtagcgatgcggagcgggagcagcgatggcggcggcgggtacgagaagggcgggatggacacgggcaagtatgtgcggtacacgccggagcaggtggagacgctggagcgggtgtacgctgagtgccccaagcccagctccgcgcgaaggcagcagctgctacgcgagtgccccatcctctcaaacatcgagcccaagcagattaaagtctggttccagaaccggaggtgccgtgataagcagcggaaggagtcttcgaggctccaagccgtgaacagaaaattgaccgcaatgaacaagcttctcatggaggagaatgagcgattgcagaagcaggtttcccagctggttcacgagaatgcgtacatgaagcagcagctacagaatccgtcattggcaaatgatgccagctgtgattcaaatgtgaccgctcctgcaaacctaagggatgcgagtaacccatcagggctcctttcaattgcagaggagaccttgacagagttcctctcaaaggctacagggactgctattgattgggtccaaatgcctgggatgaagcctggtccggattcttttggtattgtgaccatttcacatggtggccgtggtgttgctgcccgtgcctgtggtctggtgaacctagaaccaacaaagattgtagaaatcttgaaagaccgcccatcttggttccgtgattgtcggagtcttgaagtctttacaatgttaccagctggaaatggtgggaccattgaacttgtttacatgcagatgtatgctcctactactttagttcctgcacgggacttttggacactgaggtacacaaccactatggaggatggcagtcttgtggtttgtgagagatctttaagtggttctggagatggtcaaagcgctgccacagcacaacagtttgtaagagccgagatgcttcctagtggctatttagttcgccaatgtgagggtggcggctcgattgtgcgaatagtggaccatctcgaccttgacgcttggagtgttcctgaagttcttcgccccctctatgagtcgtcccgggtagttgctcagaagatgacaaccgcagcgctacggcacctcagacaaattgctcaagaaacaagtggagaggttgtatatgctatggggaggcaaccagctgttctacgaacatttagtcagaggctgagtagaggttttaatgatgctataagtggtttcaatgatgatggttggtccattatggctggagatggcatagaagatgttatcattgcttgcaactcgaagaagattaggagcggtagcaatcctgcaactgcttttggagcccctggaggtatcatctgtgctaaagcatccatgttgctgcagagtgttcctccagcagtccttgttaggttcctgagggaacatcggtctgagtgggcagattataacttcgatgcatattcagcttcagcgctgaaaacaagcccttgttcccttcctgggttgcggcctatgagattttctgggagccagatcatcatgcccctgcctcacacggtggagaatgaggagatcttagaagttgttcggcttgaaggacagactcttacacatgacgagggccttttatcaagagatatccatctgcttcagctttgcactggaatagacgagaaatcaatgggatcctgcttccagcttgtctttgcaccaatcgatgagcttttccctgatgatgctccattaatatcctcaggcttccgtgttatcccattggacataaaaacagatggactatcctctggaagaacgttagatttggcctctagccttgaagttggtgcaaccacacaacaagcatcagcagatggatctcaggatgcttgcaacctgcgatctgtgttgacaattgcctttcaatttccctatgaaatacatctccaagatactgttgcagctatggcccgtcaatatgttcgaagcattgtctctgctgttcaaagagtatcaatggctatttctccctcccagtctggcttgaatactgggcagaagataatttctggcttccctgaagctgcaacacttgttcgctggatttgccaaagctaccggtatcacatgggggtggatttggtcagccactcggatcaagctggggaatcactattgagaatgttctgggatcatcaggacgctgtcttgtgctgctctttcaaggaaaagcctgtgtttacttttggcaaccagatgggaattgacatgttagaaacaactctaattgctctacaagatctcaccctggacaagatttttgacgagcctggcagaaaggcattacacgcggaggttccgaaactgatggaacagggatatgcgtacttgccggctggggtatgcttgtctgggatgggccgccatgtctcctatgaggaagctgttgcgtggaaagttctcggtgaagatggcaacgtacactgcctcgccttctgtttcgtcaactggtccttcgtttga

SEQ ID NO: 1200 - protein, 838 aa, Sorghum bicolor
  misc_feature: Ceres ANNOT ID no. 6014465
  misc_feature (691)..(838): Pfam Id: MEKHLA Pfam Desc: MEKHLA domain
  misc_feature (163)..(373): Pfam Id: START Pfam Desc: START domain
  misc_feature (27)..(85): Pfam Id: Homeobox Pfam Desc: Homeobox domain
  misc_feature (1)..(838): NCBI GI: 37694044 NCBI Desc: homeodomain leucine-zipper protein hox9 [oryza sativa (japonica cultivar-group)]
  misc_feature (16)..(838): NCBI GI: 63095203 NCBI Desc: hb1 [phyllostachys praecox]
  misc_feature (1)..(838): NCBI GI: 82754245 NCBI Desc: rolled leaf 2 [zea mays]
  misc_feature (1)..(838): NCBI GI: 40950648 NCBI Desc: rolled leaf1 [zea mays]
  misc_feature (1)..(838): NCBI GI: 60327621 NCBI Desc: class iii hd-zip protein 1 [populus trichocarpa]
  misc_feature: The sequence is a functional homolog of SEQ ID NO 110 in the 10/412,699US patent application
  misc_feature: The sequence is a functional homolog of SEQ ID NO 1108 in the 10/412,699US patent application
  misc_feature: The sequence is a functional homolog of SEQ ID NO 1109 in the 10/412,699US patent application
  misc_feature: The sequence is a functional homolog of SEQ ID NO 1110 in the 10/412,699US patent application
  misc_feature: The sequence is a functional homolog of SEQ ID NO 1111 in the 10/412,699US patent application
  misc_feature: The sequence is a functional homolog of SEQ ID NO 259 in the 11/479,226US patent application
  misc_feature: The sequence is a functional homolog of SEQ ID NO 665 in the 10/374,780US patent application
  misc_feature: The sequence is a functional homolog of SEQ ID NO 666 in the 10/374,780US patent application
  misc_feature: The sequence is a functional homolog of SEQ ID NO 667 in the 10/374,780US patent application
  misc_feature: The sequence is a functional homolog of SEQ ID NO 668 in the 10/374,780US patent application
  misc_feature: The sequence is a functional homolog of SEQ ID NO 721 in the 10/374,780US patent application
  misc_feature: The sequence is a functional homolog of SEQ ID NO 782 in the 10/666,642US patent application
  misc_feature: The sequence is a functional homolog of SEQ ID NO 783 in the 10/666,642US patent application
  misc_feature: The sequence is a functional homolog of SEQ ID NO 784 in the 10/666,642US patent application
  misc_feature: The sequence is a functional homolog of SEQ ID NO 785 in the 10/666,642US patent application
  misc_feature: Useful for making plants with altered lignin content
  misc_feature: Useful for making plants with modulated growth and phenotype characteristics
  misc_feature: GREAT-hit functional homolog of the protein sequence encoded by LOCUS at5g60690
  misc_feature: The sequence is a functional homolog of SEQ ID NO 110 in the 20040045049 US patent application
  misc_feature: The sequence is a functional homolog of SEQ ID NO 1108 in the 20040045049 US patent application
  misc_feature: The sequence is a functional homolog of SEQ ID NO 1109 in the 20040045049 US patent application
  misc_feature: The sequence is a functional homolog of SEQ ID NO 1110 in the 20040045049 US patent application
  misc_feature: The sequence is a functional homolog of SEQ ID NO 1111 in the 20040045049 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 2 in US patent 7056739
  misc_feature: Useful for making plants with altered lignin content
  misc_feature: Useful for making plants with altered carbohydrate content
  misc_feature: Functional homolog of the protein sequence given in SEQ ID NO 13708
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1108 in the 10/412,699 US patent application
  misc_feature: The sequence is a functional homolog of SEQ ID NO 665 in the 10/374,780 US patent application
  misc_feature: The sequence is a functional homolog of SEQ ID NO 782 in the 10/666,642 US patent application
MAAAVAMRSGSSDGGGGYEKGGMDTGKYVRYTPEQVETLERVYAECPKPSSARRQQLLRECPILSNIEPKQIKVWFQNRRCRDKQRKESSRLQAVNRKLTAMNKLLMEENERLQKQVSQLVHENAYMKQQLQNPSLANDASCDSNVTAPANLRDASNPSGLLSIAEETLTEFLSKATGTAIDWVQMPGMKPGPDSFGIVTISHGGRGVAARACGLVNLEPTKIVEILKDRPSWFRDCRSLEVFTMLPAGNGGTIELVYMQMYAPTTLVPARDFWTLRYTTTMEDGSLVVCERSLSGSGDGQSAATAQQFVRAEMLPSGYLVRQCEGGGSIVRIVDHLDLDAWSVPEVLRPLYESSRVVAQKMTTAALRHLRQIAQETSGEVVYAMGRQPAVLRTFSQRLSRGFNDAISGFNDDGWSIMAGDGIEDVIIACNSKKIRSGSNPATAFGAPGGIICAKASMLLQSVPPAVLVRFLREHRSEWADYNFDAYSASALKTSPCSLPGLRPMRFSGSQIIMPLPHTVENEEILEVVRLEGQTLTHDEGLLSRDIHLLQLCTGIDEKSMGSCFQLVFAPIDELFPDDAPLISSGFRVIPLDIKTDGLSSGRTLDLASSLEVGATTQQASADGSQDACNLRSVLTIAFQFPYEIHLQDTVAAMARQYVRSIVSAVQRVSMAISPSQSGLNTGQKIISGFPEAATLVRWICQSYRYHMGVDLVSHSDQAGESLLRMFWDHQDAVLCCSFKEKPVFTFGNQMGIDMLETTLIALQDLTLDKIFDEPGRKALHAEVPKLMEQGYAYLPAGVCLSGMGRHVSYEEAVAWKVLGEDGNVHCLAFCFVNWSFV

SEQ ID NO: 1201 - DNA, 1536 bp, Sorghum bicolor
  misc_feature: Ceres ANNOT ID no. 6014515
  misc_feature: Encodes the peptide sequence at SEQ ID NO 1202
atggggcagccaaaaaaatgcacaagggccagcctggtcatcttcatctctcccctctgcttcccatacaaattcatacaaagccccatggacttcggccccttgaacctgatagtcttccactccccagccgcggtgctgcggccccagtcgtcaggagacatctccatgcttctcagcttcctctccggctcgtctctgagcaaggtcacggtggcagccagaggagcaggccactccatccatggccaggctcaggctctggatggcattgtggtggagatgcgcgccttgcctgccgagatggaattccacagaggaggagaagaaggacaggtttcctacgccgatgtgagcggtggggttatgtggatcgagctcctggagcagagcctgaagctcgggctggctccaaggtcatggactgactacctctatctcaccgttggcggaacgctgtccaatgccggcatcagcgggcagacatttaagcacgggcctcagatcagcaacgttctacagctggaggtagtcacaggacgaggggagattgtgaaatgctcacccagcaaggacgccgatctgttcaatgccgttctgggaggccttggccagtttggcatcataaccagggccaggatcctgttgcaggaagctccacagaaagtgacgtgggtgagagccttctatgatgatttcagcatcttcaccagggaccaggagttgctggtgtcgattccggatttggactacgtcgaaggtttcatcgtcttgaatgaacaatcccttcacagctcctccatcgccttccctgctagcgtggacttcaacccggattttggcaccaagaacagccctaagatctactactgcatagagtttgcagtccatgattaccagcacaaaaacactaatgtgcaccatgttgtggaggttatctcgaggcagatgagccacatggtgtcccagttgtacagtgtggaggtgtcctacttcgatttcctgaaccgggtcaggatggaggagatgagcctgaggagcgtggggctatgggaggtacaccacccatggctcaacatgtttgtgccaaaggccggggtcgctgacttcagggatctgctcatggacaacatttcaccggacagctttgagggcctcatcctcatctacccactcctcagagacaagtgggacaccaacacatcagtggtgataccggattccgggtccacggaccgggtgatgtacgtggttggcatcctccgctccgcgaaccctgaagatggctgctcccaccactgcctccaagagcttctccgccgccaccgccggatcgccgacgccgccggagcacgcctcggcgccaagcagtacctgggtcaccacccgactccggccggctggcaccagcacttcggccggcggtgggagcagttcgcggagcgcaaggcccggttcgacccgctacgcatcctggggcccggacaaggcatattccctcggacccccgatgctgctgcttatgctgggagctag

SEQ ID NO: 1202 - protein, 511 aa, Sorghum bicolor
  misc_feature: Ceres ANNOT ID no. 6014515
  misc_feature (220)..(499): Pfam Id: Cytokin-bind Pfam Desc: Cytokinin dehydrogenase 1, FAD and cytokinin binding
  misc_feature (43)..(188): Pfam Id: FAD_binding_4 Pfam Desc: FAD binding domain
  misc_feature (31)..(502): NCBI GI: 92898380 NCBI Desc: fad linked oxidase, n-terminal [medicago truncatula]
  misc_feature (31)..(501): NCBI GI: 145339819 NCBI Desc: atckx6/atckx7/ckx6 (cytokinin oxidase/dehydrogenase 6); cytokinin dehydrogenase [arabidopsis thaliana]
  misc_feature (30)..(503): NCBI GI: 23267157 NCBI Desc: cytokinin dehydrogenase 2 [hordeum vulgare]
  misc_feature (31)..(501): NCBI GI: 110736853 NCBI Desc: cytokinin oxidase -like protein [arabidopsis thaliana]
  misc_feature (30)..(503): NCBI GI: 27312007 NCBI Desc: cytokinin dehydrogenase 2 [hordeum vulgare]
MGQPKKCTRASLVIFISPLCFPYKFIQSPMDFGPLNLIVFHSPAAVLRPQSSGDISMLLSFLSGSSLSKVTVAARGAGHSIHGQAQALDGIVVEMRALPAEMEFHRGGEEGQVSYADVSGGVMWIELLEQSLKLGLAPRSWTDYLYLTVGGTLSNAGISGQTFKHGPQISNVLQLEVVTGRGEIVKCSPSKDADLFNAVLGGLGQFGIITRARILLQEAPQKVTWVRAFYDDFSIFTRDQELLVSIPDLDYVEGFIVLNEQSLHSSSIAFPASVDFNPDFGTKNSPKIYYCIEFAVHDYQHKNTNVHHVVEVISRQMSHMVSQLYSVEVSYFDFLNRVRMEEMSLRSVGLWEVHHPWLNMFVPKAGVADFRDLLMDNISPDSFEGLILIYPLLRDKWDTNTSVVIPDSGSTDRVMYVVGILRSANPEDGCSHHCLQELLRRHRRIADAAGARLGAKQYLGHHPTPAGWHQHFGRRWEQFAERKARFDPLRILGPGQGIFPRTPDAAAYAGS

SEQ ID NO: 1203 - DNA, 1200 bp, Sorghum bicolor
  misc_feature: Ceres ANNOT ID no. 6014521
  misc_feature: Encodes the peptide sequence at SEQ ID NO 1204
atggagcggaggctgtcggcggtgtccaggcggtccgcgccgtcgcccatccagcagctgtcccacctggcgcagcgcgtcggcgccgtcaacctcgccgagggcttccccgacttccccgcgccgccgcacgtcaaggccgccgctgccaccgccatcgccgcggacctcaaccagtacaggcatgtgcaggggatctgcgacatcctcgccaacacgatgaaacgggaccatggcctcgacgtcgacccgctcacggacttcgtcatctgctgcggccaatccgaagcattcgctgcggcaatctttgcaataatcgaccaaggagatgaagttttgctcttcgaccctgcttatgaaacgtatgagacatgcattgagctagctcgaggcgtccctgtgtatgtgccattggatccaccttcttggactctgaacgaagacaattttctgaaatctttttcaagtcggaccaaggcagtggtcttgaacagcccacacaatccaacagggaaggtcttcagcaaagaggagttgcttattatctctcaggcttgtcagaaaatggactgctttgcgataactgatgaggtttatgagtatattacttacgatgcaaacaagcatatctcactggcttctcttccagggatgcaagagaggaccatcatcacatcctcactgtcaaaaacttacagtgtaactgcagcaagcatcgcctcagctattagaaatatccacattaaactaacagattcagctcctgcaccattccaagaagctgcgttggttgctttaacaagcacagcagactactacacatccctgaaaaaagactatgaggtgaaaagagacttcatccttcagttgctgaaagacttcggcttcaaaatcagcttcaagccacaaggttcagtatttgtgtttgctgagctgccaaagtcctgtcaactttcagatatagaatttgtgacaaagttgatcaacgatgctggtgtggctgccgtgcctggccgtgggttcttccacaagacttgtgacggtgaaagctaccgtcaccggtatgtcaggtttgcattctgcaagggcgacgacacacttaaggctgctgccatgaagatgaagaagctggcaagcaggcagggagaaccatggcttactggcagacaagaagatcagactatgcctgcctctaattga

SEQ ID NO: 1204 - protein, 399 aa, Sorghum bicolor
  misc_feature: Ceres ANNOT ID no. 6014521
  misc_feature (27)..(374): Pfam Id: Aminotran_1_2 Pfam Desc: Aminotransferase class I and II
  misc_feature (1)..(383): NCBI GI: 140039636 NCBI Desc: aminotransferases class-i pyridoxal-phosphate-binding site [medicago truncatula]
  misc_feature (1)..(374): NCBI GI: 92878270 NCBI Desc: aminotransferases class-i pyridoxal-phosphate-binding site [medicago truncatula]
  misc_feature (11)..(377): NCBI GI: 116225879 NCBI Desc: aminotransferase, class i and ii [solibacter usitatus ellin6076]
  misc_feature (1)..(376): NCBI GI: 37522685 NCBI Desc: probable aminotransferase [gloeobacter violaceus pcc 7421]
  misc_feature (4)..(384): NCBI GI: 68234201 NCBI Desc: aminotransferase, class i and ii [frankia sp. ean1pec]
  misc_feature: Useful for making plants with modulated nitrogen use efficiency
  misc_feature: Functional homolog of the protein sequence encoded by LOCUS at1g77670
  misc_feature: The sequence is a functional homolog of SEQ ID NO. 286 in the 11/188,298 US application
  misc_feature: The sequence is a functional homolog of SEQ ID NO. 526 in the 11/188,298 US application
  misc_feature: The sequence is a functional homolog of SEQ ID NO. 527 in the 11/188,298 US application
MERRLSAVSRRSAPSPIQQLSHLAQRVGAVNLAEGFPDFPAPPHVKAAAATAIAADLNQYRHVQGICDILANTMKRDHGLDVDPLTDFVICCGQSEAFAAAIFAIIDQGDEVLLFDPAYETYETCIELARGVPVYVPLDPPSWTLNEDNFLKSFSSRTKAVVLNSPHNPTGKVFSKEELLIISQACQKMDCFAITDEVYEYITYDANKHISLASLPGMQERTIITSSLSKTYSVTAASIASAIRNIHIKLTDSAPAPFQEAALVALTSTADYYTSLKKDYEVKRDFILQLLKDFGFKISFKPQGSVFVFAELPKSCQLSDIEFVTKLINDAGVAAVPGRGFFHKTCDGESYRHRYVRFAFCKGDDTLKAAAMKMKKLASRQGEPWLTGRQEDQTMPASN

SEQ ID NO: 1205 - DNA, 1083 bp, Sorghum bicolor
  misc_feature: Ceres ANNOT ID no. 6014533
  misc_feature: Encodes the peptide sequence at SEQ ID NO 1206
atgagccgcccccatttgcccaaggacccgaccttcccgcgcaccaatgggtccttggacggcggggcccgcggcctcggcgagatcgaggaggtgggcgctgcggccaccgtagccgtcgagcagtcgccgccctcgcagtcctcgtccccgtcggcgtcgtcgccgccggcggcgatgtcgtcgtgcgggcagtacatgctacaccgggtgcgcaagctggacaccctagcgggcgtcgccatcaagtacggtgtcgaggtagccgacattaaaaggctgaacggcctctcaactgacctccagatgtttgcacacaagacactgcggattccactcccggggaggcaccctccgtcgtcttaccaggagaatggttcatatgagagtgacgacagggaatgtactccacgccgcattcacgaagatatcttggattcaattttgaaaacaccaaagcccaaagtttcgccagctatgagtcttctgcagggatactatggccttgcaccacctccaaagagagatcaaacaagtgaaggcactgaaatggcagtttacagtaaaggcaaatctgcttttttggatgttgagccgtggctggagccaccaaattccgacccattccctcttcagaataggaaaaccagaagcttgatgataggttcttctcttgacggtgatactgatgagaatggtgacagtgaaaggttcataaggcggcgccagaaagctgatggtgagctgttaccgagggaggaaaatggtggtgactttctggcaagcgctggaaaaggcttggcactgaggccaaagtctagcaatcgaccagacatgaacaagagccagcagaatctttttgtgatggcggagcctttgtttgtcaatggtgtgcaaactgtaaggaaatcatccagcactccagagttccaggagccagagaccaacaccagttcatccatatggtcagcgagcaagtggagcataaatacagatgctttcgctcttcctctccccatccctcgttttgacaacattccaaagcccattgctgcttggagaaacaaggcggctcgcgactaa

SEQ ID NO: 1206 - protein, 360 aa, Sorghum bicolor
  misc_feature: Ceres ANNOT ID no. 6014533
  misc_feature (69)..(112): Pfam Id: LysM Pfam Desc: LysM domain
  misc_feature (33)..(303): NCBI GI: 115450233 NCBI Desc: os03g0110600 [oryza sativa (japonica cultivar-group)]
  misc_feature (3)..(155): NCBI GI: 34864366 NCBI Desc: similar to riken cdna 2210402c18 [rattus norvegicus]
  misc_feature (20)..(134): NCBI GI: 49119382 NCBI Desc: loc443603 protein [xenopus laevis]
MSRPHLPKDPTFPRTNGSLDGGARGLGEIEEVGAAATVAVEQSPPSQSSSPSASSPPAAMSSCGQYMLHRVRKLDTLAGVAIKYGVEVADIKRLNGLSTDLQMFAHKTLRIPLPGRHPPSSYQENGSYESDDRECTPRRIHEDILDSILKTPKPKVSPAMSLLQGYYGLAPPPKRDQTSEGTEMAVYSKGKSAFLDVEPWLEPPNSDPFPLQNRKTRSLMIGSSLDGDTDENGDSERFIRRRQKADGELLPREENGGDFLASAGKGLALRPKSSNRPDMNKSQQNLFVMAEPLFVNGVQTVRKSSSTPEFQEPETNTSSSIWSASKWSINTDAFALPLPIPRFDNIPKPIAAWRNKAARD

SEQ ID NO: 1207 - DNA, 684 bp, Sorghum bicolor
  misc_feature: Ceres ANNOT ID no. 6014544
  misc_feature: Encodes the peptide sequence at SEQ ID NO 1208
atggcggcggcggagaagcccgcggcggtgcggcaagcggaggagctggtggagagggagatgggcgggcgcgacgcctcccacgacgccgcgcacgcgctccgcgtccgggacctcgcgctctcgctcgcagccgaagagggcctctccgcccccagccgcctcctcaccgtggaactggcctctctcctgcacgacgttggagattacaagtataccaagaacaatgtggaggacatgagcgtcgtggagacgtttcttcaagaggtaggattggatgaagcccagaaggatgaaatagtggcgattattaaggggatggggttcaaaaatgaagtttcgaataaatctattgttgatcccacccttgagtttgcaattgtacaagacgcagatcgcctggatgcaattggagcaattggtattgcaaggtgctttacatatggtgggagcaagaacagcgcattgcatgatcctcgaattctgccacgtgataacttgtcaaaggaaaagtacatgtccaaggaagagaagcagacatcaatcaatcattttcatgagaagctttttaaactgaaggacatgatgaagacagaggctgggaaaaggagagctgagaaaaggcataggttcatggaggactttgtggctgaattctacgaagagtggagtggcagggcttga

SEQ ID NO: 1208 - protein, 227 aa, Sorghum bicolor
  misc_feature: Ceres ANNOT ID no. 6014544
  misc_feature (29)..(137): Pfam Id: HD Pfam Desc: HD domain
  misc_feature (5)..(225): NCBI GI: 92878460 NCBI Desc: metal-dependent phosphohydrolase, hd region [medicago truncatula]
  misc_feature (24)..(226): NCBI GI: 89203402 NCBI Desc: metal-dependent phosphohydrolase, hd subdomain [bacillus cereus subsp. cytotoxis nvh 391-98]
  misc_feature (10)..(226): NCBI GI: 86134930 NCBI Desc: metal-dependent phosphohydrolase [tenacibaculum sp. med152]
  misc_feature (10)..(226): NCBI GI: 89302924 NCBI Desc: hd domain containing protein [tetrahymena thermophila sb210]
  misc_feature (5)..(225): NCBI GI: 29374918 NCBI Desc: hd domain protein [enterococcus faecalis v583]
  misc_feature: Useful for making plants with modulated oxidative stress sensitivity
  misc_feature: GREAT-hit functional homolog of the protein sequence given in SEQ ID NO 12986
  misc_feature: Useful for making plants with modulated oxidative stress sensitivity
  misc_feature: Functional homolog of the protein sequence given in SEQ ID NO 12986
MAAAEKPAAVRQAEELVEREMGGRDASHDAAHALRVRDLALSLAAEEGLSAPSRLLTVELASLLHDVGDYKYTKNNVEDMSVVETFLQEVGLDEAQKDEIVAIIKGMGFKNEVSNKSIVDPTLEFAIVQDADRLDAIGAIGIARCFTYGGSKNSALHDPRILPRDNLSKEKYMSKEEKQTSINHFHEKLFKLKDMMKTEAGKRRAEKRHRFMEDFVAEFYEEWSGRA

SEQ ID NO: 1209 - DNA, 1719 bp, Sorghum bicolor
  misc_feature: Ceres ANNOT ID no. 6014550
  misc_feature: Encodes the peptide sequence at SEQ ID NO 1210
atgggtctagcttactccaaccaagctaagcgtatgcaggctcttctatttggttccttacatgcagggacgctgaagcgttacatcttcgccgccgggacgtacaaggtcggccgcaaagattgtgatgtcattgttcaaactgacacatctatatcccgagtccatgcggagattgcaattgaaaagatggttgcctgggatccgcattctggtgcacctgccagtccatcatttgttcgtgtaatcgaccgatcaaagtatggcacatttgtcaacaaagtacatggaacccagggcagtcgtctgcataaagatgaaaatatgatgcttactgatggggatgctgtgacttttggaactggtaatgcgaccttcaggttatcatttgttccaatagtggcctattttcatggcggaaagtcatcacgaattgatccatcattacatgcagtcatgaaatctattggtgcatatgttactcgtaagtggagcaatgaatgtacgcatgttcttgttgacgaatcatgttcgttgacacctgagctcctcgatgcagttatggcgaagaagcagatcgtgttgggagactggtttaaggcaatggctgaaaagaacatacacacagagatcccttcttgcacacaatacattccaaacttgacccttgatgggatggtgatcaagatggtggatatcagtgtcattcagaattgcctagcaggctatacttttatcctggggtcatcagataaatatcaatttggtgagaagctccctggattactggaatcaactggagcaaagtacctccacattgacgacttttgtgcaaacagccaggactcagcagctggagatactgatcaacaaattcttgtagttcctgcaagatatcctttggaattcagcaagatacgtgggttatttactttgtcaaagatcagtgatgttaagctatttgctgctacattatctggccgcttggaagcaacttctattgaaccacctgctttcatcgttacatcctcgaattccacggatgacactattgtggcggattcagatgttgaaatggagacagcaacttctgatcctattggtgctgctaaaaagtctcaacatcacattgagaatatctctgaatctgatgacgaaaaggatatcacaaatagaaccaatgaagttgctgtaagtatcagtggaacaaagggtaatgctattcacccaaaatacccagagaaagttgaagatttgaaacctatagaggaggatgttaaggtcatagagaaaacagcaatgtataggtccacagctagagatgaggatgctcgcattttgaacaaggcaccaaaggatgagaatttggacaccagcagggatggggcttctgatgtcatatttagtcagaatctggttgtcagaagcttccctcagtcagctcctgctgcaccaacagaagttggaggtgttaacttcaaacgtttcaggaagagggaaacagtgtctggaaacagcttcaaggaccttattccatttgcgcgggaaccatacagagaatcggactacgaacgtggcacattgaacgatttcatgcgggaggagaaacagcggaaacaaatggaagccattgcagatgacctcttcaacaatgcaaagtcgaagaaaagagcagctgctggaagttcgattcacaccctacttaccggctacagatga

SEQ ID NO: 1210 - protein, 572 aa, Sorghum bicolor
  misc_feature: Ceres ANNOT ID no. 6014550
  misc_feature (35)..(120): Pfam Id: FHA Pfam Desc: FHA domain
  misc_feature (23)..(572): NCBI GI: 111414330 NCBI Desc: dna damage signaling and repair protein [zea mays]
  misc_feature (22)..(374): NCBI GI: 145338027 NCBI Desc: nbs1 (nijmegen breakage syndrome 1) [arabidopsis thaliana]
  misc_feature (22)..(374): NCBI GI: 118027140 NCBI Desc: nbs1 [arabidopsis thaliana]
  misc_feature (22)..(254): NCBI GI: 45383480 NCBI Desc: nijmegen breakage syndrome 1 (nibrin) [gallus gallus]
  misc_feature (12)..(234): NCBI GI: 34809499 NCBI Desc: recombination and dna repair protein [xenopus laevis]
MGLAYSNQAKRMQALLFGSLHAGTLKRYIFAAGTYKVGRKDCDVIVQTDTSISRVHAEIAIEKMVAWDPHSGAPASPSFVRVIDRSKYGTFVNKVHGTQGSRLHKDENMMLTDGDAVTFGTGNATFRLSFVPIVAYFHGGKSSRIDPSLHAVMKSIGAYVTRKWSNECTHVLVDESCSLTPELLDAVMAKKQIVLGDWFKAMAEKNIHTEIPSCTQYIPNLTLDGMVIKMVDISVIQNCLAGYTFILGSSDKYQFGEKLPGLLESTGAKYLHIDDFCANSQDSAAGDTDQQILVVPARYPLEFSKIRGLFTLSKISDVKLFAATLSGRLEATSIEPPAFIVTSSNSTDDTIVADSDVEMETATSDPIGAAKKSQHHIENISESDDEKDITNRTNEVAVSISGTKGNAIHPKYPEKVEDLKPIEEDVKVIEKTAMYRSTARDEDARILNKAPKDENLDTSRDGASDVIFSQNLVVRSFPQSAPAAPTEVGGVNFKRFRKRETVSGNSFKDLIPFAREPYRESDYERGTLNDFMREEKQRKQMEAIADDLFNNAKSKKRAAAGSSIHTLLTGYR

SEQ ID NO: 1211 - DNA, 453 bp, Sorghum bicolor
  misc_feature: Ceres ANNOT ID no. 6014551
  misc_feature: Encodes the peptide sequence at SEQ ID NO 1212
atggcgagccctggacggatcgagctggacaagctgagcgtggagcagctcaaggggctcaaggagcagacggatctggaggtcaacctcctccaggacagcctcaccaagatccgcaccgccaccacccgactcgagagcgcctccgccgcgctccaggacctatccctccgcccccacgggaagaagatgctcgtgccccttacggcttctctctacgttcccggctctctggacgacgccgagaaggtcctcgtcgacgtcggcaccggttacttcatcgagaaaaccatggctcaggggaaagaatactgtgaaaggaaagttaatttattgaagtcaaattttgatgaactgcttgaggtggctacaaaaaagaaagccatagcagatgatctgggtatgctactacaagccaagctgaggcaagcatcgcctggcccgagttcatga

SEQ ID NO: 1212 - protein, 150 aa, Sorghum bicolor
  misc_feature: Ceres ANNOT ID no. 6014551
  misc_feature (24)..(143): Pfam Id: Prefoldin Pfam Desc: Prefoldin subunit
  misc_feature (61)..(122): NCBI GI: 115482634 NCBI Desc: os10g0488100 [oryza sativa (japonica cultivar-group)]
  misc_feature (7)..(143): NCBI GI: 50926001 NCBI Desc: zgc:100894 protein [danio rerio]
  misc_feature (7)..(143): NCBI GI: 1731809 NCBI Desc: c-myc binding protein [homo sapiens]
  misc_feature (7)..(143): NCBI GI: 61371542 NCBI Desc: prefoldin 5 [synthetic construct]
  misc_feature (7)..(143): NCBI GI: 7209590 NCBI Desc: eig-1 [mus musculus]
  misc_feature: Useful for making plants with modulated heat sensitivity
  misc_feature: GREAT-hit functional homolog of the protein sequence given in SEQ ID NO 13057
  misc_feature: Useful for making plants with modulated heat sensitivity
  misc_feature: Functional homolog of the protein sequence given in SEQ ID NO 13057
MASPGRIELDKLSVEQLKGLKEQTDLEVNLLQDSLTKIRTATTRLESASAALQDLSLRPHGKKMLVPLTASLYVPGSLDDAEKVLVDVGTGYFIEKTMAQGKEYCERKVNLLKSNFDELLEVATKKKAIADDLGMLLQAKLRQASPGPSS

SEQ ID NO: 1213 - DNA, 3591 bp, Sorghum bicolor
  misc_feature: Ceres ANNOT ID no. 6014566
  misc_feature: Encodes the peptide sequence at SEQ ID NO 1214
atggcgtcggtggaggtgcggtcggtacggaagtccgcggccctgcgtgcgcgcggcgggcccagcaagctgcagccggcgcggtccatgccgctcgactacaggtactcggccgccggggccgcctcgtcgccgaacggtggcgggcgcgggccggctgcgaacggcgtcgggcgtcgtgcggctgcggcggagtcagagaaggaagaggatttggtgcggttggagcgggacgacgcggactcgccgtacagctccaaggcggtgacggcagaggaggaggaggaggaagtgggggagagaggtggaggaggagacgaggtggattcggtggccgcggcgacgccaaggagattgtcgccgagggcagcggcgagccccacggaaggcgacgccaggtggagtgacaccagctcgtacggagctaagaagaagcatagagttttctgtcagcttccgaacggtgattgggcattatgcacagtacttacaacctctggtgatgagtccgttctaaaggtttctgaaggaaaagtactgcgattgaaaacagacagtcttcaacctgcaaatcctgaaattcttgatggagtggatgatcttatgcagctaagttatctaagtgaagcatcagtactatacaatctgcagtacagatactcccaggacatgatttatactaaagcaggtccagttttggtggctgtcaatcctttcaagaaagtttcattgtatggtaatgagtacattgatgcatatagaaataaatcaatggacagtccacatgtttatgcaatagcagatgcagcacttcgtgaaatgaaaagagatgaagtcaaccaatctataattataagtggtgagagtggagcaggaaaaacagaaaccgcaaaaattgctatgcagtatctagcttctcttggaggtggaagtggtattgaatatgaaattcttcagaccaatccaatactcgaggcttttggcaatgcaaagacattgagaaatgataactcaagtcgttttggaaagcttatcgaaattcatttcagtaccactggaagaatatgtggtgccatgattcaaacatttttgcttgagaagtccagagttgtacaatgtgcagttggtgagcgatcctaccatatattttatcagctgtgtgctggtgcacctgtgtctctaagagagaagttgaatttgaaaaaggtggatgagtacaaatatcttaaacagagctgttgctattcaattgcgggtgtggatgatgcccaaatgtttcgaactgtgacggaagctatgaacatcgttcatatcagcaaagaggaccaagagaatgtttttgcaatggtctctgctgttctatggctgggggatgtctcatttacagtaattgacaatgaaagtcatgttgaaatcattgtagatgaagcttcaagaacggttgcagaacttcttggctgcagtattgaagatctcaatctagctttgtcaaagcgccacatgaaagtcaataatgaaaacattgtccagaaacttacccttgctcaggcaactgacacaagagatgctctggccaaatcagtctatgccagtttgtttgagtggcttgtagaacaaattaataagtctctctcagtaggcaagcgtcgaactgggagatcaatcagtattcttgatatctatggctttgagtcatttgataagaacagttttgaacagttctgcattaattatgctaatgaaaggttgcaacaacatttcaatcgtcatttgtttaagcttgagcaagaggaatatgtggaggatggcattgactgggcaaaggttgactttgaggataatcaagactgtttgagtctctttgagaaaaaaccactggggttattgtctctgctggacgaggaatctactttccccaatgccacagatcttacttttgcaaacaagcttaagcaacatcttgactcgaactcttgcttcagaggagaaagaggcaaggcatttgctgtccgtcactatgcaggagaggtggcttatgatacttcgggttttctggagaagaatagagatttattgcacatggactcgattcagctccttgccaaatgcaagacttctctgccaaaaatgtttgcatctaagatgctagttcaatcagataattctatgtctgttccatatagatctagtgctgctgattctcaaaaactaagtgttgccatgaagttcaagggtcaactgttccaacttatgcaaagactggaaagtacaacaccacactttattcgctgcattaaaccaaataatttacaactccctgcaatttacgaacaaggacttgtgcttcaacaacttaaatgctgtggggttcttgaggttgtccggatttcaagatctggatatccaacaagaatgactcaccagaagtttgctcggcggtatggctttcttcttcttgaggatgttgcatcccaagatccactcagtgtttcagttgcaattcttcatcagttcaacattttacctgagatgtatcaagttggctacacaaagttgtttttccgaactggccagattggcaaacttgaagatactcggaatcgtactctgcacggtattttaagggttcaaagctgtttcagggggcatcaagcccgtcatcatgcgagagaacgaataagaggagttttggctcttcaatcattcattcgtggtgagaatgcacggcaaatttattcctctttgtcgaggaaacatagagcagcagttattttgcagagaaatgtgagatgttggctcgcaagaaggtatttcataaaactccggaaggcctcggtaataatacagtctggtattcgtggcagtcttgttcgaagatgtaatggaaatattgatctaataaacgtgctaagagagtttgaatcaaaacaggaggcagagggtgaccaaattttgatcaaggcatcagtcctggctgagttacagaggcggatactaaaagccgaggccacagttcgtgaaaaggatgaagagaatgagatgcttcatcagcggcttcagcaatatgaaaaccgctggttagagtacgagcagaaaatgaaagctatggaggaaatgtggcagaagcaaatgcgttcattgcaatcgagcctttccgtagcaaagaagagtcttgctctagatgagacgcctaggatgtcagactcatcagtggatcagagctgggaaagcaatgggaatcatgtcagtagtgggtctcagctggtgccacgcactggtgggcgtgaaatgaacgctggcctgagcgtcattggccgcctaaacgaagaattcgaacaacggagccaggtatttgctgatgacgccaagttcctggttgaggtcaagtctgggcaggcggatgccagcctaaacccagacatggagctccggaggttgaagcagaattttgactcgtggaagaaggatttcagtggccgcataagggagacaaaggtgatcctgaacaagctcgggaatggcaacgagtcatcgcccaactctgtgaagcggaaatggtggggcagactgaacacctccaagttttcgtga

SEQ ID NO: 1214 - protein, 1196 aa, Sorghum bicolor
  misc_feature: Ceres ANNOT ID no. 6014566
  misc_feature (198)..(855): Pfam Id: Myosin_head Pfam Desc: Myosin head (motor domain)
  misc_feature (919)..(939): Pfam Id: IQ Pfam Desc: IQ calmodulin-binding motif
  misc_feature (100)..(1196): NCBI GI: 4885026 NCBI Desc: myosin viii zmm3 [zea mays]
  misc_feature (247)..(1196): NCBI GI: 115482640 NCBI Desc: os10g0488800 [oryza sativa (japonica cultivar-group)]
  misc_feature (24)..(1195): NCBI GI: 6491702 NCBI Desc: myosin [arabidopsis thaliana]
  misc_feature (127)..(1195): NCBI GI: 42562644 NCBI Desc: myosin family protein [arabidopsis thaliana]
  misc_feature (127)..(1195): NCBI GI: 62319047 NCBI Desc: myosin [arabidopsis thaliana]
MASVEVRSVRKSAALRARGGPSKLQPARSMPLDYRYSAAGAASSPNGGGRGPAANGVGRRAAAAESEKEEDLVRLERDDADSPYSSKAVTAEEEEEEVGERGGGGDEVDSVAAATPRRLSPRAAASPTEGDARWSDTSSYGAKKKHRVFCQLPNGDWALCTVLTTSGDESVLKVSEGKVLRLKTDSLQPANPEILDGVDDLMQLSYLSEASVLYNLQYRYSQDMIYTKAGPVLVAVNPFKKVSLYGNEYIDAYRNKSMDSPHVYAIADAALREMKRDEVNQSIIISGESGAGKTETAKIAMQYLASLGGGSGIEYEILQTNPILEAFGNAKTLRNDNSSRFGKLIEIHFSTTGRICGAMIQTFLLEKSRVVQCAVGERSYHIFYQLCAGAPVSLREKLNLKKVDEYKYLKQSCCYSIAGVDDAQMFRTVTEAMNIVHISKEDQENVFAMVSAVLWLGDVSFTVIDNESHVEIIVDEASRTVAELLGCSIEDLNLALSKRHMKVNNENIVQKLTLAQATDTRDALAKSVYASLFEWLVEQINKSLSVGKRRTGRSISILDIYGFESFDKNSFEQFCINYANERLQQHFNRHLFKLEQEEYVEDGIDWAKVDFEDNQDCLSLFEKKPLGLLSLLDEESTFPNATDLTFANKLKQHLDSNSCFRGERGKAFAVRHYAGEVAYDTSGFLEKNRDLLHMDSIQLLAKCKTSLPKMFASKMLVQSDNSMSVPYRSSAADSQKLSVAMKFKGQLFQLMQRLESTTPHFIRCIKPNNLQLPAIYEQGLVLQQLKCCGVLEVVRISRSGYPTRMTHQKFARRYGFLLLEDVASQDPLSVSVAILHQFNILPEMYQVGYTKLFFRTGQIGKLEDTRNRTLHGILRVQSCFRGHQARHHARERIRGVLALQSFIRGENARQIYSSLSRKHRAAVILQRNVRCWLARRYFIKLRKASVIIQSGIRGSLVRRCNGNIDLINVLREFESKQEAEGDQILIKASVLAELQRRILKAEATVREKDEENEMLHQRLQQYENRWLEYEQKMKAMEEMWQKQMRSLQSSLSVAKKSLALDETPRMSDSSVDQSWESNGNHVSSGSQLVPRTGGREMNAGLSVIGRLNEEFEQRSQVFADDAKFLVEVKSGQADASLNPDMELRRLKQNFDSWKKDFSGRIRETKVILNKLGNGNESSPNSVKRKWWGRLNTSKFS

SEQ ID NO: 1215 - DNA, 645 bp, Sorghum bicolor
  misc_feature: Ceres ANNOT ID no. 6014568
  misc_feature: Encodes the peptide sequence at SEQ ID NO 1216
atggagagtttcacccagaagcacgtcattggaattccattgacttcgtttgcatacgccgatgaggaaagacaaggaaaaccttcctgttccaccatggttcataaaaaaaataagaagagttccttcatttatcggatgaacaaactgagcgataaaacagataactacatgcaagggttcaaagaacacttaactctgggaccaaaaatttcagaaactataaaagggaaactaagcttcggtgcaaaggttctccaagctggcggtattgataaagtcttcagagaatacttttctgttgagaaagatgagaaactactgaaggctttccagtgctatctttcaaccacagctggtccaatagctggaatgcttttcatctcaactaagaagattgctttccatagtgataggcctttgaatttcatgtctcccaaaggaggcagtacaaaggtgccatacaaggtgttgatccccacaaagaggataaagagtgcttcagtgcgggaaaatttatacaatccagacgagaagtatattgatgtagttactgttgatggctttgatttttggttcatgggctttgtcagctatgagaagtcattcaaatatcttcagcatgtaattccggagctgagatga

SEQ ID NO: 1216 - protein, 214 aa, Sorghum bicolor
  misc_feature: Ceres ANNOT ID no. 6014568
  misc_feature (93)..(171): Pfam Id: GRAM Pfam Desc: GRAM domain
  misc_feature (84)..(210): NCBI GI: 56542469 NCBI Desc: avr9/cf-9 rapidly elicited protein 140 [nicotiana tabacum]
  misc_feature (51)..(206): NCBI GI: 38454154 NCBI Desc: at5g13200 [arabidopsis thaliana]
  misc_feature (89)..(210): NCBI GI: 115488548 NCBI Desc: os12g0478200 [oryza sativa (japonica cultivar-group)]
  misc_feature (46)..(210): NCBI GI: 140038631 NCBI Desc: gram [medicago truncatula]
  misc_feature (48)..(190): NCBI GI: 4103635 NCBI Desc: aba-responsive protein [hordeum vulgare]
  misc_feature: The sequence is a functional homolog of SEQ ID NO. 430 in the 11/188,298 US application
MESFTQKHVIGIPLTSFAYADEERQGKPSCSTMVHKKNKKSSFIYRMNKLSDKTDNYMQGFKEHLTLGPKISETIKGKLSFGAKVLQAGGIDKVFREYFSVEKDEKLLKAFQCYLSTTAGPIAGMLFISTKKIAFHSDRPLNFMSPKGGSTKVPYKVLIPTKRIKSASVRENLYNPDEKYIDVVTVDGFDFWFMGFVSYEKSFKYLQHVIPELR

SEQ ID NO: 1217 - DNA, 645 bp, Sorghum bicolor
  misc_feature: Ceres ANNOT ID no. 6014570
  misc_feature: Encodes the peptide sequence at SEQ ID NO 1218
atggagagttttgcccagaaccagaagcatgtcattggaattcctttggcctcgtatgcatatgccagtgaggaaggaaaaccttcctgttctgccttgattcataagaagaacaagaagacttccttcatttaccggatgaacaagctgaacctgaaaacagatagctacatgcaagggttcaaacaacacttaactctggggccaaaaatttctgaaactatcaaagggaaactaagcttcggtgcaaaggttctacaagctggcagcattgagaaaatcttcaggcaatactttgtagtggagaaggatgagaaattattgaaggctttccagtgttatctttcaaccacagctggtccaatagcaggaatgctttttatctcaaatgagaagattgctttccatagtgataggcccctgagtttagcatgtcccaaaggggaaaggaccagggtgccctacaaggtgttgatccccgcaaaaagaataaagagcgcttccgtgagagaaaatttgtacaatcctgatgagaagtatattgatttagttactgttgatggatttgatttttggtttatgggttttattagctatgagaaatcattcagatatcttcaacatgtaatttcaaggtttagatga

SEQ ID NO: 1218 - protein, 214 aa, Sorghum bicolor
  misc_feature: Ceres ANNOT ID no. 6014570
  misc_feature (93)..(171): Pfam Id: GRAM Pfam Desc: GRAM domain
  misc_feature (53)..(214): NCBI GI: 38454154 NCBI Desc: at5g13200 [arabidopsis thaliana]
  misc_feature (84)..(211): NCBI GI: 56542469 NCBI Desc: avr9/cf-9 rapidly elicited protein 140 [nicotiana tabacum]
  misc_feature (89)..(211): NCBI GI: 115488548 NCBI Desc: os12g0478200 [oryza sativa (japonica cultivar-group)]
  misc_feature (64)..(213): NCBI GI: 140038631 NCBI Desc: gram [medicago truncatula]
  misc_feature (48)..(190): NCBI GI: 4103635 NCBI Desc: aba-responsive protein [hordeum vulgare]
  misc_feature: The sequence is a functional homolog of SEQ ID NO. 430 in the 11/188,298 US application
MESFAQNQKHVIGIPLASYAYASEEGKPSCSALIHKKNKKTSFIYRMNKLNLKTDSYMQGFKQHLTLGPKISETIKGKLSFGAKVLQAGSIEKIFRQYFVVEKDEKLLKAFQCYLSTTAGPIAGMLFISNEKIAFHSDRPLSLACPKGERTRVPYKVLIPAKRIKSASVRENLYNPDEKYIDLVTVDGFDFWFMGFISYEKSFRYLQHVISRFR

SEQ ID NO: 1219 - DNA, 1212 bp, Sorghum bicolor
  misc_feature: Ceres ANNOT ID no. 6014571
  misc_feature: Encodes the peptide sequence at SEQ ID NO 1220
atgttcaccgccggtgcggacggcaacggccacctgccgcgtccgcgcaggtcgcggcgcggcggagtaggccacgcaggcgtcatggggtctccacagggacaggtggctctgggggctcatccgcacccggccgccccgccgtgcaccgactacgacgtggcctacttcaaggcctactcacacattggcgtccacgaggagatgctcaaggatcatgtgagaactagtacttacagaaatgccataatgcatcacaaagatcttatttcaggcaaggtagttttggatgtgggttgcggcactggtgtcctttcgatattttgtgcttttgctggtgccactcgtgtttatgcagttgatgcaagtgatattgcattgcaggctatggagattgtaagagagaatgagctatctgacaaagttgtggttttgcacggccgaattgaggatgtcaatatcgaagaaaaagttgatgtcatcatatctgaatggatgggatacatgcttctgtatgagagtatgctgggaagcataatttttgctagggataaatggcttaagccaggaggtcttattcttccatcgcatgcatcgctttacatggcacctgtcacaaattctcagagataccatgatagtatttacttctggcgagatgtatatggcataaaaatgtcctctatgatgcctcttgcaaaacaatgtgcgtttatggagccatcagttgagacaattagtggagagaatgtcttgacatggccaacagtggttgcacaggtggattgttataccatacaagctcaggagcttgaaaccatcactgctgcatttaaatttacgtcaatgttgcaagctccattgcatggttttgcattttggttcgatgttgagttcaatggaccagtacgccagaaatccaagaagcaacctagtcaatcattggatgggaacacccaaaatgccagcccaagcagtaagaagaaaaaaccagatgtctctattgttctttcaactgcaccagaggatgcccctactcattggcagcagaccctattgtacttgtttgaacctattgaactaaacaaagatcagatcatagaaggttctgttaccatctcccagagccagcaacatgcccgcttccttaacatctgcctgaaatactttactggtgaccaatggtatgtcaaagaatctgtgatgcgataa

SEQ ID NO: 1220 - protein, 403 aa, Sorghum bicolor
  misc_feature: Ceres ANNOT ID no. 6014571
  misc_feature (96)..(193): Pfam Id: Methyltransf_12 Pfam Desc: Methyltransferase domain
  misc_feature (17)..(403): NCBI GI: 30685597 NCBI Desc: protein arginine n-methyltransferase family protein [arabidopsis thaliana]
  misc_feature (44)..(403): NCBI GI: 140067418 NCBI Desc: sam (and some other nucleotide) binding motif [medicago truncatula]
  misc_feature (149)..(403): NCBI GI: 145332651 NCBI Desc: protein arginine n-methyltransferase family protein [arabidopsis thaliana]
  misc_feature (9)..(403): NCBI GI: 38344195 NCBI Desc: osjnba0064g10.11 [oryza sativa (japonica cultivar-group)]
  misc_feature (17)..(324): NCBI GI: 9293956 NCBI Desc: protein arginine n-methyltransferase-like protein [arabidopsis thaliana]
MFTAGADGNGHLPRPRRSRRGGVGHAGVMGSPQGQVALGAHPHPAAPPCTDYDVAYFKAYSHIGVHEEMLKDHVRTSTYRNAIMHHKDLISGKVVLDVGCGTGVLSIFCAFAGATRVYAVDASDIALQAMEIVRENELSDKVVVLHGRIEDVNIEEKVDVIISEWMGYMLLYESMLGSIIFARDKWLKPGGLILPSHASLYMAPVTNSQRYHDSIYFWRDVYGIKMSSMMPLAKQCAFMEPSVETISGENVLTWPTVVAQVDCYTIQAQELETITAAFKFTSMLQAPLHGFAFWFDVEFNGPVRQKSKKQPSQSLDGNTQNASPSSKKKKPDVSIVLSTAPEDAPTHWQQTLLYLFEPIELNKDQIIEGSVTISQSQQHARFLNICLKYFTGDQWYVKESVMR

SEQ ID NO: 1221 - DNA, 480 bp, Sorghum bicolor
  misc_feature: Ceres ANNOT ID no. 6014588
  misc_feature: Encodes the peptide sequence at SEQ ID NO 1222
atggtgagcaccaagcttgcgttcctggccgtcgccgtcctgcttctgcaggcgtcgtggtgtgccgtggcccggcaccaccacgacccggatccatgcgtgaacccagaccccgcccaccgctgctcgtccctggccgtgtcgcccaacggtggtacgccggcggtgatgacggtgacctcgttcgaggctgacgggagcgggggcggccccgcggcgtgcgacgggggctaccacaacaacggcgacccgctcgcggcgctttccacggcgtggtacggggacggaagccggtgcctaaagccgatccgcatcacgagcacgcagaccgggcgcagcgtcatggccgaggtcgtggacgagtgcgacaccgacagcggctgcaaggacaacgaggtcagcacgtcccaggccgtctgggaggcgctcggcctcactaccaacatcggcgaggtttccatcacctggtccgacgcctaa

SEQ ID NO: 1222 - protein, 159 aa, Sorghum bicolor
  misc_feature: Ceres ANNOT ID no. 6014588
  misc_feature (38)..(159): NCBI GI: 38346744 NCBI Desc: osjnba0081g05.7 [oryza sativa (japonica cultivar-group)]
  misc_feature (21)..(159): NCBI GI: 85701136 NCBI Desc: kiwellin (allergen act c ?)
  misc_feature (28)..(159): NCBI GI: 92874714 NCBI Desc: barwin-related endoglucanase [medicago truncatula]
  misc_feature (28)..(159): NCBI GI: 92874720 NCBI Desc: barwin-related endoglucanase [medicago truncatula]
  misc_feature (28)..(159): NCBI GI: 92874728 NCBI Desc: barwin-related endoglucanase [medicago truncatula]
MVSTKLAFLAVAVLLLQASWCAVARHHHDPDPCVNPDPAHRCSSLAVSPNGGTPAVMTVTSFEADGSGGGPAACDGGYHNNGDPLAALSTAWYGDGSRCLKPIRITSTQTGRSVMAEVVDECDTDSGCKDNEVSTSQAVWEALGLTTNIGEVSITWSDA

SEQ ID NO: 1223 - DNA, 501 bp, Sorghum bicolor
  misc_feature: Ceres ANNOT ID no. 6014599
  misc_feature: Encodes the peptide sequence at SEQ ID NO 1224
atggcgaacgctacgcttgccgtcgtggcgctgcttgttctggtgcaggtttcgtgcggcgtcgcgcggcatcaccacgagcaccacccggacccgtgcggcggggacgacgactcggtcggcctgatgggccacaaggacaacggctgctcgtcgccggccgtgtcgcgccacggtacgcgcgcggtgatgacggtgaacgggttccagaggggcgaggacggcggaggcccgtcggagtgcgacgggcactaccacagcgacaacgacctgatcgtggcgctgtccacggggtggtacgcgggagggaagaggtgccacaagaagatccgcatcacgagcgtgcagaacgggcgcaccgtggaggcaacggtcgtggacgagtgcgactcccgccatggctgcaagaccaacatcgtcgacacgtccaaggccgtctggaagaagctagggctcaacaccgaaattggcgaggtcccagtcatctggtccgacgcatga

SEQ ID NO: 1224 - protein, 166 aa, Sorghum bicolor
  misc_feature: Ceres ANNOT ID no. 6014599
  misc_feature (92)..(163): Pfam Id: DPBB_1 Pfam Desc: Rare lipoprotein A (RlpA)-like double-psi beta-barrel
  misc_feature (16)..(166): NCBI GI: 85701136 NCBI Desc: kiwellin (allergen act c ?)
  misc_feature (50)..(166): NCBI GI: 38346744 NCBI Desc: osjnba0081g05.7 [oryza sativa (japonica cultivar-group)]
  misc_feature (52)..(166): NCBI GI: 92874720 NCBI Desc: barwin-related endoglucanase [medicago truncatula]
  misc_feature (30)..(166): NCBI GI: 92874716 NCBI Desc: barwin-related endoglucanase [medicago truncatula]
  misc_feature (52)..(166): NCBI GI: 92874714 NCBI Desc: barwin-related endoglucanase [medicago truncatula]
MANATLAVVALLVLVQVSCGVARHHHEHHPDPCGGDDDSVGLMGHKDNGCSSPAVSRHGTRAVMTVNGFQRGEDGGGPSECDGHYHSDNDLIVALSTGWYAGGKRCHKKIRITSVQNGRTVEATVVDECDSRHGCKTNIVDTSKAVWKKLGLNTEIGEVPVIWSDA

SEQ ID NO: 1225 - DNA, 1686 bp, Sorghum bicolor
  misc_feature: Ceres ANNOT ID no. 6014626
  misc_feature: Encodes the peptide sequence at SEQ ID NO 1226
atgagtgagggggatgctactcagattgaccttgagaaaggattactgcaaatgtctaatgatgatgattcgagtagccctgcaactatgcacaagatgaaagttgacacagaagacgctggaattaaaattgaatcacccactccagagaagcttgaatctagaagcaaaggggttgttgtgagttcgctggcaaggaatttacttgcagaaaggtacaaagatagatttgcaaatcagttcgtggaagatgagggtgacacagatgatgaagactataatgacagtattttgcctggtgtgagccgttctcatatgtcaagaagcattgaacttttcgagaaacacaaggatttactgaacctttttaatagaatggagagttctataaggttgttacacctacggaagaggatggctacatttagtaatattgctgcccaggtggaaatactcacaaaaaggaagttatcgtacagtcatttggcccaaatgaaacatttgtttccagaagcaatccagattaagaggatacttctacatgatgagaaaagcctatgcatgtatgctgatatggaaatcatacttgtaatggatgttgtggaatgcacaagtcctgatcagtctccatccatggcaatttgtgaggctttttactcaaagcttttgagatttttggatactcatcataagggtacagacattccagaggcaaccttaccagaaccctttaactcgaggtcaaagggccagttatttcttgaggcatcacataatggtcatgctgctgagccacatctgcagggcaccactgaggatggattctcaaatgcttcccattttccacaatcttttcgaaagctaatgtcccagaaagtcattactgatggagctgaaaagactcaattgctacctgatccaacaaaactgagctctgtgagtgcttatgatatggaaggaacaaacagaagccctataaagcaagacaaacatgcttcatttacagtgaactctgaaatttctgctactccaagccgtcatttgatctcttgttgtcaagagggtacgccaaaacaagagacctcagagtcaccattgttggttcaaacaccagcaatgcagacacccaaaaggccattgccaactccacttgagaaactcgaggccacgtgtggacacatttctgaaccacgttcagccagttctgcccgcagatcactaaatacatctttaaaatttgaaggaggaagcccttcttatcatgacagaatggaacatgaggctgcatctaaaaaggaaattttctcagaagactcatctagtttcaacaagtcattagaggagaaagatcctgtcttctttactgaagacaaaatcaatctggcagaccaagtgggtacccaggaaaagatggcttcgttacgttccacatttgacattgtctgtggtatttctcattcgaccaagaattcgctaattacaaaacaggaacttttccacaatattcttgccaacaacttggagatagaacagatgggtgaggtagaagagcagctgcatattttagaggatctggctcccgattggatatctaagaaggtgataaatggaggagaaatactttacagcattgaacctataacagatcagaattcagttcgggaaaggcttgtagaagctgtgtga

SEQ ID NO: 1226 - protein, 561 aa, Sorghum bicolor
  misc_feature: Ceres ANNOT ID no. 6014626
  misc_feature (112)..(242): Pfam Id: CDT1 Pfam Desc: DNA replication factor CDT1 like
  misc_feature (68)..(561): NCBI GI: 115482658 NCBI Desc: os10g0489900 [oryza sativa (japonica cultivar-group)]
  misc_feature (43)..(560): NCBI GI: 38344618 NCBI Desc: osjnbb0003a12.4 [oryza sativa (japonica cultivar-group)]
  misc_feature (43)..(560): NCBI GI: 116317853 NCBI Desc: osigba0148j22.4 [oryza sativa (indica cultivar-group)]
  misc_feature (47)..(559): NCBI GI: 38567811 NCBI Desc: cdt1a protein [arabidopsis thaliana]
MSEGDATQIDLEKGLLQMSNDDDSSSPATMHKMKVDTEDAGIKIESPTPEKLESRSKGVVVSSLARNLLAERYKDRFANQFVEDEGDTDDEDYNDSILPGVSRSHMSRSIELFEKHKDLLNLFNRMESSIRLLHLRKRMATFSNIAAQVEILTKRKLSYSHLAQMKHLFPEAIQIKRILLHDEKSLCMYADMEIILVMDVVECTSPDQSPSMAICEAFYSKLLRFLDTHHKGTDIPEATLPEPFNSRSKGQLFLEASHNGHAAEPHLQGTTEDGFSNASHFPQSFRKLMSQKVITDGAEKTQLLPDPTKLSSVSAYDMEGTNRSPIKQDKHASFTVNSEISATPSRHLISCCQEGTPKQETSESPLLVQTPAMQTPKRPLPTPLEKLEATCGHISEPRSASSARRSLNTSLKFEGGSPSYHDRMEHEAASKKEIFSEDSSSFNKSLEEKDPVFFTEDKINLADQVGTQEKMASLRSTFDIVCGISHSTKNSLITKQELFHNILANNLEIEQMGEVEEQLHILEDLAPDWISKKVINGGEILYSIEPITDQNSVRERLVEAV

SEQ ID NO: 1227 - DNA, 1281 bp, Sorghum bicolor
  misc_feature: Ceres ANNOT ID no. 6014665
  misc_feature: Encodes the peptide sequence at SEQ ID NO 1228
atggcgcgcgccccgagctggtcgtcgcccctcgtcctggtgctcatcatcgtggccaccgccgtcgccgccgtgaccgcgtcggaggcgatcagggtgcccgccgtcggcaactggacggaggagctgcgcggggccgcgacgacgaggcgagcccggcagcggcacgggtggcgctcccggcgccggacgttcgagaacggcctcggccgtacgccgcagatggggtggaatagctggaaccacttcggctgcgggatcaacgagaacctcatcaagcagacagctgatgcactggtcaacactggtctggcgaaattgggctatgagtatgttaatatagatgattgctgggcagaatctgacagggactaccagggaaactttgttgcacatagacaaaacttcccttctggcatcaaggcactcgcagattatgtgcacgcaaaagggctgaagcttggcatctacagtgatgctgggacacgaacatgcagccaaaaaatgccaggatcacttgatcatgaagagcaggatgtgaaaacattttcatcttggggtattgattatctgaaatatgacaactgcaatgatgctggcaggagtgtaatggagagatatactaaaatgagcaatgctatgaaaacctatggaaagaacatcttcttctcgttgtgtgaatggggaagagaaaatcctgctacctgggcaggcagcatgggaaacagctggagaacaactgatgatatcgctgacaactggggcagcatgacatctcgtgcagaccagaatgacagatgggcttcctatgccggacctggtgggtggaacgatcctgatatgcttgaagtgggcaacggtggtatgtctgaggcggagtaccgctctcacttcagcatctgggcacttgccaaggctcctcttctgatcggatgcgacgtacggtcgatgagccagcagacaaaggacatactcagcaactcagaagtcatcgctgtgaaccaagatagtcttggtgtccaaggaaagaaagtgcaatccaacaatggcttggaggtttgggctgggccactcagcaacaacaggaaggccgtggtgctctggaaccggcagggctaccaggcaaccatcaccgcacaatggtcgagcatcgggcttgcttcatccactgctgtcactgctcgtgatctatgggcgcactcatcattctcggctcagggccaattatcagcttcagtggcacctcatgactgcaagatgtatgtcctgacaccaaattaa

SEQ ID NO: 1228 - protein, 426 aa, Sorghum bicolor
  misc_feature: Ceres ANNOT ID no. 6014665
  misc_feature (40)..(371): Pfam Id: Melibiase Pfam Desc: Melibiase
  misc_feature (1)..(426): NCBI GI: 60389815 NCBI Desc: alpha-galactosidase precursor (melibiase) (alpha-d-galactoside galactohydrolase)
  misc_feature (9)..(426): NCBI GI: 115482692 NCBI Desc: os10g0493600 [oryza sativa (japonica cultivar-group)]
  misc_feature (65)..(426): NCBI GI: 33358179 NCBI Desc: chain a, crystal structure of rice alpha-galactosidase
  misc_feature (61)..(425): NCBI GI: 29335747 NCBI Desc: alpha-galactosidase [helianthus annuus]
  misc_feature (60)..(425): NCBI GI: 6164944 NCBI Desc: alpha-galactosidase [lycopersicon esculentum]
  misc_feature (1)..(426): SWISSPROT Homolog: EC 3.2.1.22 Alpha-galactosidase precursor
MARAPSWSSPLVLVLIIVATAVAAVTASEAIRVPAVGNWTEELRGAATTRRARQRHGWRSRRRTFENGLGRTPQMGWNSWNHFGCGINENLIKQTADALVNTGLAKLGYEYVNIDDCWAESDRDYQGNFVAHRQNFPSGIKALADYVHAKGLKLGIYSDAGTRTCSQKMPGSLDHEEQDVKTFSSWGIDYLKYDNCNDAGRSVMERYTKMSNAMKTYGKNIFFSLCEWGRENPATWAGSMGNSWRTTDDIADNWGSMTSRADQNDRWASYAGPGGWNDPDMLEVGNGGMSEAEYRSHFSIWALAKAPLLIGCDVRSMSQQTKDILSNSEVIAVNQDSLGVQGKKVQSNNGLEVWAGPLSNNRKAVVLWNRQGYQATITAQWSSIGLASSTAVTARDLWAHSSFSAQGQLSASVAPHDCKMYVLTPN

SEQ ID NO: 1229 - DNA, 2583 bp, Sorghum bicolor
  misc_feature: Ceres ANNOT ID no. 6014685
  misc_feature: Encodes the peptide sequence at SEQ ID NO 1230
atggcgtcggcggcgtggtcctctaatgtgatgctcgcgatccacgagaagaaaacgactgccactgatctctaccgcccgctgcgcctctacatcgcctccgtctactcggagcgcgaggccgccgcggccgacgacgaccttaccgtggtgcgagacctccgcgccgctgtcgagcagccctccctcccggacccgtcctccctcgagcagcgccgcgacgcgctgctcgcctacgcgcgggctctggcgctcgtggagccccggttccccatctcccccgaccgcgcccacgtccactccctcaccttcacctggcacgacgccttcaaggggaacaagaagtgcgccctcgcctccatccacctcgagaaggcctccgtgctcttcaacatcggcgccgtctactcccagatcgcgctcgccgcggaccgctccaccgacgtcgggatcaagaccgcgtgcggcgccttccagagtgcggcgggggcgttcgcgtggctcagggagagcggggtcgcggccaaggctgtcgctgcgggggccaccactgtggacatcacgcccgagtgcgccggcatgctggagaaactcatgctcgcgcaggcgcaggagtgcttcttcgagaaggtcataggtggagggaagccacccgcgctgtgctccaaggtggcgcggcaggtgggcatattctatgaagaagcatacgcagctctcagtgcacctcctctaagtcagcactttgataagacatgggtgtcccatgtccagctgaaagctgctcaattctacgccgatgcttgctataggtattcattagatcttcatcagaaagaagaaattgctgaggaaattgcacgtttaaagattggtatgagtgccttggcagatgctaagaaggctgcgaagggagttgctgcccagcttctggattctgtgaacaagctggaaactaacatgaaaaccaacttggaaagggctatgaaggagaatgatcgtgtttacctgatgcgggttccagctgctgcatcccttgtaaagcctacctctttggcagaagttttagatgccagcaaggaaaggcttttttcatcacttgtgcctgatggcagcatgaaagcactctctaagtacacagagatgctagataatattatccggacccaagcagagaaattgcagcaagccagtgagatcactagagtcaggctgaaggaaatggacttaccagattctattctttcattggaaggaaatataaccttgcccttggatctcaaggaagacgtagaggctgtgcagataagtggtggccctgctggcttagaatctgagttgcagcagcttagggatttgagcagggtcaatcaggaactacttgttcagactgaagagcttctacagaaggaggcgaatgaagacgctcaatttcgtacacaatttgggagtcgctggactagacctcaatcaagcaccctaaccaagaatattcaggatagattgaatctgtttgcttctaatctgaagagagctgctgatagtgattctctgatcgaacgaggcgtgaaggagaactatccattgatgtctatccttgacaaaagaccgatagagtctgcacttccaagtatttccaggcctatcatgtccttggatgggaatgaagatgccattgttggagccctgaaacaaagcttgagacaactggaggctcttggagcacaaagggcaggtcttgaagacatgctcaaagaaatgaaaagaaaggacgatatattgcctaagttgatgactggtgtgggatcacatgatgatcttttcaagaaggagcttgctaagtatgatcctatctgtgctgatattgctgataacattgtggcacaggaacaattattgctacaaatacaggcacaaaatgagcaatttgctgctgtattcaacctagaggattacaaagctgctcgtgagagatgctacaagcaaatcgctgctgctgttgctaaatatcaggagttcaaaaagaacattaacgagggcctaaacttttatgtgactttacaggaagcaataggcaaaataaagcagcagtgcagtgactttataatgacccgaaacattcaatgccgtgaaatgatcgaagatgtgcagaggaagctagcgggtttcagcttctcgtcctccggccactcttctttgcagaggaatgcttctgtgccacctgatcagagcagcccatcaccaccgccgcatgctcaggctccctatgcctctacacctggggtagactcaaggcctggatattctcaaccggagccaagaccttcatactcacagccatacccctcatcctatggcgcgccaccgcaacagcctccatacagtgcaccacaccctggtcagtaccagccaccagcgcatcagccgcctcctggtcatgactatggtcagccggcatatcctggatggcgtggtccatattacaatgcccatcagccgcagcaatctgcgccatatccacagccaccgtacaatgcccctggggcttaccctccgcaccagagcaactattacaggcctcaataa

SEQ ID NO: 1230 - protein, 860 aa, Sorghum bicolor
  misc_feature: Ceres ANNOT ID no. 6014685
  misc_feature (10)..(390): Pfam Id: BRO1 Pfam Desc: BRO1-like domain
  misc_feature (1)..(858): NCBI GI: 46389755 NCBI Desc: alg2-interacting protein x [nicotiana tabacum]
  misc_feature (1)..(858): NCBI GI: 15218061 NCBI Desc: hydroxyproline-rich glycoprotein family protein [arabidopsis thaliana]
  misc_feature (1)..(858): NCBI GI: 23297205 NCBI Desc: at1g15130/f9l1_7 [arabidopsis thaliana]
  misc_feature (224)..(858): NCBI GI: 5103812 NCBI Desc: similar to gbaj005073 alix (alg-2-interacting protein x) from mus musculus. ests gbr90133, gbz17944 and gbaa605465 come from this gene. [arabidopsis thaliana]
  misc_feature (2)..(589): NCBI GI: 144923834 NCBI Desc: helix-turn-helix, fis-type; bro1 [medicago truncatula]
MASAAWSSNVMLAIHEKKTTATDLYRPLRLYIASVYSEREAAAADDDLTVVRDLRAAVEQPSLPDPSSLEQRRDALLAYARALALVEPRFPISPDRAHVHSLTFTWHDAFKGNKKCALASIHLEKASVLFNIGAVYSQIALAADRSTDVGIKTACGAFQSAAGAFAWLRESGVAAKAVAAGATTVDITPECAGMLEKLMLAQAQECFFEKVIGGGKPPALCSKVARQVGIFYEEAYAALSAPPLSQHFDKTWVSHVQLKAAQFYADACYRYSLDLHQKEEIAEEIARLKIGMSALADAKKAAKGVAAQLLDSVNKLETNMKTNLERAMKENDRVYLMRVPAAASLVKPTSLAEVLDASKERLFSSLVPDGSMKALSKYTEMLDNIIRTQAEKLQQASEITRVRLKEMDLPDSILSLEGNITLPLDLKEDVEAVQISGGPAGLESELQQLRDLSRVNQELLVQTEELLQKEANEDAQFRTQFGSRWTRPQSSTLTKNIQDRLNLFASNLKRAADSDSLIERGVKENYPLMSILDKRPIESALPSISRPIMSLDGNEDAIVGALKQSLRQLEALGAQRAGLEDMLKEMKRKDDILPKLMTGVGSHDDLFKKELAKYDPICADIADNIVAQEQLLLQIQAQNEQFAAVFNLEDYKAARERCYKQIAAAVAKYQEFKKNINEGLNFYVTLQEAIGKIKQQCSDFIMTRNIQCREMIEDVQRKLAGFSFSSSGHSSLQRNASVPPDQSSPSPPPHAQAPYASTPGVDSRPGYSQPEPRPSYSQPYPSSYGAPPQQPPYSAPHPGQYQPPAHQPPPGHDYGQPAYPGWRGPYYNAHQPQQSAPYPQPPYNAPGAYPPHQSNYYRPQ

SEQ ID NO: 1231 - DNA, 1185 bp, Sorghum bicolor
  misc_feature: Ceres ANNOT ID no. 6014695
  misc_feature: Encodes the peptide sequence at SEQ ID NO 1232
  misc_feature: Down-regulated in shoot tissues in response to methyl jasmonate treatment
  misc_feature: Down-regulated in shoot tissues in response to salicylic acid treatment
atggcgctccaggcggcgacgtccttcctcccctccgccctctccgcgcgcaaggaggggtcggtcaaggactcggcgttcttgggtgttcgtctcgcggatggcctcaagctggagaccactgctctcggcctacgcaccaagagggtgagcacgtcggtggccatccgcgcgcagacggcagcggtgtcctccccatcagtgacccccgcgtcgccgtcaggcaagaagaccctccgcaagggcacggcggtcatcaccggcgcgtcgtccggtctcggcctggccacggcgaaggccctggcggagacaggcaagtggcacgtcatcatggcctgccgcgacttcctcaaggcgtcgcgcgcggccaaggcggccggcatggacaaggacagcttcaccatcgtgcacctggacctcgcctctctcgacagcgtccgccagttcgtcaagaacgtgcgccagctggagatgcccatcgacgtcgtggtctgcaacgccgccgtgtaccagcccaccgccaaggacccgtcctacaccgccgacggcttcgagatgagcgtcggcgtcaaccacctcggccacttcctcctcgcccgcgagctcctcagcgacctccagtcctccgactacccctccaagcgcctcatcatcgtcggctccatcaccgggaacacgaacacgctggcggggaacgtgccgccgaaggcgaacctgggtgacctgcgcggcctcgccggcggcctcaacggcattggcagctcggtgatgatcgacggcggggagttcgacggcgccaaggcgtacaaggacagcaaggtgtgcaacatgctgacgatgcaggagttccaccgccggtaccacgaggagacgggcgtcaccttcgcgtcgctctacccgggctgcatcgccaccacgggcctgttccgcgagcacatcccgctgttccggctgctcttcccgccgttccagaagtacatcaccaaggggtacgtctccgaggaggaggccgggaagcggctggcgcaggtggtgagcgaccccagcctgaccaagtccggcgtgtactggagctggaacaagaactcggcgtccttcgagaaccagctctccgaggaggccagcgactccgacaaggccaagaagctgtgggagatcagcgagaagctcgtcggcttggcgtga

SEQ ID NO: 1232 - protein, 394 aa, Sorghum bicolor
  misc_feature: Ceres ANNOT ID no. 6014695
  misc_feature (82)..(248): Pfam Id: adh_short Pfam Desc: short chain dehydrogenase
  misc_feature (1)..(394): NCBI GI: 683476 NCBI Desc: nadph dehydrogenase [hordeum vulgare]
  misc_feature (25)..(394): NCBI GI: 46019982 NCBI Desc: nadph-protochlorophyllide oxidoreductase [zea mays]
  misc_feature (1)..(394): NCBI GI: 6644198 NCBI Desc: nadph:protochlorophyllide oxidoreductase [daucus carota]
  misc_feature (1)..(394): NCBI GI: 2244614 NCBI Desc: nadph-protochlorophyllide oxidoreductase [cucumis sativus]
  misc_feature (1)..(394): NCBI GI: 20830 NCBI Desc: protochlorophyllide reductase [pisum sativum]
  misc_feature (1)..(394): SWISSPROT Homolog: EC 1.3.1.33 Protochlorophyllide reductase B, chloroplast precursor
  misc_feature: Down-regulated in shoot tissues in response to methyl jasmonate treatment
  misc_feature: Down-regulated in shoot tissues in response to salicylic acid treatment
  misc_feature: The sequence is a functional homolog of SEQ ID NO. 453 in the 11/188,298 US application
  misc_feature: The sequence is a functional homolog of SEQ ID NO. 389 in the 11/188,298 US application
MALQAATSFLPSALSARKEGSVKDSAFLGVRLADGLKLETTALGLRTKRVSTSVAIRAQTAAVSSPSVTPASPSGKKTLRKGTAVITGASSGLGLATAKALAETGKWHVIMACRDFLKASRAAKAAGMDKDSFTIVHLDLASLDSVRQFVKNVRQLEMPIDVVVCNAAVYQPTAKDPSYTADGFEMSVGVNHLGHFLLARELLSDLQSSDYPSKRLIIVGSITGNTNTLAGNVPPKANLGDLRGLAGGLNGIGSSVMIDGGEFDGAKAYKDSKVCNMLTMQEFHRRYHEETGVTFASLYPGCIATTGLFREHIPLFRLLFPPFQKYITKGYVSEEEAGKRLAQVVSDPSLTKSGVYWSWNKNSASFENQLSEEASDSDKAKKLWEISEKLVGLA

SEQ ID NO: 1233 - DNA, 993 bp, Sorghum bicolor
  misc_feature: Ceres ANNOT ID no. 6014700
  misc_feature: Encodes the peptide sequence at SEQ ID NO 1234
atggggacgctcatccggccggggcccgccgcgtcgcctctccccatcgcttcctcctcctcgtccggccacgtggcggccgttggcggcggcgaaggggcgaggagcttgcggcatcgggtgtcggtggcggtgttccggtccccgagtacgcatgttctggcgacgagatggcgccggcggagaggtacggttgtgcggtcggatgccatcgccggcgccgcggcagctggggattcgacgccggcactgtcaggcctgcaattggctcccagagtcagaggggtttgcttctatttggtgactgcagttgcagcaatctttttgtttgtagctatggttgtggttcatccactcgtgctactatttgaccggtaccgtaggagagtgcagcactacatcgcgaagatttgggctacgttgacaatttccatgttctacaagcttgaggttgagggaatggaaaatctacctccaaataatagtcctggtgtctatgttgctaaccatcagagcttcttggatatttatacccttcttactctagggaggtgcttcaaatttataagcaagaccagtatctttatgttccctattatagggtgggctatgtatctcttgggtgtgattcctctgcggcgtatggacagcaggagccagctggattgtctcaaacggtgcgtggacttggtgggaaaaggagcttctgtatttttctttccagagggtactcgaagtagagatggcaagttaggtgtatttaagcgtggtgcattcagtgtcgccgcaaagaccggagctcctgtgatacctattactcttatcggaactgggaaattgatgccttctggaatggaaggaattctcaattcaggttcagtaaaggtgattattcaccgacctattcaaggaaatgatgcagaaacattatgttccaaagcaaggaatgtgatagcagatactcttgttctacatggttatggagtgcattaa

SEQ ID NO: 1234 - protein, 330 aa, Sorghum bicolor
  misc_feature: Ceres ANNOT ID no. 6014700
  misc_feature (148)..(275): Pfam Id: Acyltransferase Pfam Desc: Acyltransferase
  misc_feature (59)..(324): NCBI GI: 8163563 NCBI Desc: lysophosphatidic acid acyltransferase [brassica napus]
  misc_feature (99)..(322): NCBI GI: 121537413 NCBI Desc: 1-acyl-sn-glycerol-3-phosphate acyltransferases [anaeromyxobacter sp. fw109-5]
  misc_feature (97)..(322): NCBI GI: 145620480 NCBI Desc: 1-acyl-sn-glycerol-3-phosphate acyltransferase [geobacter bemidjiensis bem]
  misc_feature (97)..(328): NCBI GI: 108761281 NCBI Desc: 1-acyl-sn-glycerol-3-phosphate acyltransferase family protein [myxococcus xanthus dk 1622]
  misc_feature (132)..(319): NCBI GI: 110599477 NCBI Desc: 1-acyl-sn-glycerol-3-phosphate acyltransferases [geobacter sp. frc-32]
  misc_feature (59)..(324): SWISSPROT Homolog: EC 2.3.1.51 1-acyl-sn-glycerol-3-phosphate acyltransferase 1, chloroplast precursor
  misc_feature: The sequence is a functional homolog of SEQ ID NO. 487 in the 11/188,298 US application
MGTLIRPGPAASPLPIASSSSSGHVAAVGGGEGARSLRHRVSVAVFRSPSTHVLATRWRRRRGTVVRSDAIAGAAAAGDSTPALSGLQLAPRVRGVCFYLVTAVAAIFLFVAMVVVHPLVLLFDRYRRRVQHYIAKIWATLTISMFYKLEVEGMENLPPNNSPGVYVANHQSFLDIYTLLTLGRCFKFISKTSIFMFPIIGWAMYLLGVIPLRRMDSRSQLDCLKRCVDLVGKGASVFFFPEGTRSRDGKLGVFKRGAFSVAAKTGAPVIPITLIGTGKLMPSGMEGILNSGSVKVIIHRPIQGNDAETLCSKARNVIADTLVLHGYGVH

SEQ ID NO: 1235 - DNA, 924 bp, Sorghum bicolor
  misc_feature: Ceres ANNOT ID no. 6014701
  misc_feature: Encodes the peptide sequence at SEQ ID NO 1236
atggcgggccgtgtggcggggcgaggcgggaggccgctgctgggcggaagcggcgggggcgggaagcgcggcgggaggccgtcgatggcggtcgtggcggcgctgctgctggcgtgcgcggcgctgctcctgctcctggcgctcggcgcgctatcgctgcccggggcctccgacggctccgggggccgcggcgtggggctcgcgcgcccgcgcccgcgctcgcacttccgcagatccaccttcgactcggggctagagatgcgtggggagaagggggagccgtggacggaggtgctgtcgtgggagccccgcgcgttcgtgtaccacaacttcctctccaaggaagaatgtgaccatttgatttcactggcaaagcctcatatgaagaagtcaacagtagttgattcagcaactggagcgagcaaggatagcagagtgcggacaagttcaggaatgtttcttagaagagggcaggataaaattattcagacaattgagaaaaggatagcagatttcaccttcatacctgtagagcatggtgagggtcttcaagtcctccactatgaagttgggcagaagtacgagcctcactttgattacttccatgatgattacaacaccaagaatggaggccagcgtatagccactcttcttatgtatctttcggatgttgaagatggtggcgagactgtgttcccttcatcgacaacaaacagcagctcttcaccattttataatgagctgtctgaatgtgcaaagggcggtctatctgttaaaccaaagatgggagatgcgcttctgttctggagcatgaagcctgatggatccatggattccacaagcctgcatggtgggtgcccagtgataaaaggcaacaaatggtcatcgacaaagtggatgcgcgttcatgagtacaaagcttag

SEQ ID NO: 1236 - protein, 307 aa, Sorghum bicolor
  misc_feature: Ceres ANNOT ID no. 6014701
  misc_feature (179)..(302): Pfam Id: 2OG-FeII_Oxy Pfam Desc: 2OG-Fe(II) oxygenase superfamily
  misc_feature (29)..(306): NCBI GI: 18394842 NCBI Desc: oxidoreductase, 2og-fe(ii) oxygenase family protein [arabidopsis thaliana]
  misc_feature (28)..(306): NCBI GI: 144923396 NCBI Desc: 2og-fe(ii) oxygenase [medicago truncatula]
  misc_feature (28)..(306): NCBI GI: 25411813 NCBI Desc: similar to prolyl 4-hydroxylase alpha subunit [imported] - arabidopsis thaliana
  misc_feature (28)..(305): NCBI GI: 42567428 NCBI Desc: oxidoreductase, 2og-fe(ii) oxygenase family protein [arabidopsis thaliana]
  misc_feature (28)..(284): NCBI GI: 10177121 NCBI Desc: prolyl 4-hydroxylase, alpha subunit-like protein [arabidopsis thaliana]
  misc_feature: The sequence is a functional homolog of SEQ ID NO. 333 in the 11/188,298 US application
MAGRVAGRGGRPLLGGSGGGGKRGGRPSMAVVAALLLACAALLLLLALGALSLPGASDGSGGRGVGLARPRPRSHFRRSTFDSGLEMRGEKGEPWTEVLSWEPRAFVYHNFLSKEECDHLISLAKPHMKKSTVVDSATGASKDSRVRTSSGMFLRRGQDKIIQTIEKRIADFTFIPVEHGEGLQVLHYEVGQKYEPHFDYFHDDYNTKNGGQRIATLLMYLSDVEDGGETVFPSSTTNSSSSPFYNELSECAKGGLSVKPKMGDALLFWSMKPDGSMDSTSLHGGCPVIKGNKWSSTKWMRVHEYKA

SEQ ID NO: 1237 - DNA, 948 bp, Sorghum bicolor
  misc_feature: Ceres ANNOT ID no. 6014703
  misc_feature: Encodes the peptide sequence at SEQ ID NO 1238
atggcgctggagatcgagcacacccacctccccatccgcggcctcaacctccacgtcgcacacgtaggcaaaggtgacctgggcacggtggtgttcctgcacggcttcccggagatctggtactcgtggcgccaccagatgcgggccgtggccgccgcggggtacctcgccatcgcgccggactgccgcgggtacggcctgtccgaccagccgccggaggacgaggaggcctcccttgacgacctcgtcgccgacgtgctcggcatcctcgacgccctcagcgtcccaaaggcgttcctggtgggcaaagacttcggcgccatgccggcgtacgagttcgcgctgcagcacccggaccgcacccgcggcgtggtgtgcctgggcatccccttcagcccggtgcccatgtccttggacgccatgcccgaaggcttgtacatccggcgctggcgcgagccggggggcagggcggaggccgacttcggccggttcgacgtgaggcgcgtggtgcgcaccgtctacgtgctcttctccggcgccgacatcccgatcgccaaggaagggcaggaggtcatggacctggccgacctgtcgacgccgctcccggcgtggttcaccgaggaggacctggacgcctacgccaagctctacgagaagtccggcttcggctacccgctcaagatgccgtacagagctatacacaagatcccgaaccggctggacgccaagttccaggtgccggtgttcatggtgatgggggagaaggactactgcttcaagttcccggggttcgagaccgccatgcgcagcggcgtcatgaacaacttcatgccggacctcaagatcacctacatcccggaggggagccacttcgtgcaggagcagctcccggagcaggtcaacgacctgctcctcggcttcctcagtgaccatccctccgccgcataa

SEQ ID NO: 1238 - protein, 315 aa, Sorghum bicolor
  misc_feature: Ceres ANNOT ID no. 6014703
  misc_feature (55)..(306): Pfam Id: Abhydrolase_1 Pfam Desc: alpha/beta hydrolase fold
  misc_feature (11)..(314): NCBI GI: 115482748 NCBI Desc: os10g0498300 [oryza sativa (japonica cultivar-group)]
  misc_feature (4)..(151): NCBI GI: 115482744 NCBI Desc: os10g0498100 [oryza sativa (japonica cultivar-group)]
  misc_feature (4)..(308): NCBI GI: 1354849 NCBI Desc: epoxide hydrolase [nicotiana tabacum]
  misc_feature (5)..(308): NCBI GI: 25044843 NCBI Desc: epoxide hydrolase [ananas comosus]
  misc_feature (4)..(308): NCBI GI: 46090793 NCBI Desc: soluble epoxide hydrolase [citrus jambhiri]
MALEIEHTHLPIRGLNLHVAHVGKGDLGTVVFLHGFPEIWYSWRHQMRAVAAAGYLAIAPDCRGYGLSDQPPEDEEASLDDLVADVLGILDALSVPKAFLVGKDFGAMPAYEFALQHPDRTRGVVCLGIPFSPVPMSLDAMPEGLYIRRWREPGGRAEADFGRFDVRRVVRTVYVLFSGADIPIAKEGQEVMDLADLSTPLPAWFTEEDLDAYAKLYEKSGFGYPLKMPYRAIHKIPNRLDAKFQVPVFMVMGEKDYCFKFPGFETAMRSGVMNNFMPDLKITYIPEGSHFVQEQLPEQVNDLLLGFLSDHPSAA

SEQ ID NO: 1239 - DNA, 3942 bp, Sorghum bicolor
  misc_feature: Ceres ANNOT ID no. 6014737
  misc_feature: Encodes the peptide sequence at SEQ ID NO 1240
  misc_feature: Up-regulated in shoot tissues in response to methyl jasmonate treatment
  misc_feature: Up-regulated in root tissues in response to methyl jasmonate treatment
atggacggcggcgccaactggcgccctacgcagggagccgaccctgccgccgtcgctgccgctggcggggttgaccccaacgcggctgcacccgccggaagcgactggcgtacccagcttcagcccgaggcgcgccacaggatcgtcaataagataatggagactctgaagaagcacctgccagtatcagtaccagaagggctgactgagcttcacaaaattgccgtgcgatttgaagagaaaatctatactgcagccaccagccagtctgattatttgcggaagatttctctgaaaatgctgtccatggaaagtcagacaaagacccaacagaacgctggaagtgctcaagtgattccaaatcaaaaccctcctggtccagcacctggccttcctccacaaggtagtaatccagcacagtcatcagctatcccattgatgtctcagcaacagacacggcagccaaatgcttctacatctgttcaaggttctcttcccagccagacatcgacgctgcagaacctgtctggcctgccacaaaataccatgaacaatggtttagcacaaggtactccacaagatatgtatgctgcacaaagacaaatggcaggtaggcagcagcagcagcaacaacaacaacaagcacataatcagttaatttatcaacagcagaaattgttgatgagccagaaattgcagcagaattcacttatgcaaccgcatattcagcagcagcaaactttgttgcagtcaacacagatgcaatcttcacagcagtccatgatgcaaatgtcatctggccttcagcctgggcagaccaccattccacaaactcagtccatggcgatgcagtcagctacacagagcggtattcaacagaatccattgaattcagtacaacaatctgtgcaatcattactccagcagcctacacaatctgtagtgaggcagcagcaacatccacagtccatgcaccagcagccttctctgcagcaaactcaaccaactcaacagcccaacattcctttgcaacagcagccacaacaattaatgggccagcagtcaaatttacagcaaaatcagttaatgaatcaacagagtggtgctgtggagatgcaacagcaacaaaggctaccagttcagtcaaataatcttttgaatatgcagcaaacacagcagatgatgaaccagcaatctatgcccttgcaccagccccaacaattggcaaaccagggaaacatgtcaagtctacatcaacagcagcagcaaaatcagcagcagcagcagcagcagcttcttggaactgcgccaaatgtccgtatgcatatgttacagcagcaaaagccaattcagcaaccacagcagcaacagcatgctcagcagacatcgatgggtttgatgcaacctcagtctcagcagaaccagcttcagcaacctcaacaacatatgatgtcgcagttccagtctcagcctaatcaagtgcagcaacaattgggaatgcaacaaaggctccaaacttcagctggcatgctcttgcaacaaaataatattgatcaacaaaagcaatacgttcaggcacagaggggcctccaagaagcacccagtacatctgtggattccactgctcaaactggtcatccaggaggtgatttgcaagaggagttatatcaaatgattaagagtttaaaggaccagtactttgcggaattgaatgatttgtacaataagatatccatgaagatacaacatattgacaaccacatgcctgctcaaaagtcagcagagcagtatgaaaagatgaagggctttaaactaatgttggagcgcacattgcatttcctgcaagttaacaagaacagcattcagccagcttttagggaaaaaatccctgtttacgagaggcaaattctcagtatcctaagttcacaaagaaggaagcctgtgcaggcacctggacagcaaatatttcagcaatctggtgggcaagctcctagctctaacatttcacagcaacatcagacttcccaaggtttgcagcagcatgatagtcatactaatcagatgcctcaagcaagtataccaagtatgaacacaggagtacagacctctggagcacctggcattcagcatgtacctgcgcctcaagcaacaaactttggtgttccaacaacacagcaaaatgtcacaaatgcaccgcaggctggttctaatctggagaatgctcagggaaatagttttaatcctgtgcagcatggttcaatgggtactgcgttgcaacagggaagcactggtcccatgcagggtgcattaaatgcacagcagcagtccagtagtaacatgatatccaacaatgcaatgagtacaatgcagactaataccaatgccatgcaagcaaatgcgaactcattgcagcagctaaagcagcaacatcaggagcatcagatgatgcaaagtcagcaaatgaagcagcgtcagcagatgatgcatcagatacagcaaaagcaaatgcttcaacagcagctcccaatacagcaactacagaaacaacagcagcaagggcagatgccggttccacagcttcattctggaaatgatgtgaatgagctaaaggttaggcaaggagctgcaatcaaatctggaatgtatcaacagctgagccagcgtaactattatcatcagcagataaaacagggtggtgtctttccaatttcttctccgcaaaaccttcaagcatcgtccccacaaatttcacaccattctcctcaggttgatcagcacagtctgttgcaatctcaagtgaagaccgggacaccattgcattcagctaactcaccatttgtcccatctccatcccctcctgttgccccatcaccgatgccagtggattcagataaaccactctccaacttatcttcgctcactagtgcggggcaagcacatcagcaaacatcccttgcacctcagacacaatctatagccgttaacacaccaggtatatcagcgtcacccttgcttgcagaattcacaagtgctgatggaagtcaggttaacctaccaactcaagttccaaccaaatcagcagcagaaaggcctctggatcgcttgcttaaattgcgaacaacacagcgcgagtcccttagtgctgctgttagcgatattggatctgtcgtgagtatgattgacaggattgctggatcagcgcctggtaatggttctagagctgctgtgggtgaagatcttgtcgctatgacaaagtgccgcttgcaagcccggaacttcataactcatgacgggagtggtgcatcaaagaaaatgaaacgggacactagtgctatgcctcttaatgtgtcatcggctggaagcgtgaatgatagcttgaagcaatcatatactgttggcactccagagctacaatcaactgcaacgtcacgtgtcaagtggcaaagggctgaggtaaaccatgctctgatggaggagattcaggagataaaccagcagcttatagatacagagctccatgtctctgaggatgatgccgagtccttcactgcatctgaggggggtgaagggacagtcattagatgcacattcactgctgttgctgttagccccagcttgaaatccatgtttgcttcagcgcagatgagtccgattttgccgttgaggctgcttgttcctgctagctacccaaaatgctctccggtgctcctagacaagtttcctgatgaacaatgcaggaactcagacgacctgtctacgaaggccaagtcaaagttcagtgtgttgctccggggtctagcagagcccatgtcactgcgagaaatcgcaagaacatgggatgcttgcgcccgcaaagtgatcgcagagtatgcccagcaaactggaggaggcagtttcagctcgagctatggttgctgggaaagctgcgtaggcgcttcataa

SEQ ID NO: 1240 - protein, 1313 aa, Sorghum bicolor
  misc_feature: Ceres ANNOT ID no. 6014737
  misc_feature (60)..(1313): NCBI GI: 24461867 NCBI Desc: ctv.22 [poncirus trifoliata]
  misc_feature (141)..(1313): NCBI GI: 8927657 NCBI Desc: est gbn38213 comes from this gene. [arabidopsis thaliana]
  misc_feature (110)..(926): NCBI GI: 23480318 NCBI Desc: drosophila melanogaster cg8797 gene product-related [plasmodium yoelii yoelii]
  misc_feature (72)..(915): NCBI GI: 28828998 NCBI Desc: similar to dictyostelium discoideum (slime mold). adenylyl cyclase
  misc_feature (146)..(1003): NCBI GI: 56311470 NCBI Desc: cg32133-pa [drosophila melanogaster]
  misc_feature: Up-regulated in shoot tissues in response to methyl jasmonate treatment
  misc_feature: Up-regulated in root tissues in response to methyl jasmonate treatment
MDGGANWRPTQGADPAAVAAAGGVDPNAAAPAGSDWRTQLQPEARHRIVNKIMETLKKHLPVSVPEGLTELHKIAVRFEEKIYTAATSQSDYLRKISLKMLSMESQTKTQQNAGSAQVIPNQNPPGPAPGLPPQGSNPAQSSAIPLMSQQQTRQPNASTSVQGSLPSQTSTLQNLSGLPQNTMNNGLAQGTPQDMYAAQRQMAGRQQQQQQQQQAHNQLIYQQQKLLMSQKLQQNSLMQPHIQQQQTLLQSTQMQSSQQSMMQMSSGLQPGQTTIPQTQSMAMQSATQSGIQQNPLNSVQQSVQSLLQQPTQSVVRQQQHPQSMHQQPSLQQTQPTQQPNIPLQQQPQQLMGQQSNLQQNQLMNQQSGAVEMQQQQRLPVQSNNLLNMQQTQQMMNQQSMPLHQPQQLANQGNMSSLHQQQQQNQQQQQQQLLGTAPNVRMHMLQQQKPIQQPQQQQHAQQTSMGLMQPQSQQNQLQQPQQHMMSQFQSQPNQVQQQLGMQQRLQTSAGMLLQQNNIDQQKQYVQAQRGLQEAPSTSVDSTAQTGHPGGDLQEELYQMIKSLKDQYFAELNDLYNKISMKIQHIDNHMPAQKSAEQYEKMKGFKLMLERTLHFLQVNKNSIQPAFREKIPVYERQILSILSSQRRKPVQAPGQQIFQQSGGQAPSSNISQQHQTSQGLQQHDSHTNQMPQASIPSMNTGVQTSGAPGIQHVPAPQATNFGVPTTQQNVTNAPQAGSNLENAQGNSFNPVQHGSMGTALQQGSTGPMQGALNAQQQSSSNMISNNAMSTMQTNTNAMQANANSLQQLKQQHQEHQMMQSQQMKQRQQMMHQIQQKQMLQQQLPIQQLQKQQQQGQMPVPQLHSGNDVNELKVRQGAAIKSGMYQQLSQRNYYHQQIKQGGVFPISSPQNLQASSPQISHHSPQVDQHSLLQSQVKTGTPLHSANSPFVPSPSPPVAPSPMPVDSDKPLSNLSSLTSAGQAHQQTSLAPQTQSIAVNTPGISASPLLAEFTSADGSQVNLPTQVPTKSAAERPLDRLLKLRTTQRESLSAAVSDIGSVVSMIDRIAGSAPGNGSRAAVGEDLVAMTKCRLQARNFITHDGSGASKKMKRDTSAMPLNVSSAGSVNDSLKQSYTVGTPELQSTATSRVKWQRAEVNHALMEEIQEINQQLIDTELHVSEDDAESFTASEGGEGTVIRCTFTAVAVSPSLKSMFASAQMSPILPLRLLVPASYPKCSPVLLDKFPDEQCRNSDDLSTKAKSKFSVLLRGLAEPMSLREIARTWDACARKVIAEYAQQTGGGSFSSSYGCWESCVGAS

SEQ ID NO: 1241 - DNA, 513 bp, Sorghum bicolor
  misc_feature: Ceres ANNOT ID no. 6014750
  misc_feature: Encodes the peptide sequence at SEQ ID NO 1242
atgccgccgccgcagtcgggcatggccctctgccgccttcccacggccaccgttggccttccgctttctctcccctgtttgctatctcggccccgcatgtccctcgccgcacgtcgcgccagggccgtcgccgccagggcctcctcctcctcctcctcctctccatcaccggactcttccttcggttcgcggatggaggattccgtcaagaagacggtggccgacaaccccgttgtcatctactccaagtcatggtgctcatattccatggaggtgaaggcgctcttcaagcggatcggtgtgcagccccacgtcatcgagctcgaccatctcggtgctcaaggaccacaactacaaaaggtattagagaggctgactggacagactactgttcctaatgttttcatcggtggaaagcatgttggtggctgtacagatactgtgaagctgtatcgcaagggggagctagctagcatgctatcggacttggatatcaacattaacaactcatga

SEQ ID NO: 1242 - protein, 170 aa, Sorghum bicolor
  misc_feature: Ceres ANNOT ID no. 6014750
  misc_feature (78)..(141): Pfam Id: Glutaredoxin Pfam Desc: Glutaredoxin
  misc_feature (3)..(170): NCBI GI: 122063508 NCBI Desc: monothiol glutaredoxin-s10 precursor
  misc_feature (4)..(170): NCBI GI: 45735917 NCBI Desc: glutaredoxin protein family-like [oryza sativa (japonica cultivar-group)]
  misc_feature (101)..(170): NCBI GI: 115477883 NCBI Desc: os08g0565800 [oryza sativa (japonica cultivar-group)]
  misc_feature (27)..(160): NCBI GI: 19548658 NCBI Desc: glutaredoxin [populus tremula x populus tremuloides]
  misc_feature (70)..(162): NCBI GI: 55584168 NCBI Desc: glutaredoxin
  misc_feature: The sequence is a functional homolog of SEQ ID NO. 382 in the 11/188,298 US application
MPPPQSGMALCRLPTATVGLPLSLPCLLSRPRMSLAARRARAVAARASSSSSSSPSPDSSFGSRMEDSVKKTVADNPVVIYSKSWCSYSMEVKALFKRIGVQPHVIELDHLGAQGPQLQKVLERLTGQTTVPNVFIGGKHVGGCTDTVKLYRKGELASMLSDLDININNS

SEQ ID NO: 1243 - DNA, 564 bp, Sorghum bicolor
  misc_feature: Ceres ANNOT ID no. 6014759
  misc_feature: Encodes the peptide sequence at SEQ ID NO 1244
atgtctgaggtggtggcgatggcggggcaagcctacatgaggcagctgcaggcgcacccgctgcgcaccaaggccatcacctccggcgtcctggccggctgcagcgacgccgtcgcccagaagatctccggcgtccccaagctccaactcaggaggctcctcctcatcgcgctatatggatttgcatacgctggaccctttggacatttcctccacaagctcatggataagtttttcaagggaaagaaaggaaaagaaactacagccaagaaggtcttagtagagcagctgaccgcgtctccatggaacaacatgatgtttatgatgtattttggtctcgtggttgaagggagaccatttggacaagtaaagaacaaggtgaagaaggattatgcatctgtccaactgacagcttggaggttctggccaattgtaagttggatcaactatgagtacatgccactccagctccgagttcttttccacagcttcgtcgcatcctgctgggctgtgtttttgaacctcaaggcagcaagatcaatcgcaaatactaagaaggcatag

SEQ ID NO: 1244 - protein, 187 aa, Sorghum bicolor
  misc_feature: Ceres ANNOT ID no. 6014759
  misc_feature (114)..(182): Pfam Id: Mpv17_PMP22 Pfam Desc: Mpv17 / PMP22 family
  misc_feature (10)..(181): NCBI GI: 27764998 NCBI Desc: at4g04470 [arabidopsis thaliana]
  misc_feature (11)..(180): NCBI GI: 116126802 NCBI Desc: ensangp00000012562 [anopheles gambiae str. pest]
  misc_feature (47)..(174): NCBI GI: 38454114 NCBI Desc: at3g24570 [arabidopsis thaliana]
  misc_feature (47)..(174): NCBI GI: 115435436 NCBI Desc: os01g0228300 [oryza sativa (japonica cultivar-group)]
  misc_feature (7)..(180): NCBI GI: 51858973 NCBI Desc: loc446961 protein [xenopus laevis]
MSEVVAMAGQAYMRQLQAHPLRTKAITSGVLAGCSDAVAQKISGVPKLQLRRLLLIALYGFAYAGPFGHFLHKLMDKFFKGKKGKETTAKKVLVEQLTASPWNNMMFMMYFGLVVEGRPFGQVKNKVKKDYASVQLTAWRFWPIVSWINYEYMPLQLRVLFHSFVASCWAVFLNLKAARSIANTKKA

SEQ ID NO: 1245 - DNA, 1002 bp, Sorghum bicolor
  misc_feature: Ceres ANNOT ID no. 6014788
  misc_feature: Encodes the peptide sequence at SEQ ID NO 1246
atggaccgggagggcctttacggaggccgcggcgacggcagcaggctcctggtggtccaagacctccatgagcggccgatggagtgcttctccgatgaggtcaacagccgaaacggctgcggcgacgacgaggaggaggaggaggggaatggcggaactggttctggttctggttcacggccgctgccggcgcccaacggggcaggaggaggaggaggcgacggaccggtgagcgtggagaccgggaagcggaggcgcgggcggccgccgggatccaagaacaagccgaagccgccgccggtggtgacgcgggacgtggagcccgcggcggccatgcgcccgcacgtgctcgagatccccagcggcggggacgtcgcgcgcgcgctcgcgggcttcgcgcgccgccggggtctcgggatctgcgtgctcgcggggaccggcgccgtcgccgacgtctcgctccgtcacccggcggcgtcgtcgtccgcggatggaggaggagggggtgctgccgctgccgccgccgcggtcgtcgtcttccgcggccggtacgagatcctctccatctcggccacgttcctggcgccgtccatgtccgcggcggtgccggcccgctccgccgtcagcagggacctctcgatatcgctcgccggcccgcacggacagatcgtcgggggcgctgtcgtgggccctctcgtcgccgccaccaccgtcgttgtcctggctgccgccttcaccgaccttaacttccaccgcctccccctcgaggatgacgcgtcagcagcgtccgtctccgggagtggggaggccggcgaacaccgtcaccgtgggcatcacgggcagcatcagcaacgggagcatcacgacgcgagcgggttgcacccgcagaccatggtggctccggcgacgactcagccggttcccttgtacgcgcgccagtcacaggagttgtggccgccggcggcggcaagtgcacagcgcccacgcccgccgtatcaatag

SEQ ID NO: 1246 - protein, 333 aa, Sorghum bicolor
  misc_feature: Ceres ANNOT ID no. 6014788
  misc_feature (3)..(333): NCBI GI: 42407866 NCBI Desc: dna-binding protein-like [oryza sativa (japonica cultivar-group)]
  misc_feature (1)..(331): NCBI GI: 50725207 NCBI Desc: dna-binding protein-like [oryza sativa (japonica cultivar-group)]
  misc_feature (40)..(332): NCBI GI: 119331588 NCBI Desc: at-hook dna-binding protein [catharanthus roseus]
  misc_feature (39)..(271): NCBI GI: 115474893 NCBI Desc: os08g0159700 [oryza sativa (japonica cultivar-group)]
  misc_feature (62)..(159): NCBI GI: 51091035 NCBI Desc: dna-binding protein-like [oryza sativa (japonica cultivar-group)]
  misc_feature: The sequence is a functional homolog of SEQ ID NO 10 in the 10/669,824US patent application
  misc_feature: The sequence is a functional homolog of SEQ ID NO 10 in the 10/870,198US patent application
  misc_feature: The sequence is a functional homolog of SEQ ID NO 1395 in the 10/374,780US patent application
  misc_feature: The sequence is a functional homolog of SEQ ID NO 1399 in the 10/374,780US patent application
  misc_feature: The sequence is a functional homolog of SEQ ID NO 1400 in the 10/374,780US patent application
  misc_feature: The sequence is a functional homolog of SEQ ID NO 1402 in the 10/374,780US patent application
  misc_feature: The sequence is a functional homolog of SEQ ID NO 1403 in the 10/374,780US patent application
  misc_feature: The sequence is a functional homolog of SEQ ID NO 1404 in the 10/374,780US patent application
  misc_feature: The sequence is a functional homolog of SEQ ID NO 1406 in the 10/374,780US patent application
  misc_feature: The sequence is a functional homolog of SEQ ID NO 1408 in the 10/374,780US patent application
  misc_feature: The sequence is a functional homolog of SEQ ID NO 1410 in the 10/374,780US patent application
  misc_feature: The sequence is a functional homolog of SEQ ID NO 1412 in the 10/374,780US patent application
  misc_feature: The sequence is a functional homolog of SEQ ID NO 150 in the 10/412,699US patent application
  misc_feature: The sequence is a functional homolog of SEQ ID NO 1507 in the 10/412,699US patent application
  misc_feature: The sequence is a functional homolog of SEQ ID NO 1509 in the 10/412,699US patent application
  misc_feature: The sequence is a functional homolog of SEQ ID NO 1510 in the 10/412,699US patent application
  misc_feature: The sequence is a functional homolog of SEQ ID NO 22 in the 10/669,824US patent application
  misc_feature: The sequence is a functional homolog of SEQ ID NO 22 in the 10/870,198US patent application
  misc_feature: The sequence is a functional homolog of SEQ ID NO 2528 in the 10/374,780US patent application
  misc_feature: The sequence is a functional homolog of SEQ ID NO 256 in the 10/225,066US patent application
  misc_feature: The sequence is a functional homolog of SEQ ID NO 26 in the 10/669,824US patent application
  misc_feature: The sequence is a functional homolog of SEQ ID NO 26 in the 10/870,198US patent application
  misc_feature: The sequence is a functional homolog of SEQ ID NO 28 in the 10/669,824US patent application
  misc_feature: The sequence is a functional homolog of SEQ ID NO 28 in the 10/870,198US patent application
  misc_feature: The sequence is a functional homolog of SEQ ID NO 298 in the 11/435,388US patent application
  misc_feature: The sequence is a functional homolog of SEQ ID NO 300 in the 10/714,887US patent application
  misc_feature: The sequence is a functional homolog of SEQ ID NO 32 in the 10/669,824US patent application
  misc_feature: The sequence is a functional homolog of SEQ ID NO 32 in the 10/870,198US patent application
  misc_feature: The sequence is a functional homolog of SEQ ID NO 322 in the 11/435,388US patent application
  misc_feature: The sequence is a functional homolog of SEQ ID NO 324 in the 10/714,887US patent application
  misc_feature: The sequence is a functional homolog of SEQ ID NO 340 in the 11/435,388US patent application
  misc_feature: The sequence is a functional homolog of SEQ ID NO 342 in the 10/714,887US patent application
  misc_feature: The sequence is a functional homolog of SEQ ID NO 344 in the 11/435,388US patent application
  misc_feature: The sequence is a functional homolog of SEQ ID NO 346 in the 10/714,887US patent application
  misc_feature: The sequence is a functional homolog of SEQ ID NO 346 in the 11/435,388US patent application
  misc_feature: The sequence is a functional homolog of SEQ ID NO 348 in the 10/714,887US patent application
  misc_feature: The sequence is a functional homolog of SEQ ID NO 348 in the 11/435,388US patent application
  misc_feature: The sequence is a functional homolog of SEQ ID NO 350 in the 10/714,887US patent application
  misc_feature: The sequence is a functional homolog of SEQ ID NO 350 in the 11/435,388US patent application
  misc_feature: The sequence is a functional homolog of SEQ ID NO 352 in the 10/714,887US patent application
  misc_feature: The sequence is a functional homolog of SEQ ID NO 352 in the 11/435,388US patent application
  misc_feature: The sequence is a functional homolog of SEQ ID NO 354 in the 10/714,887US patent application
  misc_feature: The sequence is a functional homolog of SEQ ID NO 38 in the 10/669,824US patent application
  misc_feature: The sequence is a functional homolog of SEQ ID NO 38 in the 10/870,198US patent application
  misc_feature: The sequence is a functional homolog of SEQ ID NO 48 in the 10/669,824US patent application
  misc_feature: The sequence is a functional homolog of SEQ ID NO 48 in the 10/870,198US patent application
  misc_feature: The sequence is a functional homolog of SEQ ID NO 50 in the 10/669,824US patent application
  misc_feature: The sequence is a functional homolog of SEQ ID NO 50 in the 10/870,198US patent application
  misc_feature: The sequence is a functional homolog of SEQ ID NO 64 in the 10/669,824US patent application
  misc_feature: The sequence is a functional homolog of SEQ ID NO 64 in the 10/870,198US patent application
  misc_feature: The sequence is a functional homolog of SEQ ID NO 830 in the 11/435,388US patent application
  misc_feature: The sequence is a functional homolog of SEQ ID NO 90 in the 10/669,824US patent application
  misc_feature: Useful for making plants with modulated growth and phenotype characteristics
  misc_feature: The sequence is a functional homolog of SEQ ID NO 150 in the 20040045049 US patent application
  misc_feature: The sequence is a functional homolog of SEQ ID NO 1507 in the 20040045049 US patent application
  misc_feature: The sequence is a functional homolog of SEQ ID NO 1509 in the 20040045049 US patent application
  misc_feature: The sequence is a functional homolog of SEQ ID NO 1510 in the 20040045049 US patent application
  misc_feature: The sequence is a functional homolog of SEQ ID NO 26 in the 20040128712 US patent application
  misc_feature: The sequence is a functional homolog of SEQ ID NO 28 in the 20040128712 US patent application
  misc_feature: The sequence is a functional homolog of SEQ ID NO 32 in the 20040128712 US patent application
  misc_feature: The sequence is a functional homolog of SEQ ID NO 38 in the 20040128712 US patent application
  misc_feature: The sequence is a functional homolog of SEQ ID NO 48 in the 20040128712 US patent application
  misc_feature: The sequence is a functional homolog of SEQ ID NO 50 in the 20040128712 US patent application
  misc_feature: The sequence is a functional homolog of SEQ ID NO 64 in the 20040128712 US patent application
  misc_feature: The sequence is a functional homolog of SEQ ID NO 90 in the 20040128712 US patent application
  misc_feature: The sequence is a functional homolog of SEQ ID NO 1412 in the 20060162006 US patent application
MDREGLYGGRGDGSRLLVVQDLHERPMECFSDEVNSRNGCGDDEEEEEGNGGTGSGSGSRPLPAPNGAGGGGGDGPVSVETGKRRRGRPPGSKNKPKPPPVVTRDVEPAAAMRPHVLEIPSGGDVARALAGFARRRGLGICVLAGTGAVADVSLRHPAASSSADGGGGGAAAAAAAVVVFRGRYEILSISATFLAPSMSAAVPARSAVSRDLSISLAGPHGQIVGGAVVGPLVAATTVVVLAAAFTDLNFHRLPLEDDASAASVSGSGEAGEHRHRGHHGQHQQREHHDASGLHPQTMVAPATTQPVPLYARQSQELWPPAAASAQRPRPPYQ

SEQ ID NO: 1247 - DNA, 492 bp, Sorghum bicolor
  misc_feature: Ceres ANNOT ID no. 6014791
  misc_feature: Encodes the peptide sequence at SEQ ID NO 1248
atggctcgtagcggacctggttgccgtcttctcgtcctgctcctagccataactgccttcaatggcagctttgcagctcgacatcttttggagacagcagctgcgccagaggccacacctgctcagccatccattccagcggttccaaccaaacagcctccagtgccttccataccagcagttccaaccacgctgacgctgcctccaatgccttccattccagcggtcccgaagatgacaatcccaactattcctatcccaaagttagctctgccaccaacagctgctggcgcaatcccatctctcccaaacccggtgattccaaccaccataccagctattcctaaagtaccggttaccctgccaccaatatcctcaatccccactactgtgccatccattccaactacgattccaacaacaatcccaaccattcccggactccaggtgcctccactcaccgccccatccccacaaaccaccaacccttga

SEQ ID NO: 1248 - protein, 163 aa, Sorghum bicolor
  misc_feature: Ceres ANNOT ID no. 6014791
  misc_feature (4)..(163): NCBI GI: 34393335 NCBI Desc: early nodulin 75 precursor-like protein [oryza sativa (japonica cultivar-group)]
  misc_feature (4)..(158): NCBI GI: 24059939 NCBI Desc: early nodulin 75 precursor-like protein [oryza sativa (japonica cultivar-group)]
  misc_feature (10)..(158): NCBI GI: 24059937 NCBI Desc: proline-rich protein-like [oryza sativa (japonica cultivar-group)]
  misc_feature (13)..(158): NCBI GI: 115455727 NCBI Desc: os03g0782400 [oryza sativa (japonica cultivar-group)]
  misc_feature (1)..(158): NCBI GI: 115459480 NCBI Desc: os04g0521900 [oryza sativa (japonica cultivar-group)]
  misc_feature: Useful for making plants with modulated heat sensitivity
  misc_feature: Functional homolog of the protein sequence given in SEQ ID NO 13091
MARSGPGCRLLVLLLAITAFNGSFAARHLLETAAAPEATPAQPSIPAVPTKQPPVPSIPAVPTTLTLPPMPSIPAVPKMTIPTIPIPKLALPPTAAGAIPSLPNPVIPTTIPAIPKVPVTLPPISSIPTTVPSIPTTIPTTIPTIPGLQVPPLTAPSPQTTNP

SEQ ID NO: 1249 - DNA, 501 bp, Sorghum bicolor
  misc_feature: Ceres ANNOT ID no. 6014795
  misc_feature: Encodes the peptide sequence at SEQ ID NO 1250
atggctcgtagcggacctggttgccgtcttctcgtcctgctcctatccctggctgccttcaatggcagctttgcagctcgacatcttttggacacagccgctgcgccagaggccgcacctgctcagccgtccattccaatgattccaaccaaattgcctccagtgccttccataccagctgttccaaccacgctgacgctgccaccaatgccttccattccggcggtcccgaagacagcagtcccaccaattccgtccattcctattccaaagttagccctgccaccaacagctgctggcgcaatcccctctctcccaaacccggtgattccaaccaccgtaccagctattcctaaagtccaggttaccctgccaccaatgccgtcgatccccactactgtgccatcaattccaactacgattccaacaacaatcccaaccattcccggactccaggtgcctccactcactgccccatccccacaaaccaccagcccttga

SEQ ID NO: 1250 - protein, 166 aa, Sorghum bicolor
  misc_feature: Ceres ANNOT ID no. 6014795
  misc_feature (4)..(166): NCBI GI: 34393335 NCBI Desc: early nodulin 75 precursor-like protein [oryza sativa (japonica cultivar-group)]
  misc_feature (4)..(161): NCBI GI: 24059939 NCBI Desc: early nodulin 75 precursor-like protein [oryza sativa (japonica cultivar-group)]
  misc_feature (13)..(161): NCBI GI: 115455727 NCBI Desc: os03g0782400 [oryza sativa (japonica cultivar-group)]
  misc_feature (10)..(166): NCBI GI: 24059937 NCBI Desc: proline-rich protein-like [oryza sativa (japonica cultivar-group)]
  misc_feature (10)..(142): NCBI GI: 115470547 NCBI Desc: os07g0142600 [oryza sativa (japonica cultivar-group)]
MARSGPGCRLLVLLLSLAAFNGSFAARHLLDTAAAPEAAPAQPSIPMIPTKLPPVPSIPAVPTTLTLPPMPSIPAVPKTAVPPIPSIPIPKLALPPTAAGAIPSLPNPVIPTTVPAIPKVQVTLPPMPSIPTTVPSIPTTIPTTIPTIPGLQVPPLTAPSPQTTSP

SEQ ID NO: 1251 - DNA, 1314 bp, Sorghum bicolor
  misc_feature: Ceres ANNOT ID no. 6014816
  misc_feature: Encodes the peptide sequence at SEQ ID NO 1252
atggcgccggtgtatgctggggagctcgccggcaccagcggctccggctccggcctgacgctgaacccggtggcgcggcgggcgctcagccgcggcgcgtcgacgtcgacgctgggcacgcccaagtcgcctccgccggcctacgggagcatcgtcaccgtgctgagcatcgacggcggtggcgtgcgcgggatcatcccgggcaccatcctcggcttcctcgaggaaaagctgcaggagctcgacgggccggacgcgaggctggcggactacttcgacgtgatcgccgggaccagcaccggcgggctggtgacggccatgctcacggcgccgaacaaggacggccgtccgctctttgctgccaaggacatcaacgacttctacctcgagcactgccccaagatcttcccatccggcagcggcggtcctctggggttgttcaagagcatggcagggcccaagtacgacggcaagtacctccactccatcgtccgggagctcctcggcgagacgagggtcagccaggcgctccagaacatcgtcatccccaccttcgacatcaaactcctccagcccactgtcttctccagatacgatgccatgagcgatgtctccaaggacgctctgctctccgacgtctgcatcagcacgtccgccgcgccgacctaccttccaggccaccagttccagacgacagacaaggacggcaagccccgggccttcaacctcatcgacggtggcgtcgccgcaaacaatccgacgctgctggcgatgacgcacgtgagcaagcagatcctgctgggaaaccaggacttcttcccgatcaagccagcggactacggcaagttcttggtgctgtcgctgggcacgggctccgccaaggtggaggagaagttcgacgccgtggagagcagcaggtggggaatcctggggtggctctacaacaagggagccacgccgatcatcgacagcttcagccaggccagctccgacctcgtcgacatccacgcctccgtgctcttccaggcgctgcactgcagcagcaagagctacctccggatccaggacgacgagctcaagggcgagacggcgtccgtcgacgtgtccaccagggagaacctgaaccgcctcgtcggcgtcggcaaggcgctgctgaagaagccggcgtgcaaggtgaacattgagactggcaggaacgagccggatggacataggggcaccaatgaggaggagctcgtccatttcgctcagatgctggtagatgagcgacgtgcgaggcttcagaagaagggcaacagcacagtactggtgtaa

SEQ ID NO: 1252 - protein, 437 aa, Sorghum bicolor
  misc_feature: Ceres ANNOT ID no. 6014816
  misc_feature (55)..(258): Pfam Id: Patatin Pfam Desc: Patatin-like phospholipase
  misc_feature (45)..(426): NCBI GI: 9794868 NCBI Desc: patatin-like protein 1 [nicotiana tabacum]
  misc_feature (40)..(426): NCBI GI: 62766606 NCBI Desc: patatin-like protein [gossypium hirsutum]
  misc_feature (24)..(427): NCBI GI: 9794870 NCBI Desc: patatin-like protein 3 [nicotiana tabacum]
  misc_feature (38)..(426): NCBI GI: 21554076 NCBI Desc: similar to latex allergen from hevea brasiliensis [arabidopsis thaliana]
  misc_feature (34)..(426): NCBI GI: 4539677 NCBI Desc: patatin-like protein [sorghum bicolor]
  misc_feature: Useful for making plants with modulated heat sensitivity
  misc_feature: Functional homolog of the protein sequence given in SEQ ID NO 13256
  misc_feature: Useful for making plants with modulated heat sensitivity
  misc_feature: Functional homolog of the protein sequence given in SEQ ID NO 13256
MAPVYAGELAGTSGSGSGLTLNPVARRALSRGASTSTLGTPKSPPPAYGSIVTVLSIDGGGVRGIIPGTILGFLEEKLQELDGPDARLADYFDVIAGTSTGGLVTAMLTAPNKDGRPLFAAKDINDFYLEHCPKIFPSGSGGPLGLFKSMAGPKYDGKYLHSIVRELLGETRVSQALQNIVIPTFDIKLLQPTVFSRYDAMSDVSKDALLSDVCISTSAAPTYLPGHQFQTTDKDGKPRAFNLIDGGVAANNPTLLAMTHVSKQILLGNQDFFPIKPADYGKFLVLSLGTGSAKVEEKFDAVESSRWGILGWLYNKGATPIIDSFSQASSDLVDIHASVLFQALHCSSKSYLRIQDDELKGETASVDVSTRENLNRLVGVGKALLKKPACKVNIETGRNEPDGHRGTNEEELVHFAQMLVDERRARLQKKGNSTVLV

SEQ ID NO: 1253 - DNA, 807 bp, Sorghum bicolor
  misc_feature: Ceres ANNOT ID no. 6014817
  misc_feature: Encodes the peptide sequence at SEQ ID NO 1254
atgccatctcttatcgattacagcccggccgcgctgaggtcgctgctccggccgtccagcgatgagcgtcgggcgaagctgtctggggcggcggcgggggcaggggccggggccggggccggcggcgtcttggggctcttcaagatgttcaagctcctgcccgtgctcaccacgggctgcaagatggcggcgatgctggggcggcacaacaaccaccgggccctcctggccgaccacgcgccgacggtgacgctgttcgggcaccggcgcgggcggctgagcctggccatccacgaggacacgcggtccccgccggcgttcctcatcgagctgcccatgctggcgcccgcgctgcaccgcgagatggccacgggcaccgtgcgcctggcgctcgagagcgacacccgcggcgtcgccgtcgcatcaaggcggcggcgcccgctgctggaggagtatgtgtgggcggtctactgcaacgggcgcagcgccggctacgccatccgccggaaggacgcgtccgacgacgagcgccacgtcctgcgcctgctccgcggcgtgtccatgggcgccggggtgctgccgccgccgcccgacgagaggagggcgggagcggcagcacgcgccacgcctggcgcttgcggcgatggcgagctcacctacatgcgcgcccgcgtcgaacgcgtcgtcgggtccaaggactctgaggcgttctacatgatcaaccccgacgatggcagcgccaacgccgccgcccgtggcggcgactgcgcgccggagctgagcgttttctttgtgaggaacaagtga

SEQ ID NO: 1254 - protein, 268 aa, Sorghum bicolor
  misc_feature: Ceres ANNOT ID no. 6014817
  misc_feature (63)..(266): NCBI GI: 115465611 NCBI Desc: os05g0577100 [oryza sativa (japonica cultivar-group)]
  misc_feature (63)..(266): NCBI GI: 115438821 NCBI Desc: os01g0642600 [oryza sativa (japonica cultivar-group)]
  misc_feature (106)..(266): NCBI GI: 115448223 NCBI Desc: os02g0709600 [oryza sativa (japonica cultivar-group)]
  misc_feature (82)..(266): NCBI GI: 21741231 NCBI Desc: osjnbb0034i13.25 [oryza sativa (japonica cultivar-group)]
MPSLIDYSPAALRSLLRPSSDERRAKLSGAAAGAGAGAGAGGVLGLFKMFKLLPVLTTGCKMAAMLGRHNNHRALLADHAPTVTLFGHRRGRLSLAIHEDTRSPPAFLIELPMLAPALHREMATGTVRLALESDTRGVAVASRRRRPLLEEYVWAVYCNGRSAGYAIRRKDASDDERHVLRLLRGVSMGAGVLPPPPDERRAGAAARATPGACGDGELTYMRARVERVVGSKDSEAFYMINPDDGSANAAARGGDCAPELSVFFVRNK

SEQ ID NO: 1255 - DNA, 783 bp, Sorghum bicolor
  misc_feature: Ceres ANNOT ID no. 6014819
  misc_feature: Encodes the peptide sequence at SEQ ID NO 1256
atgctgaggtcagtgtccggctccaactcctcgaggggcatcgccgccgtggtcggcgtcgggccccggctcggctccgcggtggcgcgcaagttcgcctccgagggctacaccatcgccatcctctcccgcgacctcgagaagctgtcgcagctggcggaggagatcgcgcaggaggccaaggcgcaggtgttcgcgctgcgggtggactgcgccgacgcccgctccgtgcgcgaggccttcgagggcgtcctctccctcggccccgtcgaggtgctcgtctacaacgcctgcgagccgccggcggccaacggcgacgacgccgcggccgcgcgacccacgcccttcctcgccgtcacccccgacgctttccaccgcgctctcgccgtctccgccggaggggccttccactgcgcgcaacaggtcatcccgggcatggtggagaggggcaggggcaccatcatcttcacgggctcctcggcgtcggtcaccggcttcgccggctactccgatctaagctgcggcaagtttgcgctccgggggttgtcccagtcgctggccagggagttccagccggccggcgtgcacattgcgcatgtgatcatcgacggcgtcatcggcgagaggaggtcgccgacgccgaggagcagcagggtcggcagcgccggcgacgcggcgggcgcggacccggacgcggtggcgcagagctactggcacgtccacgcccaggacaagagcgcgtggacgcacgagatggacatccggtcgccgtccttcatgtag

SEQ ID NO: 1256 - protein, 260 aa, Sorghum bicolor
  misc_feature: Ceres ANNOT ID no. 6014819
  misc_feature (13)..(191): Pfam Id: adh_short Pfam Desc: short chain dehydrogenase
  misc_feature (1)..(260): NCBI GI: 42408058 NCBI Desc: short-chain dehydrogenase/reductase family protein-like [oryza sativa (japonica cultivar-group)]
  misc_feature (1)..(259): NCBI GI: 21928097 NCBI Desc: at3g50560/t20e23_160 [arabidopsis thaliana]
  misc_feature (13)..(258): NCBI GI: 108805798 NCBI Desc: short-chain dehydrogenase/reductase sdr [rubrobacter xylanophilus dsm 9941]
  misc_feature (14)..(258): NCBI GI: 119486458 NCBI Desc: short-chain dehydrogenase/reductase sdr [lyngbya sp. pcc 8106]
  misc_feature (1)..(255): NCBI GI: 113936030 NCBI Desc: short-chain dehydrogenase/reductase sdr [caulobacter sp. k31]
  misc_feature: The sequence is a functional homolog of SEQ ID NO. 389 in the 11/188,298 US application
MLRSVSGSNSSRGIAAVVGVGPRLGSAVARKFASEGYTIAILSRDLEKLSQLAEEIAQEAKAQVFALRVDCADARSVREAFEGVLSLGPVEVLVYNACEPPAANGDDAAAARPTPFLAVTPDAFHRALAVSAGGAFHCAQQVIPGMVERGRGTIIFTGSSASVTGFAGYSDLSCGKFALRGLSQSLAREFQPAGVHIAHVIIDGVIGERRSPTPRSSRVGSAGDAAGADPDAVAQSYWHVHAQDKSAWTHEMDIRSPSFM

SEQ ID NO: 1257 - DNA, 1068 bp, Sorghum bicolor
  misc_feature: Ceres ANNOT ID no. 6014835
  misc_feature: Encodes the peptide sequence at SEQ ID NO 1258
atggccgaaaacgagagcagcggagtgcgggtgtgcgtcaccggaggcgccgggttcatcggctcctggctcgtcaagaagctcctcgagaaaggctacaccgtccacgccaccctgcggaacaccggagacgaggagaaggcagggctgctgcggcggctggtccccggcgcggcggagcggctgcggctgttcgacgctgacctcttcgacgccgccaccttcgcgccggcgatcgctggttgccagttcgtcttcctcgtcgccacaccattcgggctccaagacgccggctccaagtataagagcacggcggaagctgtagtggacgcggtgcgcgcgatcctccggcagtgcgaggagtccaggacggtgaagcgagtgatccacaccgcctccgtatcggccgcttcgccgctgaaggaggaggaggtctccggcgtcatcgggtacagagagttcatcagcgaatcttgttggacttcgcccgacgttgactatcctctccgaagcgcacacttcgataagtacatactgtccaaggtgcagtcagagcaggaactcctgagctacaacggcggcgagagtccggcgttcgaggtggtgaccttggccctgggcctcgtcgccggcgacacggtccttggccgcgtcccggagacggtggagagcgccgtgtcgcccgtgtcccggaacgaggcctacttcgggctcccgcgcatcctgcagcagctcctggggtcgctgccgctggtgcacgtcgacgacgtctgcgacgcgctcatcttctgcatggagcgccgccactccatcgccggccgattcctctgcgccgccgcgtacccgaccatccacgacgtggttggccactacgccaggaagttccctcacctcgacatcttgaaagagacggaggcggtggcgagggtgcagcctgacggggacaggttgggcgagctgggtttcgtgtacaagtacggcatcgaagagattcttgatagcagcgttgcctgtgcggcgagattaggttgtcttgatgcaaccaagctcagcatgcagaaaggataa

SEQ ID NO: 1258 - protein, 355 aa, Sorghum bicolor
  misc_feature: Ceres ANNOT ID no. 6014835
  misc_feature (11)..(278): Pfam Id: Epimerase Pfam Desc: NAD dependent epimerase/dehydratase family
  misc_feature (13)..(261): Pfam Id: NAD_binding_4 Pfam Desc: Male sterility protein
  misc_feature (12)..(267): Pfam Id: 3Beta_HSD Pfam Desc: 3-beta hydroxysteroid dehydrogenase/isomerase family
  misc_feature (1)..(354): NCBI GI: 2911362 NCBI Desc: nadph hc toxin reductase [zea mays]
  misc_feature (1)..(354): NCBI GI: 2911360 NCBI Desc: nadph hc toxin reductase [zea mays]
  misc_feature (1)..(355): NCBI GI: 2911364 NCBI Desc: nadph hc toxin reductase [zea mays]
  misc_feature (1)..(355): NCBI GI: 2911358 NCBI Desc: nadph hc toxin reductase [zea mays]
  misc_feature (1)..(355): NCBI GI: 168643 NCBI Desc: nadph hc-toxin reductase
MAENESSGVRVCVTGGAGFIGSWLVKKLLEKGYTVHATLRNTGDEEKAGLLRRLVPGAAERLRLFDADLFDAATFAPAIAGCQFVFLVATPFGLQDAGSKYKSTAEAVVDAVRAILRQCEESRTVKRVIHTASVSAASPLKEEEVSGVIGYREFISESCWTSPDVDYPLRSAHFDKYILSKVQSEQELLSYNGGESPAFEVVTLALGLVAGDTVLGRVPETVESAVSPVSRNEAYFGLPRILQQLLGSLPLVHVDDVCDALIFCMERRHSIAGRFLCAAAYPTIHDVVGHYARKFPHLDILKETEAVARVQPDGDRLGELGFVYKYGIEEILDSSVACAARLGCLDATKLSMQKG

SEQ ID NO: 1259 - DNA, 1062 bp, Sorghum bicolor
  misc_feature: Ceres ANNOT ID no. 6014841
  misc_feature: Encodes the peptide sequence at SEQ ID NO 1260
atggatccagacaacgaggtggactacgacatgtcgccgtacctcatccgctacaagagcggccgcgtgcaccacctcatgggcacaggcagggtcgacgccggcacggacgccgccaccggcgtcacctccagggacgttgttatcgacgtcggcactggcctcgccgcgcgtctccacattcccagcgacgtcctcggtacatccacgaagctgcccgtcctcgtctacttccacggcggcgcctttgccgtgaactcggccttctccacgcagtacttccgcttcctgaacgcgctcgtgtcagcggcccgcgccgtggccgtgtccgtcgacttccgcctcgcgcccgagcacccgctgcccgccgcctacgacgacgcctgggccgcgctcggctgggccgtggcgaccgccagctgcgcccgagcgtcgtccgagcaggagccgtgggcgtggctggccgagcacggcgatcccgcgcgcctcttcgtcgcgggcgacagcaccggcggcaacatcgcgcacaacgtggcgatgagggcaggcaggaggagcggtctgcccggcggcgagcggatcgaagggatggtgctcctgcacccgtacttctgcggcaaggagctcgtggcgccgtccgagggcgcggagccccgccgccgccggtcgttggagacggaggagcggtggtgggcgttcgtgtgcgcggagagatacgggatcgaccacccgttcatcaatccggtggcgatgccagcgacggagtgggtgtcgctcggctgccggcgagccatggtgaccgtggccgagctggacaggatgcgggacagaggccggaggtacgtggaggcactgagagccagcacgtgggcaggagacgaggccgtgctgtacgaggatcaaggcgagaggcacgtcttcttcctcagtagttccgacgatagcggcaagacgaagcagatgatagcagccattgcgtccttcatggcgtcgtcaaatgcccaagctctgttattaggtccatcgtccgagcgatctttgggttgtgatgctaagctttag

SEQ ID NO: 1260 - protein, 353 aa, Sorghum bicolor
  misc_feature: Ceres ANNOT ID no. 6014841
  misc_feature (75)..(309): Pfam Id: Abhydrolase_3 Pfam Desc: alpha/beta hydrolase fold
  misc_feature (1)..(334): NCBI GI: 115476872 NCBI Desc: os08g0475000 [oryza sativa (japonica cultivar-group)]
  misc_feature (6)..(326): NCBI GI: 115476870 NCBI Desc: os08g0474800 [oryza sativa (japonica cultivar-group)]
  misc_feature (5)..(329): NCBI GI: 115479607 NCBI Desc: os09g0461900 [oryza sativa (japonica cultivar-group)]
  misc_feature (5)..(343): NCBI GI: 115472471 NCBI Desc: os07g0527600 [oryza sativa (japonica cultivar-group)]
  misc_feature (6)..(337): NCBI GI: 82697977 NCBI Desc: cxe carboxylesterase [actinidia eriantha]
MDPDNEVDYDMSPYLIRYKSGRVHHLMGTGRVDAGTDAATGVTSRDVVIDVGTGLAARLHIPSDVLGTSTKLPVLVYFHGGAFAVNSAFSTQYFRFLNALVSAARAVAVSVDFRLAPEHPLPAAYDDAWAALGWAVATASCARASSEQEPWAWLAEHGDPARLFVAGDSTGGNIAHNVAMRAGRRSGLPGGERIEGMVLLHPYFCGKELVAPSEGAEPRRRRSLETEERWWAFVCAERYGIDHPFINPVAMPATEWVSLGCRRAMVTVAELDRMRDRGRRYVEALRASTWAGDEAVLYEDQGERHVFFLSSSDDSGKTKQMIAAIASFMASSNAQALLLGPSSERSLGCDAKL

SEQ ID NO: 1261 - DNA, 852 bp, Sorghum bicolor
  misc_feature: Ceres ANNOT ID no. 6014845
  misc_feature: Encodes the peptide sequence at SEQ ID NO 1262
atggccagcgctgtctgcggcgtcaccgcgcgcccgcacctgccttccgccgtccctgcagccgcaagaaagctcttcttccgctgcagggccgcctccaccatgaacgaggcatcggcgagctcgccagacgccgaggagaagaagacgacgaccgtcttcgtggccggctcgacggggcgcaccggcaagcgcgtcgtggagaagctgctggccaagggattcggcgtcgtcgccggcacgacggacgtgagcagggcccgcggcagcctgccccaggaccccaaccttcagctcgtcagggctgacgttacggagggcgtcgacaagctggtggaggcggtgcgcggcgtcgatgctgtcgtctgcgcgacgggattccggcggtcctttgacccctttgctccgtggaaggtagacaactttggcacagtgaacctggttgaagcatgccgaaaggcaggcgtaacaagatttgtactcgtcagctccattttagtaaatggggccgctatgggtcaatttctgaatccagcctacattgtgctcaatctacttggcttaacactggttgcaaagctacaggcagagaatcacatcaggaaatcaggaataaactacactattgtaaggcctggagggctgacagatcaacccccaacagggaatatagtcatggaacctgaggacactctttattcaggatccatatctcggagccaggtagctgaagtagctgtagaagcattgttgtgtccagagtcttcctacaaagttgttgagattatcgcccgaactgatgctccaaatcgccctctgaaggatatgtatgctgcaattaagcaaaattga

SEQ ID NO: 1262 - protein, 283 aa, Sorghum bicolor
  misc_feature: Ceres ANNOT ID no. 6014845
  misc_feature (53)..(277): Pfam Id: NmrA Pfam Desc: NmrA-like family
  misc_feature (53)..(263): Pfam Id: Epimerase Pfam Desc: NAD dependent epimerase/dehydratase family
  misc_feature (36)..(282): NCBI GI: 92868314 NCBI Desc: nad-dependent epimerase/dehydratase [medicago truncatula]
  misc_feature (54)..(280): NCBI GI: 119512098 NCBI Desc: 3-beta hydroxysteroid dehydrogenase/isomerase [nodularia spumigena ccy9414]
  misc_feature (54)..(277): NCBI GI: 75910514 NCBI Desc: 3-beta hydroxysteroid dehydrogenase/isomerase [anabaena variabilis atcc 29413]
  misc_feature (54)..(278): NCBI GI: 86605827 NCBI Desc: 3-beta hydroxysteroid dehydrogenase/isomerase family protein [cyanobacteria bacterium yellowstone a-prime]
  misc_feature (54)..(278): NCBI GI: 86608008 NCBI Desc: 3-beta hydroxysteroid dehydrogenase/isomerase family protein [cyanobacteria bacterium yellowstone b-prime]
MASAVCGVTARPHLPSAVPAAARKLFFRCRAASTMNEASASSPDAEEKKTTTVFVAGSTGRTGKRVVEKLLAKGFGVVAGTTDVSRARGSLPQDPNLQLVRADVTEGVDKLVEAVRGVDAVVCATGFRRSFDPFAPWKVDNFGTVNLVEACRKAGVTRFVLVSSILVNGAAMGQFLNPAYIVLNLLGLTLVAKLQAENHIRKSGINYTIVRPGGLTDQPPTGNIVMEPEDTLYSGSISRSQVAEVAVEALLCPESSYKVVEIIARTDAPNRPLKDMYAAIKQN

SEQ ID NO: 1263 - DNA, 2292 bp, Sorghum bicolor
  misc_feature: Ceres ANNOT ID no. 6014850
  misc_feature: Encodes the peptide sequence at SEQ ID NO 1264
atgtctgagtttctggaccttgagacccaggatgggataagaatgacatggaatgttataccaggcacaaagcaggatgccactaactgtgttgttcctgtttctgccatttatactcctctaaagccaaacccttccattcctgtccttccttatgcccctctccgttgccgcatgtgccgttcgattctcaaccctttctcagttgttgattttgttgcgaagatttgggtctgtccgttctgctttcagcgcaaccatttcccccaacattacaactccatttcagaaaacaaccttcctgctgagctgtttcctcaatataccaccgttgagtatgcatccacttctgaaacgggtcctgtggcacctccagtcttcctctttgttgttgatacatgtatgattgaggaggagattggctatttgaagtctgctttagcacaagcaattgaactattgccagatcagtcccttgttggatttattactttcgggacatatgttcaggtgcatgaattgggttttggcttgttgccaaagtcatatgtgtttaaagggacaaaagaagttacaaaggagcaaattttggaccaaatgagtttctttgctgggaaaactaaacccacatcaggtgtgatcgcaggcgcaagggatggcctctcagcagagagtattgctaggttcctgttgcctgcttctgagtgcgagtttgtgttgaattcagtaatagaagaactgcaaaaggacccttggcctgttccagctgataaacgttcatcaaggtgtactggagttgcattaagtgttgctgctagtctcttgggggtttgtgttcctggatcaggtgctagaattatggcatttgtaggtggtccatctacagagggacctggttctatcgtatccaagtccctatcagaaccaattcgctcgcacaaagacctcgataaaggttcagctccactttataacaaagctgttaaattctacgaggatatctctaagcagcttgtgaatcaaggccatgtacttgatttatttgcttgtgcgcttgaccaggttggtgttgctgagatgaaggttgctgtggagagaactggtggaatagttgttcttgcggaaagttttggtcattctgtttttaaagactcacttcgacgcatctttcagtcaagtgacaatgatcttgatttatcattcaatggtatctttgagattaactgctcaaaggatgtcaaaatccaaggaattattggaccttgtacttccctggagaagaaaagccctctatcgtcagatacagttgtaggtcagggaaacacgaacgcatggaagatgtgtggtctagacaggaaaacatcactctgtttagtatttgatattgcaaagaaggatggaccagattcggttggtgttggtcaatcagcaagcaatcagttctacttccaattcttaacctattaccagcatcatgaggggcagatgagattacgagccactacactttctagaagatgggttgctggttctggtggtgtgcaggaactaatagatggctttgatcaagaggcagctgctgcagtcatggcacgcttggtctcgtttaagatggaagctgaggctgattttgacccgataagatggcttgatcgagcattgattagtttatgttcgaaatttggagactatcacaaagaaacaccctcatccttcagtttatcccctcgtctgtccatatttccccagttcatctttaatttgagacgatctcaatttgttcaggtttttaacaacagtccagatgaaactgcatatttcacaatgatgttaaacagagagaatgtatcaaatgcagttgtgatgatccagccatcacttatatcttattcattccaatcgggtccagagccagttctgttggatgtaactgcaattgcagctgataggatccttttgttggattcttattttactgttgtcatattccatgggataacgattgcacagtggcgaaaggctggttaccaatatcaagaaggccatgagtcatttgcccagttgttgcaagctccacaggaggaagctgatgcaataatcaaggaacgctttcctgtgcctcgattggtcgtgtgcgatcaatatggttctcaggctcgatttttgctggcaaagcttaatccatcggtctcgtatgacaatcctccagcaccaggaggggatgtcatattcacagatgatgtgagcttccaggtcttcatggatcatctccagcgcttggccgttaattag

SEQ ID NO: 1264 - protein, 763 aa, Sorghum bicolor
  misc_feature: Ceres ANNOT ID no. 6014850
  misc_feature (122)..(390): Pfam Id: Sec23_trunk Pfam Desc: Sec23/Sec24 trunk domain
  misc_feature (400)..(508): Pfam Id: Sec23_BS Pfam Desc: Sec23/Sec24 beta-sandwich domain
  misc_feature (523)..(623): Pfam Id: Sec23_helical Pfam Desc: Sec23/Sec24 helical domain
  misc_feature (53)..(92): Pfam Id: zf-Sec23_Sec24 Pfam Desc: Sec23/Sec24 zinc finger
  misc_feature (632)..(722): Pfam Id: Gelsolin Pfam Desc: Gelsolin repeat
  misc_feature (2)..(762): NCBI GI: 140068525 NCBI Desc: zinc finger, sec23/sec24-type; sec23/sec24 trunk region; sec23/sec24 helical region; gelsolin region; sec23/sec24 beta-sandwich [medicago truncatula]
  misc_feature (1)..(762): NCBI GI: 140063092 NCBI Desc: zinc finger, sec23/sec24-type; sec23/sec24 trunk region; sec23/sec24 helical region; gelsolin region; sec23/sec24 beta-sandwich [medicago truncatula]
  misc_feature (3)..(762): NCBI GI: 7268121 NCBI Desc: transport protein [arabidopsis thaliana]
  misc_feature (3)..(762): NCBI GI: 20147367 NCBI Desc: at4g14160/dl3120w [arabidopsis thaliana]
  misc_feature (5)..(762): NCBI GI: 15912297 NCBI Desc: at1g05520/t25n20_16 [arabidopsis thaliana]
MSEFLDLETQDGIRMTWNVIPGTKQDATNCVVPVSAIYTPLKPNPSIPVLPYAPLRCRMCRSILNPFSVVDFVAKIWVCPFCFQRNHFPQHYNSISENNLPAELFPQYTTVEYASTSETGPVAPPVFLFVVDTCMIEEEIGYLKSALAQAIELLPDQSLVGFITFGTYVQVHELGFGLLPKSYVFKGTKEVTKEQILDQMSFFAGKTKPTSGVIAGARDGLSAESIARFLLPASECEFVLNSVIEELQKDPWPVPADKRSSRCTGVALSVAASLLGVCVPGSGARIMAFVGGPSTEGPGSIVSKSLSEPIRSHKDLDKGSAPLYNKAVKFYEDISKQLVNQGHVLDLFACALDQVGVAEMKVAVERTGGIVVLAESFGHSVFKDSLRRIFQSSDNDLDLSFNGIFEINCSKDVKIQGIIGPCTSLEKKSPLSSDTVVGQGNTNAWKMCGLDRKTSLCLVFDIAKKDGPDSVGVGQSASNQFYFQFLTYYQHHEGQMRLRATTLSRRWVAGSGGVQELIDGFDQEAAAAVMARLVSFKMEAEADFDPIRWLDRALISLCSKFGDYHKETPSSFSLSPRLSIFPQFIFNLRRSQFVQVFNNSPDETAYFTMMLNRENVSNAVVMIQPSLISYSFQSGPEPVLLDVTAIAADRILLLDSYFTVVIFHGITIAQWRKAGYQYQEGHESFAQLLQAPQEEADAIIKERFPVPRLVVCDQYGSQARFLLAKLNPSVSYDNPPAPGGDVIFTDDVSFQVFMDHLQRLAVN

SEQ ID NO: 1265 - DNA, 891 bp, Sorghum bicolor
  misc_feature: Ceres ANNOT ID no. 6014857
  misc_feature: Encodes the peptide sequence at SEQ ID NO 1266
atgaccaaccgcgccttctccgccatggcagcgagccaccaatcatcctacatgatccgattcgacggcgcccactccgacgacccgtcgccgagctccgccggcgccgagccgccgggccccgcgcagccgcagccgcagccgcagccaccgttcgcggggcggaggatgatctcccccgagcaggagcaccaagtcattgtcgccgccctgctccacgtcgtctccgggtacaccacgccgccgccggaggtcttcccgcctccaccgccgccgacagcggcgtgctgccagctgtgcgggatggagcggtgcctcggctgcgagttcttcgccgccgccggggagggctgcttattaccagcgacgaccgcattggacggcgcggggaaggcagtggccgcggcgacaagcgcggcgccggggcagaggaggcggaggaagaagaagaacaagtaccgcggcgtgcggcagcggccgtgggggaagtgggcggcggagatccgcgacccgcgccgcgccgtgcgcaagtggctgggcacgttcgacaccgccgaggaggccgccagggcgtacgaccaggccgccatcgagttccgcggcccgcgcgccaagctcaacttcccgttccccgagcagctggcgacgggcacgggccacgacgaggccagcgcggccgccaccaccaagtcgtcggacaacacgctgtcgctgtcgccgtcgctctgcagcgacgagcgggagcgggagcgggggcagccggagtggctgccgagcgccgggctcggagggcaggaaacaggggagcagctctgggaaggcctgcaggacttgatgaagctggacgaaggcgagctctggttcccgccaacctcgagcgcttggaattga

SEQ ID NO: 1266 - protein, 296 aa, Sorghum bicolor
  misc_feature: Ceres ANNOT ID no. 6014857
  misc_feature (151)..(202): Pfam Id: AP2 Pfam Desc: AP2 domain
  misc_feature (49)..(294): NCBI GI: 51536200 NCBI Desc: ethylene-binding protein-like [oryza sativa (japonica cultivar-group)]
  misc_feature (132)..(296): NCBI GI: 115476860 NCBI Desc: os08g0474000 [oryza sativa (japonica cultivar-group)]
  misc_feature (143)..(221): NCBI GI: 92871591 NCBI Desc: pathogenesis-related transcriptional factor and erf [medicago truncatula]
  misc_feature (143)..(209): NCBI GI: 92871585 NCBI Desc: pathogenesis-related transcriptional factor and erf [medicago truncatula]
  misc_feature (143)..(213): NCBI GI: 92871592 NCBI Desc: pathogenesis-related transcriptional factor and erf [medicago truncatula]
  misc_feature: Abnormal phyllotaxy, leaf number higher than wild-type
  misc_feature: Bushy plant with varying petiole angles, abnormal phyllotaxy, leafnumber higher than wild-type
  misc_feature: No seed is being produced by the plant
  misc_feature: The plant flowers significantly late compared to wild-type.
  misc_feature: The plant is abnormally small.
  misc_feature: The plant produces a reduced number of seeds.
  misc_feature: The sequence is a functional homolog of SEQ ID NO 1291 in the 10/374,780US patent application
  misc_feature: The sequence is a functional homolog of SEQ ID NO 1474 in the 10/666,642US patent application
  misc_feature: The sequence is a functional homolog of SEQ ID NO 16 in the 10/225,066US patent application
  misc_feature: The sequence is a functional homolog of SEQ ID NO 1756 in the 10/374,780US patent application
  misc_feature: The sequence is a functional homolog of SEQ ID NO 1769 in the 10/374,780US patent application
  misc_feature: The sequence is a functional homolog of SEQ ID NO 2144 in the 10/374,780US patent application
  misc_feature: The sequence is a functional homolog of SEQ ID NO 503 in the 10/374,780US patent application
  misc_feature: Useful for biocontainment applications
  misc_feature: Useful for making plants with altered Lignin content
  misc_feature: Useful for making plants with altered cell wall content and/or composition
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13051
  misc_feature: Functional homolog of the protein sequence given in SEQ ID NO 13240
  misc_feature: GREAT-hit functional homolog of the protein sequence given in SEQ ID NO 13481
  misc_feature: GREAT-hit functional homolog of the protein sequence given in SEQ ID NO 13510
  misc_feature: The sequence is a functional homolog of SEQ ID NO 16 in the 20050160493 US patent application
  misc_feature: The sequence is a functional homolog of SEQ ID NO 1291 in the 20060162006 US patent application
  misc_feature: The sequence is a functional homolog of SEQ ID NO 1756 in the 20060162006 US patent application
  misc_feature: The sequence is a functional homolog of SEQ ID NO 1769 in the 20060162006 US patent application
  misc_feature: The sequence is a functional homolog of SEQ ID NO 503 in the 20060162006 US patent application
  misc_feature: Useful for making plants with modulated biomass
  misc_feature: Functional homolog of the protein sequence given in SEQ ID NO 13051
MTNRAFSAMAASHQSSYMIRFDGAHSDDPSPSSAGAEPPGPAQPQPQPQPPFAGRRMISPEQEHQVIVAALLHVVSGYTTPPPEVFPPPPPPTAACCQLCGMERCLGCEFFAAAGEGCLLPATTALDGAGKAVAAATSAAPGQRRRRKKKNKYRGVRQRPWGKWAAEIRDPRRAVRKWLGTFDTAEEAARAYDQAAIEFRGPRAKLNFPFPEQLATGTGHDEASAAATTKSSDNTLSLSPSLCSDERERERGQPEWLPSAGLGGQETGEQLWEGLQDLMKLDEGELWFPPTSSAWN

SEQ ID NO: 1267 - DNA, 1332 bp, Sorghum bicolor
  misc_feature: Ceres ANNOT ID no. 6014860
  misc_feature: Encodes the peptide sequence at SEQ ID NO 1268
atggcgaaccacctggccgccggcctgttcggcctcctcctagctgtcgcggtgctgtgcttgcttattggctccaacacggcacgagcccaggtcctgttccaggggttcaactgggagtcttgcaagaagcaaggcggctggtacaagtttctccaggcgcaggtggacgacatcgccggcgccggcgccacccacgtctggctgccgccgccatcgcactccgtcgcgccacagggctacatgccggggcggctctacgacctgaacgcgtccaggtacggcacggaggcggagctgcggtcgctgatcgccgcgttcaggggcaagggcgtggaggccgtggcggacatcgtcatcaaccaccggtgcgccgacaagaaggacggccgcggcgtgtactgcatcttcgagggcggcggcggcgacgacggcggaacggggacggggcggctcaactgggacgccgacatgatctgcggcgacgacacggagttctccaacgggcgcggcaaccgcgacacgggcaaggacttcggcgcggcgccggacatcgaccacctgaacccgcgcgtgcagcgggagctctcggactggctctgctggctcagcgccgacgtcgggttcaccggcggctggcgcctcgacttcgccaagggctactccgcggccgtcgccaaggcgtacgtcgacaggacgcggccgagcttcgtggtcgcggagatatggagctccctcagctacgacggcgacggcaagccgaagcacaaccaggacggggaccggcaggagctggtggactgggtgaacgccgtgggcggccccgccgccgcgttcgacttcaccaccaagggcgtgctgcaggcggccgtgcagggggagctgtggcggatgcgggacggcaatggcaaggcgcccggcatgatcggctggctgccggagaaggccgtcacgttcgtcgacaaccacgacacgggctccacgcagaactcgtggccgttcccgcgtgacaaggtcatgcagggctacgcctacatcctcacccacccagggatcccatccatcttctacgaccacgtgttcgagtggaacctaaagcaggagatcagcacgctggcggcgatcaggaagagaaacgggatccatccggggagcaagctaagcatcgtaaaagcagaaggcgatgtctacgtcgccatgatcgacgacaaggtgatcaccaagatcgggacgaggtacgacgtcggcagcgtgatcccgtcgggtttcagtgtcgccgcgcatggcgacggctactgcatttgggagaagagagactaccactaccactag

SEQ ID NO: 1268 - protein, 443 aa, Sorghum bicolor
  misc_feature: Ceres ANNOT ID no. 6014860
  misc_feature (31)..(376): Pfam Id: Alpha-amylase Pfam Desc: Alpha amylase, catalytic domain
  misc_feature (377)..(437): Pfam Id: Alpha-amyl_C2 Pfam Desc: Alpha-amylase C-terminal beta-sheet domain
  misc_feature (1)..(437): NCBI GI: 113680 NCBI Desc: alpha-amylase isozyme 3b precursor (1,4-alpha-d-glucan glucanohydrolase)
  misc_feature (1)..(437): NCBI GI: 78099754 NCBI Desc: alpha-amylase isozyme 3c precursor (1,4-alpha-d-glucan glucanohydrolase)
  misc_feature (1)..(437): NCBI GI: 426482 NCBI Desc: alpha-amylase
  misc_feature (1)..(437): NCBI GI: 20339 NCBI Desc: alpha-amylase [oryza sativa (japonica cultivar-group)]
  misc_feature (17)..(440): NCBI GI: 11263719 NCBI Desc: alpha-amylase (ec 3.2.1.1) isozyme iii - rice
  misc_feature (1)..(437): SWISSPROT Homolog: EC 3.2.1.1 Alpha-amylase isozyme 3B precursor
MANHLAAGLFGLLLAVAVLCLLIGSNTARAQVLFQGFNWESCKKQGGWYKFLQAQVDDIAGAGATHVWLPPPSHSVAPQGYMPGRLYDLNASRYGTEAELRSLIAAFRGKGVEAVADIVINHRCADKKDGRGVYCIFEGGGGDDGGTGTGRLNWDADMICGDDTEFSNGRGNRDTGKDFGAAPDIDHLNPRVQRELSDWLCWLSADVGFTGGWRLDFAKGYSAAVAKAYVDRTRPSFVVAEIWSSLSYDGDGKPKHNQDGDRQELVDWVNAVGGPAAAFDFTTKGVLQAAVQGELWRMRDGNGKAPGMIGWLPEKAVTFVDNHDTGSTQNSWPFPRDKVMQGYAYILTHPGIPSIFYDHVFEWNLKQEISTLAAIRKRNGIHPGSKLSIVKAEGDVYVAMIDDKVITKIGTRYDVGSVIPSGFSVAAHGDGYCIWEKRDYHYH

SEQ ID NO: 1269 - DNA, 1497 bp, Sorghum bicolor
  misc_feature: Ceres ANNOT ID no. 6014868
  misc_feature: Encodes the peptide sequence at SEQ ID NO 1270
atgaagggctcctcccacccgcaggcggcggcaggccggcggcggcgctgggggtggctgctgccgctcctcgtgggcgccgccttcctcgccgagatcgcgttcctcggccgcctcgacatggcgaagaacgccgaggcggtcgagagctggaccacctccttctaccgccgctccggccattggggcgacgccgtgggcgggggcgccaccccgagggcaggcggcgacggcgacggcgaggacgaagagatccggcggtgcgagcagcggctcgagagggaggacgatgtgccctacgaccgcgacttcgacagggatcccgtacttgttggtggcgctgccaaggattggaataagtgctatgtaggatgtgaatttggtttttctgcaagcaagacacctgatgctacttttggaattgcaccagatccttctgtagatggtatcctcagatcaatggaatcatctcaatattattcagagaataatattgatgtggctcgagggagagggtacaagattgtgatgaccaccagcctttcttcagatgtaccagttggctacttttcatgggctgaatatgatatcatggcacctgtgcctccaaagactgaagaagctcttgctgcagcctttatttctaactgcggtgcacgaaattttcgtttgcaagcccttgagatgcttgaaaatttggatgtcaaaatagattcatatggtagttgtcatcgtaaccgtgatggcaaagtggacaaagtggacactttgaaacgctacagattcagcttggcatttgagaattctaatgaggaggattacgtaacagaaaagttttttcagtcactggtagcaggttctattccagttgttgttggtgctccaaatattcaagagttttctccgggagaaggtgcaatattacatattaaggaacttgatgatgttgcttcagttgctaagacaatgaaaaatattgcttcaaatcctgatgccttcaatcaatctttgaggtggaagtatgatggtccctctgattctttcaaagcccttattgacatggcagcagttcattcatcttgtcgtctttgtatacatattgctaccaagatccagttaaaggaggaaatgactccaaaatttacaaatcgtccttgtagctgttccagcaaaaagggaacagtttaccacttatttatccgagaaagagggcggtttaagtcagagagcatttatatgagatcgggccggttaactctgggagccttggaatctgcagtgctcagtaaatttaggtccctcaatcacgttcctgtatggaaggatgaaagaccaccgagtattagaggtggggatgacctgaaagtatacagaatttacccggtcggtctaacacaacgtcaggctttgtacggtttcagatttagagatgattctgaactcgagcaatatatcaaagaccatccctgtgcaaagcttgaagtaatttttgtgtaa

SEQ ID NO: 1270 - protein, 498 aa, Sorghum bicolor
  misc_feature: Ceres ANNOT ID no. 6014868
  misc_feature (8)..(382): Pfam Id: Glyco_transf_10 Pfam Desc: Glycosyltransferase family 10 (fucosyltransferase)
  misc_feature (1)..(498): NCBI GI: 66393901 NCBI Desc: core alpha 1,3-fucosyltransferase [zea mays]
  misc_feature (11)..(498): NCBI GI: 82775234 NCBI Desc: 3-alpha-l-fucosyltransferase [zea mays]
  misc_feature (37)..(498): NCBI GI: 34786921 NCBI Desc: glycoprotein 3-alpha-l-fucosyltransferase [oryza sativa (japonica cultivar-group)]
  misc_feature (14)..(498): NCBI GI: 61845103 NCBI Desc: alpha 1,3 fucosyltransferase [populus alba x populus tremula]
  misc_feature (5)..(498): NCBI GI: 5702039 NCBI Desc: fuct c3 protein [vigna radiata var. radiata]
  misc_feature (85)..(498): SWISSPROT Homolog: EC 2.4.1.214 Glycoprotein 3-alpha-L-fucosyltransferase A
MKGSSHPQAAAGRRRRWGWLLPLLVGAAFLAEIAFLGRLDMAKNAEAVESWTTSFYRRSGHWGDAVGGGATPRAGGDGDGEDEEIRRCEQRLEREDDVPYDRDFDRDPVLVGGAAKDWNKCYVGCEFGFSASKTPDATFGIAPDPSVDGILRSMESSQYYSENNIDVARGRGYKIVMTTSLSSDVPVGYFSWAEYDIMAPVPPKTEEALAAAFISNCGARNFRLQALEMLENLDVKIDSYGSCHRNRDGKVDKVDTLKRYRFSLAFENSNEEDYVTEKFFQSLVAGSIPVVVGAPNIQEFSPGEGAILHIKELDDVASVAKTMKNIASNPDAFNQSLRWKYDGPSDSFKALIDMAAVHSSCRLCIHIATKIQLKEEMTPKFTNRPCSCSSKKGTVYHLFIRERGRFKSESIYMRSGRLTLGALESAVLSKFRSLNHVPVWKDERPPSIRGGDDLKVYRIYPVGLTQRQALYGFRFRDDSELEQYIKDHPCAKLEVIFV

SEQ ID NO: 1271 - DNA, 633 bp, Sorghum bicolor
  misc_feature: Ceres ANNOT ID no. 6014916
  misc_feature: Encodes the peptide sequence at SEQ ID NO 1272
atggggcaatgccgggcaggcgcggcggtggcagcggtaacgctgtggtggcttaccgggtgcgccggggcggtgtggctggagctggcgaccacggcgatcaagtgcatctccgaggacatccagtccaacgtcgtcgtcatggccgactactccatcctcttcgaggagcaccccatccgccccaaggtctccgccaaggtgacatcgcctttgggagacgtcctgcatcacgccgacaaggttagccatggccagtttgcctttaccacggtggaatctggcagttaccttgcctgcttctggacggagactctggagaagggaatggtggtgaaccttaaccttgattggagaacggggatcgcagcaaaggactgggactccattgctaagaaagagaagcttgatggtgtggcactagagcttgtcaagctagaagtagctgcaaaagccatccatgaaaacttgctctaccttaaattaaaagaagcagacttgcgagacctgagtgagtggacacaagtgaagatcacatggctgagcgttatatgcctcgctatctgtattggagtctccattttgcaattgtggcgtctcaaacagttcttccgaaagaataaactcatctag

SEQ ID NO: 1272 - protein, 210 aa, Sorghum bicolor
  misc_feature: Ceres ANNOT ID no. 6014916
  misc_feature (49)..(118): Pfam Id: EMP24_GP25L Pfam Desc: emp24/gp25L/p24 family/GOLD
  misc_feature (22)..(210): NCBI GI: 47026935 NCBI Desc: emp24 protein [hyacinthus orientalis]
  misc_feature (24)..(210): NCBI GI: 38566614 NCBI Desc: at1g09580 [arabidopsis thaliana]
  misc_feature (10)..(210): NCBI GI: 124360279 NCBI Desc: emp24/gp25l/p24 [medicago truncatula]
  misc_feature (2)..(163): NCBI GI: 115479497 NCBI Desc: os09g0453200 [oryza sativa (japonica cultivar-group)]
  misc_feature (7)..(210): NCBI GI: 21387055 NCBI Desc: transmembrane protein-like protein [arabidopsis thaliana]
  misc_feature: Useful for making plants with altered cell wall content and/or composition
  misc_feature: Functional homolog of the protein sequence encoded by LOCUS at1g09580
  misc_feature: Useful for making plants with altered carbohydrate content
  misc_feature: Functional homolog of the protein sequence given in SEQ ID NO 13728
  misc_feature: Useful for making plants with altered cell wall content and/or composition
  misc_feature: Functional homolog of the protein sequence given in SEQ ID NO 13729
MGQCRAGAAVAAVTLWWLTGCAGAVWLELATTAIKCISEDIQSNVVVMADYSILFEEHPIRPKVSAKVTSPLGDVLHHADKVSHGQFAFTTVESGSYLACFWTETLEKGMVVNLNLDWRTGIAAKDWDSIAKKEKLDGVALELVKLEVAAKAIHENLLYLKLKEADLRDLSEWTQVKITWLSVICLAICIGVSILQLWRLKQFFRKNKLI

SEQ ID NO: 1273 - DNA, 2766 bp, Sorghum bicolor
  misc_feature: Ceres ANNOT ID no. 6014929
  misc_feature: Encodes the peptide sequence at SEQ ID NO 1274
  misc_feature: Down-regulated in shoot tissues in response to salicylic acid treatment
atggccgctgtcgagccccggcagttcggccgcctcgagccgggcgtcgccacgaacggcgccaaggcgtaccctcctccggcgagccacctcccgcggcgcgccgactcgcccgtgcgcggctgcggcttccctcccctcgtctccccgccgccccgcagcaacaagccggacgacgcgtcgccgtcggacgacgacgacgacgacgacgaggactggcgctcgctctacggctcgcacctgcagctggaggtggagcccgcggtgcacgacgcgcgcgacgaaggcaccgcggacgcgtggatcgagcgcaacccgtccctggtccggctgacggggaagcacccgttcaactgcgagccgccgctggcgcggctgatgcaccacggcttcatcaccccggcgccgctgcactacgtgcgcaaccacggcgccgtgccgcgcggggactgggcgacgtgggccgtcgaggtgacggggctcgtcaagcggcccgcgcggatcaccatggaggagctggcccgggacttccccgccgtggagatccccgtcacgctcgcctgcgcgggcaaccggcgcaaggagcagaacatggtgcggcagacggtgggcttcaactggggcgccgcgggggtgtccacctccgtgtggcgcggcgcgcgcctccgcgacgtgctccgccggtgcggcatcatgccacgcaagggccccggcggcgcgctcaacgtctgcttcgagggcgccgaggacctccccggcggcggcggcggcggcggcgggagcaccaagtacggcaccagcgtcacgcgtgagtgggcgctggacccgtcgcgggacatcatgctcgcctacatgcagaacggcgagccgctgctgccggaccacggcttcccggtgcgcgtcatcatcccgggctgcatcggcggccgcatggtcaagtggctcaagcgcatcgtcgtcacccccgccgagtccgacaactactaccattacaaggacaaccgcgtcctgccgtcgcacgtcgacgccgagctcgccaacgcagaagcgtggtggtacaagccggagtacatcatcaacgagctgaacataaactcggtgatcacgacgccggggcacgacgagatcctgcccatcaacgccattaccacacagcgcggctacaccatgaaaggatacgcctactccggcggcggcaagaaggtgacgcgggtggaggtgacgctggacggcggcgagacatggctggtgtgcgacctcgaccacccggagaagcccaacaagtacggcaagtactggtgctggtgcttctggtccgtcgaggtggaggtcctcgacctcctcggcgccaaggagatcgccgtccgcgcatgggaccagtcgctcaacacgcagcccgagaagctcatatggaacctcatggggatgatgaacaactgctggttcaaggtgaaggtgaacgtgtgccgtccacacagaggcgagatcgggctggtgttcgagcacccgacgcagccgggcaaccagtccggcgggtggatggcgcggcagaagcacctggagacggcggaggccgcggcgccggggctgaagcgcagcacgtccacgcccttcatgagcaccatcagcgacggcaagcagttcaccatgtcggaggtgcgcaggcacgcgtcgcaggagtcggcgtggatcgtcgtgcacggccacgtctacgactgcaccaagttcctcaaggaccacccgggcggcgccgacagcatcctcatcaacgccggcaccgactgcaccgaggagttcgacgccatccactccgacaaggccaaggcgctcctcgacacctaccgcatcggcgagctcatcaccaccggcaccggatacagctccgacaactccgtccatggcggctccgccgtcctgtccaacctcgcgcccatccgcgaggccgtcagggccccggcccccgtcgcgctctctaatccgcgcgagaagatccactgccgcctcgtcggcaagaaggagctgtcccgcgacgtccgcctcttccgcttcgccctgccgtcgtccgaccaggtgctcggcctccccatcggcaagcacatcttcgtctgcgccaccatcgacgggaagctctgcatgcgggcgtacacgccgacgagcatggtggacgagatcggccacttcgacctcctcgtcaaggtctacttcaagaacgagcacccaaagttccccgccggcgggctcatgacgcagtacctcgactcgcttcccgtcggctcctacatcgacgtcaagggcccgctcggccacgtcgagtacaccggccgcggcagcttcgtcatcaacggcaagcagcgccacgcgagccgcctcgccatgatctgcggcggcagcgggatcacgcccatgtaccaggtcatccaggcggtgctgcgcgaccagccggaggaccagacggagatgcacctcgtgtacgccaaccggacggaggacgacatcctcctccgcgacgagctcgaccggtgggcggcagagtacccggacaggctcaaggtgtggtacgtgatcgaccaggtgaagcgccccgaggaggggtggaagtacagcgtcggcttcgtcacggaggccgtcctgcgggagcacgttccggaaggcggcgacgatacgctggcccttgcctgcggaccgccgccgatgatccagttcgctgtctcgccgaacttggagaagatgaattatgacatggccaattctttcgtcgtgttctaa

SEQ ID NO: 1274 - protein, 921 aa, Sorghum bicolor
  misc_feature: Ceres ANNOT ID no. 6014929
  misc_feature (356)..(489): Pfam Id: Mo-co_dimer Pfam Desc: Mo-co oxidoreductase dimerisation domain
  misc_feature (139)..(331): Pfam Id: Oxidored_molyb Pfam Desc: Oxidoreductase molybdopterin binding domain
  misc_feature (665)..(772): Pfam Id: FAD_binding_6 Pfam Desc: Oxidoreductase FAD-binding domain
  misc_feature (791)..(904): Pfam Id: NAD_binding_1 Pfam Desc: Oxidoreductase NAD-binding domain
  misc_feature (547)..(620): Pfam Id: Cyt-b5 Pfam Desc: Cytochrome b5-like Heme/Steroid binding domain
  misc_feature (1)..(921): NCBI GI: 5020385 NCBI Desc: nitrate reductase [zea mays]
  misc_feature (2)..(921): NCBI GI: 116256153 NCBI Desc: nitrate reductase [nadh] 1 (nr1)
  misc_feature (2)..(921): NCBI GI: 27527625 NCBI Desc: nitrate reductase apoenzyme [oryza sativa (japonica cultivar-group)]
  misc_feature (2)..(921): NCBI GI: 128185 NCBI Desc: nitrate reductase [nadh] (nr)
  misc_feature (2)..(921): NCBI GI: 18994 NCBI Desc: nitrate reductase [hordeum vulgare subsp. vulgare]
  misc_feature (2)..(921): SWISSPROT Homolog: EC 1.7.1.1 Nitrate reductase [NADH] 1
  misc_feature (61)..(921): SWISSPROT Homolog: EC 1.7.1.2 Nitrate reductase [NAD(P)H]
  misc_feature: Down-regulated in shoot tissues in response to salicylic acid treatment
MAAVEPRQFGRLEPGVATNGAKAYPPPASHLPRRADSPVRGCGFPPLVSPPPRSNKPDDASPSDDDDDDDEDWRSLYGSHLQLEVEPAVHDARDEGTADAWIERNPSLVRLTGKHPFNCEPPLARLMHHGFITPAPLHYVRNHGAVPRGDWATWAVEVTGLVKRPARITMEELARDFPAVEIPVTLACAGNRRKEQNMVRQTVGFNWGAAGVSTSVWRGARLRDVLRRCGIMPRKGPGGALNVCFEGAEDLPGGGGGGGGSTKYGTSVTREWALDPSRDIMLAYMQNGEPLLPDHGFPVRVIIPGCIGGRMVKWLKRIVVTPAESDNYYHYKDNRVLPSHVDAELANAEAWWYKPEYIINELNINSVITTPGHDEILPINAITTQRGYTMKGYAYSGGGKKVTRVEVTLDGGETWLVCDLDHPEKPNKYGKYWCWCFWSVEVEVLDLLGAKEIAVRAWDQSLNTQPEKLIWNLMGMMNNCWFKVKVNVCRPHRGEIGLVFEHPTQPGNQSGGWMARQKHLETAEAAAPGLKRSTSTPFMSTISDGKQFTMSEVRRHASQESAWIVVHGHVYDCTKFLKDHPGGADSILINAGTDCTEEFDAIHSDKAKALLDTYRIGELITTGTGYSSDNSVHGGSAVLSNLAPIREAVRAPAPVALSNPREKIHCRLVGKKELSRDVRLFRFALPSSDQVLGLPIGKHIFVCATIDGKLCMRAYTPTSMVDEIGHFDLLVKVYFKNEHPKFPAGGLMTQYLDSLPVGSYIDVKGPLGHVEYTGRGSFVINGKQRHASRLAMICGGSGITPMYQVIQAVLRDQPEDQTEMHLVYANRTEDDILLRDELDRWAAEYPDRLKVWYVIDQVKRPEEGWKYSVGFVTEAVLREHVPEGGDDTLALACGPPPMIQFAVSPNLEKMNYDMANSFVVF

SEQ ID NO: 1275 - DNA, 1461 bp, Sorghum bicolor
  misc_feature: Ceres ANNOT ID no. 6014934
  misc_feature: Encodes the peptide sequence at SEQ ID NO 1276
atgcgccgccaaagcctcgccgccgtcctgctcctcctcctggcggccaccgtggccctggccgccgcccccgccgcagggcactcggcggaggagtcctgccccttccatgaccatggcggccacgacgaaccgcacgagcatcatcaccacggccacagctgcggtggcggcgcggaccatgagcaccaccatcaccacggccacggcgagatccagcggctgctcccggaggagatagcggaggaggcggatctcgagctcgagtccttcggttacgacgagcatgaccacagccaccaccaccaccaccaccaccaccaccacggccacggcgacatggagacatcgaccatgggcgtgtggctgagtgcgatggggtgctcgcttctggtcagtatggcgtccctcgtctgcctcgtcctcctcccggtcatcttctttcaggggaaaccgtctaaggccatagtggattcgcttgcagtgtttggggcaggagcaatgcttggagattcatttcttcatcagctgccacatgcttttggtggaggacactctcactcacatgatcatgagggtcatgatcatgctcacgagcatgcacatgcacactcactggaagatctttctgtggggttgtctatactatttggcattgtattgttttttatcgttgagaagattgtgaggtatgttgaagacaattctcaaaatgggactcatagcatgggtcacgggcaccatcatcataatcataaacggcatgattctagtgataaagctaaattgaatcaccaaaagagtgataccgatggtaaagacattgaccatactgaagaggaacctttggttgatggcgccactggaaaaataagtgatggccatgaatcaaaagctactatacgcaagaggagctcatccaaagctactgatggagaatccgccagttctgaaagtgatcctgcccctgaaaaagcatcatcaaatgaaggctcatcaatttcaaactctaacttagtgtttggctacctcaaccttttctcagacggtgtccataacttcactgatgggatggctcttgggagtgcctttctgctacatggttctgttggtggctggtccaggactttatttctgcttgcacatgaacttcctcaagaggtaggagattttggtatccttgtgcggtcaggcttcacggtatctaaggccctattcttcaatttcctctccgcgttggttgctcttgctggaacagcactagcattgtctttgggtaaagatcccggacattcctccctgattgagggtttcacggctggtggtttcatttacattgctgtcgcgggagtcctcccacagatgaacgaccagaaaacaaccctcagaagctcagtagctcagctgatctccctgtcaatggggatgctggtcgctctaggcatttctctggtagaataa

SEQ ID NO: 1276 - protein, 486 aa, Sorghum bicolor
  misc_feature: Ceres ANNOT ID no. 6014934
  misc_feature (119)..(483): Pfam Id: Zip Pfam Desc: ZIP Zinc transporter
  misc_feature (12)..(294): NCBI GI: 55956945 NCBI Desc: solute carrier family 39 protein (zinc transporter) member 7 [canis familiaris]
  misc_feature (12)..(275): NCBI GI: 123982052 NCBI Desc: solute carrier family 39 (zinc transporter), member 7 [synthetic construct]
  misc_feature (27)..(286): NCBI GI: 12643401 NCBI Desc: zinc transporter slc39a7 (solute carrier family 39 member 7) (histidine-rich membrane protein ke4)
  misc_feature (12)..(274): NCBI GI: 4219088 NCBI Desc: ke4 protein [homo sapiens]
  misc_feature (27)..(286): NCBI GI: 2137538 NCBI Desc: mhc h-2k/t-w5-linked orf precursor - mouse
MRRQSLAAVLLLLLAATVALAAAPAAGHSAEESCPFHDHGGHDEPHEHHHHGHSCGGGADHEHHHHHGHGEIQRLLPEEIAEEADLELESFGYDEHDHSHHHHHHHHHHGHGDMETSTMGVWLSAMGCSLLVSMASLVCLVLLPVIFFQGKPSKAIVDSLAVFGAGAMLGDSFLHQLPHAFGGGHSHSHDHEGHDHAHEHAHAHSLEDLSVGLSILFGIVLFFIVEKIVRYVEDNSQNGTHSMGHGHHHHNHKRHDSSDKAKLNHQKSDTDGKDIDHTEEEPLVDGATGKISDGHESKATIRKRSSSKATDGESASSESDPAPEKASSNEGSSISNSNLVFGYLNLFSDGVHNFTDGMALGSAFLLHGSVGGWSRTLFLLAHELPQEVGDFGILVRSGFTVSKALFFNFLSALVALAGTALALSLGKDPGHSSLIEGFTAGGFIYIAVAGVLPQMNDQKTTLRSSVAQLISLSMGMLVALGISLVE

SEQ ID NO: 1277 - DNA, 978 bp, Sorghum bicolor
  misc_feature: Ceres ANNOT ID no. 6014965
  misc_feature: Encodes the peptide sequence at SEQ ID NO 1278
atgagccagcgagatgcgcatgacggcggggacgacgactacaccaccggccgcagcgcgggcgcggccgcgagcatcgattccttctcgcagctgccgttcatccgcccgcagaagcagcaccagcagccgccgccgcgaagctccgccgccgggacatcatccggcatccggctgttcggcgtcgacgtcccaccggacgctgctgccccggggccggcggcctccccacgcgccgacgtcgtggaggaagaagatagctccgtcaacgaaagcaccgccaacgccaacgccgctgccgagccggcggcaggcagtactgacagcggcggcggcggcggaggaggaggagggacccggaagttcgagtgccactactgctgccggaacttcccgacgtcgcaggcgctgggcgggcaccagaacgcgcacaagcgggagcggcagcacgcgaagcgcgcgcagttccagaccgccatggccatgcaccacagccagtactactacccgcacccggcagtcccggaccccgcagcccacctctaccccgccttcgcagcttacagacaccaccaccgcttcaccgccgcgccgccgccgccgccgccgcactacccctcgtgggcgggcgccagccggtactacagcggacccgggtccatctcgcagccgatcaacggcagcccggtgacgccgtcgtccgggctgtggcagcaggtccccacaggcgccgccggcatcggagtggggactccggctccgccgttggccgcgcgacgtcaagaacagccctccgttcaaccacttccgatgatgatgctcggaggcgaggaaccagctgtggtggtgcggggagctggctcggcgcccttctcgccgtcgacctcctcctcgtcatcgtcggcttcgcctcatgagcgccgccccgccccgccggagtctaaagagaataatgtgagtttggatctgagcttgtag

SEQ ID NO: 1278 - protein, 325 aa, Sorghum bicolor
  misc_feature: Ceres ANNOT ID no. 6014965
  misc_feature (102)..(303): NCBI GI: 115479419 NCBI Desc: os09g0445500 [oryza sativa (japonica cultivar-group)]
  misc_feature (109)..(303): NCBI GI: 51536147 NCBI Desc: zinc finger protein-like [oryza sativa (japonica cultivar-group)]
  misc_feature (120)..(235): NCBI GI: 32362299 NCBI Desc: at3g58070 [arabidopsis thaliana]
  misc_feature (120)..(235): NCBI GI: 6729550 NCBI Desc: zinc finger-like protein [arabidopsis thaliana]
  misc_feature (69)..(294): NCBI GI: 51091156 NCBI Desc: zinc finger protein-like [oryza sativa (japonica cultivar-group)]
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1090 in the 10/412,699US patent application
  misc_feature: The sequence is a functional homolog of SEQ ID NO 1091 in the 10/412,699US patent application
  misc_feature: The sequence is a functional homolog of SEQ ID NO 1092 in the 10/412,699US patent application
  misc_feature: The sequence is a functional homolog of SEQ ID NO 1093 in the 10/412,699US patent application
  misc_feature: The sequence is a functional homolog of SEQ ID NO 1094 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 635 in the 10/374,780US patent application
  misc_feature: The sequence is a functional homolog of SEQ ID NO 636 in the 10/374,780US patent application
  misc_feature: The sequence is a functional homolog of SEQ ID NO 637 in the 10/374,780US patent application
  misc_feature: The sequence is a functional homolog of SEQ ID NO 638 in the 10/374,780US patent application
  misc_feature: The sequence is a functional homolog of SEQ ID NO 639 in the 10/374,780US patent application
  misc_feature: The sequence is a functional homolog of SEQ ID NO 760 in the 10/666,642US patent application
  misc_feature: The sequence is a functional homolog of SEQ ID NO 761 in the 10/666,642US patent application
  misc_feature: The sequence is a functional homolog of SEQ ID NO 762 in the 10/666,642US patent application
  misc_feature: The sequence is a functional homolog of SEQ ID NO 763 in the 10/666,642US patent application
  misc_feature: Useful for biocontainment applications
  misc_feature: Useful for making plants with altered alkaloid content
  misc_feature: Useful for making plants with altered terpenoid content
  misc_feature: Useful for making plants with modulated biomass
  misc_feature: Useful for making plants with modulated growth and phenotype characteristics
  misc_feature: Functional homolog of the protein sequence given in SEQ ID NO 13309
  misc_feature: The sequence is a functional homolog of SEQ ID NO 10 in the 20040045049 US patent application
  misc_feature: The sequence is a functional homolog of SEQ ID NO 1090 in the 20040045049 US patent application
  misc_feature: The sequence is a functional homolog of SEQ ID NO 1091 in the 20040045049 US patent application
  misc_feature: The sequence is a functional homolog of SEQ ID NO 1092 in the 20040045049 US patent application
  misc_feature: The sequence is a functional homolog of SEQ ID NO 1093 in the 20040045049 US patent application
  misc_feature: The sequence is a functional homolog of SEQ ID NO 1094 in the 20040045049 US patent application
  misc_feature: Functional homolog of the protein sequence given in SEQ ID NO 13581
MSQRDAHDGGDDDYTTGRSAGAAASIDSFSQLPFIRPQKQHQQPPPRSSAAGTSSGIRLFGVDVPPDAAAPGPAASPRADVVEEEDSSVNESTANANAAAEPAAGSTDSGGGGGGGGGTRKFECHYCCRNFPTSQALGGHQNAHKRERQHAKRAQFQTAMAMHHSQYYYPHPAVPDPAAHLYPAFAAYRHHHRFTAAPPPPPPHYPSWAGASRYYSGPGSISQPINGSPVTPSSGLWQQVPTGAAGIGVGTPAPPLAARRQEQPSVQPLPMMMLGGEEPAVVVRGAGSAPFSPSTSSSSSSASPHERRPAPPESKENNVSLDLSL

SEQ ID NO: 1279 - DNA, 810 bp, Sorghum bicolor
  misc_feature: Ceres ANNOT ID no. 6014967
  misc_feature: Encodes the peptide sequence at SEQ ID NO 1280
atggcggcggcggtggcgagcatcgggatcatggacggcgcctacttcgtcgggaggggcgagatcctgcactggatcaatgccaccctccagctctccctcgccaaggtcgaggaggcggcgtctggggccgtgcagtgccagctgatggatatggttcaccctggagtggtgccgatgcataaggttaattttgatgcgaagacagagtatgatatgatccagaactacaaggttcttcaggatgtgttcaacaagctgcgtataggcaagaatattgaggtcaacaagcttgttaaaggacggccattggacaacttggagttccttcagtggttgaaaagatattgtgattctgtgaatggtggaatcatgaacgaaaactacagtcctgtagaaaggaggtctaagggatgcaaagaacgtggctcaaagggctccaataagacatctaaatcattgcaagccaataggcttcctggtgctgattcagcagatggaggccctggagttggaaaagtatgtaacactttttctgaagagcattacatagaacagattcagaagctgtctgagaagattgcagatctgaaagtttctgttgatagtattgaaaaagaaagggacttctacttctcaaagttgcgtgatattgagatactgtgtcaacggcctgagttagagcatttaccgatgactaaggcagtccggaagatactttatgcagctgatgcaaaggattcaccgctacctgaggcgaacgacataatcaccaagtcgccaagcttgttctcaactgaaaccgagtga

SEQ ID NO: 1280 - protein, 269 aa, Sorghum bicolor
  misc_feature: Ceres ANNOT ID no. 6014967
  misc_feature (203)..(250): Pfam Id: EB1 Pfam Desc: EB1-like C-terminal motif
  misc_feature (17)..(118): Pfam Id: CH Pfam Desc: Calponin homology (CH) domain
  misc_feature (2)..(267): NCBI GI: 90399108 NCBI Desc: h0423h10.8 [oryza sativa (indica cultivar-group)]
  misc_feature (2)..(267): NCBI GI: 38347318 NCBI Desc: osjnba0063c18.9 [oryza sativa (japonica cultivar-group)]
  misc_feature (2)..(267): NCBI GI: 115460892 NCBI Desc: os04g0642100 [oryza sativa (japonica cultivar-group)]
  misc_feature (7)..(269): NCBI GI: 21536831 NCBI Desc: microtubule-associated protein eb1-like protein [arabidopsis thaliana]
  misc_feature (7)..(260): NCBI GI: 92892433 NCBI Desc: microtubule-associated protein eb1-like protein [medicago truncatula]
MAAAVASIGIMDGAYFVGRGEILHWINATLQLSLAKVEEAASGAVQCQLMDMVHPGVVPMHKVNFDAKTEYDMIQNYKVLQDVFNKLRIGKNIEVNKLVKGRPLDNLEFLQWLKRYCDSVNGGIMNENYSPVERRSKGCKERGSKGSNKTSKSLQANRLPGADSADGGPGVGKVCNTFSEEHYIEQIQKLSEKIADLKVSVDSIEKERDFYFSKLRDIEILCQRPELEHLPMTKAVRKILYAADAKDSPLPEANDIITKSPSLFSTETE

SEQ ID NO: 1281 - DNA, 1626 bp, Sorghum bicolor
  misc_feature: Ceres ANNOT ID no. 6014970
  misc_feature: Encodes the peptide sequence at SEQ ID NO 1282
atgccgccgcctctccaggcccaccgcctcctcatctcccaccgccgcctcccctctcccgctcgccgccggttcaccgccgcgtcttccctccaatccgctcccgccacaaccctggccccgggtcccgccacatcctccatcctctccatccgcgagtcgctcctttccggcgagaggacagcggcggacatcacctccgagtacctctcccgcctccgccgtaccgagccgagcttgcgcagcttcatccacgtcgcggacgccgccgccgagcgggaggcggaggaactcgaccggaggattgcgtccggggagaaggatgcggtggggccgctcgctggagtgctggtgggagtgaaggacaacctctgcaccgccaacatgccctccacgggcgggtcgcggatactagacgggtaccggccggcgtacgacgccacggccgtgcggcggctgcaggaggccggcgctattgtggtggggaagacgaacctcgacgaattcggaatggggagcaccaccgagggctccgcgtttcaggtgacgacaaacccgtgggatgattcacgtgtgcctgggggatcctctggtggttctgcttctgcggtatctgctaggcaatgtgtagtgtcactaggaagcgacacaggggggagtgtgagacaaccagcgtcattttgcggtgtagtggggttgaagccaacttatggtcgggtttctcgttttggtctcatggcctatgcttcatcgctggatgttgtgggatgctttggttcatctgtttttgacactgcaaccatcttatctgttgttgctggccatgacaagatggactcaaccagcagttcacaggttgttccagactatgcatcggagttggtctccctagatttactagaatcaaaaccattggctggtctgagaattgggattatacaagaaactcttggagaaggtgttgccaacggagtcatatcatcaatcaagggtgctgcttcacacctggagcagttgggatctgtagtggaagaggtttcactgccttcattttctcttggcttaccagcatattacatactagcctcatctgaagcttcttctaatctatcacgctatgatggtatcaggtatggaagacagttttcagctgatgacttgaatgagctttatggagagtccagggctaatggtttgggtcatgaggtcaaaatgagaattttgatgggaacctatgctctttctgccgggtactatgatgcatactacaaacgagcacaacaggtgaggacactggttaaggaaagcttcaaagatgctttggaaagatatgacattctaatttcaccagctgcgccatcagcagcctacaagataggtgaaaagataaatgatccattagccatgtacgcaggagatatcttgacggtgaatgttaatttggcgggtcttcctgcattggttgtgccttgtggatttgttgaaggtggacctgcagggctcccagttggacttcagctgatcggatctccattctgtgaggggaatttgctgagagtaggccacatctttgagcagactcttcagaatctcagctttgttccaccgttgttggcagagagctag

SEQ ID NO: 1282 - protein, 541 aa, Sorghum bicolor
  misc_feature: Ceres ANNOT ID no. 6014970
  misc_feature (64)..(518): Pfam Id: Amidase Pfam Desc: Amidase
  misc_feature (1)..(514): NCBI GI: 115460898 NCBI Desc: os04g0643200 [oryza sativa (japonica cultivar-group)]
  misc_feature (1)..(494): NCBI GI: 38347327 NCBI Desc: osjnba0063c18.18 [oryza sativa (japonica cultivar-group)]
  misc_feature (23)..(539): NCBI GI: 11078533 NCBI Desc: glu-trna(gln) amidotransferase subunit a [arabidopsis thaliana]
  misc_feature (46)..(527): NCBI GI: 17228548 NCBI Desc: glutamyl-trna (gln) amidotransferase subunit a [nostoc sp. pcc 7120]
  misc_feature (46)..(527): NCBI GI: 75909951 NCBI Desc: glutamyl-trna(gln) amidotransferase a subunit [anabaena variabilis atcc 29413]
MPPPLQAHRLLISHRRLPSPARRRFTAASSLQSAPATTLAPGPATSSILSIRESLLSGERTAADITSEYLSRLRRTEPSLRSFIHVADAAAEREAEELDRRIASGEKDAVGPLAGVLVGVKDNLCTANMPSTGGSRILDGYRPAYDATAVRRLQEAGAIVVGKTNLDEFGMGSTTEGSAFQVTTNPWDDSRVPGGSSGGSASAVSARQCVVSLGSDTGGSVRQPASFCGVVGLKPTYGRVSRFGLMAYASSLDVVGCFGSSVFDTATILSVVAGHDKMDSTSSSQVVPDYASELVSLDLLESKPLAGLRIGIIQETLGEGVANGVISSIKGAASHLEQLGSVVEEVSLPSFSLGLPAYYILASSEASSNLSRYDGIRYGRQFSADDLNELYGESRANGLGHEVKMRILMGTYALSAGYYDAYYKRAQQVRTLVKESFKDALERYDILISPAAPSAAYKIGEKINDPLAMYAGDILTVNVNLAGLPALVVPCGFVEGGPAGLPVGLQLIGSPFCEGNLLRVGHIFEQTLQNLSFVPPLLAES

SEQ ID NO: 1283 - DNA, 810 bp, Sorghum bicolor
  misc_feature: Ceres ANNOT ID no. 6014971
  misc_feature: Encodes the peptide sequence at SEQ ID NO 1284
atggctgggcagaaccagcgcctcaacgtcgtgccgacagtgacgatgctcggcgtcatgaaggcccggctcgtcggcgcgacccgcggccacgcgctgctgaagaagaagtccgacgcgctgacggtccagttccgcgccatcctcaagaagatcgtcgccgccaaggagtccatgggcgagacgatgcgcgcctcctccttctccctagccgaggccaagtacgtcgccggcgacggcgtccgccacgtcgtcctccagtccgtccgcgccgcgtccgtccgcgtccggtcccaccaggagaacgtggccggggtcaagctccccaagttcacccacttcgtagaccctgccgcggcctccgggggcccatccaacgcgtccccgagcctcacgggcctggcccgcggcgggcagcaggtcgccgcctgccgcgccgcgcacgtcaaggccatcgaggtgctcgtcgagctcgcctcgctgcagacctccttcctcacgctcgacgaggccatcaagaccaccaaccgccgcgtcaacgcgctcgagaacgtcgtcaagcccaggatcgagaacaccatcagctacatcaagggggagcttgacgagctcgagcgcgaggacttcttcaggctcaagaagatccagggctacaagaagagggagatcgagcgccagatggctgccgccaagctgttcgcagaggaacagctcgccgaggatctcgcgcttaagaggggcatctccgtgggggctgcggcaaatctgctggttgctggtggggaaaaggatgacgacatcatcttctga

SEQ ID NO: 1284 - protein, 269 aa, Sorghum bicolor
  misc_feature: Ceres ANNOT ID no. 6014971
  misc_feature (15)..(220): Pfam Id: ATP-synt_D Pfam Desc: ATP synthase subunit D
  misc_feature (1)..(269): NCBI GI: 90399277 NCBI Desc: h0306f03.5 [oryza sativa (indica cultivar-group)]
  misc_feature (1)..(269): NCBI GI: 38347326 NCBI Desc: osjnba0063c18.17 [oryza sativa (japonica cultivar-group)]
  misc_feature (1)..(269): NCBI GI: 115460896 NCBI Desc: os04g0643100 [oryza sativa (japonica cultivar-group)]
  misc_feature (1)..(269): NCBI GI: 5360953 NCBI Desc: v-atpase subunit d [arabidopsis thaliana]
  misc_feature (1)..(269): NCBI GI: 21700909 NCBI Desc: at3g58730/t20n10_80 [arabidopsis thaliana]
  misc_feature (1)..(269): SWISSPROT Homolog: EC 3.6.3.14 Vacuolar ATP synthase subunit D
MAGQNQRLNVVPTVTMLGVMKARLVGATRGHALLKKKSDALTVQFRAILKKIVAAKESMGETMRASSFSLAEAKYVAGDGVRHVVLQSVRAASVRVRSHQENVAGVKLPKFTHFVDPAAASGGPSNASPSLTGLARGGQQVAACRAAHVKAIEVLVELASLQTSFLTLDEAIKTTNRRVNALENVVKPRIENTISYIKGELDELEREDFFRLKKIQGYKKREIERQMAAAKLFAEEQLAEDLALKRGISVGAAANLLVAGGEKDDDIIF

SEQ ID NO: 1285 - DNA, 2166 bp, Sorghum bicolor
  misc_feature: Ceres ANNOT ID no. 6014974
  misc_feature: Encodes the peptide sequence at SEQ ID NO 1286
atgatgtttgacagtgctcaaaatgctcaatatggacacagagagtttattaggctggacgagtcaagtcctagatcatctgtaccttctgaagtgggaggcaggagtaccttgaggttcagcatgcctggatttggttatggttcatttaatgcactaaggtctttcttgtcaggggtccggaagggctctggaagactgaagtcatttagacagtcacttacatctggtgctcctaagacagcttttgcggaagatcttaaatcatataagagaaatatattcgatccccaggacaaacttctctttcaaatgaactgggttttcttctcgtcttgtctttttgctgttgcagtggatccactattcttctttctacccatcatcaacactccaaactgcattggtatagataaaaaattggcactgacatcaacaataatacggacggttattgattttgtctaccttatacgtgtgtgtcttcaattccgcactgcttatgtcgccccgtcttctcgagtgtttggaactggcgagcttgtgattgatccaatgctaatagcaaagcgatacattaaaagttactttgcgatggacgttgttgcattgctaccacttccacagattgttgtttggagatatctccacattccagatggcccagacgtactgactacgaaaactgcactggtttgggttgttttgattcagtacattccaaggttgtttcgaatattccctgtcaccacagatttgaaaagaacagctggtgtttttattgaaactgcttgggctggtgctgcttattatctgctatggtttatgcttgctggtcataatgttggtactttgtggtactttttaaccatagaacgtgaagatgactgctggcgtcagtactgtgatccaaatactggatgtaatagcagctacctgtattgcagtaataatcatccgggcagctatactagttggcttaatagtaatagtactcaagtattcagcatgtgcaatggcaatcaatcttatgctttcaactttggcatttatgagcaagcactggtctctggaatacttggtccaggaaattttatctcaaaattatgttattgcttctggtggggactgcaaaacctgagtacacttggtcaagggcttatgacaagcacatacactggagaagtgttattctctattgcaatatgtgtccttggactaattctttttgctctcctcattggtaacatgcagagctacctacaatctgttgctatacgccttgaagagatgagagttaagaaacgtgatgctgagcagtggatgcatcaccgttcactgccaccggaaatcagacatcgggtgaggaagtatgaacgttatcggtggttggaaaccaggggagtagatgaagaaagtttggttcaaactcttccgaaagatcttaggcgggatatcaagcgtcatctttgtttgggcttagtgaaaagggtgcctttgtttgaaaatatggatgaacggttattggatgcaatatgtgagcggttaagacctgcactctacacagaaaatgaattcattttgagagaaggtgatccggtggatgagatgcattttattcttcatggttgtttggagagtgtaaccactgatggtggacggagtggattctttaacaaggtccagctaaaggaaggatcattctgtggtgatgagttgctcacttgggcattagatcccaagtcagctgctaattttccagtttcaagcaggactgtcaaggcactcaccgaggttgaggcatttgccctatgtgcagaagagctgaaattcgtggccagtcagttcaggaggctgcacagcaggcaagtacaacacacattccgattctattcccagcaatggaggacctgggcagcttgcttcatccaagcggcatggcgccgttattacaagaggaagatggcagagcagcggcgcaaagaagaagaggcggcaagccggccaagtagtagtcaccctagccttggggcgactatctatgcatctcgttttgcagctaacgccatgcgaggggttcacaggctaagaagcaaggctgtccctaccattgtcaggctgccaaaacccccagagccagattttggtgtcgacgatgctgactaa

SEQ ID NO: 1286 - protein, 721 aa, Sorghum bicolor
  misc_feature: Ceres ANNOT ID no. 6014974
  misc_feature (148)..(417): Pfam Id: Ion_trans Pfam Desc: Ion transport protein
  misc_feature (518)..(618): Pfam Id: cNMP_binding Pfam Desc: Cyclic nucleotide-binding domain
  misc_feature (2)..(721): NCBI GI: 38344883 NCBI Desc: osjnba0033g05.7 [oryza sativa (japonica cultivar-group)]
  misc_feature (12)..(719): NCBI GI: 20197298 NCBI Desc: cyclic nucleotide and calmodulin-regulated ion channel [arabidopsis thaliana]
  misc_feature (12)..(718): NCBI GI: 9758363 NCBI Desc: cyclic nucleotide and calmodulin-regulated ion channel [arabidopsis thaliana]
  misc_feature (60)..(718): NCBI GI: 115454335 NCBI Desc: os03g0646300 [oryza sativa (japonica cultivar-group)]
  misc_feature (45)..(715): NCBI GI: 38503202 NCBI Desc: probable cyclic nucleotide-gated ion channel 10 (cyclic nucleotide-and calmodulin-regulated ion channel 10) (cam-regulated potassium ion channel)
  misc_feature: The sequence is a functional homolog of SEQ ID NO. 503 in the 11/188,298 US application
MMFDSAQNAQYGHREFIRLDESSPRSSVPSEVGGRSTLRFSMPGFGYGSFNALRSFLSGVRKGSGRLKSFRQSLTSGAPKTAFAEDLKSYKRNIFDPQDKLLFQMNWVFFSSCLFAVAVDPLFFFLPIINTPNCIGIDKKLALTSTIIRTVIDFVYLIRVCLQFRTAYVAPSSRVFGTGELVIDPMLIAKRYIKSYFAMDVVALLPLPQIVVWRYLHIPDGPDVLTTKTALVWVVLIQYIPRLFRIFPVTTDLKRTAGVFIETAWAGAAYYLLWFMLAGHNVGTLWYFLTIEREDDCWRQYCDPNTGCNSSYLYCSNNHPGSYTSWLNSNSTQVFSMCNGNQSYAFNFGIYEQALVSGILGPGNFISKLCYCFWWGLQNLSTLGQGLMTSTYTGEVLFSIAICVLGLILFALLIGNMQSYLQSVAIRLEEMRVKKRDAEQWMHHRSLPPEIRHRVRKYERYRWLETRGVDEESLVQTLPKDLRRDIKRHLCLGLVKRVPLFENMDERLLDAICERLRPALYTENEFILREGDPVDEMHFILHGCLESVTTDGGRSGFFNKVQLKEGSFCGDELLTWALDPKSAANFPVSSRTVKALTEVEAFALCAEELKFVASQFRRLHSRQVQHTFRFYSQQWRTWAACFIQAAWRRYYKRKMAEQRRKEEEAASRPSSSHPSLGATIYASRFAANAMRGVHRLRSKAVPTIVRLPKPPEPDFGVDDAD

SEQ ID NO: 1287 - DNA, 1731 bp, Sorghum bicolor
  misc_feature: Ceres ANNOT ID no. 6014980
  misc_feature: Encodes the peptide sequence at SEQ ID NO 1288
atggcgtcagaagaggtccccgcgccggcggcggatcgaattcgggtggtcggcaagtgggccggcgccctggaggtggacctgggcgcctggacggtgccgatgcttcgggcggaggtggcgcggcgggttggggacggcgtggggcctgagtgcgtcggcctcatcttcggcggccgcgtgctcaaggatgaaccccccgcctcgctgcgggaggccggacttaaggccaacgccaaggtgctctcctcccttacctcccccgatcgcgccaaagaaatcgccgccgaggccgccaaggccaaggctgaggaggagcacgctgcaaggcttgtcaggctgtgggaagctgcaaaagcattgtctcaaaggcacacggatggctcctaccttgcggaagaagactacaacttagatcttgaggatcaaagtggccagaaagtgatgtttggatctgtagatgataaaaaggctttgacgatggctctaatgcttcaccaaaaagctaaaactcagatgaagaggcaaatgtataaggaagccctagatgtgttaacaatggctgaggaagctttctccctttgtgacccaaagcttattgagaaagttgataatgtgccaatgcttcaactagatatagtatggtgttattttgtgcttcgtgatgtatcatgcttagaggtcgccgggactcgcctagaaaaagcacggttaggttttgaacgttctcatgggaaagattccactcgcttcagaatactccaggctggccgttatgtaaggctggagcttttggaaggagtggtggcataccataatggtcatgttgaaaaggcgcgtggatgtctcacttctgcccatgctaaatacctgcagcttcaagtaccagaggaagctatatcgatgttaatggatatgggctatgaaccacgatctgcaaaaagagcattgaagatgactggctatgatattcaatcatcagttgaactcttatgtgaggagcgtgaaaagaaatttcgtagaagagaggaggaccgagttagacaacgagagattctagaacaaatggcatatggtaaaactccaatgaacaaggcagttgacatgcagaagctgaaaggcttgactgctatcggatttgagaagtatcttgctgcagaagcactgcgcataaatgaaaatgatgctgacaaagcgttagaccttttgacaaatcctgaacaaaactgcatcctacaaagtaaaattcaggcaaagagaagccgggcatctcgtggatcatcgagctccagggcagctgttgccagggctgctccagcaatcaacaactctcagacttctgtcaatgatgtaccacatcctgctgatggagatgctccaccacatcctgcagatggaggagcaccacatcctgcggatggaggagatgctcctccacatgctgcagatggagatgcccctccacatgctgcagacggagatgcccctccgatgaacaatgaagaaactgcaaaccaagatgaaattatgattgatgaagtagctgccgatgatgaaaacgaaggcgcaaactctcatccagttccagccagggatgcgtcgatggaaagtgagcttgccaatgaactgacgggggatgccttggatgactacgatattgatgtcagtaacgaaggacaggctattgcagagtacttgagcctactggaggctgctcctagtagttcttag

SEQ ID NO: 1288 - protein, 576 aa, Sorghum bicolor
  misc_feature: Ceres ANNOT ID no. 6014980
  misc_feature (295)..(331): Pfam Id: UBA Pfam Desc: UBA/TS-N domain
  misc_feature (367)..(403): Pfam Id: UBA Pfam Desc: UBA/TS-N domain
  misc_feature (13)..(422): NCBI GI: 133778854 NCBI Desc: at2g12550 [arabidopsis thaliana]
  misc_feature (13)..(422): NCBI GI: 42569006 NCBI Desc: ubiquitin-associated (uba)/ts-n domain-containing protein [arabidopsis thaliana]
  misc_feature (116)..(403): NCBI GI: 24650084 NCBI Desc: cg5111-pa [drosophila melanogaster]
  misc_feature (116)..(403): NCBI GI: 21429718 NCBI Desc: at07671p [drosophila melanogaster]
  misc_feature (131)..(403): NCBI GI: 54642737 NCBI Desc: ga13736-pa [drosophila pseudoobscura]
MASEEVPAPAADRIRVVGKWAGALEVDLGAWTVPMLRAEVARRVGDGVGPECVGLIFGGRVLKDEPPASLREAGLKANAKVLSSLTSPDRAKEIAAEAAKAKAEEEHAARLVRLWEAAKALSQRHTDGSYLAEEDYNLDLEDQSGQKVMFGSVDDKKALTMALMLHQKAKTQMKRQMYKEALDVLTMAEEAFSLCDPKLIEKVDNVPMLQLDIVWCYFVLRDVSCLEVAGTRLEKARLGFERSHGKDSTRFRILQAGRYVRLELLEGVVAYHNGHVEKARGCLTSAHAKYLQLQVPEEAISMLMDMGYEPRSAKRALKMTGYDIQSSVELLCEEREKKFRRREEDRVRQREILEQMAYGKTPMNKAVDMQKLKGLTAIGFEKYLAAEALRINENDADKALDLLTNPEQNCILQSKIQAKRSRASRGSSSSRAAVARAAPAINNSQTSVNDVPHPADGDAPPHPADGGAPHPADGGDAPPHAADGDAPPHAADGDAPPMNNEETANQDEIMIDEVAADDENEGANSHPVPARDASMESELANELTGDALDDYDIDVSNEGQAIAEYLSLLEAAPSSS

SEQ ID NO: 1289 - DNA, 654 bp, Sorghum bicolor
  misc_feature: Ceres ANNOT ID no. 6014981
  misc_feature: Encodes the peptide sequence at SEQ ID NO 1290
atggagtccaccaagctctccgcgctgctggtgctcgccatgctcgcgctctcctcgtccccgctcgctctcgcgtgggagaaggcggagccggagtgccactcgtgcgagtccggctcgccaccctcgaccggcgtccccctgccccctatcagcataccgtcagtccccttgccgcctgtcagcataccgtcggtgcccctgccgcctgtcagtataccgtcggtccccatcccgaagctccccgtcccgcccgtcaccttaccccctgtcagcgggctgccgccggtcagcctcccgcccattccgatcatcggaggaagcccgacgaagaagggacaccggaaggcgtgcccgccgcctccgtctcccccgacgccgacgccgacgccgacaccgtcctcggacaagtgccccatcgacgcgctgaagctgggcgcgtgcgtggacgttctcgggaacgaggtgcacatcggcgacgccaacgtcaagtgctgcccactcgtgaagggcatcgccgggctctccgcggcggcgtgcctgtgcaccgccatcaaggccaaggtgctggacatctccgtctacgtgcccatcgcgctggaggtgctcgtcaactgcggctgcgccgtcccgccaggctacaaatgcacttaa

SEQ ID NO: 1290 - protein, 217 aa, Sorghum bicolor
  misc_feature: Ceres ANNOT ID no. 6014981
  misc_feature (138)..(216): Pfam Id: Tryp_alpha_amyl Pfam Desc: Protease inhibitor/seed storage/LTP family
  misc_feature (48)..(216): NCBI GI: 38344891 NCBI Desc: osjnba0033g05.15 [oryza sativa (japonica cultivar-group)]
  misc_feature (108)..(216): NCBI GI: 115460916 NCBI Desc: os04g0644400 [oryza sativa (japonica cultivar-group)]
  misc_feature (1)..(217): NCBI GI: 17154773 NCBI Desc: extensin-like protein [cucumis sativus]
  misc_feature (40)..(216): NCBI GI: 1155068 NCBI Desc: cell wall-plasma membrane linker protein [brassica napus]
  misc_feature (3)..(217): NCBI GI: 140068332 NCBI Desc: plant lipid transfer/seed storage/trypsin-alpha amylase inhibitor [medicago truncatula]
  misc_feature: Useful for making plants with modulated heat sensitivity
  misc_feature: GREAT-hit functional homolog of the protein sequence given in SEQ ID NO 13091
MESTKLSALLVLAMLALSSSPLALAWEKAEPECHSCESGSPPSTGVPLPPISIPSVPLPPVSIPSVPLPPVSIPSVPIPKLPVPPVTLPPVSGLPPVSLPPIPIIGGSPTKKGHRKACPPPPSPPTPTPTPTPSSDKCPIDALKLGACVDVLGNEVHIGDANVKCCPLVKGIAGLSAAACLCTAIKAKVLDISVYVPIALEVLVNCGCAVPPGYKCT

SEQ ID NO: 1291 - DNA, 387 bp, Sorghum bicolor
  misc_feature: Ceres ANNOT ID no. 6014982
  misc_feature: Encodes the peptide sequence at SEQ ID NO 1292
atggccgcccgccgacaagccaccgcggccgccaccctcgcgttcctcctcctcctctcagtctctgcagcgtcgtcgtcgccggcgctgccgacgacggcggcgtcgcgcaaggtgctgcactggaagctgagctgcccctgggacgcggtcaagttcggggcctgcgtcggcgtgctcggcgccgcgggcctgcaggccggcgcgcagctcgggagcaagtgctgcgacgtcgtgcaggggctcgcggcggccgaggcggccgcctgcttctgcaccaccgtcaaggagacagtgctcggcatccccacggagtgggacgtcggcgtcggcgtcttggccagcgcctgcaagacggagctgcccaacgggttcaagtgtctctga

SEQ ID NO: 1292 - protein, 128 aa, Sorghum bicolor
  misc_feature: Ceres ANNOT ID no. 6014982
  misc_feature (46)..(127): Pfam Id: Tryp_alpha_amyl Pfam Desc: Protease inhibitor/seed storage/LTP family
  misc_feature (24)..(127): NCBI GI: 508304 NCBI Desc: bimodular protein [medicago sativa]
  misc_feature (24)..(127): NCBI GI: 146141284 NCBI Desc: bimodular protein [medicago sativa subsp. falcata]
  misc_feature (46)..(127): NCBI GI: 8745402 NCBI Desc: proline-rich protein [glycine max]
  misc_feature (1)..(127): NCBI GI: 92873310 NCBI Desc: plant lipid transfer/seed storage/trypsin-alpha amylase inhibitor [medicago truncatula]
  misc_feature (1)..(127): NCBI GI: 10798758 NCBI Desc: p-rich protein nteig-c29 [nicotiana tabacum]
MAARRQATAAATLAFLLLLSVSAASSSPALPTTAASRKVLHWKLSCPWDAVKFGACVGVLGAAGLQAGAQLGSKCCDVVQGLAAAEAAACFCTTVKETVLGIPTEWDVGVGVLASACKTELPNGFKCL

SEQ ID NO: 1293 - DNA, 891 bp, Sorghum bicolor
  misc_feature: Ceres ANNOT ID no. 6014990
  misc_feature: Encodes the peptide sequence at SEQ ID NO 1294
atggcagcgtcgccgtcgccggaccacctcttcggcctgcgcaacagcttctacatcggcgcgtaccacgccgccatcaccagcagccagtccctccccgcgcacgcgctctcccccgacgacctcgtcgagcgcgacgccctcctctaccgctcctacatcgccatcggctcccaccagttggtgatcggcgagatcgggcccagcgcagccacgccgctccaggccgtcaagctgctcgccgtgtacctctccggcgacgccgggaacagggaatcggtggtctcgaggcttcgggagctcctgtcagatgcggctgttgggaccaatccgatcctacggttgatggccggcaccgtcttcatgcacgaacgcgattacgccgaggcactgaagcacaccagctccggtggcagcatggaactgcatgcgttgaatgttcagatataccttcaaatgaataggacagaccatgcagagaagcaactcagggtgatgcaacagctggacgaagaccacacgctgacgcagctcgccaatgcatggatcgaccttgtcatgggtggctccaagatccaagaagcgcacctcatcttccaggacttgtccgagaagtacccggcgacctgcacgattcttaacgggaaagccctgtgttcgatgcacatgggcaacttcgaggacgccgagggcttgctgctggagtcactgaacaaggacgccaaggatgctgaaactcttgcgaacctcacggtgtgcagcctcaacttgggaaaacctgcaacgcgctacctcaaccagttgaagctagcacagccagaccacgcgctggtgaagcgaatgtcctccgctgcagacagcttcgacagagcctgccaagcaatggcatga

SEQ ID NO: 1294 - protein, 296 aa, Sorghum bicolor
  misc_feature: Ceres ANNOT ID no. 6014990
  misc_feature (6)..(296): Pfam Id: Coatomer_E Pfam Desc: Coatomer epsilon subunit
  misc_feature (1)..(296): NCBI GI: 90399097 NCBI Desc: h0413e07.10 [oryza sativa (indica cultivar-group)]
  misc_feature (7)..(296): NCBI GI: 21593069 NCBI Desc: coatomer-like protein, epsilon subunit [arabidopsis thaliana]
  misc_feature (6)..(296): NCBI GI: 7677264 NCBI Desc: epsilon-cop [zea mays]
  misc_feature (6)..(294): NCBI GI: 56311392 NCBI Desc: coatomer epsilon subunit [medicago truncatula]
  misc_feature (6)..(296): NCBI GI: 7670062 NCBI Desc: epsilon1-cop [glycine max]
MAASPSPDHLFGLRNSFYIGAYHAAITSSQSLPAHALSPDDLVERDALLYRSYIAIGSHQLVIGEIGPSAATPLQAVKLLAVYLSGDAGNRESVVSRLRELLSDAAVGTNPILRLMAGTVFMHERDYAEALKHTSSGGSMELHALNVQIYLQMNRTDHAEKQLRVMQQLDEDHTLTQLANAWIDLVMGGSKIQEAHLIFQDLSEKYPATCTILNGKALCSMHMGNFEDAEGLLLESLNKDAKDAETLANLTVCSLNLGKPATRYLNQLKLAQPDHALVKRMSSAADSFDRACQAMA

SEQ ID NO: 1295 - DNA, 2445 bp, Sorghum bicolor
  misc_feature: Ceres ANNOT ID no. 6014991
  misc_feature: Encodes the peptide sequence at SEQ ID NO 1296
atggcgccgagggaccccaaggaggatggcttcggcgtcggtggcggcggcgcggcggatccggatgctgacatcgaggccccactgctggtctcctccggctcgtccttcctcctggacccggcgctcgaggacggcggcggcggcgacgaggaacagcgccggcgccggaggcggttcatccacggcagccacacgcactccaacaccacctcccaggtcgcgcttgtcggcaccgacgtctgccccatcgagagcctcgactacgagctgatcgaaaacgacgtgttcaagcaggactggagggcccggggaaggggccacatcctgcgctacgtggcgctcaagtgggccctctgcttcctcgtcggggccctcacggccgccgccggcttcgtcgccaacctcggcgtcgagaatgtcgccggcgccaagttcgtcgtcacctccaacctcatgttggacggcagacatgggtcggcgtttgcggtgttcctgtcgtccaactttgcgctcacgatgttagccacggtgctgacggtgtacgtggcgcctgcggctgccggatcggggatcccggaggtgaaggcctatttgaacggtgttgacgcccccaacatattctcactgaaaactctgatagtgaagattgtgggatgcattgcggcagtatcatcatcactgcatgtgggaaaagctgggccacttgtacacacaggcgcatgcattgcatcaatacttgggcaaggtgggtcacgtaaatatcatatgacatgtaggtggctcaggtacttcaagaatgatagggatcggagggaccttgttacttgtggttctgctgctggtattgctgctgctttccgggcgccggttggtggagtcctttttgccctggaaacagtatcttcatggtggaggagtgctctactatggcgagcctttttcacaacagcgatggtcgctgttgtgcttagggcattgatagacttctgtcaaagtgacaagtgtggcttatttgggaaaggtggccttataatgtttgatgtgacagcagattatgtcacctaccatttgattgatttacctccagtaatcactttaggggtttttggaggaatactggggagtttgtacaactttttcctggacaaggttctccgtctctacaaccttatcaatgagaaaggaaaaacttacaaactgctcctggctgcaacagtcactgtttgtacgtcgtgttgtctctttggcttgccatggattgctgcttgcaaaccttgtccaactgacactggagaagcttgtccatcgataggccgttctggtaatttcaagaaattccaatgtgcaatggatgaatacaatgatttggctagcctattcttcaacacaaatgatgacactattagaaacctctacagtgctggcactgacgatgaattccacatttcttccatccttgtgttctttgttgcatcatattttttgggcatcttcagctatggccttgctttaccatctggcctttttgtgccagttattttaactggtgcagcttatggccgtctggtaggcatgttgattgggtcacagtcaactttagatcatggtctttttgcagttcttggctctgctgctctgttaggtggatcaatgaggatgactgtttcagtttgtgttatcatcctagaactgactaataatctgcgaatgcttcctttggtaatgcttgtccttctcatatcaaaggtggtggcagatgctttcaatgcaaatgtctacgatttgcttgttagattgaaagggtttccacatcttgaaggatatgctgaaccatatatgaggcaattgtcagtcagtgatgttgtaactggtcctttacagacattcaatggcatagagaaggttggtcatatagtccatgtcttgaagacaactggtcataatggtttccctgtggttgacgagccaccgttttcagatactcctacattgtatggtctaattcttcgagaccacctgcttgttctattgaggaagaaggatttcatccatagttgctcagcttctacactgaaagcttcaaaccatttctcacatgctgagtttgctaaacgtggatcaggaaaacatgacaggattgaggacattgaattatgcccagaagaactggaaatgtttgtagacttgcatccattcacaaacacatctccatatactgtccttgagactatgtctttggctaaggctcttatacttttccgtgaagttggattgagacatcttttggttctaccaaaatcttcaaagagggcgcctgttgtcggcatactaacgaggcacgatttcatgcctgaacatatattgggccttcatcctttcctctttaagagcagatggaagaaggtgcgacttggcaaggtgaaagtcgccgacatattttga

SEQ ID NO: 1296 - protein, 814 aa, Sorghum bicolor
  misc_feature: Ceres ANNOT ID no. 6014991
  misc_feature (171)..(588): Pfam Id: Voltage_CLC Pfam Desc: Voltage gated chloride channel
  misc_feature (621)..(788): Pfam Id: CBS Pfam Desc: CBS domain pair
  misc_feature (1)..(807): NCBI GI: 82621733 NCBI Desc: chloride channel-like protein [oryza sativa (japonica cultivar-group)]
  misc_feature (1)..(807): NCBI GI: 38344896 NCBI Desc: osjnba0033g05.20 [oryza sativa (japonica cultivar-group)]
  misc_feature (51)..(804): NCBI GI: 92881659 NCBI Desc: cl- channel, voltage gated; imp dehydrogenase related 1 [medicago truncatula]
  misc_feature (33)..(795): NCBI GI: 48374433 NCBI Desc: chloride channel [zea mays]
  misc_feature (69)..(806): NCBI GI: 46390910 NCBI Desc: chloride channel [oryza sativa (japonica cultivar-group)]
  misc_feature: The sequence is a functional homolog of SEQ ID NO. 506 in the 11/188,298 US application
MAPRDPKEDGFGVGGGGAADPDADIEAPLLVSSGSSFLLDPALEDGGGGDEEQRRRRRRFIHGSHTHSNTTSQVALVGTDVCPIESLDYELIENDVFKQDWRARGRGHILRYVALKWALCFLVGALTAAAGFVANLGVENVAGAKFVVTSNLMLDGRHGSAFAVFLSSNFALTMLATVLTVYVAPAAAGSGIPEVKAYLNGVDAPNIFSLKTLIVKIVGCIAAVSSSLHVGKAGPLVHTGACIASILGQGGSRKYHMTCRWLRYFKNDRDRRDLVTCGSAAGIAAAFRAPVGGVLFALETVSSWWRSALLWRAFFTTAMVAVVLRALIDFCQSDKCGLFGKGGLIMFDVTADYVTYHLIDLPPVITLGVFGGILGSLYNFFLDKVLRLYNLINEKGKTYKLLLAATVTVCTSCCLFGLPWIAACKPCPTDTGEACPSIGRSGNFKKFQCAMDEYNDLASLFFNTNDDTIRNLYSAGTDDEFHISSILVFFVASYFLGIFSYGLALPSGLFVPVILTGAAYGRLVGMLIGSQSTLDHGLFAVLGSAALLGGSMRMTVSVCVIILELTNNLRMLPLVMLVLLISKVVADAFNANVYDLLVRLKGFPHLEGYAEPYMRQLSVSDVVTGPLQTFNGIEKVGHIVHVLKTTGHNGFPVVDEPPFSDTPTLYGLILRDHLLVLLRKKDFIHSCSASTLKASNHFSHAEFAKRGSGKHDRIEDIELCPEELEMFVDLHPFTNTSPYTVLETMSLAKALILFREVGLRHLLVLPKSSKRAPVVGILTRHDFMPEHILGLHPFLFKSRWKKVRLGKVKVADIF

SEQ ID NO: 1297 - DNA, 1731 bp, Sorghum bicolor
  misc_feature: Ceres ANNOT ID no. 6014993
  misc_feature: Encodes the peptide sequence at SEQ ID NO 1298
atggggttcttggtggggctggtattgggggtcgcggtgggagtagccatcatcatcggcttcgcccgctgcgagaactcgcgcgccgcccgtcgccgacggctggctgctaccattgctagtttctccaaaatgacgattgaggactcgcgaaagttactccccgccgacctatacccttcctgggttgttttctcatcgcagcaaaagttaaaatggcttaatcaggagctgacaaagatttggccgtctgtaaatgatgcggcatcagaactgatcaaaacctctgtagagcctgttcttgaacaatataggccaataatcctagcatccctgaagttctcaaaactcactcttggtactgttgcaccacagtttaccggtatttccatcattgagaatactaaggaatcaggtattgtcatggagctagagatgaattgggatgccaatccaagtatcatacttgctgtaaaaactagacttggtgttgtgcttccaatacaggtgaaggacattggctttacaggagttttccgcttgattttcaaaccactagttgaagagctaccttgctttggagctgtttgcttttctctacggcagaagaaaaagctggatttcagactgaaagtcattggtggcgaaatttcttctgtacctggaatttcagatgctcttgaggacactataaaaaatgctattgaagattcaattacatggccagtaaggaaagtcattcctattatacctggagattacagtgatctggaactgaagcctgttggtaccttggaagtcaagcttgtgcaggcaagagatttgacaaacaaagatctgataggaaaatcggatccttttgccattgtatatgtgcgcccattaccagacaaaatgaagagaagtaaaacaattaacaatgatctgaaccctatctggaatgaacactttgagtttactattgaagatgctgatactcagaatgtaaccgtgaagatttatgatgatgatggcattcaagaatctgaattgattggctgtgctcaagtcaggctgaaggatctacaaccaggcaaagtgaaggatgtctggttaaaacttgtaaaagatctggagattcaaagggacaggaaagatcggggtcaggtgcaccttgagctgctctattgtccatttgacatgaaggaagaagcaccaaatcctttcaaccaacagttttcgatgacttcattggagagaacaatgacaagcatggaaaatggatcagggggctctagttttgctaggctgtcttctagaaagaaaagggaaattatcatacgaggagttctttcagtaacagtgatatccggggaggatctgcctgcgatggatatgaatggaaaatctgacccatatgtagtactttctctcaagaagacaaagacaaagtacaagacaagggttgtgaacgaaagcttgaacccagtatggaatcagacttttgattttgtcgttgaagatggcttacatgacatgcttatgctggaagtatatgaccatgacacttttcgtagagattacatggggcggtgcatcctgaccttgacaaaagttttgctggaagaagagtacaaggaaagcttcaacctggagggagcaaagagtgggaagctgaacttgcatctgaagtggtcgccacaaccaatcatgcgtgattcgcgagaagtggacagcttaaggttcagataa

SEQ ID NO: 1298 - protein, 576 aa, Sorghum bicolor
  misc_feature: Ceres ANNOT ID no. 6014993
  misc_feature (265)..(349): Pfam Id: C2 Pfam Desc: C2 domain
  misc_feature (444)..(526): Pfam Id: C2 Pfam Desc: C2 domain
  misc_feature (1)..(576): NCBI GI: 38344897 NCBI Desc: osjnba0033g05.21 [oryza sativa (japonica cultivar-group)]
  misc_feature (1)..(567): NCBI GI: 92881657 NCBI Desc: c2 [medicago truncatula]
  misc_feature (1)..(567): NCBI GI: 117557355 NCBI Desc: ntermtm-c2type2.2 protein [arabidopsis thaliana]
  misc_feature (1)..(567): NCBI GI: 9795162 NCBI Desc: clb1-like protein [arabidopsis thaliana]
  misc_feature (64)..(571): NCBI GI: 115475792 NCBI Desc: os08g0300200 [oryza sativa (japonica cultivar-group)]
MGFLVGLVLGVAVGVAIIIGFARCENSRAARRRRLAATIASFSKMTIEDSRKLLPADLYPSWVVFSSQQKLKWLNQELTKIWPSVNDAASELIKTSVEPVLEQYRPIILASLKFSKLTLGTVAPQFTGISIIENTKESGIVMELEMNWDANPSIILAVKTRLGVVLPIQVKDIGFTGVFRLIFKPLVEELPCFGAVCFSLRQKKKLDFRLKVIGGEISSVPGISDALEDTIKNAIEDSITWPVRKVIPIIPGDYSDLELKPVGTLEVKLVQARDLTNKDLIGKSDPFAIVYVRPLPDKMKRSKTINNDLNPIWNEHFEFTIEDADTQNVTVKIYDDDGIQESELIGCAQVRLKDLQPGKVKDVWLKLVKDLEIQRDRKDRGQVHLELLYCPFDMKEEAPNPFNQQFSMTSLERTMTSMENGSGGSSFARLSSRKKREIIIRGVLSVTVISGEDLPAMDMNGKSDPYVVLSLKKTKTKYKTRVVNESLNPVWNQTFDFVVEDGLHDMLMLEVYDHDTFRRDYMGRCILTLTKVLLEEEYKESFNLEGAKSGKLNLHLKWSPQPIMRDSREVDSLRFR

SEQ ID NO: 1299 - DNA, 1572 bp, Sorghum bicolor
  misc_feature: Ceres ANNOT ID no. 6015011
  misc_feature: Encodes the peptide sequence at SEQ ID NO 1300
  misc_feature: Up-regulated in shoot tissues in response to salicylic acid treatment
atggcgggggaaggggaggaggtgtacgtggcggccatcgaccagggcaccaccagcaccaggttcatcgtctacgaccgccacgccaagcccgtcgcctcgcaccagctcgagttcacgcagcactacccggaggcagggtgggttgagcatgatcctatggagattatagagactgttatggtgtgtatgaatgaggcagttggcaaagccaaagatggtaaatacaatgtggttgctggtttgaaggccattgggatcacaaatcagagggaaaccactgttatgtggagtaaatccactggccatccactttataatgccattgtgtggatggatgctcgcacaagccccgtttgcaggagattagaaagtgagctatcaggcggtagaacccactttgtggagagatgtgggctgccaatcagtacctatttcagtgctctgaaattattatggttgatggaaaatgtggatgctgtcaaggatgcaatcaagactggtgacgccttatttggcacaatcgacacctggttgatttggaaccttactggaggtgttgctggtgggcagcatgtcacagattgctcaaatgcatctcgtacaatgcttatgaatctaaagacacttgactgggataagccaacacttgatgtgttaggagttcctgttgagattttgccaaagattatcagtaattcagagaaaattggtgtggtcgccaaagagttcccctttgcaggtgtccccatctcagggtgccttggagatcagcatgctgctatgcttgggcagttgtgcaagaagggtgaagcgaaaagcacctatggaactggtgccttcattcttcttaacacaggggaagaacctacccagtcctcccacggtcttcttagcactatcgcatataagcttggcccaactgcacccactaattatgcccttgaaggatccattgcaattgctggagcagcagttcagtggttgagggatagccttggaatcattcaaacagcagccgaaattgaaaagttggctgaaactgtaccggattcaggtggtgtatactttgtgccagcattcaatgggttgtttgcaccatggtggagggatgatgcaagggggatctgcattggaatcacaaggttcacgaataagggtcacattgctcgagcagtacttgagagtatgtcctttcaggtgaatgatgtccttagctccatgcacaaggatgctggagaggcgggagaagtaaagagtgcagaaggggaattcttgttgcgtgttgatggtggcgctactgttaataatcttctaatgcagattcaggctgatctattgggtagccctgttgtcagaccagctgacatagagacgacagcccttggagctgcatatgcagctggtttggccgctggagtctggacgaaggagcaagtattcgcaggtttgcacaaggagaacacgacggtcttccgcccaaaactggatgaggcccacaggaagaagcgagcagattcatggtacaaggcggtgtcaagatcatttgacttggctgatctttccctttaa

SEQ ID NO: 1300 - protein, 523 aa, Sorghum bicolor
  misc_feature: Ceres ANNOT ID no. 6015011
  misc_feature (9)..(264): Pfam Id: FGGY_N Pfam Desc: FGGY family of carbohydrate kinases, N-terminal domain
  misc_feature (267)..(502): Pfam Id: FGGY_C Pfam Desc: FGGY family of carbohydrate kinases, C-terminal domain
  misc_feature (6)..(523): NCBI GI: 90399352 NCBI Desc: h0811d08.16 [oryza sativa (indica cultivar-group)]
  misc_feature (6)..(523): NCBI GI: 115460942 NCBI Desc: os04g0647800 [oryza sativa (japonica cultivar-group)]
  misc_feature (1)..(523): NCBI GI: 40716075 NCBI Desc: glycerol kinase [pandanus amaryllifolius]
  misc_feature (6)..(523): NCBI GI: 117168061 NCBI Desc: at1g80460 [arabidopsis thaliana]
  misc_feature (6)..(523): NCBI GI: 40457263 NCBI Desc: glycerol kinase [glycine max]
  misc_feature (9)..(520): SWISSPROT Homolog: EC 2.7.1.30 Glycerol kinase
  misc_feature: Up-regulated in shoot tissues in response to salicylic acid treatment
MAGEGEEVYVAAIDQGTTSTRFIVYDRHAKPVASHQLEFTQHYPEAGWVEHDPMEIIETVMVCMNEAVGKAKDGKYNVVAGLKAIGITNQRETTVMWSKSTGHPLYNAIVWMDARTSPVCRRLESELSGGRTHFVERCGLPISTYFSALKLLWLMENVDAVKDAIKTGDALFGTIDTWLIWNLTGGVAGGQHVTDCSNASRTMLMNLKTLDWDKPTLDVLGVPVEILPKIISNSEKIGVVAKEFPFAGVPISGCLGDQHAAMLGQLCKKGEAKSTYGTGAFILLNTGEEPTQSSHGLLSTIAYKLGPTAPTNYALEGSIAIAGAAVQWLRDSLGIIQTAAEIEKLAETVPDSGGVYFVPAFNGLFAPWWRDDARGICIGITRFTNKGHIARAVLESMSFQVNDVLSSMHKDAGEAGEVKSAEGEFLLRVDGGATVNNLLMQIQADLLGSPVVRPADIETTALGAAYAAGLAAGVWTKEQVFAGLHKENTTVFRPKLDEAHRKKRADSWYKAVSRSFDLADLSL

SEQ ID NO: 1301 - DNA, 1635 bp, Sorghum bicolor
  misc_feature: Ceres ANNOT ID no. 6015015
  misc_feature: Encodes the peptide sequence at SEQ ID NO 1302
atgttcgtcctgcgaatccagtccgtcgacttccccgacgccgccgcgtccgcctccccggcagcagtcgccgccgacgaagtcggcaccagcagcggcggcgctgccacctcccatccgctctccccgctctccggccaccctcccccctctaccaccacatcgtctatacctcccctcgagctccccggcgcaatccccgccgcgcccggccgaagccctaggatcctccacacccgcggcgtcatccacctctaccactcgtcgtcgtccacctccacctcctcgtcctacgcctcggccgtcgcagccacctcttcctcctcgtccgtgccggccgccccgcagctcgcctccgactcgcacctcccggcatgtcgcggcactcgcctcctggtgctcgccgttccgacgcgcgtttcgccggacgactttgttcgcttctgcggtccctgcctcgaccgtgcctccgacattcgtttcatcagggatgatggagtggaggaccggtacagcgtccttgtggagtttgaggaccagaatagcgctgaaaggttctacgcggatctcaatggctggaggttctcaacctctgagcgagaggtgtgccatgttctgtttatagcttctgtgcagtatacaccttcctcagagcttgccacaacgccaccggctggatccactgagcttcccatgtgtcctgtttgcattgaaagattggatcaagacatcagtgggattttggcaactacttgtgatcactctttccaatgttcatgtgtttccgtgtgggccaattcatcctgtccggtatgccagttttgtcagaagcagtctgaaaattctacatgttctgtttgccaaaccactggaaacctctggatatgtgtgatatgtggttttgttggatgcggaaggtataaagaaggccacgcgaagcagcactggaaagacactcagcattgctattcgctagatttggaaacacagcgtgtttgggactatgttggtgacagttttgtacatcggctgaatcaatccaagagtgatgcaaagaatgctaagttcaaatcaaaatgtaaatattctggggatgactgtgtaaactgctcgtgcaatgatgactctgacatgggtggagctatgttcagcagcaaagatgaaacaattgtggatgagtacaatcgccttctggcaagtcaactcgaaactcagagagagtattatgagggcctgttgtctgaggctaaaagaaacaaggagcaccaaatttctgaagctgttgataaagctgtaaatgataagcttcaagagatgcaacttaagcttgagaaccttattgtggagaagaagaaagttgcagatatgaatgaaaaacttactaggagccaagacatgtggcgtcagacactaagagatatagaggaaagggaaaaagcacagttgaagtcgaaggacgaaatgattctcgatctggaagagcagataaaggatttcaaattttccatcaagctgcagaagtcaatagagaagaacgacggtgtcaagggtggtacgctggttccacttcctacggtttcagattctggaggcaagggtaaaaggtcatcaagaacaagcaagaggaggggttag

SEQ ID NO: 1302 - protein, 544 aa, Sorghum bicolor
  misc_feature: Ceres ANNOT ID no. 6015015
  misc_feature (284)..(355): Pfam Id: zf-UBP Pfam Desc: Zn-finger in ubiquitin-hydrolases and other protein
  misc_feature (116)..(226): Pfam Id: BRAP2 Pfam Desc: BRCA1-associated protein 2
  misc_feature (233)..(272): Pfam Id: zf-C3HC4 Pfam Desc: Zinc finger, C3HC4 type (RING finger)
  misc_feature (1)..(543): NCBI GI: 38345493 NCBI Desc: osjnba0010d21.6 [oryza sativa (japonica cultivar-group)]
  misc_feature (124)..(543): NCBI GI: 42569859 NCBI Desc: zinc finger (ubiquitin-hydrolase) domain-containing protein [arabidopsis thaliana]
  misc_feature (104)..(544): NCBI GI: 42569332 NCBI Desc: zinc finger (c3hc4-type ring finger) family protein [arabidopsis thaliana]
  misc_feature (1)..(455): NCBI GI: 90399133 NCBI Desc: h0821g03.13 [oryza sativa (indica cultivar-group)]
  misc_feature (88)..(391): NCBI GI: 49387526 NCBI Desc: brap2-like protein [oryza sativa (japonica cultivar-group)]
MFVLRIQSVDFPDAAASASPAAVAADEVGTSSGGAATSHPLSPLSGHPPPSTTTSSIPPLELPGAIPAAPGRSPRILHTRGVIHLYHSSSSTSTSSSYASAVAATSSSSSVPAAPQLASDSHLPACRGTRLLVLAVPTRVSPDDFVRFCGPCLDRASDIRFIRDDGVEDRYSVLVEFEDQNSAERFYADLNGWRFSTSEREVCHVLFIASVQYTPSSELATTPPAGSTELPMCPVCIERLDQDISGILATTCDHSFQCSCVSVWANSSCPVCQFCQKQSENSTCSVCQTTGNLWICVICGFVGCGRYKEGHAKQHWKDTQHCYSLDLETQRVWDYVGDSFVHRLNQSKSDAKNAKFKSKCKYSGDDCVNCSCNDDSDMGGAMFSSKDETIVDEYNRLLASQLETQREYYEGLLSEAKRNKEHQISEAVDKAVNDKLQEMQLKLENLIVEKKKVADMNEKLTRSQDMWRQTLRDIEEREKAQLKSKDEMILDLEEQIKDFKFSIKLQKSIEKNDGVKGGTLVPLPTVSDSGGKGKRSSRTSKRRG

SEQ ID NO: 1303 - DNA, 951 bp, Sorghum bicolor
  misc_feature: Ceres ANNOT ID no. 6015033
  misc_feature: Encodes the peptide sequence at SEQ ID NO 1304
atggagctccatttccagcagccaccacaaagccatccccagcagcagtacagcagctaccaacaaccgccagccaccacaaaggaaaccaagccaagaacgagaaccaagtgcggcagcggcggcggcggtggcggtggcagcggcagcaagtttgtgggcgtccggcagaggccatcggggaggtgggtggccgagatcaaggacaccacccagaagatccggatgtggctcggcacgttcgagaccgccgaggaggctgcccgggcctacgacgaggccgcctgtctcctccgaggtgccaacacgcgcaccaacttcgctgccgccggcgcgcacgcctcgccgccggactcaccgctcgcggcgaggatccgtggcatcctcaaccacaagaggatgaagaagaacgcgtcccagcagcacaccgtcaacttcttccccgctggggcgtaccatcgtgctgcaggagccgccgccaccgcagccagcaccactagcaccagcaccatcaccacgaccaccagtagcgtcagtccaagtagcagccctagctccagcatcgtcagcttcgccatgagcagccatggcgtccgcactcccatcctcccagctgctcaaagcatagctgaggaagcttacaggccgtacttggtcagtggaggaggcgaggagttccagctagccacacgacagtatgaacaacaatgggccctcaacaacaccagcataccaccttcggatggatgcgacatggctaatgagaatgcttgcttggtggtcgcagaggcggacaaggttaagctggagaagaagagctctgcgtcacaccatggcggcatggacagagttcaggacaaggatgtgtttgaggcgggaaacgatgcatctgactccttgtgggatctgccacctatctgcccactttcttgcaggtctttgatgtattag

SEQ ID NO: 1304 - protein, 316 aa, Sorghum bicolor
  misc_feature: Ceres ANNOT ID no. 6015033
  misc_feature (50)..(101): Pfam Id: AP2 Pfam Desc: AP2 domain
  misc_feature (20)..(170): NCBI GI: 124361009 NCBI Desc: pathogenesis-related transcriptional factor and erf [medicago truncatula]
  misc_feature (29)..(224): NCBI GI: 2281647 NCBI Desc: ap2 domain containing protein rap2.11 [arabidopsis thaliana]
  misc_feature (28)..(210): NCBI GI: 92881796 NCBI Desc: pathogenesis-related transcriptional factor and erf [medicago truncatula]
  misc_feature (43)..(158): NCBI GI: 92883004 NCBI Desc: pathogenesis-related transcriptional factor and erf [medicago truncatula]
  misc_feature (43)..(158): NCBI GI: 92869393 NCBI Desc: pathogenesis-related transcriptional factor and erf [medicago truncatula]
  misc_feature: The sequence is a functional homolog of SEQ ID NO 1054 in the 10/225,066US patent application
  misc_feature: The sequence is a functional homolog of SEQ ID NO 1302 in the 10/374,780US patent application
  misc_feature: The sequence is a functional homolog of SEQ ID NO 144 in the 10/412,699US patent application
  misc_feature: The sequence is a functional homolog of SEQ ID NO 1447 in the 10/412,699US patent application
  misc_feature: The sequence is a functional homolog of SEQ ID NO 150 in the 11/375,241US patent application
  misc_feature: The sequence is a functional homolog of SEQ ID NO 18 in the 10/412,699US patent application
  misc_feature: The sequence is a functional homolog of SEQ ID NO 2264 in the 10/374,780US patent application
  misc_feature: The sequence is a functional homolog of SEQ ID NO 908 in the 10/666,642US patent application
  misc_feature: The sequence is a functional homolog of SEQ ID NO 912 in the 11/435,388US patent application
  misc_feature: Useful for making plants with modulated growth and phenotype characteristics
  misc_feature: The sequence is a functional homolog of SEQ ID NO 144 in the 20040045049 US patent application
  misc_feature: The sequence is a functional homolog of SEQ ID NO 1447 in the 20040045049 US patent application
  misc_feature: The sequence is a functional homolog of SEQ ID NO 18 in the 20040045049 US patent application
MELHFQQPPQSHPQQQYSSYQQPPATTKETKPRTRTKCGSGGGGGGGSGSKFVGVRQRPSGRWVAEIKDTTQKIRMWLGTFETAEEAARAYDEAACLLRGANTRTNFAAAGAHASPPDSPLAARIRGILNHKRMKKNASQQHTVNFFPAGAYHRAAGAAATAASTTSTSTITTTTSSVSPSSSPSSSIVSFAMSSHGVRTPILPAAQSIAEEAYRPYLVSGGGEEFQLATRQYEQQWALNNTSIPPSDGCDMANENACLVVAEADKVKLEKKSSASHHGGMDRVQDKDVFEAGNDASDSLWDLPPICPLSCRSLMY

SEQ ID NO: 1305 - DNA, 1473 bp, Sorghum bicolor
  misc_feature: Ceres ANNOT ID no. 6015163
  misc_feature: Encodes the peptide sequence at SEQ ID NO 1306
  misc_feature: Down-regulated in shoot tissues in response to methyl jasmonate treatment
atgaacacgccactgcatgtcaagttcctcaagaccatgtacaggctcgtcgtcaacaacttcctcgtcgtcgtcgccttggccgtcgccgccgccgtggtcccgaggacgagccctcatgaggaggtgctcgcgctggtgcgggagatccggcctgtccactgtctgctggtcctgctcctggccgccgccgtcgccaagctgtggcgcatgggccggcccaaggacgtgtacctcgtggagtacggctgcttccggcccaagccctgcttccgagcgcccttcgcgacgtgcctggagcacgcgcacctgatgccgtacctggtggacgaggagagcgtcagcttcgccatccgcctgctggaacgctccgggctcggcgaggagacgtgcgtgccggaggcgtaccactacatgccgccagaccgcagcctcgaggcctcccgcgacgagacggagctggtcatcttctccgccgtggacgaggtgttcgccaggtcgagcgtgaggcccgaggagatcgacgtgctcatcgtcaactgcagcatcttcacgcccacgccggtgttcgccgacatggtcgtcaacaggtacaagcttcgagccgacgtgcagagcgtcaacctgtccgggatgggttgcagcgcggggctcgtctccgtcggcctcgccaagaacctcctgcagacggcacggccgggcacgcacgtcctcatcgtgtccacggagatcctctcgtcgcagtactacgtgggcacggagcgcgcgatgctgctccccaactgcctcttccgcatgggcgccgcggccatgatcctgtccaactcgtcggagcgcgcgcggtacaggctcacccgcctggtgcgcaccgtgacggcggcccgcgacgccgactaccggtgcgtgttccaggaggaggacgacaagggcaacactgggatccgtctctccaaggacctcgccaccaccgccgggcacgcgctcaagagcaacatcgccgcattcggacccctcgtcctgccggcctcggagcagctcctcgtcgcgctgtccttgctcaagcggaagctcctcagcgggcgcgccaaggtgaggctctaccgaccggacttccgcacggcgttcgagcacatctgcatccatgcaggcggccgcggggtgatcgacgaggtccagcatggcctcggcctctccgaccaggacgtggaggcgtcgcggatgacgctgcaccggttcgggaacacgtccagcagctccgtcatgtacgagctggcctacatcgaggccaaggggatgatgaaaaagggcgaccggatttggatgatctccttcggcgccggcttcgactgcaacagtgttgcgtgggagtgcgtcaagccgccggccgacgctgacgggccgtgggtcgactccatccaccgctacccggtgcagctcccggaaatcgtcaaggacacatctgatgactcctaa

SEQ ID NO: 1306 - protein, 490 aa, Sorghum bicolor
  misc_feature: Ceres ANNOT ID no. 6015163
  misc_feature (69)..(357): Pfam Id: FAE1_CUT1_RppA Pfam Desc: FAE1/Type III polyketide synthase-like protein
  misc_feature (375)..(457): Pfam Id: ACP_syn_III_C Pfam Desc: 3-Oxoacyl-[acyl-carrier-protein (ACP)] synthase III C terminal
  misc_feature (10)..(482): NCBI GI: 115437198 NCBI Desc: os01g0529800 [oryza sativa (japonica cultivar-group)]
  misc_feature (7)..(481): NCBI GI: 115448487 NCBI Desc: os02g0731900 [oryza sativa (japonica cultivar-group)]
  misc_feature (4)..(488): NCBI GI: 115467464 NCBI Desc: os06g0263400 [oryza sativa (japonica cultivar-group)]
  misc_feature (7)..(484): NCBI GI: 74273645 NCBI Desc: 3-ketoacyl-coa synthase [gossypium hirsutum]
  misc_feature (57)..(487): NCBI GI: 116317876 NCBI Desc: h0207b04.6 [oryza sativa (indica cultivar-group)]
  misc_feature: Down-regulated in shoot tissues in response to methyl jasmonate treatment
MNTPLHVKFLKTMYRLVVNNFLVVVALAVAAAVVPRTSPHEEVLALVREIRPVHCLLVLLLAAAVAKLWRMGRPKDVYLVEYGCFRPKPCFRAPFATCLEHAHLMPYLVDEESVSFAIRLLERSGLGEETCVPEAYHYMPPDRSLEASRDETELVIFSAVDEVFARSSVRPEEIDVLIVNCSIFTPTPVFADMVVNRYKLRADVQSVNLSGMGCSAGLVSVGLAKNLLQTARPGTHVLIVSTEILSSQYYVGTERAMLLPNCLFRMGAAAMILSNSSERARYRLTRLVRTVTAARDADYRCVFQEEDDKGNTGIRLSKDLATTAGHALKSNIAAFGPLVLPASEQLLVALSLLKRKLLSGRAKVRLYRPDFRTAFEHICIHAGGRGVIDEVQHGLGLSDQDVEASRMTLHRFGNTSSSSVMYELAYIEAKGMMKKGDRIWMISFGAGFDCNSVAWECVKPPADADGPWVDSIHRYPVQLPEIVKDTSDDS

SEQ ID NO: 1307 - DNA, 3624 bp, Sorghum bicolor
  misc_feature: Ceres ANNOT ID no. 6015296
  misc_feature: Encodes the peptide sequence at SEQ ID NO 1308
  misc_feature: Down-regulated in root tissues in response to salicylic acid treatment
atgggatcgctgcggggcgcggcagccccgtccccggcgccgcgcgcgggcgacctggtgaccacgcaggttagcctgggcggatttgacgccaccgtcaaggcgctcgatcttgccgactttctcgagttgaaggcgggcttggtctggcgctgccgcgtcaagacctcctggaccccgccggacgcctatcccgacttccttctccccaccgtcacctccgccgccgcgcagccgccacagtacgatcgcgtgcctccgcacgccttcgtccactttgcgcgcccggagggcgcgcgcgccgccgccgacgcagcggggcggtccgagctcatcctctccgggaaacccctgcgcgccgcctccgcgcaggagagctcccttcgggcctcccgccgccgcagtgtctcgccattccgcttccctggctcacgcctcgaggtcggggatctcccggccaaggacgccttcctcgccgcctggcgcggtccggcctctgggctcgagttctccgtcgatccgttcgacgggtcttgccgcctcatcttcgcccgcgacaccgcattcaaagtccgggagttccgcgagtctgtggtcatgcgctgcgacgtcaagctcgagttccccgtacgcgacgtcgccgaagtcagggtgttccggctcgactgctcgctgctgatccggctgtcggcggcaccgctggtttattaccgcacggcggacgacgacatccacgagtccgtgccgttcgacctgctcgacgacgatgacccgtggatacggaccacggacatcacccccagtggcgcgattgggcggtgcggcgcgtatagaatcacattctcgccgcgcttctggccaaagatggaacgcgcgctggcgtacatgagggataggagggtgccgatcgttgattgcggtggtggttggggggccaggaggggcctcaccgtgcgagatgagcctgagtttggggagcgaatgcaggacctgttcttctgcgtgcagcactccgagggtctcaagtttccggtgttgttcctcgtgaatgctctggtgcacaagggagtaataaatcaacaccacctcacgcctgaattcttcggcttgctccagaggaaggaggatgatgtgaatgtggctgctttgagggaattttggggggacaaatttccagtttttgatgcatgtggcaggctgaagaatctgcaagatagggttgccaggtaccccaaacttcttcgcaacaagattggggatgacaattcagaggtgaggaggctggtagtcacgcccaccaaagcttattgcctgccaccagaagtggagcgctctaatcgtgtcatccgtcattatcgtgaagtcacagacagatttctcagggttacttttatggatgagggtatgcagctactgaacagtaatgtgctgaatttctctgctgcgcaaattgtcaaagatttgatgtcaaactcgttcctgcataagacaacagtgtacaagcgtattaaaacatttttgacagagggattccacatgtgtggtaggaagtactcatttcttgcattctcatcgaaccagctgagggacaggtcagcttggttcttcgcagaggacagaatgagaacagtggaaaccattaggaaatggatggggcggttcacaagtaagaatgtagcaaagcacgctgctcggatggggcagtgcttctcatctacatatgctacagtggtgatgcagccgcatgaggtcaatgagtgtctcgaggaagttgaacgcaatgggtacattttctctgatggaattggcaagattacgtgtgaccttgcacttgaagttgctcagaagctgcgattgacagataatcccccatccgcttaccagattaggtatgcaggcttcaagggtgttatagctgtctgggaaggagaaaatgatgggatacgactttccctgaggccgagcatgcacaagtttgagtctaaccataatgtgttagaggtggtctcatggacaaagtttcagccaggattcttaaaccgtcagattattacattactgtcctccttgaatgtcccggatgctatcttttctcaaatgcaggaagccatgttgtctaatctcaataatattttgtcggacactgatgttgcttttgacattgtaaccacctcttgtgctgagcaaggaaacactgcagcactgatgttgagtgctggcatttcacctggaactgagccacacctgaaagcaatgctgttagctataaggtcctcacagctactgggtcttttggagaagacaaggatttttgtgccgaaggggaggtggttgatgggctgccttgatgaacttgggatccttgagcaaggacagtgctttatccgggcgtcatctccatcactcaataattgtctggtaaagcatggaccaagattttcctcagcaaacaaaaatgcagagaccattgtgggtactatcgtaatggcaaagaatccatgccttcatccaggggatgtccggatccttgaagctgttgatgtgcctgaactgcatcaccttgttgattgcttggtcttccccaagaaaggtgagaggccacatgccaatgaagcatctgggagtgatcttgatggggatctctactttgtgacatgggatgaaaaccttataccacctggcaaaaagagttggaaccctatggactactccccaactgaagcaaaacaactaccgcgcgcagtatccccacatgatattgttgatttcttcttgaagaacatggtaaatgagaaactgggtccaataagcaatgctcatgttgttcacgctgatatgagcgagtatggagcaatggatgagaagtgcattcagttggcagaactagcagcaactgctgtagacttccccaagactggcaaaattgtgtcaatgccaccatcccttcggccaaaattatatcctgacttcatgggaaaggaggatgccatctcctataaatcagagaagatccttggaaggctttatcggtcaatccaagaagcctccagtggtgatttggttccagaagaaacttgcacattaaacgatttgccttatgatgcagatatggaagttcctggtgcaactgattttctctcaagtgcttgggagtgcaagtgctcatatgaaacacaactgaatgcactgctcaaccaatatggtgtgcgcactgaagcagagcttgttacagagcacatatggtcgcttcccaaatacagcagcagaaaacagggggacataaaggagagattgaagaatgcatactctgctctccacaaggacttcaggagcattttcgaaagctttgttacagatcaaactgagatctctgatgatgagaaaattcggttttatgagatgaaggcctctgcatggtaccaggtaacctaccaccccaaatgggtccaaaagtcaagggaaatgctcaaacctgactttgaggacatgccagcaaggcttagctttgcatggatcggggtcgagcacctggcacggattaagataaggtgccatggagaagtgaaagtggacagccgaaggcccgttgagaggctcgcagcctacatatctgggagcatgtga

SEQ ID NO: 1308 - protein, 1207 aa, Sorghum bicolor
  misc_feature: Ceres ANNOT ID no. 6015296
  misc_feature (591)..(974): Pfam Id: RdRP Pfam Desc: RNA dependent RNA polymerase
  misc_feature (19)..(1204): NCBI GI: 92886759 NCBI Desc: rna-binding region rnp-1 (rna recognition motif); rna dependent rna polymerase [medicago truncatula]
  misc_feature (20)..(1204): NCBI GI: 8248473 NCBI Desc: rna-dependent rna polymerase [arabidopsis thaliana]
  misc_feature (823)..(1204): NCBI GI: 115437172 NCBI Desc: os01g0527600 [oryza sativa (japonica cultivar-group)]
  misc_feature (228)..(1164): NCBI GI: 113205254 NCBI Desc: rna dependent rna polymerase family protein [solanum demissum]
  misc_feature (203)..(1164): NCBI GI: 4038592 NCBI Desc: rna-directed rna polymerase [lycopersicon esculentum]
  misc_feature: Down-regulated in root tissues in response to salicylic acid treatment
MGSLRGAAAPSPAPRAGDLVTTQVSLGGFDATVKALDLADFLELKAGLVWRCRVKTSWTPPDAYPDFLLPTVTSAAAQPPQYDRVPPHAFVHFARPEGARAAADAAGRSELILSGKPLRAASAQESSLRASRRRSVSPFRFPGSRLEVGDLPAKDAFLAAWRGPASGLEFSVDPFDGSCRLIFARDTAFKVREFRESVVMRCDVKLEFPVRDVAEVRVFRLDCSLLIRLSAAPLVYYRTADDDIHESVPFDLLDDDDPWIRTTDITPSGAIGRCGAYRITFSPRFWPKMERALAYMRDRRVPIVDCGGGWGARRGLTVRDEPEFGERMQDLFFCVQHSEGLKFPVLFLVNALVHKGVINQHHLTPEFFGLLQRKEDDVNVAALREFWGDKFPVFDACGRLKNLQDRVARYPKLLRNKIGDDNSEVRRLVVTPTKAYCLPPEVERSNRVIRHYREVTDRFLRVTFMDEGMQLLNSNVLNFSAAQIVKDLMSNSFLHKTTVYKRIKTFLTEGFHMCGRKYSFLAFSSNQLRDRSAWFFAEDRMRTVETIRKWMGRFTSKNVAKHAARMGQCFSSTYATVVMQPHEVNECLEEVERNGYIFSDGIGKITCDLALEVAQKLRLTDNPPSAYQIRYAGFKGVIAVWEGENDGIRLSLRPSMHKFESNHNVLEVVSWTKFQPGFLNRQIITLLSSLNVPDAIFSQMQEAMLSNLNNILSDTDVAFDIVTTSCAEQGNTAALMLSAGISPGTEPHLKAMLLAIRSSQLLGLLEKTRIFVPKGRWLMGCLDELGILEQGQCFIRASSPSLNNCLVKHGPRFSSANKNAETIVGTIVMAKNPCLHPGDVRILEAVDVPELHHLVDCLVFPKKGERPHANEASGSDLDGDLYFVTWDENLIPPGKKSWNPMDYSPTEAKQLPRAVSPHDIVDFFLKNMVNEKLGPISNAHVVHADMSEYGAMDEKCIQLAELAATAVDFPKTGKIVSMPPSLRPKLYPDFMGKEDAISYKSEKILGRLYRSIQEASSGDLVPEETCTLNDLPYDADMEVPGATDFLSSAWECKCSYETQLNALLNQYGVRTEAELVTEHIWSLPKYSSRKQGDIKERLKNAYSALHKDFRSIFESFVTDQTEISDDEKIRFYEMKASAWYQVTYHPKWVQKSREMLKPDFEDMPARLSFAWIGVEHLARIKIRCHGEVKVDSRRPVERLAAYISGSM

SEQ ID NO: 1309 - DNA, 1911 bp, Sorghum bicolor
  misc_feature: Ceres ANNOT ID no. 6015298
  misc_feature: Encodes the peptide sequence at SEQ ID NO 1310
atggggcggcgccgccggttcgcgcagctggacgacgacgacgacgacgacgaagaggacgtgcccatcaagttcaagccctcgggtggtgcctcctcctcgggcgccaaccccaggaagccacagccgcagccgcagcagcgccgccgagtcgccgctgacgacgacgaggacgaggaggaagtggaactcgaggaggaagaggacgacgagaaggatctcgaggcgatgcgacgggccgaggaggaggagcgccgcgagcaggaggccgagacgaagacccgccgccgccggggacggcccaagcgccgccgcgacccggagagcgaggaggaggagcccgagaaggtggcgccgcaggaggaggagccccgcgaggaggagaacacggaggcggtgcccgtagctgtaggggacccggtcaaggtcaccggcaaggggaggaagcagaagaagcactacgcttccttcgagtacgagggcaacaccttcgagctggaggaccccgtgctgctcacgcctgaggacagcactgagaagccctatgtcgccatcctcaaggatataacagaaactgaggggagcctatatgtaactggccaatggttttatagaccagaagaggctgacaaaaaggagggtggatgctgggtagcacgagatacacgagagctattttacagttttcatattgatgatgtgcctgcagaatcagttatgcacaaatgtgtggtccatttcattcctcagcacaagcagattcccagtcgaaagcagcaccctggatttattgtccagaaggtctatgatgcagttgagaagaaactgtggaacctaacagacaaggactatgaggataacaagcaacaagagattgatctccttgttaagaaaacgatagaccgtattggtcagcttcctgatctcgaacctgaagagacacctcttgagaacaatttgtcaaataaacgaggcctgcgtaagaaacctgttaaccctatagatgtaacaagagaacctccagttggcaaatccgagcagtttgcaaaagcagagacacctggcagtgataagctaaggaattatgatatccttgttaggtataaagtacttacaggctatactaatcgtgataggtggctcgataaattggtagaaagtattccgcttgcatcaaaggagaatgctggaacctctgctgacgctgattctacagccaaaagtccaatcaatggttcacctgcaaaggatgttggttctgctgaacatgaaaaatcatatggacttgatgttgttgttgagataatggttgcattagaaaaatctgcatttgaagctcttggtacagattttgggaaatataaccagaaactgcgacaactacagttcaacatcaagaatagctccaaacttcgcaggaggctgatggacaaggagcttgatcctccagttcttttaaccatgtcccccgatgaattaaaggctggcttgacttcagcagagaaaacatctgaaccagaagaatcaaggaaattgcagatgactgataaaagatgtgaaagatgcagtgaaaagaaagttgtcatatctaatattatccatgcaggtcatggagaccgctatcagttggaatgtacttcctgtggctgcacatgtttttcgtccagagatgccattacaacactgacagaggatgccccaaccactgctgggaatgtgggtaccgcccccttggcaacagcaaagtttgaggtcgttgagaagcagctcacgagcccacgggaccaatcgggcaagcctgcttccgatgccctccggaagagcactgcagcttacatgccaactatggagaggcagaagtcgtttgttaagcccaaggatgaaccctcccctgcaccgaaacagggttag

SEQ ID NO: 1310 - protein, 636 aa, Sorghum bicolor
  misc_feature: Ceres ANNOT ID no. 6015298
  misc_feature (162)..(280): Pfam Id: BAH Pfam Desc: BAH domain
  misc_feature (68)..(514): NCBI GI: 92894209 NCBI Desc: bromo adjacent region; transcription elongation factor s-ii, central region [medicago truncatula]
  misc_feature (102)..(514): NCBI GI: 144924485 NCBI Desc: bromo adjacent region; transcription elongation factor s-ii, central region [medicago truncatula]
  misc_feature (2)..(146): NCBI GI: 30526291 NCBI Desc: latency associated nuclear antigen [saimiriine herpesvirus 2]
  misc_feature (8)..(201): NCBI GI: 109829212 NCBI Desc: fk506-binding protein 4 (peptidyl-prolyl cis-trans isomerase) (ppiase) (rotamase)
  misc_feature (18)..(151): NCBI GI: 16226131 NCBI Desc: smooth muscle caldesmon protein [oryctolagus cuniculus]
MGRRRRFAQLDDDDDDDEEDVPIKFKPSGGASSSGANPRKPQPQPQQRRRVAADDDEDEEEVELEEEEDDEKDLEAMRRAEEEERREQEAETKTRRRRGRPKRRRDPESEEEEPEKVAPQEEEPREEENTEAVPVAVGDPVKVTGKGRKQKKHYASFEYEGNTFELEDPVLLTPEDSTEKPYVAILKDITETEGSLYVTGQWFYRPEEADKKEGGCWVARDTRELFYSFHIDDVPAESVMHKCVVHFIPQHKQIPSRKQHPGFIVQKVYDAVEKKLWNLTDKDYEDNKQQEIDLLVKKTIDRIGQLPDLEPEETPLENNLSNKRGLRKKPVNPIDVTREPPVGKSEQFAKAETPGSDKLRNYDILVRYKVLTGYTNRDRWLDKLVESIPLASKENAGTSADADSTAKSPINGSPAKDVGSAEHEKSYGLDVVVEIMVALEKSAFEALGTDFGKYNQKLRQLQFNIKNSSKLRRRLMDKELDPPVLLTMSPDELKAGLTSAEKTSEPEESRKLQMTDKRCERCSEKKVVISNIIHAGHGDRYQLECTSCGCTCFSSRDAITTLTEDAPTTAGNVGTAPLATAKFEVVEKQLTSPRDQSGKPASDALRKSTAAYMPTMERQKSFVKPKDEPSPAPKQG

SEQ ID NO: 1311 - DNA, 1911 bp, Sorghum bicolor; identical to SEQ ID NO: 1309
  misc_feature: Ceres ANNOT ID no. 6015300
  misc_feature: Encodes the peptide sequence at SEQ ID NO 1312

SEQ ID NO: 1312 - protein, 636 aa, Sorghum bicolor; identical to SEQ ID NO: 1310
  misc_feature: Ceres ANNOT ID no. 6015300
  misc_feature (162)..(280): Pfam Id: BAH Pfam Desc: BAH domain
  misc_feature (68)..(514): NCBI GI: 92894209 NCBI Desc: bromo adjacent region; transcription elongation factor s-ii, central region [medicago truncatula]
  misc_feature (102)..(514): NCBI GI: 144924485 NCBI Desc: bromo adjacent region; transcription elongation factor s-ii, central region [medicago truncatula]
  misc_feature (2)..(146): NCBI GI: 30526291 NCBI Desc: latency associated nuclear antigen [saimiriine herpesvirus 2]
  misc_feature (8)..(201): NCBI GI: 109829212 NCBI Desc: fk506-binding protein 4 (peptidyl-prolyl cis-trans isomerase) (ppiase) (rotamase)
  misc_feature (18)..(151): NCBI GI: 16226131 NCBI Desc: smooth muscle caldesmon protein [oryctolagus cuniculus]

SEQ ID NO: 1313 - DNA, 1146 bp, Sorghum bicolor
  misc_feature: Ceres ANNOT ID no. 6015381
  misc_feature: Encodes the peptide sequence at SEQ ID NO 1314
atggatttcaaggggttctgggagtccagattcgggggcaagaaggagccggaggagcagaacgggcacgccaacgggagcgtgccgaagaggacctccgatttggcggtctacgagcagttcgagcagcaggccaggcagacccaggtccgagccgccgcgattcgcgatggaaacgctgatgtgatccagaagccccttctaccttcatttgagtcagctgaaatgcgtaatcttgcagagacattgttgagggatattattcgcgggagcccagatgtgaaatgggagagcatcaaaggactggaaaatgcaaaacgccttctaaaagaagctgttgtcatgcccataaagtacccaaaatacttcactggtcttctttctccctggaaaggcatcttactttttggccccccagggacaggaaagacaatgctggcaaaagcggttgctactgagtgcaaaaccaccttcttcaacatttcagcttcatcaattgtcagcaaatggcgtggagattcagagaagcttgtcaaagttctgtttgagcttgctaggcatcatgcaccatccacaatatttcttgatgaaatagatgccattatcagccagcgtggtgaagctcgtagtgagcatgaagctagtcgtcgcttgaagactgaactacttattcagatggatggtttgacaaagacaaacgacttggtatttgtacttgcagctacaaatcttccatgggaattggatgcagctatgctccgcaggcttgagaagcgaattcttgtaccgcttcctgaagctgaagcaaggcaagcaatgtttgaggaacttctgccagcgactacctcaaagttagaggttccgtacaacatactagttgaaaagactgaaggttactctggttcagatatccgtcttgtgtgcaaagaagctgccatgcaaccactcagacgtctcatgtcagttcttgaagccagtgatgagttggtgccagaggaagaactgcctgaggttggtcctctgaaacctgaagatattgaacttgcattaaggaacagtaggccgtcagcccatctccatgcacatcgctatgagaagttcaaccaggactatggtagccaggtcctttgttcagagtcagcatga

SEQ ID NO: 1314 - protein, 381 aa, Sorghum bicolor
  misc_feature: Ceres ANNOT ID no. 6015381
  misc_feature (132)..(317): Pfam Id: AAA Pfam Desc: ATPase family associated with various cellular activities(AAA)
  misc_feature (1)..(381): NCBI GI: 32352152 NCBI Desc: katanin [oryza sativa (japonica cultivar-group)]
  misc_feature (23)..(376): NCBI GI: 56201915 NCBI Desc: vacuolar protein sorting factor 4b-like [oryza sativa (japonica cultivar-group)]
  misc_feature (27)..(376): NCBI GI: 115439107 NCBI Desc: os01g0673500 [oryza sativa (japonica cultivar-group)]
  misc_feature (2)..(376): NCBI GI: 92889962 NCBI Desc: aaa atpase [medicago truncatula]
  misc_feature (68)..(335): NCBI GI: 89288960 NCBI Desc: atpase, aaa family protein [tetrahymena thermophila sb210]
  misc_feature (77)..(373): SWISSPROT Homolog: EC 3.6.4.3 Katanin p60 ATPase-containing subunit
  misc_feature: The sequence is a functional homolog of SEQ ID NO. 471 in the 11/188,298 US application
  misc_feature: The sequence is a functional homolog of SEQ ID NO. 462 in the 11/188,298 US application
MDFKGFWESRFGGKKEPEEQNGHANGSVPKRTSDLAVYEQFEQQARQTQVRAAAIRDGNADVIQKPLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARQAMFEELLPATTSKLEVPYNILVEKTEGYSGSDIRLVCKEAAMQPLRRLMSVLEASDELVPEEELPEVGPLKPEDIELALRNSRPSAHLHAHRYEKFNQDYGSQVLCSESA

SEQ ID NO: 1315 - DNA, 666 bp, Sorghum bicolor
  misc_feature: Ceres ANNOT ID no. 6015382
  misc_feature: Encodes the peptide sequence at SEQ ID NO 1316
atgtcggcggacgacctgcgatcggagctggacgagctgcggcggctggagggcctcgccaagcacccccgcgtccagaccctcctcgccaacgagatccgcaacgttgaggcaaagttggcgaaggcaaccgaaccgtcgccggagccactggcggcggcttccgcgcccgcgcccgcgcccgcccccgcggcgcgtcctgttttaaactacgtcacgttggggtcgttcagctgggaccaggacaacgagaagatcaagatatatgtctcccttgagggagttgagcaagagaaggtggagactactttcaagccaacatcagtagatgtaaagtttcatgatgtcaaaggcaagaattatcggtgtgctataccaaagctcaacaaggaaattgttcctgagaaatgtaaggttgtggtgaagccaacaaaggttattattacccttttcaaggcttctaaaggcaactggttagacttgcacttcaaggaagacaagttcaagccaagcatggacaaggaaaaggatccgatgtcaggaattatggacttaatgaagaacatgtatgaggaaggtgacgaggatatgaaacgcacaatagccaaagcttggtctgatgccaggtctgggaagacgactgattcactgagcggattacgttga

SEQ ID NO: 1316 - protein, 221 aa, Sorghum bicolor
  misc_feature: Ceres ANNOT ID no. 6015382
  misc_feature (75)..(152): Pfam Id: CS Pfam Desc: CS domain
  misc_feature (156)..(220): Pfam Id: SGS Pfam Desc: SGS domain
  misc_feature (3)..(221): NCBI GI: 85719369 NCBI Desc: sgs; hsp20-like chaperone [medicago truncatula]
  misc_feature (5)..(209): NCBI GI: 28302307 NCBI Desc: sip-prov protein [xenopus laevis]
  misc_feature (4)..(209): NCBI GI: 50926902 NCBI Desc: similar to calcyclin binding protein [rattus norvegicus]
  misc_feature (4)..(209): NCBI GI: 3142331 NCBI Desc: calcyclin binding protein [mus musculus]
  misc_feature (4)..(209): NCBI GI: 33468885 NCBI Desc: calcyclin binding protein [mus musculus]
MSADDLRSELDELRRLEGLAKHPRVQTLLANEIRNVEAKLAKATEPSPEPLAAASAPAPAPAPAARPVLNYVTLGSFSWDQDNEKIKIYVSLEGVEQEKVETTFKPTSVDVKFHDVKGKNYRCAIPKLNKEIVPEKCKVVVKPTKVIITLFKASKGNWLDLHFKEDKFKPSMDKEKDPMSGIMDLMKNMYEEGDEDMKRTIAKAWSDARSGKTTDSLSGLR

SEQ ID NO: 1317 - DNA, 891 bp, Sorghum bicolor
  misc_feature: Ceres ANNOT ID no. 6015385
  misc_feature: Encodes the peptide sequence at SEQ ID NO 1318
atgttttgcttgaggagctactggtcgcctgcatttgcttcaataaaggatgggcctgttcgacatcagataaagtttaattctgtagtggtttgtggtgtcaggggtccaagaccgagatatccccgtgtgtggaaaactcagaagaaaattgggactatttccaagtcacagaagcttgttgaatgtattaaaggtctgtctaatgtaaaggaggaagtttatggagcacttgactcatttgttgcatgggaactggagtttcccttgatagtagtaaagaaggcactgcagaaacttgagggcgaaaaggaatggaaacgaataattcaggtcattaaatggatgttcaacaaaggtcaagggaagacaatgggaagctattacaccttgttgaatgctttgatcgaggatggccggattgaggaagcagaagagttatttggaatggtattctcacgatatatggagggtttgcctcgtacatttttcatgagaatgatttctttctattacagtgtgggagcgtatgataagatgtttgagatttttgctgatatggaggaactaggtgtaagacctgatggttctattatcaggatgctaggtgatgtatttcagaagttagagatgatggacaaatatgaaaagttaaaaaagaaatacccaccaccaaaatgggaatatcgatacatcaaaggcaagcgcatcagaatgagagtttaccccgataataaaactgaagaggcgacaaaaggagaccctgacaccgatgaactcgaagaggtggaaagtatgcaccttaataatgaattggaagaagcaacaagctcaggccctgacaggagcgtattggatgatgtagcttctggagaccttggatatatatag

SEQ ID NO: 1318 - protein, 296 aa, Sorghum bicolor
  misc_feature: Ceres ANNOT ID no. 6015385
  misc_feature (1)..(183): NCBI GI: 115440033 NCBI Desc: os01g0757700 [oryza sativa (japonica cultivar-group)]
  misc_feature (2)..(242): NCBI GI: 18415213 NCBI Desc: pentatricopeptide (ppr) repeat-containing protein [arabidopsis thaliana]
  misc_feature (71)..(276): NCBI GI: 2494119 NCBI Desc: est gbt04104 comes from this gene. [arabidopsis thaliana]
MFCLRSYWSPAFASIKDGPVRHQIKFNSVVVCGVRGPRPRYPRVWKTQKKIGTISKSQKLVECIKGLSNVKEEVYGALDSFVAWELEFPLIVVKKALQKLEGEKEWKRIIQVIKWMFNKGQGKTMGSYYTLLNALIEDGRIEEAEELFGMVFSRYMEGLPRTFFMRMISFYYSVGAYDKMFEIFADMEELGVRPDGSIIRMLGDVFQKLEMMDKYEKLKKKYPPPKWEYRYIKGKRIRMRVYPDNKTEEATKGDPDTDELEEVESMHLNNELEEATSSGPDRSVLDDVASGDLGYI

SEQ ID NO: 1319 - DNA, 1905 bp, Sorghum bicolor
  misc_feature: Ceres ANNOT ID no. 6015386
  misc_feature: Encodes the peptide sequence at SEQ ID NO 1320
atgccggtggcgaggccggagccgcaggagccccgggtgatcgcccatgtcgacatggactgcttctacgttcaagtcgagcagcggaggaacccggcgctcaggggccagccgaccgccgtggtgcagtacaacgactggaaaggcggcggattgattgccgtcagctacgaggctcgtgggtttggtgtgaagaggtccatgcgcggagatgaggccaagagtgtctgtcctggtattaatctggttcaggtcccagtggcgcgtggcaaggccgaccttaatctttacagaagtgctggttctgaggttgttgcaatccttgcaagcaaagggaagtgcgagcgggcatccattgacgaagtttatcttgaccttactgatgcagcaaaggaaatgctcttacaagctcccccagactcacaagaggagatttttatggaggcagcaaagtcaaatatcttgggccttctgtctgatgccggagagaaggaaaagaacgtgagggcatggctttgtcgatcagacgctgattaccaggacaagttactggcatgtggagctattattgttgcacagttacgagtcagagttctggaggaaacccaattcacatgctctgctgggattgctcacaataagatgttagctaaacttgtcagtggaatgcacaagcctgctcaacaaactgttgtcccttcttcatcagttcaagactttctagcatcattacctcttggtggtaagcttggaagttccttgcaggatgatcttggggttgagaccattggtgatctcctaagttttacagaggataagttacaagagcagtatggagtaaatacaggcacatggttatggaagactgctaggggcattagtggggaagaagttgaggatcgtcttttacccaagagtcatgggtgtggaaagacatttcctggcccaagagcactgaagaacagcgcttctgtcaaaggctggctggatcaactctgtgaagaattaagtgaacggatccaatctgacctgaaccagaacaagagaattgctcaaacgctaactcttcatgccagagcatctaaggaaaatgaacgtgattcaacgaagaaattcccttccaaatcctgtcctttgcgctatgggactcggaaaattcaggaggatgcaatgaagctatttgaatctggtcttcacgagtttttagaatctcagaacactggatggagcataacatccctttctgttactgcaagcaaaatatttgatatacctagtggaacaagctcaatcttgagatacattaaaggtcctaattctgctgcacctccggctatacctgattcttcgtctgtacctgaggatccatctcttgacaacgatgtatttgtgaagccaattcatgaagaacaatgccagccatctacgtctgagaaagaagacaataatacacattctgtgtctacgatttcagctaaacaatgccaagcaaataaagaaaaaagaatatcaaagaagttgcctgaagttaagggaacttcctcgatattgaagtttctttcacggggtcaatctaccttccatgagaaaagaaaatctgatggactaatttgcagccatcaaggtttggtggactgtccagggagttcttcggaagcaaacaaagctgaagaaaacaatgtgcctgcggatgctgaggataggaaccacaccaacagttgtgctgaaccctctggcagtaacacatggatgttcaacattcaagacattgatccagcggtggtggaggaactgccaccagagatccaaagagaaatacaggggtgggtccgtccatcgaagcacccgagcacgaagagacgtggttctacaatttcttcgtacttcccacccgcaaggtcttag

SEQ ID NO: 1320 - protein, 634 aa, Sorghum bicolor
  misc_feature: Ceres ANNOT ID no. 6015386
  misc_feature (17)..(423): Pfam Id: IMS Pfam Desc: impB/mucB/samB family
  misc_feature (1)..(426): NCBI GI: 145281849 NCBI Desc: translesion synthesis dna polymerase eta splice variant [arabidopsis thaliana]
  misc_feature (104)..(489): NCBI GI: 2660675 NCBI Desc: similar to dna-damage-inducible protein p [arabidopsis thaliana]
  misc_feature (1)..(326): NCBI GI: 145281847 NCBI Desc: translesion synthesis dna polymerase eta splice variant [arabidopsis thaliana]
  misc_feature (7)..(457): NCBI GI: 60686908 NCBI Desc: dna polymerase eta [xenopus laevis]
  misc_feature (7)..(457): NCBI GI: 50417752 NCBI Desc: polh-prov protein [xenopus laevis]
MPVARPEPQEPRVIAHVDMDCFYVQVEQRRNPALRGQPTAVVQYNDWKGGGLIAVSYEARGFGVKRSMRGDEAKSVCPGINLVQVPVARGKADLNLYRSAGSEVVAILASKGKCERASIDEVYLDLTDAAKEMLLQAPPDSQEEIFMEAAKSNILGLLSDAGEKEKNVRAWLCRSDADYQDKLLACGAIIVAQLRVRVLEETQFTCSAGIAHNKMLAKLVSGMHKPAQQTVVPSSSVQDFLASLPLGGKLGSSLQDDLGVETIGDLLSFTEDKLQEQYGVNTGTWLWKTARGISGEEVEDRLLPKSHGCGKTFPGPRALKNSASVKGWLDQLCEELSERIQSDLNQNKRIAQTLTLHARASKENERDSTKKFPSKSCPLRYGTRKIQEDAMKLFESGLHEFLESQNTGWSITSLSVTASKIFDIPSGTSSILRYIKGPNSAAPPAIPDSSSVPEDPSLDNDVFVKPIHEEQCQPSTSEKEDNNTHSVSTISAKQCQANKEKRISKKLPEVKGTSSILKFLSRGQSTFHEKRKSDGLICSHQGLVDCPGSSSEANKAEENNVPADAEDRNHTNSCAEPSGSNTWMFNIQDIDPAVVEELPPEIQREIQGWVRPSKHPSTKRRGSTISSYFPPARS

SEQ ID NO: 1321 - DNA, 2868 bp, Sorghum bicolor
  misc_feature: Ceres ANNOT ID no. 6015392
  misc_feature: Encodes the peptide sequence at SEQ ID NO 1322
atggcgcgcaatgcggtggacaaggcgacgtccatcgacgcgcagctgcggctgctggccccgcagaagctctccgacgacgacaagcttgtcgagtacgacgccctgctcctcgaccggttcctcgacatcctacaggacctgcacggcgaggacatcagggagacggaaaataagcttgaccccaaaatgctggatgagattggggaagtgctgaccgactgggatcgcggagactccatggtcataaccaagtcattctcacacagacttatcctggcaaacttggctgaggaggtacaaatggcataccgcaggagaataaaactgaagaagggtgactttgttgatgagaactcagcaacaactgaatcagacatcgaggagacattaaagaggcttatgcatcagcttaagaagtcccctctggaggtattagatgctctcaagaatcaaactgttgaccttgtcctgactgcacatccaactcagtctgtccggagatcactgctccaaaagcatggcaggataagaaactgtttaactcaactttatgcaaaggacatcactccagatgagaaacaggaacttgatgaagcacttcaaagagagattcaagctgcctttagaaccgatgaaatcaggcgggcgcctcctactccgcaggatgaaatgcgtgctggaatgagttattttcatgagaccatatggaagggtgtacccaagttcttacgcagggtcgacactgctcttaagaacattggcataaatgagcggctgccatataatgcccctatcattcagttttcttcatggatgggtggtgatcgtgatgggaatccaagagtcacaccagaggttacaagggatgtgtgcttgttggctagaatgatggctgctaatttgtataatgcccagatagaagatctgatgtttgagttatctatgtggcgctgcagtgacgagttacgtgtaaaggtcgatgagttacaatgttcctccaagaaagatagaacaaaacactatatagagttctggaaacaagttccccccagtgaaccttaccgagtgattctgagtgatgtcagagataaactctacaacacgcgtgaacgagcacgccatttattagctagtgggttttctgaaattccagaggaagcaaccttcaccgatgttgaacagttcttggagcctcttgagctctgttacagatctctctgtgcctgtggtgatcaatctattgcagatggaagccttcttgacttcttacggcaagtgtctacatttggactatcccttgttagacttgatatcaggcaagaatctgaccgacatactgatgttatggatgctataactgaataccttggcatcggatcataccgtaaatggacagaggagaaacgccaagaatggctactctcagaacttaatggaaagaggccgttatttggtcctgaccttcccaagtccgatgagattgctgatgttctagatactttccacgtattagctgaacttccttcagacagctttggtgcatatgtaatatctatggcgacagctccctcggatgttcttgctgtcgagctcttgcagcgtgaatgtcatgtgaaaaaaccactgagagttgtgccattgttcgaaaaactggcagatcttgaggcagcacctgcagctttagctcggctgttctctgttgaatggtacagaaacaggatcaatggcaagcaagaagtgatgattgggtattctgattctggcaaggatgctggtcgtttctctgctgcttggcaactgtacaaggctcaagaggagctcattaatgttgctaagatgtatggggttaagttaactatgttccacggacgaggtgggactgtgggaagaggtgggggccctacccatcttgctatactgtcacaacctccagaaactattcatggatcgcttagggtaactgttcaaggtgaagtcattgaacaatcttttggagaggagcatttgtgctttagaaccctgcaacgtttcacagctgctactcttgaacatggtatgcatcctccaatttcgccaaaaccagaatggcgtgctttaatggacgaaatggctattgttgccacaaaggaataccgatcaattgtgtttgaagaaccacgctttgttgagtatttccgccttgcaacaccagagatggaatatggtaggatgaatatcggaagcagaccatcgaaaagaaagccgagtgcaggcattgaatcactgcgtgcaatcccttggatctttgcttggacgcagactcggttccacctaccagtgtggcttggttttggcgcagcattcaaacatgtcttggataaggacatacggaatcttcaaacccttcaagagatgtacaatcagtggccatttttcagggttacaatagacttggttgagatggtgtttgccaaaggtgatcctggtatagcggctctgtatgacaagcttctagtttcagaggatttgtggtcatttggcaagcgtcttagagccaactatgaagaaacaaagcaacttcttctacaggttgctgggcacaaagaccttctggagggcgacccttacctgaagcagaggctgcgcatccgtgactcttacatcaccgcgctgaacgtttgccaagcttacacgctgaagcgcatcagggaccctggcttccaggtgaacccggggcctcacctgtcgaaggacgtcatggacattggcaagccggcttcagagctcgtgaagctcaacaccacaagcgagtacgccccggggctggaggacaccctcatcctcaccatgaagggcatcgctgccggaatgcagaacaccggctga

SEQ ID NO: 1322 - protein, 955 aa, Sorghum bicolor
  misc_feature: Ceres ANNOT ID no. 6015392
  misc_feature (11)..(955): Pfam Id: PEPcase Pfam Desc: Phosphoenolpyruvate carboxylase
  misc_feature (1)..(955): NCBI GI: 169844 NCBI Desc: phosphoenolpyruvate carboxylase [saccharum hybrid cultivar h32-8560]
  misc_feature (1)..(955): NCBI GI: 115577 NCBI Desc: phosphoenolpyruvate carboxylase, housekeeping isozyme (pepcase)
  misc_feature (1)..(955): NCBI GI: 2266947 NCBI Desc: phosphoenolpyruvate carboxylase 1 [gossypium hirsutum]
  misc_feature (1)..(955): NCBI GI: 117649967 NCBI Desc: phosphoenolpyruvate carboxylase [citrus sinensis]
  misc_feature (1)..(955): NCBI GI: 399182 NCBI Desc: phosphoenolpyruvate carboxylase, housekeeping isozyme (pepcase)
  misc_feature (1)..(955): SWISSPROT Homolog: EC 4.1.1.31 Phosphoenolpyruvate carboxylase, housekeeping isozyme
MARNAVDKATSIDAQLRLLAPQKLSDDDKLVEYDALLLDRFLDILQDLHGEDIRETENKLDPKMLDEIGEVLTDWDRGDSMVITKSFSHRLILANLAEEVQMAYRRRIKLKKGDFVDENSATTESDIEETLKRLMHQLKKSPLEVLDALKNQTVDLVLTAHPTQSVRRSLLQKHGRIRNCLTQLYAKDITPDEKQELDEALQREIQAAFRTDEIRRAPPTPQDEMRAGMSYFHETIWKGVPKFLRRVDTALKNIGINERLPYNAPIIQFSSWMGGDRDGNPRVTPEVTRDVCLLARMMAANLYNAQIEDLMFELSMWRCSDELRVKVDELQCSSKKDRTKHYIEFWKQVPPSEPYRVILSDVRDKLYNTRERARHLLASGFSEIPEEATFTDVEQFLEPLELCYRSLCACGDQSIADGSLLDFLRQVSTFGLSLVRLDIRQESDRHTDVMDAITEYLGIGSYRKWTEEKRQEWLLSELNGKRPLFGPDLPKSDEIADVLDTFHVLAELPSDSFGAYVISMATAPSDVLAVELLQRECHVKKPLRVVPLFEKLADLEAAPAALARLFSVEWYRNRINGKQEVMIGYSDSGKDAGRFSAAWQLYKAQEELINVAKMYGVKLTMFHGRGGTVGRGGGPTHLAILSQPPETIHGSLRVTVQGEVIEQSFGEEHLCFRTLQRFTAATLEHGMHPPISPKPEWRALMDEMAIVATKEYRSIVFEEPRFVEYFRLATPEMEYGRMNIGSRPSKRKPSAGIESLRAIPWIFAWTQTRFHLPVWLGFGAAFKHVLDKDIRNLQTLQEMYNQWPFFRVTIDLVEMVFAKGDPGIAALYDKLLVSEDLWSFGKRLRANYEETKQLLLQVAGHKDLLEGDPYLKQRLRIRDSYITALNVCQAYTLKRIRDPGFQVNPGPHLSKDVMDIGKPASELVKLNTTSEYAPGLEDTLILTMKGIAAGMQNTG

SEQ ID NO: 1323 - DNA, 1278 bp, Sorghum bicolor
  misc_feature: Ceres ANNOT ID no. 6015393
  misc_feature: Encodes the peptide sequence at SEQ ID NO 1324
atgcaaggggacactagctctagcgatgtttctgcttctcatgtagggcgcttaagacgccgcaaacatccaactgaagctaccgcagatgggaatagagctaatggacagccattgcttgttaatgatcagagcaagtataaatcaatgcttatccgtacatattctacaatatggatgattggaggctttgcctttactatttatatgggtcatctatatatctgggctatggtggttgtgattcaaatatacatggcaagagagcttttcaacctacttagaaaatccagtgaagagaaacaactgccagggttcaggctactgaattggcacttctttttcacggcaatgctgtacacttatggacgctttcttagtcggcagcttgtgaatacagtaacttcagatcacttgctttataaggttgtcagtggcctaataaagtatcagatgtttatctgctattttctttatattgcagggtttgtatggtttattttgactctcaagaaaaagacatacaagtatcagttcaaacagtatgcctggacgcacatgatacttttaacggtttttggacagtctgctttcactgtcgcaaacatatttgaagggatattctggtttcttttgcctgcttcacttattgtgatcaacgatatttttgcttatttatttgggttctttcttgggagaacaccattaatcaagttgtccccaaagaaaacttgggaaggttttattggtgcatcagtgacaactatcatctctgcatttctgttagcaaatgtaatgggccattcccaatggttgacatgcccaagaaaggatctgtcaactgggtggctttattgtgatcctggtccaatgtttaagccagagcattactcattgggagagtgggtgccacattggttcccatggaaagaactagccattatgcctgtgcagtggcatgctttagccctaggtttatttgcatcgataatagcaccatttggaggattttttgcgagtggcttcaagagggcattcaaaataaaggattttggtgacagcatacctgggcatggtggaattactgatagaatggattgtcaaatggttatggcagtgtttgcatacatataccaccaatcgttcattgcacctcagaacttttctgttgagataatcttggatcagattataagaaacctaacctatgaggagcaaaaatacctatacgaacaacttggggaaatgttccatgacaggcaactggcgcaaagctga

SEQ ID NO: 1324 - protein, 425 aa, Sorghum bicolor
  misc_feature: Ceres ANNOT ID no. 6015393
  misc_feature (51)..(382): Pfam Id: CTP_transf_1 Pfam Desc: Cytidylyltransferase family
  misc_feature (1)..(416): NCBI GI: 87241162 NCBI Desc: phosphatidate cytidylyltransferase [medicago truncatula]
  misc_feature (1)..(425): NCBI GI: 2182104 NCBI Desc: cdp-diacylglycerol synthetase [solanum tuberosum]
  misc_feature (1)..(420): NCBI GI: 2181182 NCBI Desc: cdp-diacylglycerol synthetase [arabidopsis thaliana]
  misc_feature (7)..(420): NCBI GI: 79325225 NCBI Desc: phosphatidate cytidylyltransferase [arabidopsis thaliana]
  misc_feature (1)..(420): NCBI GI: 7484839 NCBI Desc: cdp-diacylglycerol synthetase homolog f24o1.17 - arabidopsis thaliana
  misc_feature (1)..(425): SWISSPROT Homolog: EC 2.7.7.41 Phosphatidate cytidylyltransferase
MQGDTSSSDVSASHVGRLRRRKHPTEATADGNRANGQPLLVNDQSKYKSMLIRTYSTIWMIGGFAFTIYMGHLYIWAMVVVIQIYMARELFNLLRKSSEEKQLPGFRLLNWHFFFTAMLYTYGRFLSRQLVNTVTSDHLLYKVVSGLIKYQMFICYFLYIAGFVWFILTLKKKTYKYQFKQYAWTHMILLTVFGQSAFTVANIFEGIFWFLLPASLIVINDIFAYLFGFFLGRTPLIKLSPKKTWEGFIGASVTTIISAFLLANVMGHSQWLTCPRKDLSTGWLYCDPGPMFKPEHYSLGEWVPHWFPWKELAIMPVQWHALALGLFASIIAPFGGFFASGFKRAFKIKDFGDSIPGHGGITDRMDCQMVMAVFAYIYHQSFIAPQNFSVEIILDQIIRNLTYEEQKYLYEQLGEMFHDRQLAQS

SEQ ID NO: 1325 - DNA, 1332 bp, Sorghum bicolor
  misc_feature: Ceres ANNOT ID no. 6015406
  misc_feature: Encodes the peptide sequence at SEQ ID NO 1326
atggcgtccgataccgagggcatcgccgccctcttctcgatgtacaacgacgacgaggaagaggaggacgccgacgagcccaaccccccttccccagcgccgcccgccgccgtcacctcctcctcgccgccgtcccctcaagccggggcggaggaccctaacccttccctggcgcctccgtcgcctccccgtcccgaggagtcggccggtctcaaaaccctagcgagccctcacccttccccggcgcgggggctgcttccgccacttccctcgcggcgctctccgtcgccctttgcagtgtcgtccccgtccccgttacggggaccatcctccgcgccgccggccgacctgccgcgcccgccacggcgcggggcgcttgcaatcgtggactatgcgcacgatgagacggctatgtcgcccgagcaggaggatggggagatcatgagccacacacagagatttagctcggatgctcaggctgctgacggggatcttgaagaacgaactctctctggcacagttcatattatgaccccaaatactccagcagaaatgtctcatcatcctgatgcacccgagcagaaccaagtagggacagacatggaagtggatgcaactagagcagaaactgaagatgcccaggtggaggaaactactggtatttcaaccaatggtgataatgatgatccattgagccgtttccttcctccacctgtgactacaaaatgctctgcagcattacagcaaaaaattaacaggttccttgcatacaaaagggctggaaagagctttaatgctgaagtgcgcaacaggaaggactacagaaatccagactttttgcagcatgctgtgcggtaccaagaaattgatcagatagggacctgttttggtaaagatgtttttgatccttatgggtatgacaaaggcgactactatgatgagatagaagctgaaatgaagcgtgaacttgagaggaaggaacaggagaagaaaaggagcccaaaagttgaatttattactggaggagtacaacctccaattagtgcatcattaccgaagatcccagctctggccggtgtcagtacactaccagtacctacagaaggtttgcagaaagagactagaccaaacaagaagtcaaaatgggataaggttgatggtgatgttaagaaccacttggtacctagtggacacgacaacttatcagcaactgcttctgcggcacttttgacttcagctaatgttggtgctggatatgctgcttttgcgcaacaaaagagaaaagaggctgaagagaagagaagcgattataagtcagacagaagatcctag

SEQ ID NO: 1326 - protein, 443 aa, Sorghum bicolor
  misc_feature: Ceres ANNOT ID no. 6015406
  misc_feature (235)..(331): Pfam Id: HCNGP Pfam Desc: HCNGP-like protein
  misc_feature (1)..(443): NCBI GI: 57900391 NCBI Desc: transcriptional regulator family protein-like [oryza sativa (japonica cultivar-group)]
  misc_feature (194)..(443): NCBI GI: 57900392 NCBI Desc: transcriptional regulator family protein-like [oryza sativa (japonica cultivar-group)]
  misc_feature (1)..(171): NCBI GI: 115440065 NCBI Desc: os01g0759700 [oryza sativa (japonica cultivar-group)]
  misc_feature (193)..(383): NCBI GI: 28856236 NCBI Desc: transcriptional regulator protein [danio rerio]
  misc_feature (190)..(383): NCBI GI: 57912 NCBI Desc: hcngp [mus musculus]
MASDTEGIAALFSMYNDDEEEEDADEPNPPSPAPPAAVTSSSPPSPQAGAEDPNPSLAPPSPPRPEESAGLKTLASPHPSPARGLLPPLPSRRSPSPFAVSSPSPLRGPSSAPPADLPRPPRRGALAIVDYAHDETAMSPEQEDGEIMSHTQRFSSDAQAADGDLEERTLSGTVHIMTPNTPAEMSHHPDAPEQNQVGTDMEVDATRAETEDAQVEETTGISTNGDNDDPLSRFLPPPVTTKCSAALQQKINRFLAYKRAGKSFNAEVRNRKDYRNPDFLQHAVRYQEIDQIGTCFGKDVFDPYGYDKGDYYDEIEAEMKRELERKEQEKKRSPKVEFITGGVQPPISASLPKIPALAGVSTLPVPTEGLQKETRPNKKSKWDKVDGDVKNHLVPSGHDNLSATASAALLTSANVGAGYAAFAQQKRKEAEEKRSDYKSDRRS

SEQ ID NO: 1327 - DNA, 1575 bp, Sorghum bicolor
  misc_feature: Ceres ANNOT ID no. 6015407
  misc_feature: Encodes the peptide sequence at SEQ ID NO 1328
  misc_feature: Down-regulated in shoot tissues in response to salicylic acid treatment
atggcggaggtgaagccggaggagataagccatccgcccatggagcagctccaggggttcgagtactgcatagactcgaaccctccctggggcgaggcgatcatactgggcttccaacactacatactggcgctgggcacagcggtgatgatcccggcggtgttggttcccatgatgggtggcgacgatggagacagggtcagggtggtgcagacgctgctgttcgtgacggggataaacacgctgctgcagtccctcttcgggacccggctgccgacggtcatcggcggctcctacgcgttcgtgatcccgataatggccatcatccaggaaccgtcgctttcggggatagccgatggtcaccagaggttcctcgagaccatgaaggcgatacagggggcactgatagtgtcctccagtattcagatcatcctgggctacagccagctgtggggtattttctccagatttttcagtccagtggggatgactccagtggttgcgctgctgggatttggccttttcgaaagaggtttccctgtggttgggagatgcgtggagattggcttgccaatgctgattctctttgttgtgctctctcagtatctgaagaatatacaaataaaagaaattcccatactggaaaggttctcccttttcatctgtatcgcattggtatgggcatatgctcaaatcctcacttcaggtggagcctataagaatagctctgaggtcactcagaacaactgccgcactgacagagccaatctgatctcttctgccccatggattaagattccttacccgttgcaatggggtgcaccaaccttcaatgctggccagtcatttggtatggtgtctgctgttttggtctcgctagtagagtccactgcctcttacaaagctgctgctcggcttgcaagtgcgactccacctccggctcatatcctgagtagaggcattgggtggcagggaatcggcatccttcttgatgggctctttggaacggggactggatccactgtctcagtggagaacgttgggttgcttgggtcgacaaggattgggagccggcgcgttatacagatctcagctggcttcatgatatttttctccatactggggaaatttggagctttgttcgcttctatcccattcaccatctttgcagctgtgtactgcgtcttgtttggactagttgctgcagtggggctgtccttcttacagttcactaacatgaactccatgcgcaacctctttatcgtcggcgtctccatcttcctgggcctgtccgtgccggaatactttttccggtacaccatggctgctcaccgtggtcctgcgcacaccaaagctggatggttcaacgactacatcaacaccatcttctcgtcaccgccgacggtggggttgattgtggccgtgttcctggacaacacgctggagatgaaggacgcgggcaaggaccgggggatgccgtggtggctgcggttccgggcgttcaagggcgacagcaggaacgaggagttctacagcctgccattcaacctcaaccgcttcttccctccggcgtaa

SEQ ID NO: 1328 - protein, 524 aa, Sorghum bicolor
  misc_feature: Ceres ANNOT ID no. 6015407
  misc_feature (31)..(438): Pfam Id: Xan_ur_permease Pfam Desc: Permease family
  misc_feature (77)..(524): NCBI GI: 115440067 NCBI Desc: os01g0759900 [oryza sativa (japonica cultivar-group)]
  misc_feature (264)..(524): NCBI GI: 115478518 NCBI Desc: os09g0320400 [oryza sativa (japonica cultivar-group)]
  misc_feature (5)..(522): NCBI GI: 89330191 NCBI Desc: leaf permease 1 [oryza sativa (japonica cultivar-group)]
  misc_feature (11)..(522): NCBI GI: 30696385 NCBI Desc: xanthine/uracil permease family protein [arabidopsis thaliana]
  misc_feature (13)..(522): NCBI GI: 144924229 NCBI Desc: xanthine/uracil/vitamin c permease [medicago truncatula]
  misc_feature: Down-regulated in shoot tissues in response to salicylic acid treatment
MAEVKPEEISHPPMEQLQGFEYCIDSNPPWGEAIILGFQHYILALGTAVMIPAVLVPMMGGDDGDRVRVVQTLLFVTGINTLLQSLFGTRLPTVIGGSYAFVIPIMAIIQEPSLSGIADGHQRFLETMKAIQGALIVSSSIQIILGYSQLWGIFSRFFSPVGMTPVVALLGFGLFERGFPVVGRCVEIGLPMLILFVVLSQYLKNIQIKEIPILERFSLFICIALVWAYAQILTSGGAYKNSSEVTQNNCRTDRANLISSAPWIKIPYPLQWGAPTFNAGQSFGMVSAVLVSLVESTASYKAAARLASATPPPAHILSRGIGWQGIGILLDGLFGTGTGSTVSVENVGLLGSTRIGSRRVIQISAGFMIFFSILGKFGALFASIPFTIFAAVYCVLFGLVAAVGLSFLQFTNMNSMRNLFIVGVSIFLGLSVPEYFFRYTMAAHRGPAHTKAGWFNDYINTIFSSPPTVGLIVAVFLDNTLEMKDAGKDRGMPWWLRFRAFKGDSRNEEFYSLPFNLNRFFPPA

SEQ ID NO: 1329 - DNA, 282 bp, Sorghum bicolor
  misc_feature: Ceres ANNOT ID no. 6015409
  misc_feature: Encodes the peptide sequence at SEQ ID NO 1330
atgttggaagggaaggcggtggtggaggacaccgacatgccggcgaagatgcaggcgcaggcgatgtcggcggcgtccagggccctggaccgcttcgacgtcctcgactgccggagcatcgcggctcacatcaagaaggagtttgacgcgatccatggccccggatggcaatgcgtggtcggctccagcttcggctgctacttcacgcacagcaaggggagcttcgtctacttccgcctcgagtcgctcaggttcctcgtcttcaaaggggcggcagcatga

SEQ ID NO: 1330 - protein, 93 aa, Sorghum bicolor
  misc_feature: Ceres ANNOT ID no. 6015409
  misc_feature (1)..(91): Pfam Id: Dynein_light Pfam Desc: Dynein light chain type 1
  misc_feature (7)..(93): NCBI GI: 114215596 NCBI Desc: dynein light chain [oryza sativa (indica cultivar-group)]
  misc_feature (1)..(93): NCBI GI: 50251496 NCBI Desc: dynein light chain type 1-like [oryza sativa (japonica cultivar-group)]
  misc_feature (1)..(93): NCBI GI: 92896477 NCBI Desc: dynein light chain, type 1 [medicago truncatula]
  misc_feature (35)..(93): NCBI GI: 115440069 NCBI Desc: os01g0760000 [oryza sativa (japonica cultivar-group)]
  misc_feature (1)..(89): NCBI GI: 2208914 NCBI Desc: outer arm dynein lc6 [anthocidaris crassispina]
MLEGKAVVEDTDMPAKMQAQAMSAASRALDRFDVLDCRSIAAHIKKEFDAIHGPGWQCVVGSSFGCYFTHSKGSFVYFRLESLRFLVFKGAAA

SEQ ID NO: 1331 - DNA, 1380 bp, Sorghum bicolor
  misc_feature: Ceres ANNOT ID no. 6015411
  misc_feature: Encodes the peptide sequence at SEQ ID NO 1332
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
atggcccctgctaacgtgcgcgcggcgcaggcccctagcgccgaccgcaggttaagtacgctggtgcgtcacctgctgccttcctccccacgaagaacagcagcagaagcagcagccgacgcctccgccaccctcgaatcgttccccaccatggcgtcgcagggatcctccgtcttcgccgcactcgcgcaggccccggaggaccccatcctcggagtgaccgtcgcctacaacaaggatcccagccccgtgaaggtcaacctcggcgtcggcgcctaccggaccgaggaagggaagcccctcgtgctgaatgtggtcaggcgcgccgagcaaatgttgatcaataacccgtcacgtgtcaaggagtacctaccaatcaccggtttggctgaattcaataagctgagcgctaagcttatctttggtgctgacagtcctgctattcaggagaatagggttgctacagtgcagtgcctatcgggtactggttctttaagagttggaggtgaatttcttgcaaggcactatcatgagcgcactatctacatcccacaaccaacctggggaaatcacccaaaagtattcaccttatctggattgactgttaggagctaccgctactatgatcctgcgacccgcggtcttgacttcaaaggactcttggaagacctcagttctgctccttcaggttcaattgtactgctgcatgcctgtgcccacaaccctactggagtagatcctacccttgatcagtgggaacagattaggcagctgatgagatcaaaatcactgcttccgttctttgacagtgcctaccaaggctttgcgagtggaagtcttgacaaagatgctcagtcagtgcgaatgtttgttgctgatggtggtgaattgctcatggctcagagctacgccaagaacatgggattgtacggagagcgtgttggcgctttgagcattgtatgtggaagtgccgatgtagctgttagggttgaaagtcaactcaaacttgtgatcaggcctatgtattcaaacccccctcttcatggtgcctctatcgtggctaccatactcagggacagtgagatgtacaacgaatggactctagaactgaaggccatggctgatcggatcattagcatgaggcaacagctatttgatgcgctgaaatccagaggaacccctggagactggagccacatcattaagcaaattgggatgtttactttcactgggctgaatagcgagcaagtggcattcatgaggcaggaataccacatttatatgacatctgatgggaggatcagcatggctggtttgagcatgaggactgtgccccatcttgcagatgccatacacgctgcagttactcaactgaaatga

SEQ ID NO: 1332 - protein, 459 aa, Sorghum bicolor
  misc_feature: Ceres ANNOT ID no. 6015411
  misc_feature (83)..(451): Pfam Id: Aminotran_1_2 Pfam Desc: Aminotransferase class I and II
  misc_feature (51)..(459): NCBI GI: 584706 NCBI Desc: aspartate aminotransferase, cytoplasmic (transaminase a)
  misc_feature (51)..(459): NCBI GI: 20599 NCBI Desc: aspartate aminotransferase [panicum miliaceum]
  misc_feature (8)..(458): NCBI GI: 2654094 NCBI Desc: aspartate aminotransferase glyoxysomal isozyme aat1 precursor [glycine max]
  misc_feature (39)..(458): NCBI GI: 388896 NCBI Desc: aspartate aminotransferase p1
  misc_feature (39)..(458): NCBI GI: 168324 NCBI Desc: aspartate aminotransferase p1
  misc_feature (51)..(459): SWISSPROT Homolog: EC 2.6.1.1 Aspartate aminotransferase, cytoplasmic
  misc_feature: Useful for making plants with modulated nitrogen use efficiency
  misc_feature: GREAT-hit functional homolog of the protein sequence encoded by LOCUS at5g19550
  misc_feature: Useful for making plants with modulated nitrogen use efficiency
  misc_feature: Functional homolog of the protein sequence given in SEQ ID NO 13735
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
MAPANVRAAQAPSADRRLSTLVRHLLPSSPRRTAAEAAADASATLESFPTMASQGSSVFAALAQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLTVRSYRYYDPATRGLDFKGLLEDLSSAPSGSIVLLHACAHNPTGVDPTLDQWEQIRQLMRSKSLLPFFDSAYQGFASGSLDKDAQSVRMFVADGGELLMAQSYAKNMGLYGERVGALSIVCGSADVAVRVESQLKLVIRPMYSNPPLHGASIVATILRDSEMYNEWTLELKAMADRIISMRQQLFDALKSRGTPGDWSHIIKQIGMFTFTGLNSEQVAFMRQEYHIYMTSDGRISMAGLSMRTVPHLADAIHAAVTQLK

SEQ ID NO: 1333 - DNA, 1854 bp, Sorghum bicolor
  misc_feature: Ceres ANNOT ID no. 6015417
  misc_feature: Encodes the peptide sequence at SEQ ID NO 1334
atggcgggcaaggagcagggcggccctccgccgccgcagaggcctcccgtgcccgctgcgtccatgcagccgccgattaagaagctagtaaggcagctcgatttcaactcggcggcgttggcggggaaccccgcgatggcggcggcggccgccgccgtttctagggctctgcagccgagggcgttgcccgtggggttccagcatccgcagcacgtgagggctgccatgcctatggggatgccgcagcagctgcaccagcggattctgccggtgatgcgcccgcaccaggtggtggggcatgtgccgctgccgcggcacgcggtgccgatggcggtccctgtaccgcagcttcgtccgatgccgccgcaaccagtccagcgtcccccggtcgcggttcccttgaaaccagagtcaccaaaaccacgagcaagactctatgaaggaaaagatagcactcccacgaagaagaagtgctgcaattgcaggaactccagatgtttgaagttgtactgtgaatgcttcgcttctggtactcactgtgatgggtgcaactgcaccaactgttttaataatcctgagaatgaggttgccaggcgtgaagctattgaagctacattggagcgtaatccagatgctttcaggcctaagattgggagcagcccacatacgaataggaataatgaggtgtctagtgatctccctttagtagggaagcataataaagggtgccactgcaagaagtcaggatgcctcaagaagtactgtgagtgcttccaagctaatatactatgctctgaaaattgcaagtgtatggattgcaagaattttgaaggaagtgaagagagaagaaatcttttccaaggggatcacaaaaatgcaattaacatgcagcaggcgacaaatgcagctgtaaatggtgctattggagctacaggattcccttctccttccacatcaaggaagaggaaacatattgatccttcacttgataattcaaataaggaacatgtagcgcacaggaattatcacatatctcagtctgtttatcagaaaaatgcagtacctgatggtccaattccaataagccagtctgcacatcctccaaatctgggcccctttaaagttacctacaggccccttttagcagacattgtgcaagaagaggacataaaggagctatgcaagcttttagtggtggtatcaggagaggctgcaaaaacatatgctggccggaaaacgatggaagagagggttggcgagaaggaagatgaaaggggaggacagaaggaagatgacagggcaggttccctagcattgacaaaccatgacagagaaggaaataatcaagatccagatcaaaaagcatcaattgatgaccattcaagcagaggaactcacacgggcaaagctattctagaagaatccagacctaactgcgctgatgatcagaagtccaatagacctatgtctcctggaacactggcactgttgtgtgacgaagaagtgaaaatgtgtgacgaacaagatacagtgtttacgacttctcaaaatgctgttcctcagcagacaataactgtcaaccaaaaccaatctgcactgtatgcagaacaagaaagagttgtgctgacagaattccgtgattgcctccgcaagtttgtggaacgcggaagaaataaagagagaagatactcctccatggcaatcgaatctgaaacatctgccaatcctggacaggtaaatggtgtttctcaagtaccatattcgaaagtagatgtacctgttgtaaaaacatatccgcagagttccagcagtaatgctggaaaacctgttactggctttttggacaaaaactga

SEQ ID NO: 1334 - protein, 617 aa, Sorghum bicolor
  misc_feature: Ceres ANNOT ID no. 6015417
  misc_feature (154)..(194): Pfam Id: CXC Pfam Desc: Tesmin/TSO1-like CXC domain
  misc_feature (238)..(279): Pfam Id: CXC Pfam Desc: Tesmin/TSO1-like CXC domain
  misc_feature (1)..(616): NCBI GI: 57900356 NCBI Desc: tesmin-like [oryza sativa (japonica cultivar-group)]
  misc_feature (45)..(580): NCBI GI: 92874527 NCBI Desc: tesmin/tso1-like, cxc [medicago truncatula]
  misc_feature (101)..(603): NCBI GI: 30680884 NCBI Desc: tesmin/tso1-like cxc domain-containing protein [arabidopsis thaliana]
  misc_feature (81)..(490): NCBI GI: 115467896 NCBI Desc: os06g0332700 [oryza sativa (japonica cultivar-group)]
  misc_feature (115)..(412): NCBI GI: 79521003 NCBI Desc: transcription factor [arabidopsis thaliana]
  misc_feature: The sequence is a functional homolog of SEQ ID NO 490 in the 10/666,642US patent application
  misc_feature: The sequence is a functional homolog of SEQ ID NO 492 in the 10/666,642US patent application
  misc_feature: Useful for making plants with modulated growth and phenotype characteristics
  misc_feature: The sequence is a functional homolog of SEQ ID NO 490 in the 20070033671 US patent application
  misc_feature: The sequence is a functional homolog of SEQ ID NO 492 in the 20070033671 US patent application
MAGKEQGGPPPPQRPPVPAASMQPPIKKLVRQLDFNSAALAGNPAMAAAAAAVSRALQPRALPVGFQHPQHVRAAMPMGMPQQLHQRILPVMRPHQVVGHVPLPRHAVPMAVPVPQLRPMPPQPVQRPPVAVPLKPESPKPRARLYEGKDSTPTKKKCCNCRNSRCLKLYCECFASGTHCDGCNCTNCFNNPENEVARREAIEATLERNPDAFRPKIGSSPHTNRNNEVSSDLPLVGKHNKGCHCKKSGCLKKYCECFQANILCSENCKCMDCKNFEGSEERRNLFQGDHKNAINMQQATNAAVNGAIGATGFPSPSTSRKRKHIDPSLDNSNKEHVAHRNYHISQSVYQKNAVPDGPIPISQSAHPPNLGPFKVTYRPLLADIVQEEDIKELCKLLVVVSGEAAKTYAGRKTMEERVGEKEDERGGQKEDDRAGSLALTNHDREGNNQDPDQKASIDDHSSRGTHTGKAILEESRPNCADDQKSNRPMSPGTLALLCDEEVKMCDEQDTVFTTSQNAVPQQTITVNQNQSALYAEQERVVLTEFRDCLRKFVERGRNKERRYSSMAIESETSANPGQVNGVSQVPYSKVDVPVVKTYPQSSSSNAGKPVTGFLDKN

SEQ ID NO: 1335 - DNA, 1083 bp, Sorghum bicolor
  misc_feature: Ceres ANNOT ID no. 6015425
  misc_feature: Encodes the peptide sequence at SEQ ID NO 1336
atgtctcgcatcgcggcctcgcgcctcctccctaggatctctgcgctctccttctgcaccgcctccccggcaaccgccgccgcttcctcctcatcatccacggcggcggcggcggcagcggcagccgccaccgcctccgaggcctcctccaccgccgcagatccatcctcccagccgccccaggcagcccgcaagccgtggggcgcgctcaagttcgccgccttaactgccgtgtccgccgcggttggcggcacggcctacgtcagctacgcttattctctggatgaagtggatcagatgacgcgggagctccggaagaagtcgaagcagcccattcctgaggatgcttccggctttgagaggtttcaagctatggcttattcatctgctatgaaagttcctgttgccgctattgaggcatacctggatgtgaggagccagattgaagatcaaatccggggctttagcgaaccagtatcagacaaacttcttccagatcttcttcctcaagagcagcatgtattgactctcgttctggatctgaacgagactcttgtatactcagattggaagcgtgagagaggatggaggacctttaagaggccaggagtggatgcctttcttgaacatcttgggaagttttatgaaattgttgtgtattctgatcagcttagtatgtatgttgatcctgttgttgataggctggatccaaagggcaatattcgacacaggctatcaagagttgcaactaagtacgaaaatggaaaacattatcgggatctgtcaaagctgaacagaaaccctgctcaagttctttatatcagcgctcatgctaaagagtcaagcctgcagcctgaaaattctgtggaaattaaaccttggaagcttgaaagtgatgacactcaactgcttgatcttattccatttctagaatatgttgcgatggtaagaccttctgacatcaggtctgttcttgcatcctatcaaagtggtgatattgccgccgagtttattgagcgctctaaggagcaccagaggcgcatgcaagaacaaaagaaatcaggacgcatatggagacgatga

SEQ ID NO: 1336 - protein, 360 aa, Sorghum bicolor
  misc_feature: Ceres ANNOT ID no. 6015425
  misc_feature (166)..(327): Pfam Id: NIF Pfam Desc: NLI interacting factor-like phosphatase
  misc_feature (1)..(346): NCBI GI: 115464851 NCBI Desc: os05g0513200 [oryza sativa (japonica cultivar-group)]
  misc_feature (1)..(259): NCBI GI: 20804683 NCBI Desc: p0512c01.26 [oryza sativa (japonica cultivar-group)]
  misc_feature (2)..(346): NCBI GI: 8778307 NCBI Desc: f14j16.15 [arabidopsis thaliana]
  misc_feature (148)..(354): NCBI GI: 145345073 NCBI Desc: mpt family transporter: inner membrane translocase (import) tim50 [ostreococcus lucimarinus cce9901]
  misc_feature (141)..(356): NCBI GI: 74595874 NCBI Desc: import inner membrane translocase subunit tim50, mitochondrial precursor
MSRIAASRLLPRISALSFCTASPATAAASSSSSTAAAAAAAAATASEASSTAADPSSQPPQAARKPWGALKFAALTAVSAAVGGTAYVSYAYSLDEVDQMTRELRKKSKQPIPEDASGFERFQAMAYSSAMKVPVAAIEAYLDVRSQIEDQIRGFSEPVSDKLLPDLLPQEQHVLTLVLDLNETLVYSDWKRERGWRTFKRPGVDAFLEHLGKFYEIVVYSDQLSMYVDPVVDRLDPKGNIRHRLSRVATKYENGKHYRDLSKLNRNPAQVLYISAHAKESSLQPENSVEIKPWKLESDDTQLLDLIPFLEYVAMVRPSDIRSVLASYQSGDIAAEFIERSKEHQRRMQEQKKSGRIWRR

SEQ ID NO: 1337 - DNA, 1176 bp, Sorghum bicolor
  misc_feature: Ceres ANNOT ID no. 6015434
  misc_feature: Encodes the peptide sequence at SEQ ID NO 1338
atgcgcccttctctctattgtgcacctctttttcttctgctactattacatttggcgtttgctaggcctctctttcctctaccgagtaagacaaagtatgaagagaagaagccaatacagacatttcgaccatataacattgctcatcgtggctcaaatggggaaattcccgaggaaacagctgctgcatacctgagagctattgaagaaggggcagattttatagagtctgacatccttgctagcaaagatggaaccttgatttgttttcatgatgtaacgcttgacgatacaactgatgttgccaggcgtaaggaatttgccaatcgaagaagaacctatgaagtggagtggtttaatgtttctggatggtttgtagtggacttcacgctggaggaacttaaaacacttaaagtgaagcagagatactcgttcagagatcaaaaatacaatggtatgttttcaatcatcacatttgaagaattcatttcaattgccctagatgcagacagaactgtcggcatctatccagagattaaagatccagtttttatcaacaagcatgtcaagtgggctgatgggaagaagtttgaggacaaatttgtggataccttgcttaagtatggatacaaaggtcaatatatgtcagagaattggctgaagcagccattgtttatacaatcctttgctcccacctccattgtacatgtatcagatttgattgactctccgaaggtatttttgattgatgatatcacagtgagaacacaagacacgaaccagtcatactgggaaatcacttcagatgactaccttgcatacattgggaaatatgttgttggccttggtccgtggaaagatactattgttccagcttcaggaaactacttgatgccacctagtgatcttgtcgcacgggcacatgcccataatctccaggtacatccatacacgtacaggaacgagaaccagttcctgcacttcaacttccatcaagatccctacactgaatacgatttctggataaacacagtgggggttgatggactgtttacagatttcactggaacccttcaccggtaccaagaattgacatccccgcacccgaaggatgaaactgcaaatagcctcctagtaaaaattagtcaaatgatctcagcatatgaaggtctctga

SEQ ID NO: 1338 - protein, 391 aa, Sorghum bicolor
  misc_feature: Ceres ANNOT ID no. 6015434
  misc_feature (49)..(357): Pfam Id: GDPD Pfam Desc: Glycerophosphoryl diester phosphodiesterase family
  misc_feature (6)..(372): NCBI GI: 6562317 NCBI Desc: glycerophosphodiester phosphodiesterase-like protein [arabidopsis thaliana]
  misc_feature (4)..(281): NCBI GI: 56122686 NCBI Desc: glycerophosphodiester phosphodiesterase-like protein [manihot esculenta]
  misc_feature (43)..(354): NCBI GI: 126656105 NCBI Desc: glycerophosphoryl diester phosphodiesterase [cyanothece sp. ccy0110]
  misc_feature (44)..(353): NCBI GI: 103487690 NCBI Desc: glycerophosphoryl diester phosphodiesterase [sphingopyxis alaskensis rb2256]
  misc_feature (34)..(296): NCBI GI: 121595719 NCBI Desc: glycerophosphoryl diester phosphodiesterase [acidovorax sp. js42]
MRPSLYCAPLFLLLLLHLAFARPLFPLPSKTKYEEKKPIQTFRPYNIAHRGSNGEIPEETAAAYLRAIEEGADFIESDILASKDGTLICFHDVTLDDTTDVARRKEFANRRRTYEVEWFNVSGWFVVDFTLEELKTLKVKQRYSFRDQKYNGMFSIITFEEFISIALDADRTVGIYPEIKDPVFINKHVKWADGKKFEDKFVDTLLKYGYKGQYMSENWLKQPLFIQSFAPTSIVHVSDLIDSPKVFLIDDITVRTQDTNQSYWEITSDDYLAYIGKYVVGLGPWKDTIVPASGNYLMPPSDLVARAHAHNLQVHPYTYRNENQFLHFNFHQDPYTEYDFWINTVGVDGLFTDFTGTLHRYQELTSPHPKDETANSLLVKISQMISAYEGL

SEQ ID NO: 1339 - DNA, 567 bp, Sorghum bicolor
  misc_feature: Ceres ANNOT ID no. 6015439
  misc_feature: Encodes the peptide sequence at SEQ ID NO 1340
atggaactcttggtgttcgtgctgctcttgctggccgtgccactcagaggatcagacggcgcgtggtgcgtgtgccgcccggacgtggccgacgcggcgctgcagaagacgctggactacgcgtgcggccacggcgcggactgcgccgccgtgctcccgaccgggccgtgctacagccccacctcggtgcgcgcgcactgctcctacgccgccaacagctacttccagcggaacagcggccaggccaacggcgccacctgcgacttcggcggcacggccaacctcaccgacacagacccgagctctggaacttgcaaataccctgcaactccaagcgaagcagggacaagcggcaacgcaaccggcacgggcacgtcgtcgccaggctctgcgagtaacccggctacgacgcccagcacgggagggagcttcacgacacctgtcggcgcatttggccccacgccgagcaccgtcagcgcgggcaccaccaccaccgccgcgttttttggtcgccatgccctcctcgtcgccgtcgtctccgtcgccctgtgtttcttggtgcgctaa

SEQ ID NO: 1340 - protein, 188 aa, Sorghum bicolor
  misc_feature: Ceres ANNOT ID no. 6015439
  misc_feature (21)..(107): Pfam Id: X8 Pfam Desc: X8 domain
  misc_feature (3)..(183): NCBI GI: 57899559 NCBI Desc: glycosyl hydrolase family protein 17-like [oryza sativa (japonica cultivar-group)]
  misc_feature (1)..(186): NCBI GI: 115473199 NCBI Desc: os07g0600700 [oryza sativa (japonica cultivar-group)]
  misc_feature (1)..(186): NCBI GI: 23495810 NCBI Desc: glycosyl hydrolase family 17-like protein [oryza sativa (japonica cultivar-group)]
  misc_feature (1)..(183): NCBI GI: 22328593 NCBI Desc: glycosyl hydrolase family protein 17 [arabidopsis thaliana]
  misc_feature (20)..(150): NCBI GI: 33146901 NCBI Desc: beta-1,3-glucanase-like protein [oryza sativa (japonica cultivar-group)]
  misc_feature: Useful for making plants with altered alkaloid content
  misc_feature: Functional homolog of the protein sequence given in SEQ ID NO 12999
  misc_feature: Useful for making plants with altered cell wall content and/or composition
  misc_feature: Functional homolog of the protein sequence given in SEQ ID NO 13736
MELLVFVLLLLAVPLRGSDGAWCVCRPDVADAALQKTLDYACGHGADCAAVLPTGPCYSPTSVRAHCSYAANSYFQRNSGQANGATCDFGGTANLTDTDPSSGTCKYPATPSEAGTSGNATGTGTSSPGSASNPATTPSTGGSFTTPVGAFGPTPSTVSAGTTTTAAFFGRHALLVAVVSVALCFLVR

SEQ ID NO: 1341 - DNA, 1002 bp, Sorghum bicolor
  misc_feature: Ceres ANNOT ID no. 6015445
  misc_feature: Encodes the peptide sequence at SEQ ID NO 1342
atgcagggcatctctatatccggttcagttgcgtcaccccatggagcaaactgcagaagggcttgcattgcaaggaacaatgtgaagctgccttgtgaggttaactcagtaagccagggattatactctttgcattggtgtgtgcataaaccacaaatgaggaccaatggaagaagaatgaatgctgcagtaagaactaatgctagatggttgtttggaggagatggacgtagcaatgatgctaggctggagcgcagcgagtctgctaatgaagatatcttgatcttctacttccaaatggatctacagacccggatacaatatgcattgaatatagaacaatttgatgtggcaaagcaattgagggaaaaactaactgagattgaaacagagattattaggcagcgtgaagctaaaaggggttcaccaaagactgaagctcaagacaaagctctaaatcttttacgtgtgcgtgcagacttgcagaaagctattgacagtgaaaactatgctttggcagctggtctccgtgatgacattgccaaacttgaggccgagtctcttgcagtatctgctaaagctcttgcttatcaaaatgtgaaatatgcatttcgattagggcagaaagtacgtcacaatatacatggatatagaggcgtgatatgtggcatggacccggtgtgctgtgaatccaagtcctggatggagacagcaaacgtggagaagctgtctaagggtccaaatcaacctttttatcaggtcctggttgatgtatacgttgatccagaactgctggttgcatatgtcgcggaagaaaatctttctgcagctgaagaatcagaaaagggaaggtttgatcacccctacattgaatttctcttttacggtgaggacacagctggggatttcatccctatcaagcagctccgtgagaagtatgaccagccacgttatgaagcttctggagatgaaagtgacaacgatgacaacacaaatagctga

SEQ ID NO: 1342 - protein, 333 aa, Sorghum bicolor
  misc_feature: Ceres ANNOT ID no. 6015445
  misc_feature (201)..(308): Pfam Id: YccV-like Pfam Desc: Hemimethylated DNA-binding protein YccV like
  misc_feature (266)..(333): NCBI GI: 115440125 NCBI Desc: os01g0764500 [oryza sativa (japonica cultivar-group)]
  misc_feature (204)..(296): NCBI GI: 87136172 NCBI Desc: hemimethylated dna-binding region protein [novosphingobium aromaticivorans dsm 12444]
  misc_feature (204)..(296): NCBI GI: 103486585 NCBI Desc: hemimethylated dna-binding region [sphingopyxis alaskensis rb2256]
  misc_feature (200)..(300): NCBI GI: 56178832 NCBI Desc: uncharacterized conserved protein [idiomarina loihiensis l2tr]
  misc_feature (204)..(305): NCBI GI: 75675700 NCBI Desc: hemimethylated dna-binding region [nitrobacter winogradskyi nb-255]
MQGISISGSVASPHGANCRRACIARNNVKLPCEVNSVSQGLYSLHWCVHKPQMRTNGRRMNAAVRTNARWLFGGDGRSNDARLERSESANEDILIFYFQMDLQTRIQYALNIEQFDVAKQLREKLTEIETEIIRQREAKRGSPKTEAQDKALNLLRVRADLQKAIDSENYALAAGLRDDIAKLEAESLAVSAKALAYQNVKYAFRLGQKVRHNIHGYRGVICGMDPVCCESKSWMETANVEKLSKGPNQPFYQVLVDVYVDPELLVAYVAEENLSAAEESEKGRFDHPYIEFLFYGEDTAGDFIPIKQLREKYDQPRYEASGDESDNDDNTNS

SEQ ID NO: 1343 - DNA, 1371 bp, Sorghum bicolor
  misc_feature: Ceres ANNOT ID no. 6015449
  misc_feature: Encodes the peptide sequence at SEQ ID NO 1344
atggctcctctgactcctagactggtagtgcccatagatgtcaagaagcagccatgggagcaaaaggtccctctccacaaccgctggcatccggatatccctcctgttgctgatgtaaccgaaggggaattgttccgtgtcgagatggtggattggagtggagggcgggttagggatgataactctgcagacgatctgaaattcatggatttcacagttgctcattatcttagtgggccactaaggatagttgattctgaaggggttccagcttcaccaggtgatcttctcgcggtagagatctgcaaccttggcccacttcctggcgacgagtggggttatactgcaatacttgaaagggagaatggaggtggattcttaactgaccacttccctagcacaagaaaagccatttggtatttcgaaggaatttacgcatactcccctcagataccaggtgttcgttttcctggaataactcatcctggtgtagtgggaactgcaccatcagttgagcttcttaatatatggaatgaaagagaaaaaagattgtctgagacaaggccagagactcttacactgtgtgaagttctacaccagaggccccttgttcctttaccgactcctgacaattgcttacttgggaaggtccaagaagggactgctgaatggcacaaaattgcaaatgaagcagccagaactattgctggaagggaaaatggagggaattgtgacataaagaatctaagtagaggctccaaagtttatctaccagtatttgttgaaggagcaaatcttagcactggtgatatgcacttctcccagggcgatggtgaaatttcgttgtgtggagcaattgaaatgagtggattccttgagctcaagtgtgagatcataagaggtgggatgaaggaatacttaaccccagttggtccaacaccacttcatgtgagccctatctttgagataggtcctgttgagccacgtttctcagagtggttggtgtttgagggcatcagtgtagatgagtctgggaagcagcattttcttgatgcatctgttgcctacaaacgtgcagttctgaatgccattgagtacctttccaaatttgggtactctaaggagcaggtatatcttttactatcatgctgcccatgcgagggtaggatatctggaatagtggactctcctaatgcagtaacaactcttgccatccctacggcgatatttgaccaggatataaagccaaaacgcatgaacgggagaccacttggaggaccacaattgagaagacttccagatcttctaagctgctcaaatgatggacaccttcctgccacccaagataaaagtggtacaagtgcgccctag

SEQ ID NO: 1344 - protein, 456 aa, Sorghum bicolor
  misc_feature: Ceres ANNOT ID no. 6015449
  misc_feature (8)..(413): Pfam Id: FmdA_AmdA Pfam Desc: Acetamidase/Formamidase family
  misc_feature (1)..(456): NCBI GI: 115440133 NCBI Desc: os01g0764900 [oryza sativa (japonica cultivar-group)]
  misc_feature (1)..(454): NCBI GI: 21592429 NCBI Desc: formamidase-like protein [arabidopsis thaliana]
  misc_feature (210)..(454): NCBI GI: 7270737 NCBI Desc: formamidase-like protein [arabidopsis thaliana]
  misc_feature (1)..(377): NCBI GI: 79326408 NCBI Desc: formamidase/ hydrolase, acting on carbon-nitrogen (but not peptide) bonds, in linear amides [arabidopsis thaliana]
  misc_feature (6)..(416): NCBI GI: 87301709 NCBI Desc: formamidase [synechococcus sp. wh 5701]
MAPLTPRLVVPIDVKKQPWEQKVPLHNRWHPDIPPVADVTEGELFRVEMVDWSGGRVRDDNSADDLKFMDFTVAHYLSGPLRIVDSEGVPASPGDLLAVEICNLGPLPGDEWGYTAILERENGGGFLTDHFPSTRKAIWYFEGIYAYSPQIPGVRFPGITHPGVVGTAPSVELLNIWNEREKRLSETRPETLTLCEVLHQRPLVPLPTPDNCLLGKVQEGTAEWHKIANEAARTIAGRENGGNCDIKNLSRGSKVYLPVFVEGANLSTGDMHFSQGDGEISLCGAIEMSGFLELKCEIIRGGMKEYLTPVGPTPLHVSPIFEIGPVEPRFSEWLVFEGISVDESGKQHFLDASVAYKRAVLNAIEYLSKFGYSKEQVYLLLSCCPCEGRISGIVDSPNAVTTLAIPTAIFDQDIKPKRMNGRPLGGPQLRRLPDLLSCSNDGHLPATQDKSGTSAP

SEQ ID NO: 1345 - DNA, 1362 bp, Sorghum bicolor
  misc_feature: Ceres ANNOT ID no. 6015450
  misc_feature: Encodes the peptide sequence at SEQ ID NO 1346
atggctcctctgactcctagactggtagttcccatagatgtgaagaagcagccatgggagcaaaaggttcctctccataaccgctggcatccagacatccctcctgtcgctgatgtaactgaaggggaattgttccgtgttgagatggtagattggactggaggacgggttagagatgataactctgcagatgacatcaaattcctggatctcacaagtacccattatcttagtggccccctaagaatagttgattctgaaggggttccagcttcaccaggtgatcttcttgcagtagaaatctgcaaccttggcccacttcctggtgatgagtggggttatactgcaatatttgaaagagagaatggaggtggattcttaactgaccactttcctactgcgagaaaggccatttggtatttcgaaggaatttatgcatactcccctcagataccaggtgttcgttttccaggattaactcatcctggtattgtgggaaccgcaccatcagtcgaacttcttaatatatggaatgaaagggagaaaagattggctgagacaagtccacatactcttaaactgtgtgaagtgttacaccagaggccccttgctaatttaccgacccctgagaactgcttacttggaaagattcaggaagggactgctgaatggcacaaaatggcaaatgaagcagccagaactattccaggaagggagaatggtggtaattgtgacataaaaaatctaagcagtggttccaaagtttatctaccagtatttgttgaaggagcaaaccttagcactggtgatatgcacttctcccagggtgatggtgaagtttctttttgtggagcaattgaaatgagtggattccttgagctcaagtgcgagatcataagaggggggatgaaggaatacttgcccccagttggtccgacaccactacatgtgaaccctatctttgagatcggtcctgttgagccacgtttctcggagtggttagtgtttgagggcataagtgtcgatgaatctgggcggcagcatttccttgatgcatcagttgcttataagcgtgcagtcctgaatgccattgagtacctttccagatttgggtactccaaggagcaggtgtatctcttactatcatgctgtccttgtgagggtaggatctctggaatagtagactctcctaatgcagtggcaactcttgccatccctacagcaatatttgatcaggatataaggccaaagcacttgagaggaaggctgagaccaaaattgataagacttccagatctcctgagctgctcaaacaatggtcttcctgtcacccaagaccaaagtagtacaagggcgccctag

SEQ ID NO: 1346 - protein, 453 aa, Sorghum bicolor
  misc_feature: Ceres ANNOT ID no. 6015450
  misc_feature (8)..(413): Pfam Id: FmdA_AmdA Pfam Desc: Acetamidase/Formamidase family
  misc_feature (1)..(453): NCBI GI: 115440133 NCBI Desc: os01g0764900 [oryza sativa (japonica cultivar-group)]
  misc_feature (1)..(450): NCBI GI: 21592429 NCBI Desc: formamidase-like protein [arabidopsis thaliana]
  misc_feature (210)..(450): NCBI GI: 7270737 NCBI Desc: formamidase-like protein [arabidopsis thaliana]
  misc_feature (1)..(377): NCBI GI: 79326408 NCBI Desc: formamidase/ hydrolase, acting on carbon-nitrogen (but not peptide) bonds, in linear amides [arabidopsis thaliana]
  misc_feature (6)..(416): NCBI GI: 87301709 NCBI Desc: formamidase [synechococcus sp. wh 5701]
MAPLTPRLVVPIDVKKQPWEQKVPLHNRWHPDIPPVADVTEGELFRVEMVDWTGGRVRDDNSADDIKFLDLTSTHYLSGPLRIVDSEGVPASPGDLLAVEICNLGPLPGDEWGYTAIFERENGGGFLTDHFPTARKAIWYFEGIYAYSPQIPGVRFPGLTHPGIVGTAPSVELLNIWNEREKRLAETSPHTLKLCEVLHQRPLANLPTPENCLLGKIQEGTAEWHKMANEAARTIPGRENGGNCDIKNLSSGSKVYLPVFVEGANLSTGDMHFSQGDGEVSFCGAIEMSGFLELKCEIIRGGMKEYLPPVGPTPLHVNPIFEIGPVEPRFSEWLVFEGISVDESGRQHFLDASVAYKRAVLNAIEYLSRFGYSKEQVYLLLSCCPCEGRISGIVDSPNAVATLAIPTAIFDQDIRPKHLRGRLRPKLIRLPDLLSCSNNGLPVTQDQSSTRAP

SEQ ID NO: 1347 - DNA, 687 bp, Sorghum bicolor
  misc_feature: Ceres ANNOT ID no. 6015453
  misc_feature: Encodes the peptide sequence at SEQ ID NO 1348
atggcctcgatcagggatctagccatagcttctctctcagctgcggcgggcgccgttgctgccgcagctgcgctgcgcctcctgtcttcccgcagaacatcctccgtcagaccccagaacctttccctcgccgccaatggatccgcctccgagcgcctgctggcgcagtcccccttcgatcctgccaagagggaagggtatatttcctgggacgactacttcatggcgatcgccttcctttcggctgagcggtctaaggatcctaatcggcaggttggagcatgcttggttagccaagagggaataatcctaggaattggctacaatggcttccctagaggttgttccgatgacaagcttccttgggcaaagaaatctgcaaatggaaatccattagagaccaaatttccctatgttgttcatgctgaggttaatgcaattctaaataccaaccatgcttcagctgctggacagaaattatatgtcaccatgttcccatgcaatgaatgtgccaagattattattcagtcaggcgtatctgaggtaatttatttcgtcgaaaaaaagattgacaactcagctcatgtttatgttgcctctcacaagctattatcgatggctggtatcaaggtcaggaagcatcagccccagatggcgcaaataccgatcaagttccaggagccatga

SEQ ID NO: 1348 - protein, 228 aa, Sorghum bicolor
  misc_feature: Ceres ANNOT ID no. 6015453
  misc_feature (68)..(186): Pfam Id: dCMP_cyt_deam_1 Pfam Desc: Cytidine and deoxycytidylate deaminase zinc-binding region
  misc_feature (1)..(228): NCBI GI: 57899567 NCBI Desc: deoxycytidylate deaminase-like [oryza sativa (japonica cultivar-group)]
  misc_feature (5)..(227): NCBI GI: 42565719 NCBI Desc: cytidine/deoxycytidylate deaminase family protein [arabidopsis thaliana]
  misc_feature (63)..(225): NCBI GI: 62901894 NCBI Desc: deoxycytidylate deaminase [synthetic construct]
  misc_feature (63)..(225): NCBI GI: 61742821 NCBI Desc: dcmp deaminase isoform a [homo sapiens]
  misc_feature (63)..(225): NCBI GI: 119625105 NCBI Desc: dcmp deaminase, isoform cra_c [homo sapiens]
  misc_feature (63)..(225): SWISSPROT Homolog: EC 3.5.4.12 Deoxycytidylate deaminase
MASIRDLAIASLSAAAGAVAAAAALRLLSSRRTSSVRPQNLSLAANGSASERLLAQSPFDPAKREGYISWDDYFMAIAFLSAERSKDPNRQVGACLVSQEGIILGIGYNGFPRGCSDDKLPWAKKSANGNPLETKFPYVVHAEVNAILNTNHASAAGQKLYVTMFPCNECAKIIIQSGVSEVIYFVEKKIDNSAHVYVASHKLLSMAGIKVRKHQPQMAQIPIKFQEP

SEQ ID NO: 1349 - DNA, 687 bp, Sorghum bicolor
  misc_feature: Ceres ANNOT ID no. 6015460
  misc_feature: Encodes the peptide sequence at SEQ ID NO 1350
atggggagcatcgaggtgtccaagccgccgtcgaagcgcctgtccccgaagcgcagcaacagcagcagcagcagcagcttcaagctgagcctgccgggcctgttctgcggccagtgcaaggccaccgcggcctcgtcgccgccggactccccaacggccggcggcgctggcgcgcggtcgctgtcgtcgtcctcagcgtccgcgtcggcctcgtcgtcctctgctggcacgtcccgcgggcgcaggcgcgaccgcatggcggagctccgcgagattttccgccacttcgaccgcgacatggacgggcgcatctccggcgcggagctgcgcgagttcttcgcgtccatgggcgacgacggcggcagcctggcgctgctggggctcaacaagcaggacggaggggcgggggaacacctgatgacgctggggttcgacgacttcgtgcgcatcgtggagagcaaaggcggggaggaggaggagcgcgaggacctccgccgcgccttcgaggcgttcgaggccgtcaaggggtccggccggatcacgccgcgcggcctgcagcgcgtgctcagccagctcggcgacgagccgtccgttgccgagtgcgaggccatgatccgcgcctacgacgacgacggcgacggcgagctcgacttccacgacttccaccgcatgatgagccaggactag

SEQ ID NO: 1350 - protein, 228 aa, Sorghum bicolor
  misc_feature: Ceres ANNOT ID no. 6015460
  misc_feature (88)..(116): Pfam Id: efhand Pfam Desc: EF hand
  misc_feature (200)..(228): Pfam Id: efhand Pfam Desc: EF hand
  misc_feature (1)..(228): NCBI GI: 15289907 NCBI Desc: p0403c05.24 [oryza sativa (japonica cultivar-group)]
  misc_feature (61)..(226): NCBI GI: 15723363 NCBI Desc: calmodulin-like protein [musa acuminata]
  misc_feature (59)..(226): NCBI GI: 22136314 NCBI Desc: calmodulin-like protein [arabidopsis thaliana]
  misc_feature (58)..(226): NCBI GI: 140063818 NCBI Desc: calcium-binding ef-hand [medicago truncatula]
  misc_feature (57)..(225): NCBI GI: 144923596 NCBI Desc: flagellar calcium-binding protein (calflagin) [medicago truncatula]
MGSIEVSKPPSKRLSPKRSNSSSSSSFKLSLPGLFCGQCKATAASSPPDSPTAGGAGARSLSSSSASASASSSSAGTSRGRRRDRMAELREIFRHFDRDMDGRISGAELREFFASMGDDGGSLALLGLNKQDGGAGEHLMTLGFDDFVRIVESKGGEEEEREDLRRAFEAFEAVKGSGRITPRGLQRVLSQLGDEPSVAECEAMIRAYDDDGDGELDFHDFHRMMSQD

SEQ ID NO: 1351 - DNA, 1464 bp, Sorghum bicolor
  misc_feature: Ceres ANNOT ID no. 6015462
  misc_feature: Encodes the peptide sequence at SEQ ID NO 1352
atggcgccggctgcgggggcgggggcggtggcgggcagcaggcgcaagaactggtcggacgagtgcaggaacctgtggcgcgtcgcggggccggtgatcctcaccgggatcttccagttcctcctcggcttcgtcaccacggccttcgtcggccacatcggcaaggtcgagctcgccgctgtctccatcgtcaacggcgtcgtcgagggcctcgccttcggtctcctgctgggcatggggagcgccctggagacgctgtgcgggcaggcggtgggcgccgggcagctccagatgctgggcgtctacatgcagcggtcctggatcatctgcgtcgccacctccctcgtcctgctcccgctctacgtcttcacgtccccgatcctccgcctgctccggcagtccgccgacatctcggcggtgtccgggcggtacgcgcgctggtgcgtgccgcagctgttcgcgtacgccgtcaacttccccatgcagaagttctaccaggcgcagagcagggtgtgggtgatgacggccatctcgggcgccgtgctggccgtgcacgcgctgctcaactggctcgtcgtgtccaggctcggccgcgggctggtcggcgccgccgtcgtgggcgacgtctcctggtggctcgtcaacgtggcgcagttcgtgtacctcgtcggcggctccttcccgggggcgtggactgggttctcgcgcaaggcgttcgccagcctcggcggcttcgtcaggctctccatcgcctcggctgtcatgctgtgcttagagatgtggtattatacggcagtgctcattctggttggatgcctgaagaacccagagattcaagttgatgcgatctccatatgcatgaactatcagctttggacactgatggttgctgttggcttcaatgctgcagtaagtgttcgcgtgtcgaacgagctcggcgccaaccatccaaaggcggccaaattctccgtcgtcgtcgccaccgccacatcggccgtcatcggggtgatcttcacggcggttgctctggcggcgaggaagcagatgcctcggcttttcacgggcgacgacgtggttctcagggcgactgccaagctggggtacctcctggccgccaccatatttctcaacagcatccagcctgtgctgtcaggcgtggcgatcggtgccgggtggcagtcgttagtcgcgttcgtcaacatcggcagctactacctcgtcggcctgcccctggcagctgtgtttgggttcaagctgaagctcaatgcaacagggatttgggtgggcgtgttgattggaacagtattacagactgtgattctgtttgtaatcctcagcagaaccaaatggcagaaagaggctatgctagcagaagagagaatacgggtgtggggaggaaacgtcgagctgccacagactcaagagacgagaccaagtgaaaacactgccgcaactgtatcatag

SEQ ID NO: 1352 - protein, 487 aa, Sorghum bicolor
  misc_feature: Ceres ANNOT ID no. 6015462
  misc_feature (31)..(191): Pfam Id: MatE Pfam Desc: MatE
  misc_feature (251)..(414): Pfam Id: MatE Pfam Desc: MatE
  misc_feature (1)..(475): NCBI GI: 57899572 NCBI Desc: integral membrane protein-like [oryza sativa (japonica cultivar-group)]
  misc_feature (1)..(475): NCBI GI: 115440147 NCBI Desc: os01g0766000 [oryza sativa (japonica cultivar-group)]
  misc_feature (16)..(469): NCBI GI: 27764936 NCBI Desc: at1g47530/f16n3_20 [arabidopsis thaliana]
  misc_feature (10)..(465): NCBI GI: 15220701 NCBI Desc: mate efflux family protein [arabidopsis thaliana]
  misc_feature (10)..(453): NCBI GI: 9295710 NCBI Desc: f26f24.14 [arabidopsis thaliana]
MAPAAGAGAVAGSRRKNWSDECRNLWRVAGPVILTGIFQFLLGFVTTAFVGHIGKVELAAVSIVNGVVEGLAFGLLLGMGSALETLCGQAVGAGQLQMLGVYMQRSWIICVATSLVLLPLYVFTSPILRLLRQSADISAVSGRYARWCVPQLFAYAVNFPMQKFYQAQSRVWVMTAISGAVLAVHALLNWLVVSRLGRGLVGAAVVGDVSWWLVNVAQFVYLVGGSFPGAWTGFSRKAFASLGGFVRLSIASAVMLCLEMWYYTAVLILVGCLKNPEIQVDAISICMNYQLWTLMVAVGFNAAVSVRVSNELGANHPKAAKFSVVVATATSAVIGVIFTAVALAARKQMPRLFTGDDVVLRATAKLGYLLAATIFLNSIQPVLSGVAIGAGWQSLVAFVNIGSYYLVGLPLAAVFGFKLKLNATGIWVGVLIGTVLQTVILFVILSRTKWQKEAMLAEERIRVWGGNVELPQTQETRPSENTAATVS

SEQ ID NO: 1353 - DNA, 687 bp, Sorghum bicolor
  misc_feature: Ceres ANNOT ID no. 6015464
  misc_feature: Encodes the peptide sequence at SEQ ID NO 1354
atgtctagcggtaacgcgtggtcgccactcccttcgaatggatttggcggcatggcgaaccgtgccggcgagcctatcgcgaggaccaaccgccgcggcggcagcggcagcggcaacaaggactcgggcagcttcgagtgcaacatcttggtcaccctctacgaccacctcttctgctggccctacctctacgagtggctccacgtccacgcgcactcccaggattgccccgtctgcaaggccgtcgtcgaggaggggaagctcgtctctctctacggccgtggcggcaactccaccgcaccccgtgcaaggtcggtggcaggtgtggaaatcacgagcagaccgaccggtcagcggccctccaccgccccacagcctgaccacaacaaccattacccgcaccagaacccctggttcattggtgctggtgctcctccccctgtggctggtggtcggtgggggaactacactttctcgaccgccattggagggttgttcccgttgctaagcttccaggtgcaaggattcccccaggcaaccgcatatgggcctgctacatggtttccttatggatatggccattctttccatgattatgggcatggtttcccggcctcgcgccgggcaccgcaagtgttgctgctggtagttggtgtgcttgtaattgctagcttgatcacattttag

SEQ ID NO: 1354 - protein, 228 aa, Sorghum bicolor
  misc_feature: Ceres ANNOT ID no. 6015464
  misc_feature (8)..(228): NCBI GI: 115440149 NCBI Desc: os01g0766200 [oryza sativa (japonica cultivar-group)]
  misc_feature (11)..(120): NCBI GI: 109451836 NCBI Desc: rnf185 [synthetic construct]
  misc_feature (11)..(120): NCBI GI: 119580350 NCBI Desc: ring finger protein 185, isoform cra_d [homo sapiens]
  misc_feature (11)..(120): NCBI GI: 119580348 NCBI Desc: ring finger protein 185, isoform cra_b [homo sapiens]
  misc_feature (11)..(120): NCBI GI: 119580351 NCBI Desc: ring finger protein 185, isoform cra_e [homo sapiens]
  misc_feature: The sequence is a functional homolog of SEQ ID NO 76 in the 10/666,642US patent application
  misc_feature: Useful for making plants with modulated growth and phenotype characteristics
  misc_feature: The sequence is a functional homolog of SEQ ID NO 76 in the 20070033671 US patent application
MSSGNAWSPLPSNGFGGMANRAGEPIARTNRRGGSGSGNKDSGSFECNILVTLYDHLFCWPYLYEWLHVHAHSQDCPVCKAVVEEGKLVSLYGRGGNSTAPRARSVAGVEITSRPTGQRPSTAPQPDHNNHYPHQNPWFIGAGAPPPVAGGRWGNYTFSTAIGGLFPLLSFQVQGFPQATAYGPATWFPYGYGHSFHDYGHGFPASRRAPQVLLLVVGVLVIASLITF

SEQ ID NO: 1355 - DNA, 1248 bp, Sorghum bicolor
  misc_feature: Ceres ANNOT ID no. 6015465
  misc_feature: Encodes the peptide sequence at SEQ ID NO 1356
atgtcatggctcgctcgctccatcgccgccacactatcctccgcccactctgacgacgacgatgaatccgagtccccctccggcgacaagagcccgccgcgcgcctctgaccccaccagcgctgacaccgtggagtccgacgagcagccggacaccccgagccgcggcgttaagggcgatatctcggagctgaccgagtccctcacccgccggttctggggcgttgcctccttcctcgcgccaccgccggttgagggagaggcgggggaagaggaggaggaggaggaggaggaggaggaggaggaggaggaggaggaggagcatgccgccgctgcggaggtgcctcagtccccacggatcgacgggatccggagtgacctggcggagatcgggggcagggtgaagaccggcatctcgatgctgtcgaacgccggcgcggtggcggagatctccaggatcgcgtcgtcgttcctgccattcgggcctggggatcagggggaggaggaagaaggcgaggcggtcggtgtcaccgaggaggtagtggtgttcgtcagtaacatctcaaagcatccgaagacatggcttgattttcccttgtttgttgatgaccgacacacggatgattttgaactgtcagatgcacagtatggacatgcagttgctatagagcgccttgtgccaagcctgtcatacctcaggactgagctttgctctaccaatatgagtgaagcgtgcttctggaagatatattttgtgcttctccattcgaaactcagcaagcaagatgctgaaattctttcaacaccacaaatcctggaagcaagaggactattgcaaagttcaccaacgaagaacaagctgttatcagaaaacaggaatactacagaacctgaagagagtgagttgtcaccgtcaagcatccaaaacaagcacggagtaactgaagtgccgtcattccaagaactaaactctgaccatgtgccaaatgttgaggctgacaagcatcctatctcaagtgctgaggcagaaatagttgacaagtctgtaattcaagaagagttggtaatgaaaactgaggccaagagtttacccactgagaagtctaaccctcaccctgcagaggatgatgatgaaaaagaagtagatgattggctacaggatgtggatcatgtgtccagcaaaactggaaacaccactgcagttggtgaggaggaagatgtatccttcagcgatctagaggatgactag

SEQ ID NO: 1356 - protein, 415 aa, Sorghum bicolor
  misc_feature: Ceres ANNOT ID no. 6015465
  misc_feature (198)..(264): Pfam Id: BSD Pfam Desc: BSD domain
  misc_feature (37)..(415): NCBI GI: 115440155 NCBI Desc: os01g0766600 [oryza sativa (japonica cultivar-group)]
  misc_feature (112)..(323): NCBI GI: 115485895 NCBI Desc: os11g0557300 [oryza sativa (japonica cultivar-group)]
  misc_feature (195)..(415): NCBI GI: 6573740 NCBI Desc: f20b24.15 [arabidopsis thaliana]
  misc_feature (168)..(387): NCBI GI: 46367696 NCBI Desc: bsd protein [oryza sativa (japonica cultivar-group)]
  misc_feature (168)..(387): NCBI GI: 115455117 NCBI Desc: os03g0729900 [oryza sativa (japonica cultivar-group)]
MSWLARSIAATLSSAHSDDDDESESPSGDKSPPRASDPTSADTVESDEQPDTPSRGVKGDISELTESLTRRFWGVASFLAPPPVEGEAGEEEEEEEEEEEEEEEEEEHAAAAEVPQSPRIDGIRSDLAEIGGRVKTGISMLSNAGAVAEISRIASSFLPFGPGDQGEEEEGEAVGVTEEVVVFVSNISKHPKTWLDFPLFVDDRHTDDFELSDAQYGHAVAIERLVPSLSYLRTELCSTNMSEACFWKIYFVLLHSKLSKQDAEILSTPQILEARGLLQSSPTKNKLLSENRNTTEPEESELSPSSIQNKHGVTEVPSFQELNSDHVPNVEADKHPISSAEAEIVDKSVIQEELVMKTEAKSLPTEKSNPHPAEDDDEKEVDDWLQDVDHVSSKTGNTTAVGEEEDVSFSDLEDD

SEQ ID NO: 1357 - DNA, 2070 bp, Sorghum bicolor
  misc_feature: Ceres ANNOT ID no. 6015467
  misc_feature: Encodes the peptide sequence at SEQ ID NO 1358
atggcgcagtggtggggacgggaggcgcggggcggcggcggccgcggcgggacctctgtggtggttaagatggagagcccggactgggccgtcccggggtcggcggcggcggggggcaaagccggccgcagcaagaacgctcgccagatcacgtgggtgctgctgctcaaggcgcaccgagccgcggggaagctcacgggcgccgcctccgccgcgctgtctgtcgccgccgccgcgcggaggcgggtgtcggcggggcggaccgacgacgacgtcgacgccgacgaggccggcgccgccgcgacgcccggggagagccccgccctgcgcgccaggctctacggcttcctccgcgtcttcctcctcctgtccatgctcctcctcgccgtcgacgtcgccgcgcacctccagggctggcacctcgccgtcgacgtccccgacctgctcgccgtcgagggcctcttcgccgctgggtacgcgtcctgggtgcgcgtccgcctcgagtacctcgcgccggcgctgcagttcatggcgaacgcgtgcgtcgtgctcttcttgatccagagcgccgaccgccttatcctctgcctgggttgcctctggatcaagctcaagggcatcaagcctgttcccaaggctgctggcaaagggtcggacgacgacgtcgaggccgacacaaccggggagttccccatggtgctcgtgcagattccaatgtgcaacgagaaggaggtgtaccagcaatctattggtgctgtttgcggtctggactggccaaggcccaacttcttggtgcaggtgctagatgattctgatgatgctgccacttcagcacttattaaagaggaggtggagaagtggcaacgcgaaggcgttcgcatattgtaccgacaccgagtaattcgtgatggatacaaggctggaaatctcaagtcagccatgaactgcagctatgtaaaagattatgagtttgttgttatctttgacgctgattttcaaccccagccagacttcctgaagcgaactgtgccccatttcaagggcaatgaggatgttgggctagttcaggcaaggtggtcttttgtgaacaaggatgagaacttgttaactagactgcaaaacataaacctttgcttccactttgaggtggagcagcaggttaatgggatcttcctcaatttctttggattcaacggaacggcaggagtgtggagaataaaggcacttgaggattcaggtggatggatggagaggacaacagtggaggacatggatattgctgtccgagcacacctcaagggctggaagtttatgttccttaatgatgttgagtgccagtgtgaattgccagagtcgtatgaggcatatcggaaacagcaacaccgatggcactctggtcccatgcaattgtttagactctgctttgtggatattattaaatcaaagattggattttggaagaagttcaacctcatatttcttttctttctccttcgcaagcttattttgcccttctattccttcactcttttctgcatcatccttcccatgacaatgtttattcctgaagctgagctccctgcctgggttgtgtgctacattccggcaaccatgtccttgctgaacatcctcccagcccccaaatccttcccatttattgtcccctatctcctatttgagaataccatgtcagtaaccaaattcaacgccatggtttctggcttattccagctcgggagtgcctacgagtgggtcgtcaccaagaaatcaggccgttcttctgagggtgatctcattgccctcgtcgagaagcagtctaaacagcaaagggtagggtctgcacccaaccttgattcccttacaaaggagtcttccaatctcaaaaaggattccaaaaagaagaaacacaataggatatacaggaaggagctggcactctccttccttctcttgacagcagctgctcggagcctgctatcggtgcaaggaatacatttctacttccttctgttccaaggggtatcattcttggttgttggactcgatttaatcggtgagcaagttgagtga

SEQ ID NO: 1358 - protein, 689 aa, Sorghum bicolor
  misc_feature: Ceres ANNOT ID no. 6015467
  misc_feature (234)..(409): Pfam Id: Glycos_transf_2 Pfam Desc: Glycosyl transferase family 2
  misc_feature (98)..(689): NCBI GI: 17385963 NCBI Desc: cslc9 [oryza sativa]
  misc_feature (98)..(689): NCBI GI: 16974749 NCBI Desc: cslc9 [oryza sativa]
  misc_feature (4)..(688): NCBI GI: 114224789 NCBI Desc: cellulose synthase-like c3 [physcomitrella patens]
  misc_feature (4)..(688): NCBI GI: 114224787 NCBI Desc: cellulose synthase-like c2 [physcomitrella patens]
  misc_feature (1)..(689): NCBI GI: 34419218 NCBI Desc: tpa: cellulose synthase-like c2 [oryza sativa (indica cultivar-group)]
  misc_feature: Useful for making plants with altered cell wall content and/or composition
  misc_feature: Functional homolog of the protein sequence encoded by LOCUS at3g07330
  misc_feature: Functional homolog of the protein sequence encoded by LOCUS at4g07960
  misc_feature: Useful for making plants with altered carbohydrate content
  misc_feature: Functional homolog of the protein sequence given in SEQ ID NO 13737
  misc_feature: Useful for making plants with altered cell wall content and/or composition
  misc_feature: Functional homolog of the protein sequence given in SEQ ID NO 13738
  misc_feature: The sequence is a functional homolog of SEQ ID NO. 403 in the 11/188,298 US application
MAQWWGREARGGGGRGGTSVVVKMESPDWAVPGSAAAGGKAGRSKNARQITWVLLLKAHRAAGKLTGAASAALSVAAAARRRVSAGRTDDDVDADEAGAAATPGESPALRARLYGFLRVFLLLSMLLLAVDVAAHLQGWHLAVDVPDLLAVEGLFAAGYASWVRVRLEYLAPALQFMANACVVLFLIQSADRLILCLGCLWIKLKGIKPVPKAAGKGSDDDVEADTTGEFPMVLVQIPMCNEKEVYQQSIGAVCGLDWPRPNFLVQVLDDSDDAATSALIKEEVEKWQREGVRILYRHRVIRDGYKAGNLKSAMNCSYVKDYEFVVIFDADFQPQPDFLKRTVPHFKGNEDVGLVQARWSFVNKDENLLTRLQNINLCFHFEVEQQVNGIFLNFFGFNGTAGVWRIKALEDSGGWMERTTVEDMDIAVRAHLKGWKFMFLNDVECQCELPESYEAYRKQQHRWHSGPMQLFRLCFVDIIKSKIGFWKKFNLIFLFFLLRKLILPFYSFTLFCIILPMTMFIPEAELPAWVVCYIPATMSLLNILPAPKSFPFIVPYLLFENTMSVTKFNAMVSGLFQLGSAYEWVVTKKSGRSSEGDLIALVEKQSKQQRVGSAPNLDSLTKESSNLKKDSKKKKHNRIYRKELALSFLLLTAAARSLLSVQGIHFYFLLFQGVSFLVVGLDLIGEQVE

SEQ ID NO: 1359 - DNA, 1557 bp, Sorghum bicolor
  misc_feature: Ceres ANNOT ID no. 6015470
  misc_feature: Encodes the peptide sequence at SEQ ID NO 1360
  misc_feature: Down-regulated in root tissues in response to salicylic acid treatment
atgatgcatccgctccgccgattcctcctcctcctcctcctcctcctcgtcggcctcctccccgcggccgtgtggtccctggcaccgccccgattcccgaggcaccagcaccgctcgcggccgggagttaatggggtgggggactacgagtacgagacgcgatacttccggcagcggttggaccacttcagctttcccggggtcgcggacgaggacgaggcggcggcgttcttccagcagcggtacctggtgggccgcggcggtgggtgggccggacccggcggccccatcttcttctactgcggcaacgagggcgacatcgcctggttcgcctccaactccggcctcgtctgggaggccgccccgcgcttcgccgccctcgtcgtcttcgccgagcatcgctactacggagagtccatgccgtttggtagcaaagctaaggcgtacaatgactccaagtccctagcgtatctcacggccgagcaggcgcttgctgacttcgctgtgctcctcactgacctcaagcggaacctatctgcagagggcagccccgtcgtgctctttgggggctcatatggtggaatgctagctgcttggatgagactcaagtatccccatatttctgttggagctctctcatcatcagcaccaatactgcagtttgaggacattgttccttctactattttctatgatctcgtatcggatgattttaggagggaaagtttaagctgctttcttacaataaaagactcctggaaagaattagatgaccaaggaaacgagcaaggtggtcttctgaaactaagcaaaacatttcacctttgccagaccttgaaaacaagcggagacctttcagattggttgagctctgcgtacagttatctggccatggtggattacccacttccatcagaatttctcatgcctttgccagccaatcctattaaagaagtatgcagaaatatcgacagtcaacctgagggtactagtactctggaacgcatatatgcaggagtaaatgtatactacaattatactggcacagttggctgctttgatctaaatgatgatccccatggaatgggtggatgggattggcaggcttgtaccgagatggtaatgccaatgtcttacagtgaaggcaggagcatgtatccaccatataaatttgactatccttcctatgctgatgggtgcatcaaaagctatggtgtcaggccaaggcctcggtggatcacaacagagtttggtgggcataatatcactacggtcctggaaaagtttggtagtaacatcatattcttcaatgggctccttgacccgtggagtggcggaggtgtcttgaagaacatatctgagagtgtcattgcaattgtggctccattaggagcacaccacatcgatctgcgccccgcaactccagacgacccagattggctggtggccctgagagaatcagagctgaagatcatctctggctggttatcggattactacggggcgggaggggcggtcttccagcctgtagctgccaagggctcctcttcatcctaa

SEQ ID NO: 1360 - protein, 518 aa, Sorghum bicolor
  misc_feature: Ceres ANNOT ID no. 6015470
  misc_feature (58)..(488): Pfam Id: Peptidase_S28 Pfam Desc: Serine carboxypeptidase S28
  misc_feature (8)..(499): NCBI GI: 22328106 NCBI Desc: serine carboxypeptidase s28 family protein [arabidopsis thaliana]
  misc_feature (30)..(499): NCBI GI: 10177334 NCBI Desc: lysosomal pro-x carboxypeptidase [arabidopsis thaliana]
  misc_feature (8)..(468): NCBI GI: 18700101 NCBI Desc: at5g65760/mpa24_11 [arabidopsis thaliana]
  misc_feature (51)..(500): NCBI GI: 22655366 NCBI Desc: at2g24280/f27d4.19 [arabidopsis thaliana]
  misc_feature (30)..(368): NCBI GI: 2827710 NCBI Desc: lysosomal pro-x carboxypeptidase - like protein [arabidopsis thaliana]
  misc_feature: Down-regulated in root tissues in response to salicylic acid treatment
MMHPLRRFLLLLLLLLVGLLPAAVWSLAPPRFPRHQHRSRPGVNGVGDYEYETRYFRQRLDHFSFPGVADEDEAAAFFQQRYLVGRGGGWAGPGGPIFFYCGNEGDIAWFASNSGLVWEAAPRFAALVVFAEHRYYGESMPFGSKAKAYNDSKSLAYLTAEQALADFAVLLTDLKRNLSAEGSPVVLFGGSYGGMLAAWMRLKYPHISVGALSSSAPILQFEDIVPSTIFYDLVSDDFRRESLSCFLTIKDSWKELDDQGNEQGGLLKLSKTFHLCQTLKTSGDLSDWLSSAYSYLAMVDYPLPSEFLMPLPANPIKEVCRNIDSQPEGTSTLERIYAGVNVYYNYTGTVGCFDLNDDPHGMGGWDWQACTEMVMPMSYSEGRSMYPPYKFDYPSYADGCIKSYGVRPRPRWITTEFGGHNITTVLEKFGSNIIFFNGLLDPWSGGGVLKNISESVIAIVAPLGAHHIDLRPATPDDPDWLVALRESELKIISGWLSDYYGAGGAVFQPVAAKGSSSS

SEQ ID NO: 1361 - DNA, 1107 bp, Sorghum bicolor
  misc_feature: Ceres ANNOT ID no. 6015482
  misc_feature: Encodes the peptide sequence at SEQ ID NO 1362
atgcagagctcgctcgcgcggccgctgcggccgccggtactggccggatgcggcggtagacggggccacggggccccacgcggctcggtatccgtggcacggtgccgcgctgaggcggcgccgccgacggtggggacggcgtctagggcgcctgcgggcccgtacaccgggagggacccggaggtgaagaagcccgcgtggctgcggcagcgcgctgcgcagggggacaagtacgctcgcctgcgggagtccatcggcgagctcaagctcaacaccgtctgcgtcgaggcacagtgccccaacatcggcgagtgttggaacggaggtggaggggccggcggcgaaggggacggcatcgcgacggccaccatcatggtgcttggtgacacctgcacgcgcggctgtcgattctgcgctgtgaagaccagcaacaagccgcccccgccggatcccctggagcctctaaacacggctttggcagttgcaagctggggagtagactatgttgtgctaaccagtgtcgatagagatgacttacctgatggtggaagcagccattttgctcagacagtgagagctttaaaggagctcaaacctggaatactggtggagtgcttaacctcggattttcgaggtgacctggaggctgtttcatctttagcaaactccggcctagatgtttatgcgcacaacattgaaactgtgaggagtctgcagaggattgtgagggatcctcgggcagggtatgatcagagcttggcagttctcaagcatgcaaaagattgcagggagggcatgattacaaagtcttctatcatgcttggtcttggagagactgatgaagaggtgaaacaagcaatgatagatctacgggcaattggtgttgacatccttactttgggccagtacttgcagccaacagaaagacatctaacagtaagagagtatgtgactcccgagaagttccagttttggaaggagtatggagaatcggtcggtttccgatatgttgctagtggacccttggttcggtcttcctaccgtgcaggagagctctttgtccaaaatttggtcagaaataacaaaactgggtcttcctcatcttaa

SEQ ID NO: 1362 - protein, 368 aa, Sorghum bicolor
  misc_feature: Ceres ANNOT ID no. 6015482
  misc_feature (125)..(290): Pfam Id: Radical_SAM Pfam Desc: Radical SAM superfamily
  misc_feature (53)..(367): NCBI GI: 21553591 NCBI Desc: lipoic acid synthase-like protein [arabidopsis thaliana]
  misc_feature (53)..(367): NCBI GI: 18415808 NCBI Desc: lipoic acid synthase family protein [arabidopsis thaliana]
  misc_feature (53)..(220): NCBI GI: 10178283 NCBI Desc: lipoic acid synthase-like protein [arabidopsis thaliana]
  misc_feature (62)..(363): NCBI GI: 60650254 NCBI Desc: lipoic acid synthetase isoform 1 precursor [bos taurus]
  misc_feature (57)..(360): NCBI GI: 108874549 NCBI Desc: lipoic acid synthetase [aedes aegypti]
MQSSLARPLRPPVLAGCGGRRGHGAPRGSVSVARCRAEAAPPTVGTASRAPAGPYTGRDPEVKKPAWLRQRAAQGDKYARLRESIGELKLNTVCVEAQCPNIGECWNGGGGAGGEGDGIATATIMVLGDTCTRGCRFCAVKTSNKPPPPDPLEPLNTALAVASWGVDYVVLTSVDRDDLPDGGSSHFAQTVRALKELKPGILVECLTSDFRGDLEAVSSLANSGLDVYAHNIETVRSLQRIVRDPRAGYDQSLAVLKHAKDCREGMITKSSIMLGLGETDEEVKQAMIDLRAIGVDILTLGQYLQPTERHLTVREYVTPEKFQFWKEYGESVGFRYVASGPLVRSSYRAGELFVQNLVRNNKTGSSSS

SEQ ID NO: 1363 - DNA, 846 bp, Sorghum bicolor
  misc_feature: Ceres ANNOT ID no. 6015491
  misc_feature: Encodes the peptide sequence at SEQ ID NO 1364
atggcgcacggcctcgccggcggcgtcggccccctccggtgctgtccctccgtgtcctcctcctccaccaccgttcatcacaccctggacgctccccctcgtcgaagcttagcgatgtgcgcctcgaccttctctcctccagccgcttccgccatcgagggccgcgacgtcgggctctcggtgaccacgcggcggggcagggtgttgccggtgcttaagggatgctccctccttgtcccacccgggcagctctggatgctcctcgggcccaacggctgcggcaagtccaccctgctgaaggttttagcaggttttctgaatccttcggctggtacagtgtatgtaaacagaccatgcagctatgtcttccaaaatcctgatcaccaggttgtgatgcctacagtggaatctgatgtagcatttggtcttggtaagctcaaacttccattagatgaggtcaggttaagggtatcaaaatctttggatgctgttgggatgttgagctactctcagaggccaatccaaactctgagtggtgggcagaaacagagagttgcaattgctggggcgttagctgaagcatccaaagtattattgctggatgaactgaccacattcttagatgaacatgaccagataggcgtgataaaggcagtgaggaactctgtggctgctgatggggaggtcgccgcgttatgggtgactcatcggttggaggagctgaaatatgcagatggcgccatttatatggaagatggccagataatcattcaaggcgacgtttctaccatatcaagatttataaagagaaaacaagcacgctactttggtcattttgaactctaa

SEQ ID NO: 1364 - protein, 281 aa, Sorghum bicolor
  misc_feature: Ceres ANNOT ID no. 6015491
  misc_feature (82)..(253): Pfam Id: ABC_tran Pfam Desc: ABC transporter
  misc_feature (72)..(272): NCBI GI: 145353496 NCBI Desc: abc(atp-binding) family transporter: cobalt ion [ostreococcus lucimarinus cce9901]
  misc_feature (70)..(273): NCBI GI: 16330365 NCBI Desc: abc transporter [synechocystis sp. pcc 6803]
  misc_feature (71)..(268): NCBI GI: 126657001 NCBI Desc: abc transporter [cyanothece sp. ccy0110]
  misc_feature (71)..(264): NCBI GI: 67920049 NCBI Desc: abc transporter [crocosphaera watsonii wh 8501]
  misc_feature (72)..(260): NCBI GI: 17232038 NCBI Desc: abc transporter atp-binding protein [nostoc sp. pcc 7120]
MAHGLAGGVGPLRCCPSVSSSSTTVHHTLDAPPRRSLAMCASTFSPPAASAIEGRDVGLSVTTRRGRVLPVLKGCSLLVPPGQLWMLLGPNGCGKSTLLKVLAGFLNPSAGTVYVNRPCSYVFQNPDHQVVMPTVESDVAFGLGKLKLPLDEVRLRVSKSLDAVGMLSYSQRPIQTLSGGQKQRVAIAGALAEASKVLLLDELTTFLDEHDQIGVIKAVRNSVAADGEVAALWVTHRLEELKYADGAIYMEDGQIIIQGDVSTISRFIKRKQARYFGHFEL

SEQ ID NO: 1365 - DNA, 750 bp, Sorghum bicolor
  misc_feature: Ceres ANNOT ID no. 6015501
  misc_feature: Encodes the peptide sequence at SEQ ID NO 1366
atgctccgccgcgccgcccctacgacggccgcactctgccgtcgcgcgctctctgccacgccatcctcctcccgcaccgccgcggcaaccgcggcggcctcctcctctgccgtgaactccatcctcctccgctcgctcaaggagcactacctcgaggtctgcaagatgacgccaccgcccaaggtcagcccaccagagcccttcaccatcgtcaagggcgccctggaccagccgtcgggacccgtgctgcgccgcgaatatggtgacgacggcgaggagatctccatctccgtcgccaggctcgccaacatcctgcccgccggcgccgactctgactcggacggtgccggcgagggcggagggatgagcgcgtccatcagccagctcttcctccatgttgatatctccaagcccgggtcaggaaagtcgatgcagttcctttgcgggctgtacccggacgcccttgggatccattcggtctgcctccggtctaagaacgccgagtctttgaacggggatatgacttcgaagggcggcggagagtaccgagggcgtattttccaagagttggatgaaaaggttcgtgatgcactccatctttacattgaagcccgtggcataaatgagaagctcttccgttttctccaagcttggctttatgtaaaggatcaccgcaatcttatacgctggttcaagagtgttggttcagccatcagtgagccaaagccaaacattaccacgtttgtttag

SEQ ID NO: 1366 - protein, 249 aa, Sorghum bicolor
  misc_feature: Ceres ANNOT ID no. 6015501
  misc_feature (42)..(238): Pfam Id: MAM33 Pfam Desc: Mitochondrial glycoprotein
  misc_feature (133)..(240): NCBI GI: 6503284 NCBI Desc: f23a5.7 [arabidopsis thaliana]
  misc_feature (11)..(240): NCBI GI: 115480619 NCBI Desc: os09g0557400 [oryza sativa (japonica cultivar-group)]
  misc_feature (133)..(240): NCBI GI: 20334884 NCBI Desc: at1g15870/f7h2_19 [arabidopsis thaliana]
  misc_feature (16)..(234): NCBI GI: 50725737 NCBI Desc: mitochondrial glycoprotein-like [oryza sativa (japonica cultivar-group)]
  misc_feature (82)..(234): NCBI GI: 4176524 NCBI Desc: spbc776.07 [schizosaccharomyces pombe]
MLRRAAPTTAALCRRALSATPSSSRTAAATAAASSSAVNSILLRSLKEHYLEVCKMTPPPKVSPPEPFTIVKGALDQPSGPVLRREYGDDGEEISISVARLANILPAGADSDSDGAGEGGGMSASISQLFLHVDISKPGSGKSMQFLCGLYPDALGIHSVCLRSKNAESLNGDMTSKGGGEYRGRIFQELDEKVRDALHLYIEARGINEKLFRFLQAWLYVKDHRNLIRWFKSVGSAISEPKPNITTFV

SEQ ID NO: 1367 - DNA, 768 bp, Sorghum bicolor
  misc_feature: Ceres ANNOT ID no. 6015521
  misc_feature: Encodes the peptide sequence at SEQ ID NO 1368
atgctgccgtgcgcgaggtcggtgctgcggaggagggggctggcgtcttccgtcctgcggaggtgcggcggggagggcgaatgctccaccggcgcgggggagctggtcgccaatgccaggtgttcgagcacgctggccgcgatcgtcggcggcggcgggcgcgtgctcgagcgcggcggccggtgggcatatccgcagaccggcgtgattggcgcggggcggatggcgcgcacgcagaccaggtgtttcctcgggtgcggcgacggggaggaggggggcgtgctctccaaggtctatgaggagaggcgcgtgatggggtactcgccggagcagatgtttgccgttgtcgcggcagtggacctctacgaggactttgtgccgtggtgccagcgttccaggattattaggcggcatgacgatggctcgtttgatgctgagctcgagattggattcaagttccttgttgaaagctatgtctcccatgtggagatggagaagcccaggtatatcaagacgacagcatctgaaagtggactttttgatcatttgataaacgtttgggaatttaagcctggtcctgttccagggacatgtgacctctacttcttagtcgattttaagtttcaatcaccactttatcgtcaggttgcatcgatgttcttcaaggaagttgtttcacgactagtgagctcacttaatgaccgttgttttagaatatatggacctgctgttccagtgcttgaaaatacttatggacaaggaagatga

SEQ ID NO: 1368 - protein, 255 aa, Sorghum bicolor
  misc_feature: Ceres ANNOT ID no. 6015521
  misc_feature (105)..(233): Pfam Id: Polyketide_cyc Pfam Desc: Polyketide cyclase / dehydrase and lipid transport
  misc_feature (1)..(255): NCBI GI: 56785219 NCBI Desc: aromatic-rich family protein-like [oryza sativa (japonica cultivar-group)]
  misc_feature (73)..(253): NCBI GI: 15236600 NCBI Desc: aromatic-rich family protein [arabidopsis thaliana]
  misc_feature (79)..(253): NCBI GI: 83853823 NCBI Desc: aromatic-rich family protein [glycine max]
  misc_feature (73)..(171): NCBI GI: 7268517 NCBI Desc: sperm protein homolog [arabidopsis thaliana]
  misc_feature (97)..(246): NCBI GI: 49899100 NCBI Desc: mgc83854 protein [xenopus laevis]
MLPCARSVLRRRGLASSVLRRCGGEGECSTGAGELVANARCSSTLAAIVGGGGRVLERGGRWAYPQTGVIGAGRMARTQTRCFLGCGDGEEGGVLSKVYEERRVMGYSPEQMFAVVAAVDLYEDFVPWCQRSRIIRRHDDGSFDAELEIGFKFLVESYVSHVEMEKPRYIKTTASESGLFDHLINVWEFKPGPVPGTCDLYFLVDFKFQSPLYRQVASMFFKEVVSRLVSSLNDRCFRIYGPAVPVLENTYGQGR

SEQ ID NO: 1369 - DNA, 2082 bp, Sorghum bicolor
  misc_feature: Ceres ANNOT ID no. 6015523
  misc_feature: Encodes the peptide sequence at SEQ ID NO 1370
atgccagagttgcgtagtggagtccggcaatctcggttgagggcaaagaaggttgaggatcttgtggctcaggaccctacagacaatttggttgtggcggcacctacggtggcaggaaggcgtggtagaggaaggggtggagggagaggagcagcacggggaaggggaggaagaggaagaggtgttccagtgattgacttggatcctgaccagccttgtgaggttcttccaggagctggtgttggtggccgcgctgcaggtggagcacagcccattggagctgataaggttgtgaaaatggatggtgggagtgctgagaagattgctgcaggtgaagatgaagggactacatctccagtcccagagaaggttcaagtaggccattctccgcagtacaaggttgagcgcaagttggggaaaggtggttttggccaagtatacgttggcagaaggatttctggtggaaccgagcgcactggacctgatgcttacgaggttgctttaaaatttgagcaccgaaacagcaagggctgcaattatggccctccatatgagtggcaagtttatagtgctctgaacgggtgttatggtgtaccatgggttcattacaaaggtcggcaaggagattactatgttctggtgatggatattctagggcccagcctttgggatgtctggaattcatttgggcagacgatgacagctaatatggttgcttgcattgctgtagaggcaatttctatacttgagaaacttcatgcaaaagggtttgttcatggagatgttaaacctgagaattttctacttggtcagcctggatcccctgacgagaaaaaactttttctgattgatcttgggttagcatctagatggaaggaagcagggtcatctggacaacatgttgaatatgatcagaaaccagatattttcagaggtacaataagatacgctagtgtccatgcacatttaggacgtactggtagcagaagggatgatctggaatcattagcatatacattgatatttcttcttagaggaaggttgccgtggcaaggttatcagggcgagaacaagagttttcttgtttgcaagaagaaaatggctacctcaccagatctactatgctgtttttgcccacctccattcaaactcttcctggagactgtgacaaacatgaaatttgatgaagaaccaaattactcaaagctcatttcccttttcgatgaattgattgagccccagcatttgagacctattagaattgatggtgcattgaaggctggacaaaagcgtggaagattacttgtaaatctagaagaagatgagcaaccgaagaagaaagttcgacttggaagcccagcaaatcagtggatttcagtttataacgctagaaggcccatgaagcagagataccattacaatgtagcagatgccagacttcatcaacacatagagaagggtaatgaagatggattgttcattagttcagtagcatcttcagcaaatctttgggccctcattatggatgcagggactggtttctcatcccaagtatatgaactttcacccatattccttcataaggattggattatggagcagtgggaaaataactactacatcagtgccatagctggtgcaacgaatgggagttccttggtggttatgtcaaaaggaactccttacactcagcagtcttacaaagttagtgaatcattcccctacaagtggatcaacaagaaatggaaagaaggttttcatgttacatcaatgacaactgcaggcagccgctggggtgtagttatgtcaaggaactctggatactctgaacaggtagtggaattggattttctttatcctagtgaaggtattcaccgacgatgggagaacggatatagaataacttcaacagcagccactggtgatcaagctgctttcatattgagtatacccaaaagaaagttaatggatgagacacaggaaactcttagaacatctgcttttccaagcaaccacgtgaaggagaaatgggccaagaacctttacattgcttcgatatgctatggccggacagtgtcatga

SEQ ID NO: 1370 - protein, 693 aa, Sorghum bicolor
  misc_feature: Ceres ANNOT ID no. 6015523
  misc_feature (132)..(407): Pfam Id: Pkinase Pfam Desc: Protein kinase domain
  misc_feature (1)..(692): NCBI GI: 9758901 NCBI Desc: casein kinase-like protein [arabidopsis thaliana]
  misc_feature (102)..(692): NCBI GI: 92896769 NCBI Desc: protein kinase-like [medicago truncatula]
  misc_feature (103)..(693): NCBI GI: 115462563 NCBI Desc: os05g0200500 [oryza sativa (japonica cultivar-group)]
  misc_feature (99)..(693): NCBI GI: 30682888 NCBI Desc: protein kinase family protein [arabidopsis thaliana]
  misc_feature (83)..(693): NCBI GI: 115439889 NCBI Desc: os01g0744300 [oryza sativa (japonica cultivar-group)]
  misc_feature: The sequence is a functional homolog of SEQ ID NO. 399 in the 11/188,298 US application
  misc_feature: The sequence is a functional homolog of SEQ ID NO. 332 in the 11/188,298 US application
MPELRSGVRQSRLRAKKVEDLVAQDPTDNLVVAAPTVAGRRGRGRGGGRGAARGRGGRGRGVPVIDLDPDQPCEVLPGAGVGGRAAGGAQPIGADKVVKMDGGSAEKIAAGEDEGTTSPVPEKVQVGHSPQYKVERKLGKGGFGQVYVGRRISGGTERTGPDAYEVALKFEHRNSKGCNYGPPYEWQVYSALNGCYGVPWVHYKGRQGDYYVLVMDILGPSLWDVWNSFGQTMTANMVACIAVEAISILEKLHAKGFVHGDVKPENFLLGQPGSPDEKKLFLIDLGLASRWKEAGSSGQHVEYDQKPDIFRGTIRYASVHAHLGRTGSRRDDLESLAYTLIFLLRGRLPWQGYQGENKSFLVCKKKMATSPDLLCCFCPPPFKLFLETVTNMKFDEEPNYSKLISLFDELIEPQHLRPIRIDGALKAGQKRGRLLVNLEEDEQPKKKVRLGSPANQWISVYNARRPMKQRYHYNVADARLHQHIEKGNEDGLFISSVASSANLWALIMDAGTGFSSQVYELSPIFLHKDWIMEQWENNYYISAIAGATNGSSLVVMSKGTPYTQQSYKVSESFPYKWINKKWKEGFHVTSMTTAGSRWGVVMSRNSGYSEQVVELDFLYPSEGIHRRWENGYRITSTAATGDQAAFILSIPKRKLMDETQETLRTSAFPSNHVKEKWAKNLYIASICYGRTVS

SEQ ID NO: 1371 - DNA, 1647 bp, Sorghum bicolor
  misc_feature: Ceres ANNOT ID no. 6015550
  misc_feature: Encodes the peptide sequence at SEQ ID NO 1372
atggcgcggtgcctgatgttcatgccgctgttcctcgtctcctccctcatcaccaccgtggggctgccggtggagccgcccgcggagcttctgcagctcggaggcggcgacgtcggcggcgggcgcctcagcgtcgacgcgtccgacatcgccgaggcgtcgcgcgacttcgggggcctcgcccgcgccgccgacgccgaggtcgagcccatggcggtgttccagccgcgcgtggccggcgacgtggcgggcctggtccgcgccgcgttcggttcggcgcgcggcttccgcgtctccgcgcgtggccacggccactccatcagcgggcaggcgcaggcccccggcggcgtggtggtggacatgagccacgggcccggcgccgcggcgcgggcgcgggcgcgggcattgcccgtgtactcgccggcgctgggcgggcactacgtggacgtctggggcggcgacctgtggatcgacgtgctcaactggacgctctcccacggcgggctcgcgccgcggtcgtggacggactacctctacctgtccgttggcggcaccctctccaacgccggcatcagcgggcaggcgttccaccacgggccacagatcagcaatgtctacgagctcgacgtcgtcacagggaagggagaggtggtgacctgctcggcgacggagaacccggacctattcttcggcgcgctcggcgggctgggccagttcggcatcatcacgcgggcgcgcatcgccctggagcgtgctccccaaagggttcggtggatccgggcgctctactccaacttcaccgagttcacggcggaccaggagcgcctcatctccctcggcagcggcagcggcggccgccggttcgactacgtggagggcttcgtcgtcgccgccgagggcctcatcaacaactggaggtcctccttcttctcgccgcagaacccggtgaagctcagctcgctcaagcaccactccggcgtcctctactgcctcgaggtcaccaagaactacgacgacgacaccgccgggtcggtcgaccaggatgtggatgcgctgctgggcgagctcaacttcctccctggcacggtgttcacgacggacctgccgtacgtggacttccttgaccgcgtgcacaaggcggagctgaagctgcgcgccaagggaatgtgggaggtgccgcacccgtggctgaacctcttcgtgccggcgtcccgcatcgccgacttcgaccgcggcgtcttccgtggcgtgcttgggggacgcaccgccggcgccggcggccccatcctcatctaccccatgaacaagcacaagtgggacccgaggagctcggtggtgaccccggacgaggaggtgttctacctggtggcgttcctgcggtcggcgctgccgggcgcgccggagagcctggaggcgctggtgcggcagaaccagcggatcctcgacttctgcgcggaggccggcatcagcgccaagcagtacctgcccaaccacaaggcgcagcacgagtgggcggagcacttcggcgccgccaggtgggagcggttccaaaggctcaaggccgagttcgaccccagggccatcctggccaccgggcagggcatcttccggccgcccggctcgacgccgctcgtggccgactcgtag

SEQ ID NO: 1372 - protein, 548 aa, Sorghum bicolor
  misc_feature: Ceres ANNOT ID no. 6015550
  misc_feature (253)..(536): Pfam Id: Cytokin-bind Pfam Desc: Cytokinin dehydrogenase 1, FAD and cytokinin binding
  misc_feature (70)..(221): Pfam Id: FAD_binding_4 Pfam Desc: FAD binding domain
  misc_feature (27)..(539): NCBI GI: 66773897 NCBI Desc: cytokinin dehydrogenase 5 precursor (cytokinin oxidase 5) (cko5) (atckx5) (atckx6)
  misc_feature (27)..(539): NCBI GI: 11120516 NCBI Desc: cytokinin oxidase [arabidopsis thaliana]
  misc_feature (237)..(539): NCBI GI: 10120443 NCBI Desc: similar to cytokinin oxidase [arabidopsis thaliana]
  misc_feature (49)..(544): NCBI GI: 115463543 NCBI Desc: os05g0374200 [oryza sativa (japonica cultivar-group)]
  misc_feature (5)..(544): NCBI GI: 23267157 NCBI Desc: cytokinin dehydrogenase 2 [hordeum vulgare]
  misc_feature (27)..(539): SWISSPROT Homolog: EC 1.5.99.12 Cytokinin dehydrogenase 5 precursor
MARCLMFMPLFLVSSLITTVGLPVEPPAELLQLGGGDVGGGRLSVDASDIAEASRDFGGLARAADAEVEPMAVFQPRVAGDVAGLVRAAFGSARGFRVSARGHGHSISGQAQAPGGVVVDMSHGPGAAARARARALPVYSPALGGHYVDVWGGDLWIDVLNWTLSHGGLAPRSWTDYLYLSVGGTLSNAGISGQAFHHGPQISNVYELDVVTGKGEVVTCSATENPDLFFGALGGLGQFGIITRARIALERAPQRVRWIRALYSNFTEFTADQERLISLGSGSGGRRFDYVEGFVVAAEGLINNWRSSFFSPQNPVKLSSLKHHSGVLYCLEVTKNYDDDTAGSVDQDVDALLGELNFLPGTVFTTDLPYVDFLDRVHKAELKLRAKGMWEVPHPWLNLFVPASRIADFDRGVFRGVLGGRTAGAGGPILIYPMNKHKWDPRSSVVTPDEEVFYLVAFLRSALPGAPESLEALVRQNQRILDFCAEAGISAKQYLPNHKAQHEWAEHFGAARWERFQRLKAEFDPRAILATGQGIFRPPGSTPLVADS

SEQ ID NO: 1373 - DNA, 1440 bp, Sorghum bicolor
  misc_feature: Ceres ANNOT ID no. 6015559
  misc_feature: Encodes the peptide sequence at SEQ ID NO 1374
atggctcccgccgactcggccacggcctcctcctcctcctcctccccggagtgctccgccgccccttccatgccgacggaccctgacttcctcagctgcgtcctacagccaccgacctcctcctcgtcccgccccgacgccgactacgctgccctccgccgcctccttctccgccgcaagcccccctccgcccttcagcaccgaatggagtggcggtgcaacggcaagggctatgtcgcctaccgcaactttctcctccggcgcatcgacggtggcagcgcccagagtacacccagcaacagtggaaggtgggctccctctccggtacatgctacactctccgaggcagacagctggagttatttgcgggacttgagaagtaacagcggtgtgttaagccgcaccctaagtattggctcaaagcacagtgatactgagaggcatgtcagatttgctgagcctgcatactcatttgttggaatgcattgcatctttgacaactgcaaggcctcagttacgatattgaaatttggccgtgcaagttcggacctgcttgcatatggtgcggcagatggcagcttgacagtctgccaggtttctgagccaccatctgttcttcagaaaatgatagggcattctaaaaatatcacagattttgatttttcatctaataaccagtacatagcttcatgctctctggataaaactgtacgagtatgggaaatctctaaaggcacatgcatcagggtcgtctatggaatttcttcccagctatgtatctgttttcatcctgtgaacaataatttgcttttagttggcaatgcaaacaaggaaatcaatgcaataaattttagcactgggagagtaatcagcaaacttaactttgatgatgcggttacagctttggatattgatcacactgggcagtttattttcgctggtgatgcacagggttacatatacactgttagtgtgaactcacatacagggtcattatctagaactcacaagaacaaaagtaataagagcaaatctcctattacgacaatccagtatcggaccttctctctggtggcgcgctgtccagtacttctttcttgtgctcaagatggaaacctttctttcttcagcatcacgacaaatgctaagggatacttgactctcatatgctccctaaaactggcgtcatggctgcagactatccgtgcttctttctgtccacttctttcccttgagaaaggagagttcatagttactggaagtgaggacgcaaatgtctacttctatgatttggcacgcccaaagaactcatgtgtgaataaactacagggacatggttctccagtaattggagttgcctggaatcatggggagaattttctggcctcatctgattcagatggcacagttattgtatggaagcgatcaaaaactaattag

SEQ ID NO: 1374 - protein, 479 aa, Sorghum bicolor
  misc_feature: Ceres ANNOT ID no. 6015559
  misc_feature (203)..(241): Pfam Id: WD40 Pfam Desc: WD domain, G-beta repeat
  misc_feature (436)..(474): Pfam Id: WD40 Pfam Desc: WD domain, G-beta repeat
  misc_feature (5)..(479): NCBI GI: 30679647 NCBI Desc: transducin family protein / wd-40 repeat family protein [arabidopsis thaliana]
  misc_feature (217)..(476): NCBI GI: 115440269 NCBI Desc: os01g0776400 [oryza sativa (japonica cultivar-group)]
  misc_feature (156)..(477): NCBI GI: 50346373 NCBI Desc: wdr13-like protein [pan troglodytes]
  misc_feature (156)..(477): NCBI GI: 45501300 NCBI Desc: wdr13 protein [homo sapiens]
  misc_feature (156)..(477): NCBI GI: 37231532 NCBI Desc: wdr13 protein [homo sapiens]
  misc_feature: The sequence is a functional homolog of SEQ ID NO. 502 in the 11/188,298 US application
  misc_feature: The sequence is a functional homolog of SEQ ID NO. 485 in the 11/188,298 US application
MAPADSATASSSSSSPECSAAPSMPTDPDFLSCVLQPPTSSSSRPDADYAALRRLLLRRKPPSALQHRMEWRCNGKGYVAYRNFLLRRIDGGSAQSTPSNSGRWAPSPVHATLSEADSWSYLRDLRSNSGVLSRTLSIGSKHSDTERHVRFAEPAYSFVGMHCIFDNCKASVTILKFGRASSDLLAYGAADGSLTVCQVSEPPSVLQKMIGHSKNITDFDFSSNNQYIASCSLDKTVRVWEISKGTCIRVVYGISSQLCICFHPVNNNLLLVGNANKEINAINFSTGRVISKLNFDDAVTALDIDHTGQFIFAGDAQGYIYTVSVNSHTGSLSRTHKNKSNKSKSPITTIQYRTFSLVARCPVLLSCAQDGNLSFFSITTNAKGYLTLICSLKLASWLQTIRASFCPLLSLEKGEFIVTGSEDANVYFYDLARPKNSCVNKLQGHGSPVIGVAWNHGENFLASSDSDGTVIVWKRSKTN

SEQ ID NO: 1375 - DNA, 1431 bp, Sorghum bicolor
  misc_feature: Ceres ANNOT ID no. 6015560
  misc_feature: Encodes the peptide sequence at SEQ ID NO 1376
atggggcggcacggcgtggaccagatcggcgccgtggcggcggcgttcgcctgggtcgtcctccttcccctgctgctcgtgggcgtcgtgtgcccgggcgcccaggccggccagacaagcgagtaccggcgccaactcggctccgccatcgacatgccactcgacgccgatgtcttccgccctcccccgggccacaatgcgcccgagcaggttcacatcacacaaggcaatcatgatggcacagccatgataatctcatgggtgacaacaagtgagcctggctcgagtactgtgatctacgggacttcagaggacaacctcaactatactgcaaatgggaagcacactcagtatactttctacaactacacctcaggatacattcatcattgcacaatcaaaaagttggagtttgacacaaagtattactatgctgttgggattggacaaacggtgaggaagttttggtttatgacccctccagaaagtggcccagatgttccatatacatttggtctcataggtgatcttggtcagagcttcgattccaatgttacgctcactcattatgagtccaatgcgaaagcacaggcagtgctttttgttggggatttgtcatatgcagataactacccataccatgataatgtgaggtgggatacatgggcaagatttgtagagaggaatgtcgcataccagccttggatctggactgctggaaatcatgagatagatttcgctcctgaacttggtgaaacaaagccattcaagccattcagccaaagatatcccacaccctacaaggcttctggtagcacggcaccttactggtattccatcaaaagggcctctgcctacattattgtcttggcatcatactcagcatacggaaaatacactcctcagtacaagtggcttgaagctgaatttcccaaggtcaacaggagtgaaacaccatggttgattgtcctcatgcatgctccatggtacaatagctataactatcactacatggaaggtgaaaccatgagggtgatgtatgagccatggttcgtcaagtacaaagttgacgtggtgtttgcaggacacgtccacgcctacgaacgtacacacaggatatcaaatgtggcatacaacgttgtgaatggcctgtgcactccaatctctgatcaatcggccccagtctacatcaccatcggcgatggagggaatcaggaaggactggctaccaacatgtcgcagccgcagccgaggtactcggccttcagggaggcgagcttcgggcacgccatcctggacatcaagaaccggacgcacgcgtactacacgtggcaccgcaaccaggacgggagctcggtggccgccgactccatgtggttcaccaaccggtactgggagcccacggacgattcggccgacgatttccagtga

SEQ ID NO: 1376 - protein, 476 aa, Sorghum bicolor
  misc_feature: Ceres ANNOT ID no. 6015560
  misc_feature (169)..(367): Pfam Id: Metallophos Pfam Desc: Calcineurin-like phosphoesterase
  misc_feature (21)..(471): NCBI GI: 4160280 NCBI Desc: purple acid phosphatase [ipomoea batatas]
  misc_feature (21)..(471): NCBI GI: 6635443 NCBI Desc: purple acid phosphatase precursor [ipomoea batatas]
  misc_feature (19)..(471): NCBI GI: 27597229 NCBI Desc: purple acid phosphatase [nicotiana tabacum]
  misc_feature (16)..(471): NCBI GI: 60459337 NCBI Desc: purple acid phosphatase [medicago truncatula]
  misc_feature (33)..(471): NCBI GI: 47716655 NCBI Desc: purple acid phosphatase 2 [solanum tuberosum]
  misc_feature (21)..(471): SWISSPROT Homolog: EC 3.1.3.2 Purple acid phosphatase precursor
MGRHGVDQIGAVAAAFAWVVLLPLLLVGVVCPGAQAGQTSEYRRQLGSAIDMPLDADVFRPPPGHNAPEQVHITQGNHDGTAMIISWVTTSEPGSSTVIYGTSEDNLNYTANGKHTQYTFYNYTSGYIHHCTIKKLEFDTKYYYAVGIGQTVRKFWFMTPPESGPDVPYTFGLIGDLGQSFDSNVTLTHYESNAKAQAVLFVGDLSYADNYPYHDNVRWDTWARFVERNVAYQPWIWTAGNHEIDFAPELGETKPFKPFSQRYPTPYKASGSTAPYWYSIKRASAYIIVLASYSAYGKYTPQYKWLEAEFPKVNRSETPWLIVLMHAPWYNSYNYHYMEGETMRVMYEPWFVKYKVDVVFAGHVHAYERTHRISNVAYNVVNGLCTPISDQSAPVYITIGDGGNQEGLATNMSQPQPRYSAFREASFGHAILDIKNRTHAYYTWHRNQDGSSVAADSMWFTNRYWEPTDDSADDFQ

SEQ ID NO: 1377 - DNA, 189 bp, Sorghum bicolor
  misc_feature: Ceres ANNOT ID no. 6015580
  misc_feature: Encodes the peptide sequence at SEQ ID NO 1378
atggcagggcaattgaaggccaaggtcctcgtcgtggccgcggccgccgtggtcatcgcctcctccctcgtcggcgcggcctccgctgccgccgacgcgcccgccccggctcccacctccggcgccacagtcgccgcgccggccttcgctgccgtcactgtcgccgcttttggctacctcttctgctaa

SEQ ID NO: 1378 - protein, 62 aa, Sorghum bicolor
  misc_feature: Ceres ANNOT ID no. 6015580
  misc_feature (1)..(62): NCBI GI: 115440295 NCBI Desc: os01g0778300 [oryza sativa (japonica cultivar-group)]
  misc_feature (1)..(56): NCBI GI: 115472945 NCBI Desc: os07g0573900 [oryza sativa (japonica cultivar-group)]
  misc_feature: Useful for making plants with altered cell wall content and/or composition
  misc_feature: Functional homolog of the protein sequence encoded by LOCUS at3g13520
  misc_feature: GREAT-hit functional homolog of the protein sequence encoded by LOCUS at5g56540
MAGQLKAKVLVVAAAAVVIASSLVGAASAAADAPAPAPTSGATVAAPAFAAVTVAAFGYLFC

SEQ ID NO: 1379 - DNA, 1200 bp, Sorghum bicolor
  misc_feature: Ceres ANNOT ID no. 6015600
  misc_feature: Encodes the peptide sequence at SEQ ID NO 1380
atgaatggttcaagtggttcccaagggcatcatgtcagtggagagaagcagcaagtgcatcatgttagccgacccattcttaacaatggaccaaagcaccgtccattgacccctatgaggcgatgccgtggtgtagcatgtgtagctattatactgtcaacagcattcctattgatagtttacttggctcctattactacttttgttgtgcggctgttcagtgtgcattacagccgaaaggcgacttcctttctatttggaatatggttatctttatggccattcttgtttgagaagataaacaaaaccaaggttgtcttctctggtgaaaatgtgcctccaaaaaggcgtgtattgttatttgctaaccacaggaccgaggttgactggatgtacttgtgggatcttgcactgaggaaaggccatttaggatatatcaagtatatacttaagagcagcttgatgaagttgcctatttttagctgggcatttcacatttttgagtttatcccggtagaaaggaaatgggagattgatgaagcaattatccagaacaaactatcaaaatttaagaaccccagagatcctatctggttggcggtttttcctgaaggcacggattatactgagaagaaatgcatcaagagtcaagagtatgcttcagaacatggtttgcctaagttagaacatgtcctccttccaaagacaaaggggttcatttgttgtttgcaagagctgaggagttccttagatgaagtttatgatgtcacaatagcttacaagcatcgactgccagattttctggacaacgtatatggtgttgatccttctgaagtacatatccacattagaacggttcagctccatcacatccccacatcagaagacgagataacagaatggatgatagagaggtttaggcagaaggaccagctcctgtcagattttttcgtgaagggccactttcctgatgaaggaatggaaggagatctatcgacgccaaagtgcctggcaaactttttaacagtagtaggcttgacggtcatctgcttgtacctaactcttttctcatctgtgtggttcaaggtctatgttctagcaagctgtgcttacctctcatttgttacctattactccatactaccaccccaactgataggttcaccggagggtgatgtcaaggccaaaaaggctgtgtag

SEQ ID NO: 1380 - protein, 399 aa, Sorghum bicolor
  misc_feature: Ceres ANNOT ID no. 6015600
  misc_feature (104)..(262): Pfam Id: Acyltransferase Pfam Desc: Acyltransferase
  misc_feature (1)..(399): NCBI GI: 115440337 NCBI Desc: os01g0782500 [oryza sativa (japonica cultivar-group)]
  misc_feature (69)..(394): NCBI GI: 145332637 NCBI Desc: lpat5 [arabidopsis thaliana]
  misc_feature (32)..(340): NCBI GI: 5882722 NCBI Desc: contains similarity to gbz95637 acyl-coa:1-acylglycerol-3-phosphate acyltransferase from brassica napus. [arabidopsis thaliana]
  misc_feature (43)..(372): NCBI GI: 47086103 NCBI Desc: zgc:77380 [danio rerio]
  misc_feature (43)..(390): NCBI GI: 37182526 NCBI Desc: hsrg1849 [homo sapiens]
MNGSSGSQGHHVSGEKQQVHHVSRPILNNGPKHRPLTPMRRCRGVACVAIILSTAFLLIVYLAPITTFVVRLFSVHYSRKATSFLFGIWLSLWPFLFEKINKTKVVFSGENVPPKRRVLLFANHRTEVDWMYLWDLALRKGHLGYIKYILKSSLMKLPIFSWAFHIFEFIPVERKWEIDEAIIQNKLSKFKNPRDPIWLAVFPEGTDYTEKKCIKSQEYASEHGLPKLEHVLLPKTKGFICCLQELRSSLDEVYDVTIAYKHRLPDFLDNVYGVDPSEVHIHIRTVQLHHIPTSEDEITEWMIERFRQKDQLLSDFFVKGHFPDEGMEGDLSTPKCLANFLTVVGLTVICLYLTLFSSVWFKVYVLASCAYLSFVTYYSILPPQLIGSPEGDVKAKKAV

SEQ ID NO: 1381 - DNA, 1689 bp, Sorghum bicolor
  misc_feature: Ceres ANNOT ID no. 6015601
  misc_feature: Encodes the peptide sequence at SEQ ID NO 1382
atggcgagcaacggcttgtcgctggtgcgccgagccgccgaggcggtgcgccgcacgccgcgatggaagaaggggctcgtcttcttcgccgtcggagctagcaccttaacttttgcttgtcaagataatcgggttcttcaaatttgtgatgggactggaaacaagaagaaggtggttatccttggaactggttgggcaggtgcaagtttcttgagaaatatcgacacatctttgtatgaggtccatgtggtatcacctcgcaattacttcaccttcactcctttgttgccaaatgtgacatgtggcacagtagaagcacgtagtatcgtggagccaattcgcaatatcgtgagaaagagaaatggtgcattccgattttgggaggctgagtgcttcaagattgatccagcaaacaaaaaagtccactgcagatcagatgttgggacgaacattaatggaaatggcgaatttgttgtggattatgattacttgattgtcagtgttggggctagacctaatactttcaacacccctggtgttactgagaattgccatttcctaaaggaagtagaagatgctcaaaagatcaggaagagtgtcatgaaatgttttgaaagagctgcccttccaaacctttctgaggaagagcgaaagaagaaccttcattttgttgtcattggtggtggcccaacaggggttgaatttgctgcagagttgcacgactttgtgaatgaagacttggcaaagctgtatcctgatgtaaagaagtttgacaaaagaatcacccaatttgctgaagagaagttcaagagggatggcatagatttgaaaacaaattttaaggtcgtgaaggtgtctgataacgatattaccatgaccaatactgctacaggagaggtcactgttccttatgggatggcagtttggtcaactggaattggaacccgtcccataattatggatttcatgaagcaagttggtcaggggaatcggcgtgtgctagctactgatgagtggcttagggttcaagggtgtgaggatgtatatgctcttggtgattgcgcaacaattgctcaaagaaaagttatggaagatgttgctgccatattccgagtagcagacaaggataactctggcactttaactgtgaagaaaataaaagatgttcttggagacatctatgagagatacccgcaagtggaattgtatcttaaatccaaccaaatgaagggcttccacgatctacttaaagactcggatggtagctccaaggagttgaaagaactggatatcgaacagttcaagaaggccctggctcaagtggactctcaagtcaagatgctcccagcaacagctcaggttgccttacaagagggacgttacctagcagactgcttcaacagaatgaagacgtgtgaagaatatcctgagggtcctataaggatcagaggtacagggcgccatcggttcaaacctttcaggtacaggcatcttgggcaattcgccccactgggtggagagcaaactgcttatcaattgcctggtgactgggtacatgttggacacagcacccaatggctttggtattctgtctatgcaagcaaacaattcagttggcgtacaaggatgctggtcgtatcagattgggggaagcggttcatctttggaagggactcaagtagcatatag

SEQ ID NO: 1382 - protein, 562 aa, Sorghum bicolor
  misc_feature: Ceres ANNOT ID no. 6015601
  misc_feature (57)..(359): Pfam Id: Pyr_redox_2 Pfam Desc: Pyridine nucleotide-disulphide oxidoreductase
  misc_feature (222)..(312): Pfam Id: Pyr_redox Pfam Desc: Pyridine nucleotide-disulphide oxidoreductase
  misc_feature (257)..(562): NCBI GI: 87240748 NCBI Desc: fad-dependent pyridine nucleotide-disulphide oxidoreductase; calcium-binding ef-hand [medicago truncatula]
  misc_feature (55)..(562): NCBI GI: 5734587 NCBI Desc: external rotenone-insensitive nadph dehydrogenase [solanum tuberosum]
  misc_feature (6)..(562): NCBI GI: 18417151 NCBI Desc: nadh dehydrogenase-related [arabidopsis thaliana]
  misc_feature (55)..(328): NCBI GI: 3080393 NCBI Desc: nadh dehydrogenase like protein [arabidopsis thaliana]
  misc_feature (55)..(432): NCBI GI: 42567013 NCBI Desc: pyridine nucleotide-disulphide oxidoreductase family protein [arabidopsis thaliana]
MASNGLSLVRRAAEAVRRTPRWKKGLVFFAVGASTLTFACQDNRVLQICDGTGNKKKVVILGTGWAGASFLRNIDTSLYEVHVVSPRNYFTFTPLLPNVTCGTVEARSIVEPIRNIVRKRNGAFRFWEAECFKIDPANKKVHCRSDVGTNINGNGEFVVDYDYLIVSVGARPNTFNTPGVTENCHFLKEVEDAQKIRKSVMKCFERAALPNLSEEERKKNLHFVVIGGGPTGVEFAAELHDFVNEDLAKLYPDVKKFDKRITQFAEEKFKRDGIDLKTNFKVVKVSDNDITMTNTATGEVTVPYGMAVWSTGIGTRPIIMDFMKQVGQGNRRVLATDEWLRVQGCEDVYALGDCATIAQRKVMEDVAAIFRVADKDNSGTLTVKKIKDVLGDIYERYPQVELYLKSNQMKGFHDLLKDSDGSSKELKELDIEQFKKALAQVDSQVKMLPATAQVALQEGRYLADCFNRMKTCEEYPEGPIRIRGTGRHRFKPFRYRHLGQFAPLGGEQTAYQLPGDWVHVGHSTQWLWYSVYASKQFSWRTRMLVVSDWGKRFIFGRDSSSI

SEQ ID NO: 1383 - DNA, 255 bp, Sorghum bicolor
  misc_feature: Ceres ANNOT ID no. 6015603
  misc_feature: Encodes the peptide sequence at SEQ ID NO 1384
atggcgaaccgtggcacggccgctcttgtgatcgcgtgtctccttgtcgcggtcaccctggcggacgcagcagtcccgccggtgtcgccgctggtctgcaacaaggtgtacggggtgcaggagcgggagacatgcttcgccgtggcgcaggccgccgggctgaccctgaagcagttcctcagcttcaaccccaacatcaactgccagaaggtcttcatcggccagtgggtttgccttgatgccgctcacgcttga

SEQ ID NO: 1384 - protein, 84 aa, Sorghum bicolor
  misc_feature: Ceres ANNOT ID no. 6015603
  misc_feature (37)..(80): Pfam Id: LysM Pfam Desc: LysM domain
  misc_feature (1)..(79): NCBI GI: 110556116 NCBI Desc: chitinase a [pteris ryukyuensis]
  misc_feature (33)..(79): NCBI GI: 119467085 NCBI Desc: lysm domain protein [neosartorya fischeri nrrl 181]
  misc_feature (26)..(83): NCBI GI: 76796395 NCBI Desc: peptidoglycan-binding lysm [thermoanaerobacter ethanolicus atcc 33223]
  misc_feature (26)..(83): NCBI GI: 114844500 NCBI Desc: peptidoglycan-binding lysm [thermoanaerobacter ethanolicus x514]
MANRGTAALVIACLLVAVTLADAAVPPVSPLVCNKVYGVQERETCFAVAQAAGLTLKQFLSFNPNINCQKVFIGQWVCLDAAHA

SEQ ID NO: 1385 - DNA, 267 bp, Sorghum bicolor
  misc_feature: Ceres ANNOT ID no. 6015606
  misc_feature: Encodes the peptide sequence at SEQ ID NO 1386
atggcgaaccgtggcaccgccgctcttgtgatcgcgtgcgtccttgtcgcggtcaccctggcggacgcagcagccccgccgctgccgccgcagtcgcagctgttctgcaacaaggtgtacggggtgcaggagcaggagacgtgcttcgtcgtggcgcaggctgccgggctgaccctgacgcagttcctcggcttcaaccccaacatcaactgccggaacctcttcatcggccagtgggtttgtcttgatgcaactatcgtttcatag

SEQ ID NO: 1386 - protein, 88 aa, Sorghum bicolor
  misc_feature: Ceres ANNOT ID no. 6015606
  misc_feature (40)..(83): Pfam Id: LysM Pfam Desc: LysM domain
  misc_feature (14)..(82): NCBI GI: 119467085 NCBI Desc: lysm domain protein [neosartorya fischeri nrrl 181]
  misc_feature (40)..(88): NCBI GI: 110556116 NCBI Desc: chitinase a [pteris ryukyuensis]
  misc_feature (20)..(85): NCBI GI: 119403677 NCBI Desc: lysm domain protein [aspergillus clavatus nrrl 1]
MANRGTAALVIACVLVAVTLADAAAPPLPPQSQLFCNKVYGVQEQETCFVVAQAAGLTLTQFLGFNPNINCRNLFIGQWVCLDATIVS

SEQ ID NO: 1387 - DNA, 1461 bp, Sorghum bicolor
  misc_feature: Ceres ANNOT ID no. 6015632
  misc_feature: Encodes the peptide sequence at SEQ ID NO 1388
atggagaacaacgttgagaaaaataacatgttgaaagagttctatatcccaacttatattttcataccggagtcgccggtggagcatgcatctcagatacctacttgtccagtggttgtttttatcaacaccaaaagtggaggtcaactgggacgtgagttaatggtcacataccggaagcttctcaaccatgcccaggtatttgatctgcttgatgaagctcctgacaaggtcttgcacagactatacagcaacctggaaaggctcaagcatggtggtgacactcttgcttctgaagtctataggagactaaggctaatagttgctggaggtgacggaacggcaggttggttgcttggagttgtatctgatcttaagttagtacgtccaccgcctgttgctacagttccgctgggaactggaaataacttgccatattcttttggatggggaaagaaaaatcctggaacagatcatgattcggtcatatcatttcttcaatcagtaagggaatcaagagagatgaacattgacagctggcacattgtcatgagaatggagggcccaaaagattctccttgtgatccaatcgcacctcctgacttgcctcattctttgcatgcatttcgccgtgtgcccaagacagatccacaagatatggagtattcttacacatttcgtgggggattttggaattacttcagtatgggaatggatgcccaagtgtcttatgcgtttcattctgagaggaaactgcatccagagaagttcaagaatcagttgtccaatcagaaaacatatttgaagctggcatgcacacaaggatggttttgtacctctctgtttcatccaatgtcacggaacattgcttgccttgcgaaagtgaagataatgaagaaatctggaaaatgggaaaccatggaaattccacaaagtattcggtccattgtttgtctcaatttgcctagcttctctggtggactaaacccttggggaacaccaagtaagaggaagcaaagaaaaagagacttggtaatgcctccacttgtggatgatggtcttctggagattgtgggtttcaaagatgcttggcatggccttgtcttgctatctccaaaaggccatggaactcgccttgctcaggctcaccgtgttcgatttgagttcctcagaggcacaactgatcatgcttacatgagaatggatggggagccctggaagcagcctcttcccacggatgacggcaaagtcgtggtagagatctcccatgctgggcaggtgaagatgctcgccactaaagactgcatagccaaaggcatccatgaatcgtgcccagctatttcaacggttcatccagagtccagctccagcgacgacatgaacgatgactttgaggaggagcggaggaactttggtgctgccttgtcttttagatacttgggtgacgtgaacaaagaataa

SEQ ID NO: 1388 - protein, 486 aa, Sorghum bicolor
  misc_feature: Ceres ANNOT ID no. 6015632
  misc_feature (37)..(180): Pfam Id: DAGK_cat Pfam Desc: Diacylglycerol kinase catalytic domain
  misc_feature (232)..(405): Pfam Id: DAGK_acc Pfam Desc: Diacylglycerol kinase accessory domain
  misc_feature (2)..(484): NCBI GI: 10798892 NCBI Desc: diacylglycerol kinase [lycopersicon esculentum]
  misc_feature (2)..(486): NCBI GI: 10798895 NCBI Desc: diacylglycerol kinase variant b [lycopersicon esculentum]
  misc_feature (2)..(486): NCBI GI: 10798890 NCBI Desc: calmodulin-binding diacylglycerol kinase [lycopersicon esculentum]
  misc_feature (2)..(484): NCBI GI: 10798894 NCBI Desc: diacylglycerol kinase variant a [lycopersicon esculentum]
  misc_feature (11)..(484): NCBI GI: 78498844 NCBI Desc: diacylglycerol kinase 1 [oryza sativa (indica cultivar-group)]
MENNVEKNNMLKEFYIPTYIFIPESPVEHASQIPTCPVVVFINTKSGGQLGRELMVTYRKLLNHAQVFDLLDEAPDKVLHRLYSNLERLKHGGDTLASEVYRRLRLIVAGGDGTAGWLLGVVSDLKLVRPPPVATVPLGTGNNLPYSFGWGKKNPGTDHDSVISFLQSVRESREMNIDSWHIVMRMEGPKDSPCDPIAPPDLPHSLHAFRRVPKTDPQDMEYSYTFRGGFWNYFSMGMDAQVSYAFHSERKLHPEKFKNQLSNQKTYLKLACTQGWFCTSLFHPMSRNIACLAKVKIMKKSGKWETMEIPQSIRSIVCLNLPSFSGGLNPWGTPSKRKQRKRDLVMPPLVDDGLLEIVGFKDAWHGLVLLSPKGHGTRLAQAHRVRFEFLRGTTDHAYMRMDGEPWKQPLPTDDGKVVVEISHAGQVKMLATKDCIAKGIHESCPAISTVHPESSSSDDMNDDFEEERRNFGAALSFRYLGDVNKE

SEQ ID NO: 1389 - DNA, 627 bp, Sorghum bicolor
  misc_feature: Ceres ANNOT ID no. 6015637
  misc_feature: Encodes the peptide sequence at SEQ ID NO 1390
atggcgtcgcgaaaggttctcccaggcctcgcctccgggaggcggctccggtcccgcgctcagcaactcctctgggccgccgatctccctgtagctaccacctctcgctcgctcgcggccgccgctgtcacggcgctgccgtcgggcgggtctccagcggctcttctgttctctttgaggaccatctcgtcaacgcgcctctcgacacagtccgccgccggtgacgcgcccggcccatctgcggtggaccacaagtttgtttctcgacctcgcagcctcagcacgttgataatgcaagaggatgagtttcacaaattagcagatgaaacgattcatgacttgcttgaaaaacttgaggaatacggtgactccattcagatggatggtttcgacatagactatgggaatcaggttttgacactgaggcttggggatttggggacgtatgttgtaaacaagcaaacaccaaacagacaaatctggctttcttcacctgtaagtggaccttctaggtttgactgggatgtggcaactaatggttggatatacaagcgaactggagcgaatcttgtgcagcttttggagaaggagattggtgagctttgtcatactccagtagaactttga

SEQ ID NO: 1390 - protein, 208 aa, Sorghum bicolor
  misc_feature: Ceres ANNOT ID no. 6015637
  misc_feature (98)..(209): Pfam Id: Frataxin_Cyay Pfam Desc: Frataxin-like domain
  misc_feature (68)..(166): NCBI GI: 124360476 NCBI Desc: frataxin-like [medicago truncatula]
  misc_feature (98)..(208): NCBI GI: 11513844 NCBI Desc: chain a, mature human frataxin
  misc_feature (98)..(208): NCBI GI: 31077081 NCBI Desc: frataxin isoform 1 preproprotein [homo sapiens]
  misc_feature (100)..(208): NCBI GI: 21730873 NCBI Desc: chain a, the solution structure of the the c-terminal domain of frataxin, the protein responsible for friedreich ataxia
  misc_feature (98)..(208): NCBI GI: 1237439 NCBI Desc: frataxin
MASRKVLPGLASGRRLRSRAQQLLWAADLPVATTSRSLAAAAVTALPSGGSPAALLFSLRTISSTRLSTQSAAGDAPGPSAVDHKFVSRPRSLSTLIMQEDEFHKLADETIHDLLEKLEEYGDSIQMDGFDIDYGNQVLTLRLGDLGTYVVNKQTPNRQIWLSSPVSGPSRFDWDVATNGWIYKRTGANLVQLLEKEIGELCHTPVEL

SEQ ID NO: 1391 - DNA, 639 bp, Sorghum bicolor
  misc_feature: Ceres ANNOT ID no. 6015653
  misc_feature: Encodes the peptide sequence at SEQ ID NO 1392
atggcggtcaaggtctacgtcgtgacacagggtctcaatcatgacggtaggtactactccacgtatggacatgttggcaaactagctgaagagatcaagaaaggtgcctcatctattgaaggtgttgaggctaaaatatggcaggtccctgaaactctccctgaggaagtgcttggaaagatgggcgcaccccctaagcctgatgtgccagtcatcacaccgcaagaacttgcagaagctgatggaatcctcttcgggtttccaacaaggtttggaatgatggcagcgcaaatgaaggcgttcttcgatgctactggtgggctctggagggagcagagccttgctggcaagcctgccggcatcttcttcagcactggaacccagggtggtggccaagagactacaccgttgaccgcgattacccagttgacacaccacggcatggtgtttgtgcctgtgggctacaccttcggcgccaagctgttcggcatggaccaggttcagggtggcagcccctatggtgctggcacgttcgctgccgacggctcgaggtggccgagtgaggtggagctcgagcacgcctttcaccaggggaagtacttcgcaggcatcgccaagaagctcaagggttctgcttga

SEQ ID NO: 1392 - protein, 212 aa, Sorghum bicolor
  misc_feature: Ceres ANNOT ID no. 6015653
  misc_feature (18)..(147): Pfam Id: Flavodoxin_1 Pfam Desc: Flavodoxin
  misc_feature (1)..(212): NCBI GI: 58500257 NCBI Desc: quinone reductase 2 [triticum monococcum]
  misc_feature (1)..(212): NCBI GI: 124488474 NCBI Desc: benzoquinone reductase [gossypium hirsutum]
  misc_feature (1)..(212): NCBI GI: 124488472 NCBI Desc: benzoquinone reductase [gossypium hirsutum]
  misc_feature (1)..(212): NCBI GI: 89276317 NCBI Desc: quinone oxidoreductase [gymnadenia conopsea]
  misc_feature (1)..(209): NCBI GI: 12484052 NCBI Desc: quinone-oxidoreductase qr2 [triphysaria versicolor]
MAVKVYVVTQGLNHDGRYYSTYGHVGKLAEEIKKGASSIEGVEAKIWQVPETLPEEVLGKMGAPPKPDVPVITPQELAEADGILFGFPTRFGMMAAQMKAFFDATGGLWREQSLAGKPAGIFFSTGTQGGGQETTPLTAITQLTHHGMVFVPVGYTFGAKLFGMDQVQGGSPYGAGTFAADGSRWPSEVELEHAFHQGKYFAGIAKKLKGSA

SEQ ID NO: 1393 - DNA, 1182 bp, Sorghum bicolor
  misc_feature: Ceres ANNOT ID no. 6015654
  misc_feature: Encodes the peptide sequence at SEQ ID NO 1394
atggccgaccagtggtgggagagtacctctcacaggagtcacggcgcgtcggcgtgctcggccgccgcgccgccgccgctcacggtcacgggcggcagggtggcctgcggctggacctcccccaccgcagccgccgctgagtcgacgagctccgtaaccttccaggacccctacaggagctccacccatcagcagcctctgtctgatgccgcctcgtctctcggtgatcctcacatggactggacgcaagccttcttgagcgggaggagtgataccagcttccaagccgtgctccaagaacaaccccccgcgatgaacgatccactaatcagggacggcgacatgagtgccggcagcttcttggtcgaccagcaggcgcagctatcgccgtcgccgtcgccctacggcacggacccatcgcaagctcaagctctattcgacggcacggcggcggtgcacaacatttcgatgtacggagacagcgagtcctcggtcacctatgacgccacggcggcgtcgatgcagttttcttcccagctgctcaagacctcggtgccggcgacggcgtctacgccgatgcaaggtgtcggcgtcggcgcgccgatgcagtacttgtccgccggcagttacctgcctttcggtggcccgctgccgtcccaccttctcttgcaggccttgcaggcggctaataagcccaatagccgcagcgccaacgctaactctctgacgacggtgaaggacgactgctctccaccaccggcgacgaggaaaagcgtccccgagccgcctactaccgctgcgaaaaggccacggatcgaggcgccgtcgccgctgccgacttttaaggtgaggaaagagaaactaggggacagaatcactgcgctccagcaactagtctcgccttttggaaagactgataccgcatcggttcttcacgaggccatcgaatacatcaaattccttcacgaccaagttgcgtcgctgagctctccctacttgaaaaatgggattcccatgaagcaattccagcacaagggctctgaggattccaaggacaacggtgacacgaagcaagatctacggagccgaggcctgtgccttgtcccagtggcgagcacgtacacggtggcggccgagacgcctgagttctggcaccctacatttggaggcacattccggtag

SEQ ID NO: 1394 - protein, 393 aa, Sorghum bicolor
  misc_feature: Ceres ANNOT ID no. 6015654
  misc_feature (1)..(393): NCBI GI: 53792455 NCBI Desc: bhlh transcription factor-like protein [oryza sativa (japonica cultivar-group)]
  misc_feature (1)..(330): NCBI GI: 115440371 NCBI Desc: os01g0784900 [oryza sativa (japonica cultivar-group)]
  misc_feature (16)..(392): NCBI GI: 90399269 NCBI Desc: h0105c05.9 [oryza sativa (indica cultivar-group)]
  misc_feature (85)..(393): NCBI GI: 21360529 NCBI Desc: at1g61660/t13m11_21 [arabidopsis thaliana]
  misc_feature (231)..(393): NCBI GI: 45735905 NCBI Desc: bhlh transcription factor (bhlh123)-like protein [oryza sativa (japonica cultivar-group)]
  misc_feature: The plant flowers significantly late compared to wild-type.
  misc_feature: The sequence is a functional homolog of SEQ ID NO 900 in the 11/435,388US patent application
  misc_feature: Useful for making plants with modulated flowering time
  misc_feature: Useful for making plants with modulated growth and phenotype characteristics
  misc_feature: GREAT-hit functional homolog of the protein sequence given in SEQ ID NO 13101
  misc_feature: The sequence is a functional homolog of SEQ ID NO 900 in the 20060272060 US patent application
  misc_feature: Useful for making plants with modulated flowering time
  misc_feature: Functional homolog of the protein sequence given in SEQ ID NO 13101
  misc_feature: Useful for making plants with altered lignin content
  misc_feature: Useful for making plants with modulated nitrogen use efficiency
  misc_feature: Functional homolog of the protein sequence given in SEQ ID NO 13645
  misc_feature: Useful for making plants with modulated heat sensitivity
  misc_feature: Functional homolog of the protein sequence given in SEQ ID NO 12956
MADQWWESTSHRSHGASACSAAAPPPLTVTGGRVACGWTSPTAAAAESTSSVTFQDPYRSSTHQQPLSDAASSLGDPHMDWTQAFLSGRSDTSFQAVLQEQPPAMNDPLIRDGDMSAGSFLVDQQAQLSPSPSPYGTDPSQAQALFDGTAAVHNISMYGDSESSVTYDATAASMQFSSQLLKTSVPATASTPMQGVGVGAPMQYLSAGSYLPFGGPLPSHLLLQALQAANKPNSRSANANSLTTVKDDCSPPPATRKSVPEPPTTAAKRPRIEAPSPLPTFKVRKEKLGDRITALQQLVSPFGKTDTASVLHEAIEYIKFLHDQVASLSSPYLKNGIPMKQFQHKGSEDSKDNGDTKQDLRSRGLCLVPVASTYTVAAETPEFWHPTFGGTFR

SEQ ID NO: 1395 - DNA, 726 bp, Sorghum bicolor
  misc_feature: Ceres ANNOT ID no. 6015661
  misc_feature: Encodes the peptide sequence at SEQ ID NO 1396
atggacgggcacgtccggcggctgctgaaccgcgtgtcgatcgcgctggccgccgtcgccaccgccgcaatgctgcacctgttccgccactcctcctcctactgcatcgtcggaggcagcggctcgccaacatattcatccctatcattggcgcccttcccgcgcacctcctgcgacgccgcatcccgccgcgtcgtggacccggacctccgcctcgccaagctccgggcctcccggcgctggcgccgccgcggcgccgccctctcctcgtccactctcgcccctctccgccgtctccgcgtcctcggcgaatcctcccgcgtgctctgcgtcgccgcaggcgcggggctggtcgcggacgcgctccacgcggccggcgtcggggacgtcacggccgttgatctcgtcgacttcccgccgctcgtccgccgagcggacgcacacaacctcccattcttcgacggcgccttcgacgttgtgctgtcggacgacccgggcgcgctcaccggcgcgctcttcccgtcccggttcgcgaccgagatcgagcgcaccgtccgacgcggtggcgctatcgcgatcgcagtcgaccgtcacgtcggcttgtccaacgttgaccaccttttcaggaagtcgcgcatcgtgaaggtgacgaatgctacactggatggttcaattgtgaacatcgtcatcttgagaagttacagaaccaaaaccaaccctcattga

SEQ ID NO: 1396 - protein, 241 aa, Sorghum bicolor
  misc_feature: Ceres ANNOT ID no. 6015661
  misc_feature (109)..(193): Pfam Id: Methyltransf_11 Pfam Desc: Methyltransferase domain
  misc_feature (1)..(232): NCBI GI: 115464733 NCBI Desc: os05g0500700 [oryza sativa (japonica cultivar-group)]
  misc_feature (1)..(224): NCBI GI: 124301140 NCBI Desc: at2g16030 [arabidopsis thaliana]
  misc_feature (56)..(235): NCBI GI: 9743354 NCBI Desc: f21j9.14 [arabidopsis thaliana]
MDGHVRRLLNRVSIALAAVATAAMLHLFRHSSSYCIVGGSGSPTYSSLSLAPFPRTSCDAASRRVVDPDLRLAKLRASRRWRRRGAALSSSTLAPLRRLRVLGESSRVLCVAAGAGLVADALHAAGVGDVTAVDLVDFPPLVRRADAHNLPFFDGAFDVVLSDDPGALTGALFPSRFATEIERTVRRGGAIAIAVDRHVGLSNVDHLFRKSRIVKVTNATLDGSIVNIVILRSYRTKTNPH

SEQ ID NO: 1397 - DNA, 993 bp, Sorghum bicolor
  misc_feature: Ceres ANNOT ID no. 6015688
  misc_feature: Encodes the peptide sequence at SEQ ID NO 1398
atggccttcctcaagaccctaaaccctctcatacgcaagcgcgccaccccgatctcgaaccccaggccgctcctctccctccacacctacctcgcctcatcctcccccaccactaccgccgcggccaaccccttcgccagcgatgtgcacacccatgtccccatccggtccggcggcccgctgttcctctcgtcggccccatggatgctgtcgcagtcggcgacaccgctcacggccgcggctgccgcccttggcgccaagctccgcagggcccaggccctcgccggcggccgcgcgctggccgtcgcggacgccgtgaggtgggagcacaggcggatctccgggggtgaagcggaggttgcggcgtcttcaggaattgtgggatgtggaggtgagaggtttctgaatgcgcccaatttggtgtcgattggacggatggtgtcagggcctgtcattggatggatgatcgtgaatgaatggtatcttcctgcatttgccacattggctgtatcgggtgcaagtgattggttggatggctttttagcgagaaagatgggcatcaattctgtctttggatcatatttggaccctctggctgacaaggttttgattggctgtgttgctgtagccatggttgaaaaagatcttttacatcctggtcttgttggcctcgttgttgtaagagacttgcttcttgtgggtggtgctttctacaagcgggcttctagtctgggatggaagtggaacagttggtcagaatttgttaacttagattcgattcgtcgcgaaaagattgagcctctgttcatcagcaaggtgaacacagtattccaattgatgttggttgccgctgcacttcttcagccagaatttggcacagaggagactcagaattacattacactcctgagttggcttgtagctactacgacagtcacttccacaatagggtatggtgtgaagtactaccggatcaaaccaaggagttggtga

SEQ ID NO: 1398 - protein, 330 aa, Sorghum bicolor
  misc_feature: Ceres ANNOT ID no. 6015688
  misc_feature (165)..(316): Pfam Id: CDP-OH_P_transf Pfam Desc: CDP-alcohol phosphatidyltransferase
  misc_feature (1)..(328): NCBI GI: 56784277 NCBI Desc: phosphatidylglycerotransferase-like protein [oryza sativa (japonica cultivar-group)]
  misc_feature (53)..(250): NCBI GI: 4115948 NCBI Desc: contains similarity to cdp-alcohol phosphatidyltransferases (pfam: pf01066, score=13.7, e= 0.00016, n=1) [arabidopsis thaliana]
  misc_feature (82)..(318): NCBI GI: 119630806 NCBI Desc: chromosome 20 open reading frame 155, isoform cra_c [homo sapiens]
  misc_feature (132)..(318): NCBI GI: 108869299 NCBI Desc: cdp-diacylglycerol--glycerol-3-phosphate 3-phosphatidyltransferase [aedes aegypti]
  misc_feature (132)..(318): NCBI GI: 108870866 NCBI Desc: cdp-diacylglycerol--glycerol-3-phosphate 3-phosphatidyltransferase [aedes aegypti]
MAFLKTLNPLIRKRATPISNPRPLLSLHTYLASSSPTTTAAANPFASDVHTHVPIRSGGPLFLSSAPWMLSQSATPLTAAAAALGAKLRRAQALAGGRALAVADAVRWEHRRISGGEAEVAASSGIVGCGGERFLNAPNLVSIGRMVSGPVIGWMIVNEWYLPAFATLAVSGASDWLDGFLARKMGINSVFGSYLDPLADKVLIGCVAVAMVEKDLLHPGLVGLVVVRDLLLVGGAFYKRASSLGWKWNSWSEFVNLDSIRREKIEPLFISKVNTVFQLMLVAAALLQPEFGTEETQNYITLLSWLVATTTVTSTIGYGVKYYRIKPRSW

SEQ ID NO: 1399 - DNA, 336 bp, Sorghum bicolor
  misc_feature: Ceres ANNOT ID no. 6015707
  misc_feature: Encodes the peptide sequence at SEQ ID NO 1400
atgtctgatctcgacgtccagcttccatctgcttttgaggcaaatgctgaggactccagtgctggtgctggatcaaaggactatgtgcacgtgcgaattcagcagcgcaacggaagaaagagtctgacaactgttcagggcttgaagaaagagtacagctacaacaagatcctcaaggatctcaaaaaagagttctgctgcaatggtactgtagtccaggatccagagctaggccaggtcattcaactgcaaggtgatcagcgtaaaaatgttgcaacttttctagttgaggctggaatagtgaagaaagagagcatcaagattcacggtttttag

SEQ ID NO: 1400 - protein, 111 aa, Sorghum bicolor
  misc_feature: Ceres ANNOT ID no. 6015707
  misc_feature (23)..(104): Pfam Id: SUI1 Pfam Desc: Translation initiation factor SUI1
  misc_feature (1)..(111): NCBI GI: 126513558 NCBI Desc: translation initiation factor eif1 [synthetic construct]
  misc_feature (1)..(111): NCBI GI: 27261027 NCBI Desc: translational initiation factor eif1 [oryza sativa (japonica cultivar-group)]
  misc_feature (1)..(111): NCBI GI: 20238 NCBI Desc: gos2 [oryza sativa]
  misc_feature (1)..(111): NCBI GI: 462195 NCBI Desc: protein translation factor sui1 homolog (gos2 protein)
  misc_feature (1)..(111): NCBI GI: 14194275 NCBI Desc: translational initiation factor eif1 [porteresia coarctata]
  misc_feature: The plant flowers significantly earllier than wild-type.
  misc_feature: The plant is abnormally small.
  misc_feature: Useful for making plants with modulated biomass
  misc_feature: Useful for making plants with modulated flowering time
  misc_feature: GREAT-hit functional homolog of the protein sequence given in SEQ ID NO 13160
  misc_feature: Useful for making plants with modulated biomass
  misc_feature: Useful for making plants with modulated flowering time
  misc_feature: Functional homolog of the protein sequence given in SEQ ID NO 13160
MSDLDVQLPSAFEANAEDSSAGAGSKDYVHVRIQQRNGRKSLTTVQGLKKEYSYNKILKDLKKEFCCNGTVVQDPELGQVIQLQGDQRKNVATFLVEAGIVKKESIKIHGF

SEQ ID NO: 1401 - DNA, 900 bp, Sorghum bicolor
  misc_feature: Ceres ANNOT ID no. 6015716
  misc_feature: Encodes the peptide sequence at SEQ ID NO 1402
atggcgacagcgagtgagatcgcggcggtgggggtgatcggcgcggggcagatgggctcgggcatcgcccagctggccgccgccgccggctgtgccgtccttctcctcgacgccgaccccgccgccctctcccttgccgtcgcctccatctccgcctccctacgccgtctcgccgccaagggccagctctcccaggccgcgtgcgaagactcaatcaagcggataaggtgcgtctccaccgtgcaagatctcagggacgcggatcttgtgatcgaggccatcgtggagaaggaagatgtcaagaagaagctgttcgtggagctggataagatcacgaagtcctcggccatccttgcgtccaacactagctccatctctataacccgcctggcttcagctaccagacgcccctctcaggtcataggcatgcacttctttaaccctcctccgataatgaaactgatcgagattatccgaggagctgatacatcagatgaggtgtttgctgcagtcaaatctttttccgaaagacttgggaagtccgttatatgctcgcaagattacccaggattcattgtgaaccgcatcctcatgccgatgatcaatgaggctttttgggcactgtacaccggagtggcaaccaaagaggacattgacacagggatgaagttgggcacgaatcacccgatgggccctctgcagcttgccgatttcattgggttggatgtgtgcctttcagtacttcgggtacttcatagtggcctgggagataataagtacagcccttgccctcttcttgttcagtatgttgatgctggccggcttggaaagaagcgtggagtaggtgtatattcatatggacagaagtcttcatcagtcaggccaaagtcatctatgtaa

SEQ ID NO: 1402 - protein, 299 aa, Sorghum bicolor
  misc_feature: Ceres ANNOT ID no. 6015716
  misc_feature (9)..(188): Pfam Id: 3HCDH_N Pfam Desc: 3-hydroxyacyl-CoA dehydrogenase, NAD binding domain
  misc_feature (190)..(286): Pfam Id: 3HCDH Pfam Desc: 3-hydroxyacyl-CoA dehydrogenase, C-terminal domain
  misc_feature (7)..(286): NCBI GI: 78223279 NCBI Desc: 3-hydroxyacyl-coa dehydrogenase-like [geobacter metallireducens gs-15]
  misc_feature (6)..(286): NCBI GI: 138896971 NCBI Desc: 3-hydroxybutyryl-coa dehydrogenase [geobacillus thermodenitrificans ng80-2]
  misc_feature (7)..(286): NCBI GI: 121540299 NCBI Desc: 3-hydroxybutyryl-coa dehydrogenase [anaeromyxobacter sp. fw109-5]
  misc_feature (7)..(286): NCBI GI: 82700729 NCBI Desc: 3-hydroxyacyl-coa dehydrogenase, c-terminal:3-hydroxyacyl-coa dehydrogenase, nad binding domain:3-hydroxyacyl-coa dehydrogenase [brucella melitensis
  misc_feature (7)..(286): NCBI GI: 82700729 (continued) biovar abortus 2308]
  misc_feature (7)..(286): NCBI GI: 17986383 NCBI Desc: 3-hydroxybutyryl-coa dehydrogenase [brucella melitensis 16m]
  misc_feature (4)..(294): SWISSPROT Homolog: EC 1.1.1.157 3-hydroxybutyryl-CoA dehydrogenase
MATASEIAAVGVIGAGQMGSGIAQLAAAAGCAVLLLDADPAALSLAVASISASLRRLAAKGQLSQAACEDSIKRIRCVSTVQDLRDADLVIEAIVEKEDVKKKLFVELDKITKSSAILASNTSSISITRLASATRRPSQVIGMHFFNPPPIMKLIEIIRGADTSDEVFAAVKSFSERLGKSVICSQDYPGFIVNRILMPMINEAFWALYTGVATKEDIDTGMKLGTNHPMGPLQLADFIGLDVCLSVLRVLHSGLGDNKYSPCPLLVQYVDAGRLGKKRGVGVYSYGQKSSSVRPKSSM

SEQ ID NO: 1403 - DNA, 729 bp, Sorghum bicolor
  misc_feature: Ceres ANNOT ID no. 6015724
  misc_feature: Encodes the peptide sequence at SEQ ID NO 1404
atggcgccccgggtggcggacaagtcgccgttgccgccggccaccggcctcggactgggcgttggcggagtagtcggaggcgtgggcatgggcccacactacagaggcgtgagaaagcggccgtggggacgtttcgccgctgagatccgcgaccctgccaagaaaagccgcgtgtggctaggcacgtacgacacggccgaggaggccgccaaggcctacgacgccgccgcccgcgagttccgaggcgccaaggccaagacgaacttcccgttcccgtctcagtgcgccgtcgccgccggcggtgctggcagcccctgcagcaacagcaccgttgactcgagcggcggcgccagcggctgtgccgtccaggcgcctatgcaggccatgccgctgcctccggccctcgatctcgatctcttccatcgggcggccgccgtgaacgcggtcaccgcaggcggcatgcggtttccgttcaagggctaccccgtcgcgcgtccaaccccgcaccagtacttcttctacgaacaggccgccgcagccgctgccgcggcggccggctaccggatgcttaaggtggccccaccgccggtcaccgtggccgccgtcgcgcagagtgattcggactcctcgtctgtggttgatcacaccccttcgcctcccgcggtgacggcaaagaaggaggtgggcttcgagctggatctgaactggccgccgccggcagagaactag

SEQ ID NO: 1404 - protein, 242 aa, Sorghum bicolor
  misc_feature: Ceres ANNOT ID no. 6015724
  misc_feature (32)..(83): Pfam Id: AP2 Pfam Desc: AP2 domain
  misc_feature (1)..(242): NCBI GI: 9309342 NCBI Desc: ethylene responsive element binding factor3 [oryza sativa]
  misc_feature (1)..(242): NCBI GI: 56567583 NCBI Desc: bth-induced erf transcriptional factor 2 [oryza sativa (indica cultivar-group)]
  misc_feature (1)..(241): NCBI GI: 47087871 NCBI Desc: ethylene-responsive element binding factor [oryza sativa]
  misc_feature (1)..(241): NCBI GI: 115464685 NCBI Desc: os05g0497300 [oryza sativa (japonica cultivar-group)]
  misc_feature (1)..(241): NCBI GI: 4099921 NCBI Desc: erebp-3 homolog [stylosanthes hamata]
  misc_feature: The plant produces a reduced number of seeds.
  misc_feature: The sequence is a functional homolog of SEQ ID NO 1756 in the 10/374,780US patent application
  misc_feature: The sequence is a functional homolog of SEQ ID NO 2220 in the 10/374,780US patent application
  misc_feature: The sequence is a functional homolog of SEQ ID NO 500 in the 10/225,066US patent application
  misc_feature: Useful for biocontainment applications
  misc_feature: Useful for making plants with altered Lignin content
  misc_feature: Useful for making plants with altered alkaloid content
  misc_feature: Useful for making plants with altered sterol content
  misc_feature: Useful for making plants with modulated cold sensitivity
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13008
  misc_feature: Functional homolog of the protein sequence given in SEQ ID NO 13048
  misc_feature: Functional homolog of the protein sequence given in SEQ ID NO 13218
  misc_feature: Functional homolog of the protein sequence given in SEQ ID NO 13219
  misc_feature: Functional homolog of the protein sequence given in SEQ ID NO 13435
  misc_feature: Functional homolog of the protein sequence given in SEQ ID NO 13439
  misc_feature: The sequence is a functional homolog of SEQ ID NO 500 in the 20050160493 US patent application
  misc_feature: The sequence is a functional homolog of SEQ ID NO 1756 in the 20060162006 US patent application
  misc_feature: Useful for making plants with altered alkaloid content
  misc_feature: Functional homolog of the protein sequence given in SEQ ID NO 13048
  misc_feature: Useful for making plants with altered lignin content
  misc_feature: Functional homolog of the protein sequence given in SEQ ID NO 13219
MAPRVADKSPLPPATGLGLGVGGVVGGVGMGPHYRGVRKRPWGRFAAEIRDPAKKSRVWLGTYDTAEEAAKAYDAAAREFRGAKAKTNFPFPSQCAVAAGGAGSPCSNSTVDSSGGASGCAVQAPMQAMPLPPALDLDLFHRAAAVNAVTAGGMRFPFKGYPVARPTPHQYFFYEQAAAAAAAAAGYRMLKVAPPPVTVAAVAQSDSDSSSVVDHTPSPPAVTAKKEVGFELDLNWPPPAEN

SEQ ID NO: 1405 - DNA, 534 bp, Sorghum bicolor
  misc_feature: Ceres ANNOT ID no. 6015727
  misc_feature: Encodes the peptide sequence at SEQ ID NO 1406
atggatcccacgctacgggcagtgctgggccacggcggaggcgacggcggggcgagaggaggaggaggaggaggaggcgccgagcgcttccggggcgtgaggaagcggccgtggggcaggtacgcggccgagatccgcgacccgtggaagaagacgcgggtgtggctgggcacgttcgacacccccgcggaggccgccctcgcgtacgaccgcgccgcgcgcacgctccgcggcgccaaggccaagaccaacttccccgaccacgccggccatctggcgccgcttctgcgactgcgtcaacccccgccgcagcccgtctcgttcggaggcgtcaacaacgtcgactgccctactactccgtggcaattcgtctacctccagaccccgacaacggccgcggctccgcttcccccgacgactgcagcgatgccgccgctggtgacaaccgagccaccgtcaacggcgctggagctgggcaggggacagaggtgtggcggcctccccttcgacctcaacgaggcgccgtcatgctga

SEQ ID NO: 1406 - protein, 177 aa, Sorghum bicolor
  misc_feature: Ceres ANNOT ID no. 6015727
  misc_feature (28)..(79): Pfam Id: AP2 Pfam Desc: AP2 domain
  misc_feature (29)..(86): NCBI GI: 20340233 NCBI Desc: ethylene responsive element binding factor 4-like protein [thellungiella halophila]
  misc_feature (22)..(169): NCBI GI: 38345793 NCBI Desc: osjnba0085i10.10 [oryza sativa (japonica cultivar-group)]
  misc_feature (30)..(140): NCBI GI: 6560760 NCBI Desc: f3m18.21 [arabidopsis thaliana]
  misc_feature (17)..(91): NCBI GI: 4587373 NCBI Desc: ethylene responsive element binding factor [nicotiana tabacum]
  misc_feature (1)..(86): NCBI GI: 47087871 NCBI Desc: ethylene-responsive element binding factor [oryza sativa]
  misc_feature: The sequence is a functional homolog of SEQ ID NO 1435 in the 11/479,226US patent application
  misc_feature: The sequence is a functional homolog of SEQ ID NO 1755 in the 10/374,780US patent application
  misc_feature: The sequence is a functional homolog of SEQ ID NO 2220 in the 10/374,780US patent application
  misc_feature: The sequence is a functional homolog of SEQ ID NO 2504 in the 10/374,780US patent application
  misc_feature: The sequence is a functional homolog of SEQ ID NO 314 in the 10/666,642US patent application
  misc_feature: The sequence is a functional homolog of SEQ ID NO 500 in the 10/225,066US patent application
  misc_feature: The sequence is a functional homolog of SEQ ID NO 618 in the 10/225,066US patent application
  misc_feature: The sequence is a functional homolog of SEQ ID NO 674 in the 10/412,699US patent application
  misc_feature: Useful for making plants with modulated growth and phenotype characteristics
  misc_feature: The sequence is a functional homolog of SEQ ID NO 674 in the 20040045049 US patent application
  misc_feature: The sequence is a functional homolog of SEQ ID NO 500 in the 20050160493 US patent application
  misc_feature: The sequence is a functional homolog of SEQ ID NO 1755 in the 20060162006 US patent application
  misc_feature: The sequence is a functional homolog of SEQ ID NO 314 in the 20070033671 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
MDPTLRAVLGHGGGDGGARGGGGGGGAERFRGVRKRPWGRYAAEIRDPWKKTRVWLGTFDTPAEAALAYDRAARTLRGAKAKTNFPDHAGHLAPLLRLRQPPPQPVSFGGVNNVDCPTTPWQFVYLQTPTTAAAPLPPTTAAMPPLVTTEPPSTALELGRGQRCGGLPFDLNEAPSC

SEQ ID NO: 1407 - DNA, 2001 bp, Sorghum bicolor
  misc_feature: Ceres ANNOT ID no. 6015748
  misc_feature: Encodes the peptide sequence at SEQ ID NO 1408
atgggtttcttccagcaatgctccagctccagcagctccccgctgctccccgtgctgctcgcgctcatcggcctgtactgcgccgccgccgtctcgtgctcggcggccgccgcgcctctgccggcgccggagacgacgacgacgatgcacgagagctacgcgggcaagtcggagttcaggacggtgaaccggaaggagctcgactcgtgcctcaacccgagcccctacctggccatcaatgtcagcatcaccggcggggccggggccggggccggggccggggcggcgatccccgacgaggcgttcctccaggtcaccgtctccggcgtcctcaagcccgacgcctccgactgggtcgccatgatcacgccttccaactccagcgttgctggatgtcctctgagtggagtgaactacgtggagaccggcgacctggcgaatctcccgcttctctgccactaccctgtaaagtcccagtacctgacaagcgaccccgggtacatgggctgcaagaacgcggggtgcgggaagcgcgacgcgtccggcgcctgcaaggcccgcacctgcgccgccacgctcaccttccacgtcgtcaacttccgtaccgatgtcgagttcgtgctcttctccggcggcttcaagacgccatgcctcctcaagcggtccggcgcgctccggttcgccaacccggccagcccgctctacggccacctctccagcaccgactccaaggcgacctcgatgaagcttacctgggtgagtggagacgggaatccgcagcaagtgcagtatggagacggaaagtcatctacttctgaagtcgcaacgttcacgcaggatgatatgtgcagcgtccccgtgctgccgagccctgccaaggatttcggctggcatgaccccggctacatccactcggctgtcatgactgggctccagccatctcagtcctacacttaccgctacggaagtgattctgtgggctggagtgacagagttaagttcaaaactccaccagctgctggttcagatgagctatcctttgtgatctatggtgatatggggaaggctccactggacccgtcagttgaacactacattcagcctggatcaatttctgtgaccaaggcagtggctaaagagatccaaacaggaaacgtggactccattttccatataggagacatcagttacgccacaggcttcctggtcgagtgggacttcttccttcacctcatcacgccactcgcttctcaagtgtcctacatgacagctattggtaatcacgaaagggattatgcgaactctgcatccgtgtatgtgactcctgattcagggggtgaatgtggagtcgcctacgaatcatacttccccatgcctgctgtcagtaaggataagccatggtattctatagagcaagggaccgttcacttccttgtgatgtccaccgagcatgagtggtcggagaagtcagagcagtataattggatggacgaagatttgtcatcggttgatagatcaagaacaccatgggtgatcttcattgggcatagaccgatgtattcctcccatggtggtatactgcccaacgtggattccaactttgttgcctctgttgagccactcctgttcaactaccaggtggatttggttttcttcggccatgtacacaactatgagaggacctgtgcggtataccagggcgattgcaaaggcatgccaacgaaggacaaaaacggaattgacgtctatgacaacagcaactataccgcacctgttcatgtcattgctggagcaggagggttcaccttggacagcttccctaacaatggggaggcctggagcttatcaagggtttcggagtttggctatggcaaggtgcatgctacaagaaccgatatgctggttcagtttgtaaactcaagttcgatggaggtacgagaccaatttaggattgtgaagggagcttcggtaaacaagacaccgagcctgatacttcaataa

SEQ ID NO: 1408 - protein, 666 aa, Sorghum bicolor
  misc_feature: Ceres ANNOT ID no. 6015748
  misc_feature (345)..(558): Pfam Id: Metallophos Pfam Desc: Calcineurin-like phosphoesterase
  misc_feature (46)..(653): NCBI GI: 92867261 NCBI Desc: metallophosphoesterase; fibronectin, type iii-like fold [medicago truncatula]
  misc_feature (145)..(467): NCBI GI: 144924941 NCBI Desc: metallophosphoesterase; fibronectin, type iii-like fold [medicago truncatula]
  misc_feature (187)..(651): NCBI GI: 115480025 NCBI Desc: os09g0506000 [oryza sativa (japonica cultivar-group)]
  misc_feature (96)..(651): NCBI GI: 18075958 NCBI Desc: diphosphonucleotide phosphatase 1 [lupinus luteus]
  misc_feature (96)..(651): NCBI GI: 77556254 NCBI Desc: diphosphonucleotide phosphatase 1 [oryza sativa (japonica cultivar-group)]
MGFFQQCSSSSSSPLLPVLLALIGLYCAAAVSCSAAAAPLPAPETTTTMHESYAGKSEFRTVNRKELDSCLNPSPYLAINVSITGGAGAGAGAGAAIPDEAFLQVTVSGVLKPDASDWVAMITPSNSSVAGCPLSGVNYVETGDLANLPLLCHYPVKSQYLTSDPGYMGCKNAGCGKRDASGACKARTCAATLTFHVVNFRTDVEFVLFSGGFKTPCLLKRSGALRFANPASPLYGHLSSTDSKATSMKLTWVSGDGNPQQVQYGDGKSSTSEVATFTQDDMCSVPVLPSPAKDFGWHDPGYIHSAVMTGLQPSQSYTYRYGSDSVGWSDRVKFKTPPAAGSDELSFVIYGDMGKAPLDPSVEHYIQPGSISVTKAVAKEIQTGNVDSIFHIGDISYATGFLVEWDFFLHLITPLASQVSYMTAIGNHERDYANSASVYVTPDSGGECGVAYESYFPMPAVSKDKPWYSIEQGTVHFLVMSTEHEWSEKSEQYNWMDEDLSSVDRSRTPWVIFIGHRPMYSSHGGILPNVDSNFVASVEPLLFNYQVDLVFFGHVHNYERTCAVYQGDCKGMPTKDKNGIDVYDNSNYTAPVHVIAGAGGFTLDSFPNNGEAWSLSRVSEFGYGKVHATRTDMLVQFVNSSSMEVRDQFRIVKGASVNKTPSLILQ

SEQ ID NO: 1409 - DNA, 1932 bp, Sorghum bicolor
  misc_feature: Ceres ANNOT ID no. 6015749
  misc_feature: Encodes the peptide sequence at SEQ ID NO 1410
atgggtctctccggctccggcgtcgcgttgttgcttgtgttcctcggcctctgcaccgccgtgtcgagctggacgccgccgccgccggagatgctgcacgagagcttcgcagggaagtcggagttcaggacggtgaaccggaggagtctgggcgtgtgctccaaaccgagcccgtacctggcgatcagcgtgagcaccggcggggcgccgctccccgacgaggcgttcgtcagggtgaccgtggccggcgtcctcaggcccgatgccgatgactgggtcgccatgatcacgccttccaactactccagtgtctccagatgccgtttgagtggtgaaaactacgtccagaccggcgatctagcgcatctcccgcttctgtgccactaccctgtcaaggcccagtacctgaggcacgaccctggctacttgggctgcaagaccgcggcatgccagaagcgcgacgcgtcgggcgcctgcagcgtccgcacctgcgccgccacgctcaccttccacgtcgtcaacttccgcaccgatgtcgagttcgtgctcttctccggcggtttccggacgccgtgcgtcctccagcggtccggcgcgctgcggttcgccaaccccgccagcccgctctacggccacctctccagcaccgactccacggcaacatcgatgaggcttacctgggtgagcggcgaccggaggccgcagcaggttcagtacggagtgggcaagtctgctacttctcaagtggcaacgttcacgcagaatgatatgtgcagtagccccttgttaccaagccctgccaaggatttcgggtggcatgaccctggctacattcacacggccgtcatgaccggcctccagccttctcagtcctacacctaccgctacggaagtgattctgtgggttggagtagcacaaacaaattcagaatgccaccagctgcaggctcagacgagacatcatttgtgatctatggtgatatggggaaggctccgctggacccatcagtggaacactacattcagcctggatcgatttctttggccaaggcagtggctaaagaaattcagacaggaaaggtcgattcagtcttccacataggagacataagctatgctacgggctttctggttgaatgggacttcttcctaaacctcatagcaccagtcgcttctcgagtcccctacatgaccgctattggtaatcacgaaagggattatgcagagtctggttctgtatatgtgaccccagattcaggtggtgaatgtggagttgcatatgagtcatatttccacatgccagctgtcagtaaggataagccatggtattcaattgagcaagggagcattcacttcgtcgtgatgtcaactgagcataagtggtcagagatgtcggagcagcacaaatggatgaatcaagatttgtcatcagtcaatagatcgaggacaccatgggtaattttcattgggcatagaccgatgtattcatcccatgtcggaataccagctaatgtagatccaatttttgtggcctctgttgagccactcttactcaagtaccaggtggatttggttttctttggccatgtacacaactatgagaggacttgtgcagtataccggagcatatgcaaaggcgagccaaagaaggatgcaagtcgaattgatacttatgacaacagcaaatatactgcgcctgttcatgccatcgttggagctggagggtttagcttggacaagttccctaagattgtgttgaacaagtggagcttatcaagagtttcagagttcgggtatgccagggtgcatgccacaagaggtgatatgctggttcagtttgtaagctcaaatactatggagattctggaccaatttagaattgtgaagccagatccggcaaggaggctacggaaccagccagttcaaccatag

SEQ ID NO: 1410 - protein, 643 aa, Sorghum bicolor
  misc_feature: Ceres ANNOT ID no. 6015749
  misc_feature (320)..(533): Pfam Id: Metallophos Pfam Desc: Calcineurin-like phosphoesterase
  misc_feature (32)..(629): NCBI GI: 92867261 NCBI Desc: metallophosphoesterase; fibronectin, type iii-like fold [medicago truncatula]
  misc_feature (120)..(442): NCBI GI: 144924941 NCBI Desc: metallophosphoesterase; fibronectin, type iii-like fold [medicago truncatula]
  misc_feature (168)..(627): NCBI GI: 77556254 NCBI Desc: diphosphonucleotide phosphatase 1 [oryza sativa (japonica cultivar-group)]
  misc_feature (168)..(627): NCBI GI: 115489244 NCBI Desc: os12g0576600 [oryza sativa (japonica cultivar-group)]
  misc_feature (162)..(627): NCBI GI: 115480025 NCBI Desc: os09g0506000 [oryza sativa (japonica cultivar-group)]
MGLSGSGVALLLVFLGLCTAVSSWTPPPPEMLHESFAGKSEFRTVNRRSLGVCSKPSPYLAISVSTGGAPLPDEAFVRVTVAGVLRPDADDWVAMITPSNYSSVSRCRLSGENYVQTGDLAHLPLLCHYPVKAQYLRHDPGYLGCKTAACQKRDASGACSVRTCAATLTFHVVNFRTDVEFVLFSGGFRTPCVLQRSGALRFANPASPLYGHLSSTDSTATSMRLTWVSGDRRPQQVQYGVGKSATSQVATFTQNDMCSSPLLPSPAKDFGWHDPGYIHTAVMTGLQPSQSYTYRYGSDSVGWSSTNKFRMPPAAGSDETSFVIYGDMGKAPLDPSVEHYIQPGSISLAKAVAKEIQTGKVDSVFHIGDISYATGFLVEWDFFLNLIAPVASRVPYMTAIGNHERDYAESGSVYVTPDSGGECGVAYESYFHMPAVSKDKPWYSIEQGSIHFVVMSTEHKWSEMSEQHKWMNQDLSSVNRSRTPWVIFIGHRPMYSSHVGIPANVDPIFVASVEPLLLKYQVDLVFFGHVHNYERTCAVYRSICKGEPKKDASRIDTYDNSKYTAPVHAIVGAGGFSLDKFPKIVLNKWSLSRVSEFGYARVHATRGDMLVQFVSSNTMEILDQFRIVKPDPARRLRNQPVQP

SEQ ID NO: 1411 - DNA, 336 bp, Sorghum bicolor
  misc_feature: Ceres ANNOT ID no. 6015751
  misc_feature: Encodes the peptide sequence at SEQ ID NO 1412
atggcaaaacttccgagcttgttcttagtcctctcttctatagtagccatatccgtcgtaggctctcaggctgatggaggttgtgataatgacctccaaagcctgataactgaatgcaagcggtacgtgatgtttccaacgaatccaaaggtccctccttcagatggttgttgtggtgtcatcaagaaggtaaatgttccttgcctgtgcgccaaggtcaccaaggagattgagaaggtcgtgtgcatggagaaggttgtgtatgttgctgagcaatgtaagaggccatttgagcatggcttccagtgtggaagctacaaggttcctagaaaatga

SEQ ID NO: 1412 - protein, 111 aa, Sorghum bicolor
  misc_feature: Ceres ANNOT ID no. 6015751
  misc_feature (20)..(109): NCBI GI: 66840998 NCBI Desc: 5a2 protein [triticum aestivum]
  misc_feature (11)..(109): NCBI GI: 42567284 NCBI Desc: protease inhibitor/seed storage/lipid transfer protein (ltp) family protein [arabidopsis thaliana]
  misc_feature (10)..(109): NCBI GI: 32395579 NCBI Desc: seed specific protein bn15d18b [brassica napus]
  misc_feature (28)..(105): NCBI GI: 79495992 NCBI Desc: lipid binding [arabidopsis thaliana]
  misc_feature (83)..(109): NCBI GI: 115440511 NCBI Desc: os01g0800700 [oryza sativa (japonica cultivar-group)]
MAKLPSLFLVLSSIVAISVVGSQADGGCDNDLQSLITECKRYVMFPTNPKVPPSDGCCGVIKKVNVPCLCAKVTKEIEKVVCMEKVVYVAEQCKRPFEHGFQCGSYKVPRK

SEQ ID NO: 1413 - DNA, 1464 bp, Sorghum bicolor
  misc_feature: Ceres ANNOT ID no. 6015753
  misc_feature: Encodes the peptide sequence at SEQ ID NO 1414
atgccgctgctgctgcgcggcgcctcccttctccgcctctaccagtgtacctgtgggcttcgaagtgcgaatttcagttcaagagtacctgcactagtgaatctcatcaccacgagggacagaatgcgggctacatattcgcgtagagctgcctctaagaacagtgaggtcaacaaagatgagcagccagtcatagagaaggaagatgctgctgaaagtgatttggagatagagagtgtgaggagcaaccctagccagctccaatcaatgactgtcaaggagctcagggagctcacgaggaggatgggtgtttctgtgaaaggtaccaagaaagatttagtatcagccttgatgaattctctgggcgtggaagcaaatggtgacgagggaaagtcatccattgagctggttagcccctcggagatacctttaaaaagaaaaagtggtgcttctgttgtgattgaacaaaaactagaaagttctgagattatttctgaaacacctagcaagaaaagaagtagaacaaaacaaaagtcaagcaagagtaccacccttgaggagaattctgtgactaatgtcaagctaagtaagactattgtccagaaggaaacatttgtcgtccaaggtgctgttcctaatgacgattcagagccttggactgtactcgtgcataagaaaccacaagctggctggattccatacaaccctaagactatgaggcctccacctcttagcaaggatacacgtgctctgaagattatgtcatggaatgtcaatggattgaaagcattgctcaaatcaagaggcttctctgtgcagcaattagcacagagggaggactttgatgagaaggatgttgaagttattaaagacactttgcttgatggctacacaaatagtttctttacttgcagtgtcaaaccactctcgatcaagtatgggcttggtataccagaccatgatactgaagggagggttgtgactgtagagttcgatgacttctacctgttaactgcttatgtaccaaactctggtgatggtctaaaaagattgacttacagggtcacagagtgggatccatcccttggtaactacatgaaagaattggagaaatcgaagcctgtcatactaaccggtgaccttaattgtgcgcaccaggagattgatatacatgaccctgccggaaaccgtaaaagtgcaggcttcacaaacgaggaaagagaatcatttgagaccaattttttgtccaaagggtttgttgatacgtttcggaaacagcatcctagtgttgttgcctatagttactgggggtacaggcataatgcccggaagacaaacaaaggttggcgtctggattactttcttgtgtcggaatcaatcgctgaaaaagtgcatgattcatacattcatacattcttccggacatctctgccagtgatcacagcccccttggcctcgtactga

SEQ ID NO: 1414 - protein, 487 aa, Sorghum bicolor
  misc_feature: Ceres ANNOT ID no. 6015753
  misc_feature (251)..(483): Pfam Id: Exo_endo_phos Pfam Desc: Endonuclease/Exonuclease/phosphatase family
  misc_feature (87)..(121): Pfam Id: SAP Pfam Desc: SAP domain
  misc_feature (145)..(469): NCBI GI: 472869 NCBI Desc: arp protein [arabidopsis thaliana]
  misc_feature (145)..(469): NCBI GI: 3241944 NCBI Desc: dna-(apurinic or apyrimidinic site) lyase (arp) [arabidopsis thaliana]
  misc_feature (264)..(469): NCBI GI: 115440517 NCBI Desc: os01g0801100 [oryza sativa (japonica cultivar-group)]
  misc_feature (251)..(470): NCBI GI: 16414395 NCBI Desc: lin1894 [listeria innocua]
  misc_feature (251)..(470): NCBI GI: 47094151 NCBI Desc: exodeoxyribonuclease [listeria monocytogenes str. 4b h7858]
  misc_feature: Useful for making plants with altered Lignin content
  misc_feature: GREAT-hit functional homolog of the protein sequence given in SEQ ID NO 13303
MPLLLRGASLLRLYQCTCGLRSANFSSRVPALVNLITTRDRMRATYSRRAASKNSEVNKDEQPVIEKEDAAESDLEIESVRSNPSQLQSMTVKELRELTRRMGVSVKGTKKDLVSALMNSLGVEANGDEGKSSIELVSPSEIPLKRKSGASVVIEQKLESSEIISETPSKKRSRTKQKSSKSTTLEENSVTNVKLSKTIVQKETFVVQGAVPNDDSEPWTVLVHKKPQAGWIPYNPKTMRPPPLSKDTRALKIMSWNVNGLKALLKSRGFSVQQLAQREDFDEKDVEVIKDTLLDGYTNSFFTCSVKPLSIKYGLGIPDHDTEGRVVTVEFDDFYLLTAYVPNSGDGLKRLTYRVTEWDPSLGNYMKELEKSKPVILTGDLNCAHQEIDIHDPAGNRKSAGFTNEERESFETNFLSKGFVDTFRKQHPSVVAYSYWGYRHNARKTNKGWRLDYFLVSESIAEKVHDSYIHTFFRTSLPVITAPLASY

SEQ ID NO: 1415 - DNA, 1395 bp, Sorghum bicolor
  misc_feature: Ceres ANNOT ID no. 6015757
  misc_feature: Encodes the peptide sequence at SEQ ID NO 1416
atgggcggggcggaggggcttgggcagccggacggccacgcgaacggggcggccgtggtggaggagaagctggacgcgctgcggcggcagctggggaaggcggacggcgacccgctccggatcgtcggcgtcggggcgggcgcctggggcagcgtcttctgcgcgctgctgcaggacgcgtacggccacctccgcgacaaggcgcaggtccgcatctggcgccgcccgggccgcgccgtcgaccgcgccaccgcccagcacctcttcgacgtcatcaacgcgcgcgaggacgtcctgcgccgcctgatccgccgctgcgcctacctcaagtacgtcgaggcgcgcctcggcgaccgcacgctctacgccgacgagatactcagggacggcttctgcctcaacatggtcgacacgccgctctgcccgctcaaggtcgtcaccaacctgcaggaggccgtctgggacgccgacattgtcgtcaacggtgtgccgtccacggacaccagggaggtgttcggggagattgggaggtactggaaggagaggatcactgcccccataatcatctccctcgccaagggaatagaggcctcgctggatccactgccacggatcataactcccacgcagatggttagcaatgcaactggagttccaatggagaatattctttatcttggtggacctaatattgcttctgaaatttacaacaaagaatatgcaaatgcacgtatttgtggagctgacaaatggagaaaacctcttgcaaagtttttgaggcagcctcattttattgtgtgggataacagtgatctcatcactcatgaagtcatgggtggcttaaaaaatgtctatgctattggtgctggtatggtagctgcactaaccaacgagagtgcaaccagcaaatccgtttactttgcactttgcacatctgagatgatctacatcacacatattctggaagaagaacctgaaaaacttgctggacccttattagctgacacttatgtcacattgttgaaaggtcgtaatgcatggtatgggcagaagttagctaaaggtgaattgacattagaaatgggtgacagtattaaaggaaaagggaccattcagggtgtctctgcagttgaagcgttttatgagcttcttagtcaggatagcttaagtgtcatgcatccagaagccaacagatctgttgcgccggttgagatgtgcccgatcctaaaagcactacataggattttgatcacgagggaccgtcctgctgattcgattcttcaggctataagagatgagacaatgtatgatccacgtgaaagaattgagatggcacacggccattcactctaccgaccatctctgcttggtcaaccaaaagatgtcaaaacctag

SEQ ID NO: 1416 - protein, 464 aa, Sorghum bicolor
  misc_feature: Ceres ANNOT ID no. 6015757
  misc_feature (270)..(429): Pfam Id: NAD_Gly3P_dh_C Pfam Desc: NAD-dependent glycerol-3-phosphate dehydrogenase C-terminus
  misc_feature (39)..(253): Pfam Id: NAD_Gly3P_dh_N Pfam Desc: NAD-dependent glycerol-3-phosphate dehydrogenase N-terminus
  misc_feature (1)..(460): NCBI GI: 115464667 NCBI Desc: os05g0495700 [oryza sativa (japonica cultivar-group)]
  misc_feature (11)..(459): NCBI GI: 115442141 NCBI Desc: os01g0939600 [oryza sativa (japonica cultivar-group)]
  misc_feature (19)..(458): NCBI GI: 79396613 NCBI Desc: glycerol-3-phosphate dehydrogenase (nad+) [arabidopsis thaliana]
  misc_feature (1)..(239): NCBI GI: 29367963 NCBI Desc: glycerol-3-phosphate dehydrogenase-like protein [oryza sativa (japonica cultivar-group)]
  misc_feature (143)..(391): NCBI GI: 133915197 NCBI Desc: glycerol-3-phosphate dehydrogenase (nad(p)+) [saccharopolyspora erythraea nrrl 2338]
MGGAEGLGQPDGHANGAAVVEEKLDALRRQLGKADGDPLRIVGVGAGAWGSVFCALLQDAYGHLRDKAQVRIWRRPGRAVDRATAQHLFDVINAREDVLRRLIRRCAYLKYVEARLGDRTLYADEILRDGFCLNMVDTPLCPLKVVTNLQEAVWDADIVVNGVPSTDTREVFGEIGRYWKERITAPIIISLAKGIEASLDPLPRIITPTQMVSNATGVPMENILYLGGPNIASEIYNKEYANARICGADKWRKPLAKFLRQPHFIVWDNSDLITHEVMGGLKNVYAIGAGMVAALTNESATSKSVYFALCTSEMIYITHILEEEPEKLAGPLLADTYVTLLKGRNAWYGQKLAKGELTLEMGDSIKGKGTIQGVSAVEAFYELLSQDSLSVMHPEANRSVAPVEMCPILKALHRILITRDRPADSILQAIRDETMYDPRERIEMAHGHSLYRPSLLGQPKDVKT

SEQ ID NO: 1417 - DNA, 654 bp, Sorghum bicolor
  misc_feature: Ceres ANNOT ID no. 6015763
  misc_feature: Encodes the peptide sequence at SEQ ID NO 1418
atggacgacggagtagaccttccaagccaccaccttcatggctattgcttcgacgatttcatgaaaagtacagctgcatgtactcacacacacacttgcaatccgccgggtccatcggccgccatgcatacgcacagatgcctccacacgcacaggcaattcatagcctcctctagcgaagagctgaggacgcctcgaaaacctctcggaaaccgagaggctgtgcgcaagtaccgggagaagaagaaagcgcacgcggccttcctagaggaggaggtcaagaagctacgcgccaccaaccagcacctgctgaggaggttgcagaggcatgcggcactcgaggctgaggtggtgaggttaagaggcctcttgtttgatgtccaaggcaagatcgatgcagagatcgtcggcgccttcccgttccaaaagcatcggagctttggttctgttatctgcacagatcctactctttgctttgttaatgatgatgcagaggttgcagttccagcccgagaagagagctccgcgccaacaaattttagttttgagatggatgaaagcgacagtatttcacgtgaatttgatattcctgaagtggttaattccatggatgctgctgcaagcttggtgaactcagcctcaatggctgaatga

SEQ ID NO: 1418 - protein, 217 aa, Sorghum bicolor
  misc_feature: Ceres ANNOT ID no. 6015763
  misc_feature (59)..(116): Pfam Id: bZIP_2 Pfam Desc: Basic region leucine zipper
  misc_feature (59)..(118): Pfam Id: bZIP_1 Pfam Desc: bZIP transcription factor
  misc_feature (6)..(143): NCBI GI: 113367246 NCBI Desc: bzip transcription factor bzip121 [glycine max]
  misc_feature (6)..(143): NCBI GI: 113367214 NCBI Desc: bzip transcription factor bzip122 [glycine max]
  misc_feature (17)..(143): NCBI GI: 54291039 NCBI Desc: transcription factor-like [oryza sativa (japonica cultivar-group)]
  misc_feature (24)..(143): NCBI GI: 30693563 NCBI Desc: bzip family transcription factor [arabidopsis thaliana]
  misc_feature (107)..(143): NCBI GI: 145652373 NCBI Desc: transcription factor bzip120 [glycine max]
  misc_feature: The sequence is a functional homolog of SEQ ID NO 1707 in the 11/479,226US patent application
  misc_feature: Useful for making plants with modulated growth and phenotype characteristics
  misc_feature: The sequence is a functional homolog of SEQ ID NO 1707 in the 20070022495 US patent application
MDDGVDLPSHHLHGYCFDDFMKSTAACTHTHTCNPPGPSAAMHTHRCLHTHRQFIASSSEELRTPRKPLGNREAVRKYREKKKAHAAFLEEEVKKLRATNQHLLRRLQRHAALEAEVVRLRGLLFDVQGKIDAEIVGAFPFQKHRSFGSVICTDPTLCFVNDDAEVAVPAREESSAPTNFSFEMDESDSISREFDIPEVVNSMDAAASLVNSASMAE

SEQ ID NO: 1419 - DNA, 1215 bp, Sorghum bicolor
  misc_feature: Ceres ANNOT ID no. 6015765
  misc_feature: Encodes the peptide sequence at SEQ ID NO 1420
atggcttgctccgcgcagcttctgtcccagagcctctactcgtcccaccgcgccagcccgcccgggcccaggaacctccgctcccaggggcgaccgccggcgcgggcgtctcccgcggcgaggcctggctcgagggccagggggtgccggggtgtcagcctgagggtcgacgcgtcgttcgaggaggggaggcggcaagtggaggtctcttatgacccacaagcaaggtttaaccagatagcggaccaaattgacaaggatgctggaatgacacggcttaacctattttcaccttgcaaaattaatgtgttcttgaggataacgggtaagagaccagatgggttccacgacctggcttctctatttcatgtgataagtttgggtgatacgatcaaattttcattgtcaccaagtaaaagcagagatcgcctgtcaaccaatgttccaggtgtcccagttgatgaaagcaatttgatcatcaaggcactcaacctttaccgacagaaaacagggactaataactttttttggatacatcttgataagaaggtcccaactggtgctggtctcggtggtggaagcagcaatgctgcaactgcactttgggctgctaaccagtttgctggctgtatagcttcagagaaggatcttcaagagtggtctggtgagattggatcagatatcccctttttcttttcacaaggagcagcatattgtactggtagaggagagattgtccaagatatcccaaatcccttgccggaaaatttaccaatggttcttataaagccgcctgaagcatgctcaactgctgaagtttacaagcgattcaaattggaacaaacaagtcaagctgatcccttgaccttgctcaaggaaataactcaaaatgggatatcacaagatgtttgtgttaatgacctagagcctccagcttttgaggtgttaccttcacttaagaggttgaagaaacgaattattgcagctagccgggatgattatagtgctgtttttatgtcaggaagtggaagcacaattgttgggattggttccccggatcctcctgcattcgtgtatgacgatgaagactacaaggatgttttttggtcagaggcttgcttgctcactcgcgatgagaacgagtggtacagggaaccaatctcgtccaatgccacgtctagcaaagatggtttggaagcctcggtcgctgactga

SEQ ID NO: 1420 - protein, 404 aa, Sorghum bicolor
  misc_feature: Ceres ANNOT ID no. 6015765
  misc_feature (177)..(235): Pfam Id: GHMP_kinases_N Pfam Desc: GHMP kinases N terminal domain
  misc_feature (278)..(366): Pfam Id: GHMP_kinases_C Pfam Desc: GHMP kinases C terminal
  misc_feature (64)..(401): NCBI GI: 1899050 NCBI Desc: ripening-associated protein [lycopersicon esculentum]
  misc_feature (54)..(393): NCBI GI: 145843639 NCBI Desc: 4-diphosphocytidyl-2-c-methyl-d-erythritol kinase [salvia miltiorrhiza]
  misc_feature (59)..(394): NCBI GI: 9864191 NCBI Desc: 4-diphosphocytidyl-2c-methyl-d-erythritol kinase [arabidopsis thaliana]
  misc_feature (66)..(389): NCBI GI: 141452638 NCBI Desc: 4-diphosphocytidyl-2-c-methyl-d-erythritol kinase [nicotiana benthamiana]
  misc_feature (63)..(394): NCBI GI: 6688843 NCBI Desc: isopentenyl monophosphate kinase [mentha x piperita]
  misc_feature (59)..(394): SWISSPROT Homolog: EC 2.7.1.148 4-diphosphocytidyl-2-C-methyl-D-erythritol kinase, chloroplast precursor
MACSAQLLSQSLYSSHRASPPGPRNLRSQGRPPARASPAARPGSRARGCRGVSLRVDASFEEGRRQVEVSYDPQARFNQIADQIDKDAGMTRLNLFSPCKINVFLRITGKRPDGFHDLASLFHVISLGDTIKFSLSPSKSRDRLSTNVPGVPVDESNLIIKALNLYRQKTGTNNFFWIHLDKKVPTGAGLGGGSSNAATALWAANQFAGCIASEKDLQEWSGEIGSDIPFFFSQGAAYCTGRGEIVQDIPNPLPENLPMVLIKPPEACSTAEVYKRFKLEQTSQADPLTLLKEITQNGISQDVCVNDLEPPAFEVLPSLKRLKKRIIAASRDDYSAVFMSGSGSTIVGIGSPDPPAFVYDDEDYKDVFWSEACLLTRDENEWYREPISSNATSSKDGLEASVAD

SEQ ID NO: 1421 - DNA, 1086 bp, Sorghum bicolor
  misc_feature: Ceres ANNOT ID no. 6015773
  misc_feature: Encodes the peptide sequence at SEQ ID NO 1422
atgggcaaggaaggggccagcgccggcggcggcggcggcgacggcggcatgtcggagtcggtgatccgcaaggtcctgatctcgtacatgtacgtggcggtgtggatcttcctctccttctccgtgatcgtctacaacaagtacatcctcgaccccaagatgtacaactggcccttccccatctccctcaccatggtgcacatggccttctgctcctccctcgccgtcgcgctcgtccgcgtcctccgcgtcgtcgacctcccgtcctcccccgccatgacgtcgcagctctacgtctcatccgtcgtccccatcggcgcgctctactcgctctcgctctggttctccaactccgcctacatctacctctccgtctccttcatccagatgctcaaggcgctcatgcccgtcgccgtctactccatcggggtgctcttcaagaaggagaccttcaagtcctccgccatgctcaacatgctctccatctccttcggcgtcgccattgccgcctacggcgaggcccgcttcgacgcccgtggcgttgccctgcagctcgccgccgtcgccttcgaggccacgcgcctcgtcctcatccagatcctcctcacctccaagggcatctccctcaaccccatcacctcgctctactacgtcgcgccctgctgcctcgccttcctcgtcgtgccctgggtcttcgtcgagttgcccaaactgcgcgaagtcggcagcttccagccggacctcttcgtcttcggcaccaactcgctctgcgccttcgcgctcaacctcgccgtcttcctgctcgtcggcaagacgtccgctctcacaatgaacgtcgccggcgtcgtcaaggactggctgctcatcgccttctcctggtccgtcatccgcgacaccgtcacccccatcaacctcttcggctacgggatcgccttcctcggggtgggctactacaaccacgtcaagctgcaggcgctcaaggccaaggaggcacagaagaaggcggcgcaggccgacgaggaggccggctcgctgctgcaggagcgcgactcgcacggcgaccgcaagactgacacccaggcctag

SEQ ID NO: 1422 - protein, 361 aa, Sorghum bicolor
  misc_feature: Ceres ANNOT ID no. 6015773
  misc_feature (180)..(320): Pfam Id: TPT Pfam Desc: Triose-phosphate Transporter family
  misc_feature (15)..(360): NCBI GI: 61651606 NCBI Desc: plastidic phosphate translocator-like protein1 [mesembryanthemum crystallinum]
  misc_feature (12)..(360): NCBI GI: 18420914 NCBI Desc: phosphate translocator-related [arabidopsis thaliana]
  misc_feature (14)..(341): NCBI GI: 124484353 NCBI Desc: phosphate translocator protein [chlamydomonas reinhardtii]
  misc_feature (17)..(328): NCBI GI: 15221115 NCBI Desc: phosphate translocator-related [arabidopsis thaliana]
  misc_feature (19)..(344): NCBI GI: 145354837 NCBI Desc: dmt family transporter: phosphate/phosphoenolpyruvate [ostreococcus lucimarinus cce9901]
  misc_feature: The sequence is a functional homolog of SEQ ID NO. 360 in the 11/188,298 US application
  misc_feature: The sequence is a functional homolog of SEQ ID NO. 484 in the 11/188,298 US application
MGKEGASAGGGGGDGGMSESVIRKVLISYMYVAVWIFLSFSVIVYNKYILDPKMYNWPFPISLTMVHMAFCSSLAVALVRVLRVVDLPSSPAMTSQLYVSSVVPIGALYSLSLWFSNSAYIYLSVSFIQMLKALMPVAVYSIGVLFKKETFKSSAMLNMLSISFGVAIAAYGEARFDARGVALQLAAVAFEATRLVLIQILLTSKGISLNPITSLYYVAPCCLAFLVVPWVFVELPKLREVGSFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGDRKTDTQA

SEQ ID NO: 1423 - DNA, 507 bp, Sorghum bicolor
  misc_feature: Ceres ANNOT ID no. 6015780
  misc_feature: Encodes the peptide sequence at SEQ ID NO 1424
atggcgctcgcactagcctctcttccaatggcgtctctctccttccactccgggaggatctctgcggcggctatcggaggcgtcgcccgcactcgcagggcggccccggtgggggtatccgcctccccgttcctccggagctccttcgtctcgtcctcttccacgtcgtccgcctccgcctcccccgcctcgctcgcggcggcggtctcggcgtcgctggccttcacctcctcttcctcgttcgcgggttcatctttaggaattgagttcagctacaatagaatgacaacacgaagatcccgtggtatgcagattagggctggaaaggctgccctctgcatgaccaagaggtcaagatctaggaagtcacttgcccgtacacatggtttccgcaggcggatgcggactacttctggacgaaaggtactgaagcgcaggcgtgccaaaggcaggaaggttctttgcacaaggacaaactcacccactgggaagaaaagattattctaa

SEQ ID NO: 1424 - protein, 168 aa, Sorghum bicolor
  misc_feature: Ceres ANNOT ID no. 6015780
  misc_feature (115)..(156): Pfam Id: Ribosomal_L34 Pfam Desc: Ribosomal protein L34
  misc_feature (10)..(165): NCBI GI: 7578860 NCBI Desc: plastid ribosomal protein l34 precursor [spinacia oleracea]
  misc_feature (33)..(154): NCBI GI: 119399800 NCBI Desc: 60s ribosomal protein l34 [aspergillus clavatus nrrl 1]
  misc_feature (120)..(160): NCBI GI: 30908463 NCBI Desc: ribosomal protein l34 [thermus scotoductus]
  misc_feature (120)..(160): NCBI GI: 95929985 NCBI Desc: ribosomal protein l34 [desulfuromonas acetoxidans dsm 684]
  misc_feature (120)..(165): NCBI GI: 116122212 NCBI Desc: 50s ribosomal protein l34 [leptospira borgpetersenii serovar hardjo-bovis l550]
MALALASLPMASLSFHSGRISAAAIGGVARTRRAAPVGVSASPFLRSSFVSSSSTSSASASPASLAAAVSASLAFTSSSSFAGSSLGIEFSYNRMTTRRSRGMQIRAGKAALCMTKRSRSRKSLARTHGFRRRMRTTSGRKVLKRRRAKGRKVLCTRTNSPTGKKRLF

SEQ ID NO: 1425 - DNA, 633 bp, Sorghum bicolor
  misc_feature: Ceres ANNOT ID no. 6015788
  misc_feature: Encodes the peptide sequence at SEQ ID NO 1426
atgtcggcggggctggtgaccgacgaggccaccgtggggcggctctaccggatccggcgcacggtgatgcagatgctgcgtgaccgtggctacctggtggtggagcacgagctcgccaccagccgccgcgacttcctccgcaagttcggcgagtccttccaccgcgaggacctccaaatcaacaagtccaagaagaacgacccctccgaccagatatatgttttcttccccaatgatgacaaggtagggatgaagcacatcaagaagtacgttgaaatgatgacccatgagaatgtctccagagctatggtggttcttcagcagaacctaactccatttgcaaagtcgtttctcatagaattggagccaaagatccatttggaagttttccaggaggccgagttgcttataaacatcaaggagcatgttcttgttcctgagcatcaggtgctcacaaatgaggagaaaaagacgctattggaacggtacaccttaaaggaaactcagcttccaagaatacagatttcggatcctattgctaggtactatggcctcagaagaggtcaggtcgtgaagatcatcagacccagtgagacggcgggcagatacgttacataccgctatgttgtatga

SEQ ID NO: 1426 - protein, 210 aa, Sorghum bicolor
  misc_feature: Ceres ANNOT ID no. 6015788
  misc_feature (137)..(210): Pfam Id: RNA_pol_Rpb5_C Pfam Desc: RNA polymerase Rpb5, C-terminal domain
  misc_feature (6)..(95): Pfam Id: RNA_pol_Rpb5_N Pfam Desc: RNA polymerase Rpb5, N-terminal domain
  misc_feature (5)..(210): NCBI GI: 92889266 NCBI Desc: rna polymerase subunit, rpb5; rna polymerase rpb5, n-terminal [medicago truncatula]
  misc_feature (5)..(210): NCBI GI: 38344231 NCBI Desc: oj991113_30.8 [oryza sativa (japonica cultivar-group)]
  misc_feature (5)..(206): NCBI GI: 92880626 NCBI Desc: rna polymerase subunit, rpb5; rna polymerase rpb5, n-terminal [medicago truncatula]
  misc_feature (8)..(209): NCBI GI: 1060912 NCBI Desc: rpb5 [homo sapiens]
  misc_feature (8)..(209): NCBI GI: 14589951 NCBI Desc: dna directed rna polymerase ii polypeptide e [homo sapiens]
  misc_feature (8)..(209): SWISSPROT Homolog: EC 2.7.7.6 DNA-directed RNA polymerase II 23 kDa polypeptide
  misc_feature: Useful for making plants with modulated drought sensitivity
  misc_feature: GREAT-hit functional homolog of the protein sequence given in SEQ ID NO 13421
  misc_feature: Useful for making plants with modulated drought sensitivity
  misc_feature: Useful for making plants with modulated water use efficiency
  misc_feature: Functional homolog of the protein sequence given in SEQ ID NO 13421
MSAGLVTDEATVGRLYRIRRTVMQMLRDRGYLVVEHELATSRRDFLRKFGESFHREDLQINKSKKNDPSDQIYVFFPNDDKVGMKHIKKYVEMMTHENVSRAMVVLQQNLTPFAKSFLIELEPKIHLEVFQEAELLINIKEHVLVPEHQVLTNEEKKTLLERYTLKETQLPRIQISDPIARYYGLRRGQVVKIIRPSETAGRYVTYRYVV

SEQ ID NO: 1427 - DNA, 876 bp, Sorghum bicolor
  misc_feature: Ceres ANNOT ID no. 6015789
  misc_feature: Encodes the peptide sequence at SEQ ID NO 1428
atgaacggcgggctccctggattccacaatgcgccagcgtcgagggccgtggtcgtcgccgcagttctcttctccgtccccttcggcttccgcggtcgctcccacaacctcggcctgtcctaccagagtatttatgaaaagctgagtatctggaggctggtcacctcattgtttgctttctcgtcaacccccgagctgatctttggagcggccctgctatactactttagggtgtttgaacggcaaataggttctaacaagtatgctgtcttcatcatcttctcgactatggtgtctgtactgcttcagatccttgctttaggttacatgaaagatccttctctaaatccattgacgtcaggaccatatggcctcatctttgcatcttatgtgccattcttctttgacattcctgtctcaatgaagttccgcatatttggactgagcttaagtgataagtcgtttgtatatttggcaggactccagcttcttttttcatctggaagacgttctgttgtacctggactttctggcatactggctgggcttttgtatcgcttgaatacatttggcatccgtagattgaagttcccagagtttgcaatatcgctcttctcgcagttgtcatggcccttttctaacaatccatatcaagggttaccgaccacagaaaataatggaagtgtcccttctcaccaggcacatcaaattgaggatgcacgcacagctatccaagatcccacggaatcttctattactgcactcgtgtctatgggctttgatcgcagtgcagcaattcaggcacttgcattgaccaactacgatgtcaatttggcctcaaacattctgcttgaagcacaagctctacagccatga

SEQ ID NO: 1428 - protein, 291 aa, Sorghum bicolor
  misc_feature: Ceres ANNOT ID no. 6015789
  misc_feature (247)..(283): Pfam Id: UBA Pfam Desc: UBA/TS-N domain
  misc_feature (12)..(199): Pfam Id: DER1 Pfam Desc: Der1-like family
  misc_feature (39)..(196): NCBI GI: 115440573 NCBI Desc: os01g0806000 [oryza sativa (japonica cultivar-group)]
  misc_feature (4)..(224): NCBI GI: 119629416 NCBI Desc: phosphoglycerate dehydrogenase like 1, isoform cra_b [homo sapiens]
  misc_feature (50)..(224): NCBI GI: 39645857 NCBI Desc: phgdhl1 protein [homo sapiens]
  misc_feature (2)..(188): NCBI GI: 6523772 NCBI Desc: spac1486.02c [schizosaccharomyces pombe]
  misc_feature (118)..(224): NCBI GI: 111307736 NCBI Desc: phgdhl1 protein [homo sapiens]
MNGGLPGFHNAPASRAVVVAAVLFSVPFGFRGRSHNLGLSYQSIYEKLSIWRLVTSLFAFSSTPELIFGAALLYYFRVFERQIGSNKYAVFIIFSTMVSVLLQILALGYMKDPSLNPLTSGPYGLIFASYVPFFFDIPVSMKFRIFGLSLSDKSFVYLAGLQLLFSSGRRSVVPGLSGILAGLLYRLNTFGIRRLKFPEFAISLFSQLSWPFSNNPYQGLPTTENNGSVPSHQAHQIEDARTAIQDPTESSITALVSMGFDRSAAIQALALTNYDVNLASNILLEAQALQP

SEQ ID NO: 1429 - DNA, 1611 bp, Sorghum bicolor
  misc_feature: Ceres ANNOT ID no. 6015795
  misc_feature: Encodes the peptide sequence at SEQ ID NO 1430
atggcgacgccagcgccggcgccctccctccgcctcctcctgctgctaccgctgctcaccgtcgccggcgccgcggtgtctcacccagcgcacgagttctgcgcagtcgggggtgacgccgccggctgcggcggcggaggggacggcacgaggatcctgatcaagggcgggacggtggtgaacgcgcaccgcgcggaggaggccgacgtatacatcgaggacggcgtcgtcgtcgccgtccgctcaaacatcccggttggtgctgataatgtccgagtaatcgacgcaacaggaaaatatgtcatgccaggtggaattgaccctcacacgcacctggagatggagttcatgggcaccgtgaccatagatgacttcttcagcggccatgctgcggcgctggctggtgggacgacgatgcatattgactttgtcattcctgtgaacggcaacttgactgcaggcttggagtcctacaagcacaaggcagcaaaagctgccatggattatggctttcacatggccattacaaagtggaatgatgaggttgcaagggaaatggaagtgatggttaaggaacatggaataaattctttcaagtttttcatggcatataaaggctcgttgatggtcaccgatgacctcctcctgcaaggcctacagaaatgcaagtcgcttggtgcccttgctatggttcatgcagagaatggggatgctgttgccgagggacaacagcggatgattgaccttgggataactggtccagaagggcatgctctctcaagacctccaattttagaaggagaagcaactgcacgggcaatccgtttagcaaagttcatcaatacgccactgtacgttgttcatgtgatgagcatagacgcgatggatgagattgccaaagctaaaagagaagggcagagagtcataggtgaacctgtggtttctggactagtgcttgatgattcttggctttgggatcctgacttcacaattgcttcaaagtatgtgatgagtcctccaatccgggaagcagggcatggtaaagcactccaagctgctctttcgtcaggaattttacagcttgtaggtactgatcactgcacattcaactccacacagaaagcttttggttctgatgattttcggaagattcccaatggtgtaaatggtcttgaggaacggatgcatataatttgggacagcatggtggagactggcaaaatttctgtaaccgactatgtcagagtgacaagcacagaatgtgccaagatcttcaacatattccctcggaaaggagcaatcctggaaggatctgacgcagatatcataatcctgaatcctgaaaggagctttgtgatgggtgctcacactcaccattcgaggtccaacactaatgtgtacgagggcaggaaaggaaagggaatggtggaaatcacaatctcaaggggccgagtggtatgggaggatggtgttctgaacattacacctggttcaggaagatacgtcatgatgccacctttcggctacgtctttgatgggattcagaggtccgacgccgcctacagagcttccctccgagcccctgtacagcgtggtaaagctagtgcatag

SEQ ID NO: 1430 - protein, 536 aa, Sorghum bicolor
  misc_feature: Ceres ANNOT ID no. 6015795
  misc_feature (100)..(446): Pfam Id: Amidohydro_1 Pfam Desc: Amidohydrolase family
  misc_feature (12)..(536): NCBI GI: 28194047 NCBI Desc: dihydropyrimidine amidohydrolase [arabidopsis thaliana]
  misc_feature (10)..(536): NCBI GI: 92874029 NCBI Desc: metallo-dependent hydrolase, composite [medicago truncatula]
  misc_feature (9)..(535): NCBI GI: 92874023 NCBI Desc: metallo-dependent hydrolase, composite [medicago truncatula]
  misc_feature (49)..(526): NCBI GI: 28194051 NCBI Desc: dihydropyrimidine amidohydrolase [dictyostelium discoideum]
  misc_feature (49)..(526): NCBI GI: 93279740 NCBI Desc: chain a, crystal structure of dihydropyrimidinase from dictyostelium discoideum
  misc_feature (52)..(492): SWISSPROT Homolog: EC 3.5.2.2 D-hydantoinase
MATPAPAPSLRLLLLLPLLTVAGAAVSHPAHEFCAVGGDAAGCGGGGDGTRILIKGGTVVNAHRAEEADVYIEDGVVVAVRSNIPVGADNVRVIDATGKYVMPGGIDPHTHLEMEFMGTVTIDDFFSGHAAALAGGTTMHIDFVIPVNGNLTAGLESYKHKAAKAAMDYGFHMAITKWNDEVAREMEVMVKEHGINSFKFFMAYKGSLMVTDDLLLQGLQKCKSLGALAMVHAENGDAVAEGQQRMIDLGITGPEGHALSRPPILEGEATARAIRLAKFINTPLYVVHVMSIDAMDEIAKAKREGQRVIGEPVVSGLVLDDSWLWDPDFTIASKYVMSPPIREAGHGKALQAALSSGILQLVGTDHCTFNSTQKAFGSDDFRKIPNGVNGLEERMHIIWDSMVETGKISVTDYVRVTSTECAKIFNIFPRKGAILEGSDADIIILNPERSFVMGAHTHHSRSNTNVYEGRKGKGMVEITISRGRVVWEDGVLNITPGSGRYVMMPPFGYVFDGIQRSDAAYRASLRAPVQRGKASA

SEQ ID NO: 1431 - DNA, 1389 bp, Sorghum bicolor
  misc_feature: Ceres ANNOT ID no. 6015796
  misc_feature: Encodes the peptide sequence at SEQ ID NO 1432
atggagagtagacgaggagggtcgacggcggcggcggaagatgcgggcggggggatgccgagctttgggccacctcagcacgccatcatgcaaccttctcgagttaccgactttggggcacttgcgcagtcagctggattccgaatagaagatcttgctaacctcaatgcaaatgctttgttcaatctgaagccaaatacccatacaattaacaacagtcctcttcagtttggaagttacgggaagcctatttctcctcacataaatactatagaagcagcaacagctaaaacaagaattgaccctcagttgctagaacagcaaacaggagcacaatcaaatctggtggcattaccaactggtaacatcgagaattggggagagtcagctatggctggtggtagccctatgactgacacatcttcagatccagacactgatgagaggaaccagatgtttgaacaaggcctggttactgtccccacagcttctgattctagtgacaaatcaagggacaaactagatcagaagacacttcggcgtcttgcccaaaatcgtgaagctgccaggaaaagccgtttacgaaagaaggcatacatccaaaaccttgagagtagcagactgaaacttactcagttagagcaagagcttcagcgggctcgtcaacagggtatttttatttcgacatcaggagatcaacctcaatcaacaagtggaaatggagctttggcatttgacatggagtatgcacgctggttggaggagcacaacaaacatgtaaatgagttgagggctgctgtcaatgcacatgccggtgataatgatcttcgtggtattgttgatagcattatggcacactacgacgaaattttcaggctcaagggtgtggcagctaaagcagatgtttttcatgtgctgtctgggatgtggaagacccctgctgagagatgtttcatgtggttaggtggcttccgatcatctgagcttcttaagttactggcaggtcacctagagcctcttactgatcagcagcttgttggtatatccaacctgcaacagtcctcccagcaagctgaagatgctctttctcaagggatggaagcgttacaacagtcgcttgcagaaactctagcatctggatccctgggccctgctggaccttctggcaatgttgcaaattacatgggacaaatggcaatggctatgggaaaacttggcacccttgagaactttctacggcaggctgataatctacggctgcaaacacttcaacaaatgcaacgcatattaaccacccgacaatcagcacgagccctacttgcaataagcgactacttctctcggctgcgtgctttgagctctctttggcttgcccgtccaagggaataa

SEQ ID NO: 1432 - protein, 462 aa, Sorghum bicolor
  misc_feature: Ceres ANNOT ID no. 6015796
  misc_feature (1)..(462): NCBI GI: 297018 NCBI Desc: ocs-element binding factor 3.2 [zea mays]
  misc_feature (8)..(462): NCBI GI: 47499874 NCBI Desc: bzip transcription factor [oryza sativa (japonica cultivar-group)]
  misc_feature (2)..(462): NCBI GI: 34921538 NCBI Desc: transcription factor hbp-1b(c1)
  misc_feature (134)..(462): NCBI GI: 297020 NCBI Desc: ocs-element binding factor 3.1 [zea mays]
  misc_feature (131)..(462): NCBI GI: 17025924 NCBI Desc: bzip transcription factor [oryza sativa]
  misc_feature: The sequence is a functional homolog of SEQ ID NO 1492 in the 10/374,780US patent application
  misc_feature: The sequence is a functional homolog of SEQ ID NO 1496 in the 10/374,780US patent application
  misc_feature: The sequence is a functional homolog of SEQ ID NO 156 in the 10/412,699US patent application
  misc_feature: The sequence is a functional homolog of SEQ ID NO 1562 in the 10/412,699US patent application
  misc_feature: The sequence is a functional homolog of SEQ ID NO 1566 in the 10/412,699US patent application
  misc_feature: The sequence is a functional homolog of SEQ ID NO 164 in the 10/412,699US patent application
  misc_feature: The sequence is a functional homolog of SEQ ID NO 1754 in the 10/412,699US patent application
  misc_feature: The sequence is a functional homolog of SEQ ID NO 178 in the 10/412,699US patent application
  misc_feature: The sequence is a functional homolog of SEQ ID NO 1788 in the 10/412,699US patent application
  misc_feature: The sequence is a functional homolog of SEQ ID NO 1792 in the 10/412,699US patent application
  misc_feature: The sequence is a functional homolog of SEQ ID NO 1794 in the 10/412,699US patent application
  misc_feature: The sequence is a functional homolog of SEQ ID NO 18 in the 10/412,699US patent application
  misc_feature: The sequence is a functional homolog of SEQ ID NO 1878 in the 10/412,699US patent application
  misc_feature: The sequence is a functional homolog of SEQ ID NO 1978 in the 10/374,780US patent application
  misc_feature: The sequence is a functional homolog of SEQ ID NO 2026 in the 10/374,780US patent application
  misc_feature: The sequence is a functional homolog of SEQ ID NO 2030 in the 10/374,780US patent application
  misc_feature: The sequence is a functional homolog of SEQ ID NO 2032 in the 10/374,780US patent application
  misc_feature: The sequence is a functional homolog of SEQ ID NO 206 in the 10/225,068US patent application
  misc_feature: The sequence is a functional homolog of SEQ ID NO 2138 in the 10/374,780US patent application
  misc_feature: The sequence is a functional homolog of SEQ ID NO 353 in the 11/479,226US patent application
  misc_feature: The sequence is a functional homolog of SEQ ID NO 354 in the 10/412,699US patent application
  misc_feature: The sequence is a functional homolog of SEQ ID NO 356 in the 10/412,699US patent application
  misc_feature: The sequence is a functional homolog of SEQ ID NO 369 in the 11/479,226US patent application
  misc_feature: The sequence is a functional homolog of SEQ ID NO 372 in the 10/225,066US patent application
  misc_feature: The sequence is a functional homolog of SEQ ID NO 380 in the 10/412,699US patent application
  misc_feature: The sequence is a functional homolog of SEQ ID NO 389 in the 11/479,226US patent application
  misc_feature: The sequence is a functional homolog of SEQ ID NO 40 in the 10/374,780US patent application
  misc_feature: The sequence is a functional homolog of SEQ ID NO 534 in the 10/225,066US patent application
  misc_feature: The sequence is a functional homolog of SEQ ID NO 776 in the 10/225,066US patent application
  misc_feature: The sequence is a functional homolog of SEQ ID NO 823 in the 11/479,226US patent application
  misc_feature: The sequence is a functional homolog of SEQ ID NO 831 in the 11/479,226US patent application
  misc_feature: The sequence is a functional homolog of SEQ ID NO 878 in the 11/435,388US patent application
  misc_feature: The sequence is a functional homolog of SEQ ID NO 930 in the 11/435,388US patent application
  misc_feature: The sequence is a functional homolog of SEQ ID NO 934 in the 11/435,388US patent application
  misc_feature: The sequence is a functional homolog of SEQ ID NO 936 in the 11/435,388US patent application
  misc_feature: Useful for making plants with modulated growth and phenotype characteristics
  misc_feature: The sequence is a functional homolog of SEQ ID NO 156 in the 20040045049 US patent application
  misc_feature: The sequence is a functional homolog of SEQ ID NO 156 in the 20040045049 US patent application
  misc_feature: The sequence is a functional homolog of SEQ ID NO 1562 in the 20040045049 US patent application
  misc_feature: The sequence is a functional homolog of SEQ ID NO 1566 in the 20040045049 US patent application
  misc_feature: The sequence is a functional homolog of SEQ ID NO 178 in the 20040045049 US patent application
  misc_feature: The sequence is a functional homolog of SEQ ID NO 1788 in the 20040045049 US patent application
  misc_feature: The sequence is a functional homolog of SEQ ID NO 1792 in the 20040045049 US patent application
  misc_feature: The sequence is a functional homolog of SEQ ID NO 1794 in the 20040045049 US patent application
  misc_feature: The sequence is a functional homolog of SEQ ID NO 18 in the 20040045049 US patent application
  misc_feature: The sequence is a functional homolog of SEQ ID NO 1878 in the 20040045049 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: Useful for making plants with altered lignin content
  misc_feature: Functional homolog of the protein sequence given in SEQ ID NO 13093
  misc_feature: Useful for making plants with modulated flowering time
  misc_feature: Functional homolog of the protein sequence given in SEQ ID NO 13559
  misc_feature: The sequence is a functional homolog of SEQ ID NO 1798 in the 10/412,699 US patent application
  misc_feature: The sequence is a functional homolog of SEQ ID NO 2044 in the 10/374,780 US patent application
  misc_feature: The sequence is a functional homolog of SEQ ID NO 408 in the 10/412,699 US patent application
  misc_feature: The sequence is a functional homolog of SEQ ID NO 48 in the 10/286,264 US patent application
  misc_feature: The sequence is a functional homolog of SEQ ID NO 938 in the 11/435,388 US patent application
  misc_feature: The sequence is a functional homolog of SEQ ID NO 957 in the 11/479,226 US patent application
MESRRGGSTAAAEDAGGGMPSFGPPQHAIMQPSRVTDFGALAQSAGFRIEDLANLNANALFNLKPNTHTINNSPLQFGSYGKPISPHINTIEAATAKTRIDPQLLEQQTGAQSNLVALPTGNIENWGESAMAGGSPMTDTSSDPDTDERNQMFEQGLVTVPTASDSSDKSRDKLDQKTLRRLAQNREAARKSRLRKKAYIQNLESSRLKLTQLEQELQRARQQGIFISTSGDQPQSTSGNGALAFDMEYARWLEEHNKHVNELRAAVNAHAGDNDLRGIVDSIMAHYDEIFRLKGVAAKADVFHVLSGMWKTPAERCFMWLGGFRSSELLKLLAGHLEPLTDQQLVGISNLQQSSQQAEDALSQGMEALQQSLAETLASGSLGPAGPSGNVANYMGQMAMAMGKLGTLENFLRQADNLRLQTLQQMQRILTTRQSARALLAISDYFSRLRALSSLWLARPRE

SEQ ID NO: 1433 - DNA, 1590 bp, Sorghum bicolor
  misc_feature: Ceres ANNOT ID no. 6015805
  misc_feature: Encodes the peptide sequence at SEQ ID NO 1434
atggggccacccgccatggcgttccaagccctcaccctcaccccagtccccttctcactccacagctcgagtcgccgcgtccgcgtccgcgtgcttgccgtcgcggctgaccagacccctccgccgccggcggtccccccttcggagccggcgaacagccctagccgcctccttcgggagctcgcgcagcggaagaaggccgtatcccctaagaagaagcacccgccgcgtcgcttcatcctgaagccacctctcgacgacgagcgcctcacccggcggttcctcagcagcccgcagctgtcgctcaaggcgctcccgctgctctcttcctgcctcccctccgcgccgctctccaccgccgacaggacctggatggacgagtacctcctagaggccaagcaggcgctcgggtacccgctcgcgccctcggagacgctcggcgaaggcgatgactgccccgcgcggcatttcgatgtgctgctctacctcgcgttccagcatctggacccctcctccgagcgcacgcggacgcggcacgtgcggaacggtcactccaggctctggttcctgggtcagtacgttctggagctcgcgttctgtgagttcttcttgcagaggtaccccagggagtctcctgggccgatgagggagcgggtgttcgctctgattgggaagaaggtgttgccccgatggctcaaggcagccagcctgcacaatttggtcttcccctatgatgatttggataagatgatacgtaaggaccgggagccgccgtccaaggctgtgttctgggcactatttggagctatatatttgtgctttggaatgcctgaagtctatcgtgtcctatttgaggcatttgggatggacccagacgatgagagctgtcagccaaaattgcgtcggcaactagaggatgttgattatgtttcagtggagtttgaaaagagacagctcacgtggcaggatgttgctgcctacaggccaccaccggatgctctttttgctcatcctaggcttttccgagcttgtgtgccaccaggcatgcatcgcttcagaggaaatatttgggattttgacagtagacccaaggtcatgaataccctaggatatcccttgcccatgaatgacagaattccagaaatcacagaagcaaggaatatagagcttggacttggtcttcagctgtgctttttgcacccgtcaaaacataagtttgagcatccaagattctgttatgagcgccttgaatatgtcggccagaaaattcaggatttagtaatggcagagaggctactcatgaagcacctcgatgcaccgggcaggtggctggcagaaaagcatcggaggacgttaatgaacaagtattgcggacggtacctgcgggacaagcacctgcagcactatattatttacggggagacagtgcaagacagattcgaacacaatcgacgtctaaggaatccttcaacgacctctgtccagcaagcgctacatgggcttgcatactgtgtgtatggcaaacctgacgtgcggcgcttgatgttcgaggtgtttgactttgaacaggttcagcctaaagcagtatga

SEQ ID NO: 1434 - protein, 529 aa, Sorghum bicolor
  misc_feature: Ceres ANNOT ID no. 6015805
  misc_feature (185)..(275): Pfam Id: Ribonuclease_3 Pfam Desc: RNase3 domain
  misc_feature (50)..(527): NCBI GI: 92883698 NCBI Desc: ribonuclease iii [medicago truncatula]
  misc_feature (150)..(529): NCBI GI: 144923978 NCBI Desc: ribonuclease iii [medicago truncatula]
  misc_feature (160)..(285): NCBI GI: 29897493 NCBI Desc: ribonuclease iii [bacillus cereus atcc 14579]
  misc_feature (160)..(283): NCBI GI: 81347639 NCBI Desc: ribonuclease iii (rnase iii)
  misc_feature (160)..(283): NCBI GI: 56419727 NCBI Desc: dsrna-specific ribonuclease [geobacillus kaustophilus hta426]
MGPPAMAFQALTLTPVPFSLHSSSRRVRVRVLAVAADQTPPPPAVPPSEPANSPSRLLRELAQRKKAVSPKKKHPPRRFILKPPLDDERLTRRFLSSPQLSLKALPLLSSCLPSAPLSTADRTWMDEYLLEAKQALGYPLAPSETLGEGDDCPARHFDVLLYLAFQHLDPSSERTRTRHVRNGHSRLWFLGQYVLELAFCEFFLQRYPRESPGPMRERVFALIGKKVLPRWLKAASLHNLVFPYDDLDKMIRKDREPPSKAVFWALFGAIYLCFGMPEVYRVLFEAFGMDPDDESCQPKLRRQLEDVDYVSVEFEKRQLTWQDVAAYRPPPDALFAHPRLFRACVPPGMHRFRGNIWDFDSRPKVMNTLGYPLPMNDRIPEITEARNIELGLGLQLCFLHPSKHKFEHPRFCYERLEYVGQKIQDLVMAERLLMKHLDAPGRWLAEKHRRTLMNKYCGRYLRDKHLQHYIIYGETVQDRFEHNRRLRNPSTTSVQQALHGLAYCVYGKPDVRRLMFEVFDFEQVQPKAV

SEQ ID NO: 1435 - DNA, 1500 bp, Sorghum bicolor
  misc_feature: Ceres ANNOT ID no. 6015817
  misc_feature: Encodes the peptide sequence at SEQ ID NO 1436
atggcggggaagcagttcccctccccagcgcactcgcgccccgcctccgcctcctcccgccgactcctcgccgccgtcgccgcctccctcatactcttcaccgctttctacttcctcctcctctccccctcctcgcaccgacccaccccagccatcctcgcgagccctagcgccaccacgtccttcctcgcctccctcgaccgcttcctctccgacccgcatcccgctgcctccgccgccgctcccggcgaacttgacgccgcgatccgggtccaggaggaggcccgtctctacggggacgagtaccccgcatggcccgcgccggccgcggggccgctcagggtctacgtctacgagatgccgggcaagttcacttacgatctgctcaggctgttcagggactcctacagggacaccgacaacctcacgtccaatgggagccccgtgcaccgcctcatcgagcagcattctattgactactggctgtgggcggatctcattgcacctgaatcacaaagacttttgaagagtgttgttagggttcagcggcaagaagaagctgacattttctatgtgccattcttcacgacaatcagttacttcctgctggagaaacaagaatgcaaagcgctttatagggaagctttaaagtgggtgacagatcagcctgcttggcaacgttcagaaggcagagatcatgtcattcctgttcatcatccatggtcatttaagtcagtccggagatttgtgaagaaggcaatatggcttctacctgatatggactccactgggaactggtataaacctggacaggtatatctagaaaaggatgtcatccttccatacgttccaaacgttgatctttgtgatcataaatgtgtattagaaactcaattcaaaagaagtatattgctgttctttcgaggaagactgaagagaaatgctggaggaaagatccgcagtaaacttgtggaggaactaaaaagtgcagaagacatagttatagaagaaggttcggctggagctcagggaaaagcagcagctcaggatggcatgcgcaagtctctcttttgcttgagtccggctggggataccccatcttctgctcgcctgtttgatgcaatcgttagtggttgtattccagttataataagtgatgagctggagcttccatttgaaggaatacttgactatagggagatagcattgtttgtttcatcgagtgatgctgtgcaacctggctggctcgtgaagtacctaagaggaatcgatgccaaaagaataagagaaattcagtctaatcttgtgaagtattcaagacattttctgtattcaagtcctgctcagcctcttggaccagaagaccttacatggaggatgattgctggtaaggtggtaaatatcaagttgcagattcggcgttctcaacgtttggtcagagagtcaaggagcgtatgtacatgtgaatgcagagttgggaacaccacgaggatgctttga

SEQ ID NO: 1436 - protein, 499 aa, Sorghum bicolor
  misc_feature: Ceres ANNOT ID no. 6015817
  misc_feature (115)..(435): Pfam Id: Exostosin Pfam Desc: Exostosin family
  misc_feature (1)..(487): NCBI GI: 55297674 NCBI Desc: exostosin family protein-like [oryza sativa (japonica cultivar-group)]
  misc_feature (4)..(499): NCBI GI: 115472841 NCBI Desc: os07g0567000 [oryza sativa (japonica cultivar-group)]
  misc_feature (45)..(499): NCBI GI: 27817890 NCBI Desc: exostosin family protein-like protein [oryza sativa (japonica cultivar-group)]
  misc_feature (273)..(483): NCBI GI: 115483943 NCBI Desc: os11g0128000 [oryza sativa (japonica cultivar-group)]
  misc_feature (106)..(478): NCBI GI: 22330483 NCBI Desc: exostosin family protein [arabidopsis thaliana]
  misc_feature: Useful for making plants with altered cell wall content and/or composition
  misc_feature: GREAT-hit functional homolog of the protein sequence encoded by LOCUS at5g16890
  misc_feature: Useful for making plants with altered carbohydrate content
  misc_feature: Functional homolog of the protein sequence given in SEQ ID NO 13739
  misc_feature: Useful for making plants with altered cell wall content and/or composition
  misc_feature: Functional homolog of the protein sequence given in SEQ ID NO 13740
MAGKQFPSPAHSRPASASSRRLLAAVAASLILFTAFYFLLLSPSSHRPTPAILASPSATTSFLASLDRFLSDPHPAASAAAPGELDAAIRVQEEARLYGDEYPAWPAPAAGPLRVYVYEMPGKFTYDLLRLFRDSYRDTDNLTSNGSPVHRLIEQHSIDYWLWADLIAPESQRLLKSVVRVQRQEEADIFYVPFFTTISYFLLEKQECKALYREALKWVTDQPAWQRSEGRDHVIPVHHPWSFKSVRRFVKKAIWLLPDMDSTGNWYKPGQVYLEKDVILPYVPNVDLCDHKCVLETQFKRSILLFFRGRLKRNAGGKIRSKLVEELKSAEDIVIEEGSAGAQGKAAAQDGMRKSLFCLSPAGDTPSSARLFDAIVSGCIPVIISDELELPFEGILDYREIALFVSSSDAVQPGWLVKYLRGIDAKRIREIQSNLVKYSRHFLYSSPAQPLGPEDLTWRMIAGKVVNIKLQIRRSQRLVRESRSVCTCECRVGNTTRML

SEQ ID NO: 1437 - DNA, 930 bp, Sorghum bicolor
  misc_feature: Ceres ANNOT ID no. 6015824
  misc_feature: Encodes the peptide sequence at SEQ ID NO 1438
atggcgattgattccctcgaggagcagccgatgatgcacggcgggaacggccacggccacggccgtgtccacccggcgtcctccagctccgacttctccggcgagatgaaccagtccgtgtccgacccctcctccagcccgctctacagcttccacttcgagaagcccgtcccgcagcatcatccgccgccgggcgcgtacgtggtgcaggtgcccaaggacaaggtcttccgcgtcccgccgcccgagaacgcgcgcctcttcgaccactacacccgccgcgccaagcgccgccgcggccgctcctgcgcccgcgtctgcgcgtgcatgctggccggggccgtcgccctcgccgtcctcgccgcggccctcgccggcgtcgcgtacctcgtcctcaggccgaagcagccggcgtacacggtccaggcgctcgccgtgtccggcctcgccgggctcggcaacgcctcctcctcctcctcctcctcctccccggttgcgttctcgccggggttcgacgcgaccgtgcgcgccgacaaccccaacggcaggatcggcgtgcgctacgagggaggccggagccgcgtctccgtgtcgtacgacggcgtgcccctggccgacggcgacggcgcgtggccggcgttctaccaggggcctcggaacgtgacggtgttcgtggcgaaagcgaaggggtcagggatacggttctcgcagcgcgtgcgggggcagatggccgcggcggagcggctccggtcggtgccgttcgacgtggacgtcgaggtgcccgtgcgcctgcagctcggcaaggtcaggacgtgggccgtgccggtgcgggtgcactgcaccgtgacggtcgacaggctcgccgccgacgccaaggtggtgtccaggtcgtgcgacgtcaaggtgcacctcctgtcgtggaggaattga

SEQ ID NO: 1438 - protein, 309 aa, Sorghum bicolor
  misc_feature: Ceres ANNOT ID no. 6015824
  misc_feature (129)..(280): Pfam Id: Hin1 Pfam Desc: Harpin-induced protein 1 (Hin1)
  misc_feature (27)..(309): NCBI GI: 18844773 NCBI Desc: harpin-induced protein-related-like [oryza sativa (japonica cultivar-group)]
  misc_feature (43)..(304): NCBI GI: 140044063 NCBI Desc: harpin-induced 1 [medicago truncatula]
  misc_feature (43)..(267): NCBI GI: 115483979 NCBI Desc: os11g0130400 [oryza sativa (japonica cultivar-group)]
  misc_feature (169)..(304): NCBI GI: 56542461 NCBI Desc: avr9/cf-9 rapidly elicited protein 76 [nicotiana tabacum]
  misc_feature (96)..(302): NCBI GI: 90399035 NCBI Desc: h0402c08.7 [oryza sativa (indica cultivar-group)]
MAIDSLEEQPMMHGGNGHGHGRVHPASSSSDFSGEMNQSVSDPSSSPLYSFHFEKPVPQHHPPPGAYVVQVPKDKVFRVPPPENARLFDHYTRRAKRRRGRSCARVCACMLAGAVALAVLAAALAGVAYLVLRPKQPAYTVQALAVSGLAGLGNASSSSSSSSPVAFSPGFDATVRADNPNGRIGVRYEGGRSRVSVSYDGVPLADGDGAWPAFYQGPRNVTVFVAKAKGSGIRFSQRVRGQMAAAERLRSVPFDVDVEVPVRLQLGKVRTWAVPVRVHCTVTVDRLAADAKVVSRSCDVKVHLLSWRN

SEQ ID NO: 1439 - DNA, 1131 bp, Sorghum bicolor
  misc_feature: Ceres ANNOT ID no. 6015847
  misc_feature: Encodes the peptide sequence at SEQ ID NO 1440
atggcgatggctccgccgcccgcctgctcgctcttcctccgggtcgccgccgctgcgcccagttccgtcacctccagctccgttttgacccagcgcggcagcggtctcctcccttccccgcgtcccgcttccccccgccgccaccttaccgcggcatggtcatcgaaggccgcggcctccgcttcagtcgaaatacaggatgactacgcggatgagatggacgcggtgaacattgcgcaggacgttacccagttaattggaaaaacaccaatggtgtatctcaatagtgttgctgacggttgtgtcgctaatattgctgcaaagctcgagtacatgggaccttgccgaagtgtcaaagataggattggattaagcatgattaatgatgctgaagagaagggtttaatttctccagataagaccattttggtagaaccaacaactggaaatactggtgtagccattgctgctgtggctgcagcaagaggatacaagttgatagcaactatgccttcatcaatagatgtcgagagacgtgttcttctgcgtgcattcggagcagaggttgtgttaactgatcctaccaaaggactaaaaggagcttttgataaagctgaggaaatagttttgagaacaccaaatgcgtatatgtttcagcagttcaataatgaggccaatagcccagaaatatgggaagacacgttgggttctgttgatatacttgttgcaagcataggaacaggcggtaccattactggcactgggcgttacttgaaaaggatgaacaaagatattaaggttattggggtagaacctgctgaaactagtgtgatttctggtgataaccctggttacattccaagtatattagatgttcagttgattgatgaggttgtgaaggttagcacagcagaagctgttgattctgcaagggaacttgcactaaaagagggcttgctggttggtatctcctctggtgctgcagcaattgctgctattaatgttgccaaaagacctgaaaatgccggaaagctgattgcggtcattttccctagctttggagagaggtacatctccagcatcctattccgtccgatatatgactctgttcgaagaatgaggaagagatag

SEQ ID NO: 1440 - protein, 376 aa, Sorghum bicolor
  misc_feature: Ceres ANNOT ID no. 6015847
  misc_feature (82)..(352): Pfam Id: PALP Pfam Desc: Pyridoxal-phosphate dependent enzyme
  misc_feature (62)..(374): NCBI GI: 17944 NCBI Desc: o-acetylserine (thiol)-lyase [capsicum annuum]
  misc_feature (62)..(374): NCBI GI: 12081921 NCBI Desc: plastidic cysteine synthase 2 [solanum tuberosum]
  misc_feature (75)..(376): NCBI GI: 1084346 NCBI Desc: cysteine synthase (ec 4.2.99.8) isoform 5-8, cytosolic - arabidopsis thaliana
  misc_feature (75)..(363): NCBI GI: 11994278 NCBI Desc: cysteine synthase; o-acetylserine(thiol) lyase [arabidopsis thaliana]
  misc_feature (54)..(374): NCBI GI: 92876188 NCBI Desc: pyridoxal-5-phosphate-dependent enzyme, beta subunit [medicago truncatula]
  misc_feature (62)..(374): SWISSPROT Homolog: EC 2.5.1.47 Cysteine synthase, chloroplast/chromoplast precursor
MAMAPPPACSLFLRVAAAAPSSVTSSSVLTQRGSGLLPSPRPASPRRHLTAAWSSKAAASASVEIQDDYADEMDAVNIAQDVTQLIGKTPMVYLNSVADGCVANIAAKLEYMGPCRSVKDRIGLSMINDAEEKGLISPDKTILVEPTTGNTGVAIAAVAAARGYKLIATMPSSIDVERRVLLRAFGAEVVLTDPTKGLKGAFDKAEEIVLRTPNAYMFQQFNNEANSPEIWEDTLGSVDILVASIGTGGTITGTGRYLKRMNKDIKVIGVEPAETSVISGDNPGYIPSILDVQLIDEVVKVSTAEAVDSARELALKEGLLVGISSGAAAIAAINVAKRPENAGKLIAVIFPSFGERYISSILFRPIYDSVRRMRKR

SEQ ID NO: 1441 - DNA, 1299 bp, Sorghum bicolor
  misc_feature: Ceres ANNOT ID no. 6015884
  misc_feature: Encodes the peptide sequence at SEQ ID NO 1442
atggagaggtcgctgctggaggtgctggccacggctgcgcaaggagggaccgaggggacgtcggtgctgagcatgctcaagtatgccgtgcttcccatcgccaaggtgttcactgtctgcttcatggggttcctcatggcctccaagtacgtcaacattctccagcccaacggccgcaagcttctcaatgggcttgtgttttcccttctgcttccatgccttatattttcccaattgggtagagcaatcactatcgagaagatgatacaatggtggtatattccagtaaatattgttgtaggtgcagtatccggctctttgattggatttgttgtggcatctatcatccgacctccatatccatactttaagttcactattatccatataggaataggaaatattggaaatatacctctggtcctcattgcagcgttatgtcgggatccttctaacccatttggtgactctgataaatgcaatcaagatgggaatgcgtatatctcatttggccaatgggttggtgcaattattgtttacacatatgtattcaagatgcttgctccaccaccaggacagacctttgatggttctgaagaggatgaactcccaatcaaggcatctggagagaatacagtgccccaaataggaaattatcctatgaacactcacactagtactgtaccagagaatgaaccattgttatctgctggggatgttcaaaaggaacgtgccacttctgtaggaacaaagataatgggctttgttaaatgtgtggttaagttcctgaaagacaagcagcttctccagccaccgattattgcatctgcgtttgcaattgtaattggtgttatcccattcttgaagaattttgtccttacagatgatgcccctctgttctttttcacagacagctgcctcattcttggagaagctatgatcccatgcattttacttgctgttgggggcaatcttgtcgatggccctggtgaaggaagtaagaggcttggcgtccgtaccaccgttgctataatttttgcacggttggtcttggtccctcttgctggggttggcattatcatattagttgataaacttggtttcattcccaaagatgataaaatgttcaagtttgtcctgctactgcagcattctatgcccacatcagtgctgtcaggtgctgttgcaaatctgagagggtgtggaaaagaatcagctgcaattttgttctgggttcacatttttgctgtgttctccatggcaggatggattattttctatctgagcttgctcttctaa

SEQ ID NO: 1442 - protein, 432 aa, Sorghum bicolor
  misc_feature: Ceres ANNOT ID no. 6015884
  misc_feature (28)..(424): Pfam Id: Mem_trans Pfam Desc: Membrane transport protein
  misc_feature (1)..(432): NCBI GI: 56201894 NCBI Desc: auxin efflux carrier family protein-like [oryza sativa (japonica cultivar-group)]
  misc_feature (1)..(432): NCBI GI: 115440695 NCBI Desc: os01g0818000 [oryza sativa (japonica cultivar-group)]
  misc_feature (22)..(219): NCBI GI: 22329697 NCBI Desc: auxin efflux carrier family protein [arabidopsis thaliana]
  misc_feature (23)..(431): NCBI GI: 92867962 NCBI Desc: auxin efflux carrier [medicago truncatula]
  misc_feature (23)..(431): NCBI GI: 92867960 NCBI Desc: auxin efflux carrier [medicago truncatula]
MERSLLEVLATAAQGGTEGTSVLSMLKYAVLPIAKVFTVCFMGFLMASKYVNILQPNGRKLLNGLVFSLLLPCLIFSQLGRAITIEKMIQWWYIPVNIVVGAVSGSLIGFVVASIIRPPYPYFKFTIIHIGIGNIGNIPLVLIAALCRDPSNPFGDSDKCNQDGNAYISFGQWVGAIIVYTYVFKMLAPPPGQTFDGSEEDELPIKASGENTVPQIGNYPMNTHTSTVPENEPLLSAGDVQKERATSVGTKIMGFVKCVVKFLKDKQLLQPPIIASAFAIVIGVIPFLKNFVLTDDAPLFFFTDSCLILGEAMIPCILLAVGGNLVDGPGEGSKRLGVRTTVAIIFARLVLVPLAGVGIIILVDKLGFIPKDDKMFKFVLLLQHSMPTSVLSGAVANLRGCGKESAAILFWVHIFAVFSMAGWIIFYLSLLF

SEQ ID NO: 1443 - DNA, 855 bp, Sorghum bicolor
  misc_feature: Ceres ANNOT ID no. 6015892
  misc_feature: Encodes the peptide sequence at SEQ ID NO 1444
atggaggcgctgatggccacggacaaatgcttctccccggccagggcgatgtccccgatgccgattatgaggcccactcccactccatcaccagaacatgccagtcagtatctggaggacttgttgcaggagcaacagaagctcgggcccttcatgcaggtgctcccaatctgcggcaggctgttgaatcaagagataatgagaatatcaaacctgctttctaactctggagttagaggaaatgagaggttgccaccaattgcaagtccaaaccacatgcatccattgccccgtgtacctaatttctgtggaaacggtttcggtccgtggaatgggatgcatcctgagagaaatggttttcctaggggagccatgggctggcaaggtgccgtacagaaccattcctcctacattgtcaagaagatcgtgcgattggaagttccaacagaggcttaccccaattttaacttcattggccgtctgcttggtccgaggggacactcactaaagagagttgaagctactacaggctgccgtgttttcatcagagggaagggctccataaaagatcctgtgaaagaggaacagctcaagggaaggcctggctatgaacacttgggtgatccaacacatatcttaattgaggctgaattacctgctgatgttattgatgctagactgacacaagcacaggagatactagaggagttgctgaaaccagtggatgagtcacaagacaacatcaagagacaacaacttcgagaacttgccatgttgaactccgtataccgagaggatagcccgcatcagaacggcagtgcctctccgttcagcaatggtggcacaaaacagtga

SEQ ID NO: 1444 - protein, 284 aa, Sorghum bicolor
  misc_feature: Ceres ANNOT ID no. 6015892
  misc_feature (1)..(284): NCBI GI: 115464523 NCBI Desc: os05g0481500 [oryza sativa (japonica cultivar-group)]
  misc_feature (11)..(284): NCBI GI: 24060154 NCBI Desc: kh domain-like protein [oryza sativa (japonica cultivar-group)]
  misc_feature (35)..(241): NCBI GI: 92867398 NCBI Desc: facilitated glucose transporter; kh, type 1 [medicago truncatula]
  misc_feature (29)..(284): NCBI GI: 92893883 NCBI Desc: kh [medicago truncatula]
  misc_feature (5)..(276): NCBI GI: 19310523 NCBI Desc: at1g09660/f21m12_5 [arabidopsis thaliana]
MEALMATDKCFSPARAMSPMPIMRPTPTPSPEHASQYLEDLLQEQQKLGPFMQVLPICGRLLNQEIMRISNLLSNSGVRGNERLPPIASPNHMHPLPRVPNFCGNGFGPWNGMHPERNGFPRGAMGWQGAVQNHSSYIVKKIVRLEVPTEAYPNFNFIGRLLGPRGHSLKRVEATTGCRVFIRGKGSIKDPVKEEQLKGRPGYEHLGDPTHILIEAELPADVIDARLTQAQEILEELLKPVDESQDNIKRQQLRELAMLNSVYREDSPHQNGSASPFSNGGTKQ

SEQ ID NO: 1445 - DNA, 837 bp, Sorghum bicolor
  misc_feature: Ceres ANNOT ID no. 6015893
  misc_feature: Encodes the peptide sequence at SEQ ID NO 1446
atggagtggggggacagggccaaggcctccgccgccgccgccgcagcagcagcagcggcggcggcagcagacgagaggtccgcggtaggtgaaggactcgggggatacgtcaaggtcatgactgacgaacagatggaggtgctccgcaagcagatctccatctacgccaccatctgcgagcagcttgtcgacatgcaccgcaccctgaccgagcaccaggacaccattgcaggaatgaggtttagcaatctgtactgtgatcctctaattatcccaggaggtcacaagatcacagcaaggcaacgatggcaaccaacaccaatgcagctgcagatcttggagaacatctttgaccaaggcaatggaacaccaagcaagcagaagataaaagagataacagcagagctctcgcaccatggccaaatctcggagacaaatgtttacaactggtttcagaacagacgggcacggtcaaagcggaagcaggctgcttctttaccaaacaatgctgaatctgaagctgaggtggatgaggagtctctcaccgacaagaagccgaagtcagataggccgctccaggatcacaaggctatgggcgctcacagtgctgacaggatctcagggatgcatcacttcgacacagatcatgaccaaatcggtggcatgatgtatggatgcaatgacaatggcttgagatcgtctggcagttcaggccagatgtccttctacgagaacatcatgtcgaatccaagaatcgatcatttcccggggaaggtggagagctcccggagcttcccccatctccaacacggtgaaggctttgacatgtttggatga

SEQ ID NO: 1446 - protein, 278 aa, Sorghum bicolor
  misc_feature: Ceres ANNOT ID no. 6015893
  misc_feature (99)..(160): Pfam Id: Homeobox Pfam Desc: Homeobox domain
  misc_feature (36)..(223): NCBI GI: 40233087 NCBI Desc: homeodomain protein hb2 [populus tomentosa]
  misc_feature (36)..(216): NCBI GI: 3955021 NCBI Desc: hb2 homeodomain protein [populus tremula x populus tremuloides]
  misc_feature (30)..(278): NCBI GI: 23308275 NCBI Desc: at4g35550/f8d20_60 [arabidopsis thaliana]
  misc_feature (30)..(201): NCBI GI: 3955019 NCBI Desc: hb1 homeodomain protein [populus tremula x populus tremuloides]
  misc_feature (30)..(201): NCBI GI: 40233103 NCBI Desc: homeodomain protein hb1 [populus tomentosa]
  misc_feature: The sequence is a functional homolog of SEQ ID NO 46 in the 10/666,642US patent application
  misc_feature: The sequence is a functional homolog of SEQ ID NO 466 in the 10/666,642US patent application
  misc_feature: Useful for making plants with altered Lignin content
  misc_feature: Useful for making plants with modulated growth and phenotype characteristics
  misc_feature: Useful for making plants with modulated nitrogen use efficiency
  misc_feature: GREAT-hit functional homolog of the protein sequence given in SEQ ID NO 12912
  misc_feature: The sequence is a functional homolog of SEQ ID NO 46 in the 20070033671 US patent application
  misc_feature: The sequence is a functional homolog of SEQ ID NO 466 in the 20070033671 US patent application
  misc_feature: The sequence is a functional homolog of SEQ ID NO 466 in the 10/666,642 US patent application
  misc_feature: Useful for making plants with altered lignin content
  misc_feature: Useful for making plants with modulated nitrogen use efficiency
  misc_feature: Functional homolog of the protein sequence given in SEQ ID NO 12912
MEWGDRAKASAAAAAAAAAAAAADERSAVGEGLGGYVKVMTDEQMEVLRKQISIYATICEQLVDMHRTLTEHQDTIAGMRFSNLYCDPLIIPGGHKITARQRWQPTPMQLQILENIFDQGNGTPSKQKIKEITAELSHHGQISETNVYNWFQNRRARSKRKQAASLPNNAESEAEVDEESLTDKKPKSDRPLQDHKAMGAHSADRISGMHHFDTDHDQIGGMMYGCNDNGLRSSGSSGQMSFYENIMSNPRIDHFPGKVESSRSFPHLQHGEGFDMFG

SEQ ID NO: 1447 - DNA, 1923 bp, Sorghum bicolor
  misc_feature: Ceres ANNOT ID no. 6015901
  misc_feature: Encodes the peptide sequence at SEQ ID NO 1448
atggccactgaatcttccactgtcgccgtcgctggcgacgcaaattccactgaaccatggagcgcgcgggtgcgcaccctcacgcgcctcgggcggcacagggagtctcttgctctcctacgacacggcgacccctcgccgccgccccacgcgctggcgctcccggcctcggtcatctcctgcgccgcgctgtccctcccctccggcgttgcccagatacacgcgctcgctgccaagcgcggcctgctccccgccgccgacgcctacctgctctcagcgctgctgacttcctactcccgcctcggctgcctcccgctcgcccaccagctcctcgacgaaatgcctctcgagtccacaccccacaccacgctccgtaccgcgttcaactctgtcatctccggctgcgccctccacgcactcccggtggctagcttcgctctcttccgccgcatgcgcgccgcggcggtcggcttcgatgcggtcaccctcctcgcccttgtccctgccacgcctctgagcgtcgtgccgcaggtccacgccctcgctgcccgagtcgggctcgccaccgagacctccgtggctaactgcctcatgtccacatacgcgcgcggcggcgcgttcggcgcggccctcgcccggagggttttcgacgagatgccgctggcctcccgcgacctggtgtcgtggaacgctgtgctatcagcgcacgcgcagaacggcctggccgtggacgccctcgaactgtaccgccgcatgcgtagccccgaaggcagtggggtggagccggacgccgtgacgatcgtcggcgtgctctcctctgcagcgcacctgggcgcgcgtggtgtaggcttcgacgttgagcactatgtgcgccagaggatcccgggcttccacaccaacgtgcagctttgcaacgcgctaatcaacttccacgcgcgctgcggcagcctgccccgagcgcagcagctgttcgacgaaatgcccaggaaaagcatcgtgtcatggacggcgctcatcactgggcatggcatgcacggaaatggtgacgtcgccgtcagcctcttcgaaaggatggtgtccgaaggcatccgcccggacaacgtcgcaatggtcgccctcttctccgcgtgcagccacgccgggttgtatgacgaggggcgcaggtacttctcggcaatggagagcgtctacaagttgcggcccacgctggagcactacacctgcatggtggacctcctcggacgtgctggccgtctggaggaggctcgagagctcatctcgtcaatgcccatgccggccgacggtgccgtctggggtgcccttcttggtgcgtgcaagatacacaagaacgttgacgttggggaggaggccttcacgcgtgtcatcgagctggagccgaagaacgtgggatactacgtgctcatgtcaaacatatacactgacacggggcagctggactgcgttgcgagggtacgggcgatgatgagggagcgcgggctcaagaaggagcccggatgcagctacgtcgagcacaaggggagggtgcacctcttcatggccgacgaccactcgcacccacaagcgaggaggatctacgagctggtaatcaggctggagctgatggtgaaggagaagtcgggaatgagggagagcgaggtggcggccgccaagggacgcatggagaaggcggctgcacaaccgctggttgggattcacagcgagaagttggcggtggcgtttgggttgctgaacaccgaggccggcagtgagattgtggtgatcaagaacctcagggtgtgcggggactgccactcgttcttgaaggtggtttcggccactaccaaccgggcgttcctggtcagggacgcgagccgcttccatcgcttcgatggtggagtttgttcctgcaaagattactggtga

SEQ ID NO: 1448 - protein, 640 aa, Sorghum bicolor
  misc_feature: Ceres ANNOT ID no. 6015901
  misc_feature (333)..(367): Pfam Id: PPR Pfam Desc: PPR repeat
  misc_feature (1)..(640): NCBI GI: 21104789 NCBI Desc: pentatricopeptide (ppr) repeat-containing protein-like [oryza sativa (japonica cultivar-group)]
  misc_feature (3)..(640): NCBI GI: 76556518 NCBI Desc: pentatricopeptide repeat-containing protein [hordeum vulgare subsp. vulgare]
  misc_feature (13)..(640): NCBI GI: 87240699 NCBI Desc: tetratricopeptide-like helical [medicago truncatula]
  misc_feature (13)..(640): NCBI GI: 9279668 NCBI Desc: selenium-binding protein-like [arabidopsis thaliana]
  misc_feature (84)..(640): NCBI GI: 8778839 NCBI Desc: t6d22.15 [arabidopsis thaliana]
MATESSTVAVAGDANSTEPWSARVRTLTRLGRHRESLALLRHGDPSPPPHALALPASVISCAALSLPSGVAQIHALAAKRGLLPAADAYLLSALLTSYSRLGCLPLAHQLLDEMPLESTPHTTLRTAFNSVISGCALHALPVASFALFRRMRAAAVGFDAVTLLALVPATPLSVVPQVHALAARVGLATETSVANCLMSTYARGGAFGAALARRVFDEMPLASRDLVSWNAVLSAHAQNGLAVDALELYRRMRSPEGSGVEPDAVTIVGVLSSAAHLGARGVGFDVEHYVRQRIPGFHTNVQLCNALINFHARCGSLPRAQQLFDEMPRKSIVSWTALITGHGMHGNGDVAVSLFERMVSEGIRPDNVAMVALFSACSHAGLYDEGRRYFSAMESVYKLRPTLEHYTCMVDLLGRAGRLEEARELISSMPMPADGAVWGALLGACKIHKNVDVGEEAFTRVIELEPKNVGYYVLMSNIYTDTGQLDCVARVRAMMRERGLKKEPGCSYVEHKGRVHLFMADDHSHPQARRIYELVIRLELMVKEKSGMRESEVAAAKGRMEKAAAQPLVGIHSEKLAVAFGLLNTEAGSEIVVIKNLRVCGDCHSFLKVVSATTNRAFLVRDASRFHRFDGGVCSCKDYW

SEQ ID NO: 1449 - DNA, 795 bp, Sorghum bicolor
  misc_feature: Ceres ANNOT ID no. 6015905
  misc_feature: Encodes the peptide sequence at SEQ ID NO 1450
atgaagagggagcagtcctttgagtttggggatcccagtgcccaagatgctatgggatctgctgcctcggagtcgtcttacagccctcccggagctgtgtttgggctctccccaccggagtcggcctcgccgcgcagcggccggcataacagaaggagggatagaccttcatgggtcagactcacgtacacaccttattttgatggtcacttgtggcgaaaatatgggcaaaagaaaatcaaggatgctgagtaccctaggctatacttcagatgttcttaccgtgaggacaggcaatgcctggcctctaagctgctgcagcagaagaacggcgacgacccaccactgtacgaggtgacctacacgtacgagcacacgtgcggcgcaccgcccgtctcgttcccggatatcgtggccgagccgccgccggccgccagggaaggtctggtgctcaggttcgactcccccggcggccacggcggccacgcacggatgcagcagaacggacactgccagcagtccacgtctcggagtccgttcatgatgctcagctttggttccaggagccagacgcacgatcaacatcctgccgtcttccgctctgacttggaggccggatcatcgtcgtttcccaccgaggcgccgccggcgccgccaccaccggcaaacggcgacggtggggacatgctctcgacattgaactccttcgcatatgatttcgacaatcaaatgcacttcggcgatcacacgtatttacctcataataatagtaattacgattatgatgattactga

SEQ ID NO: 1450 - protein, 264 aa, Sorghum bicolor
  misc_feature: Ceres ANNOT ID no. 6015905
  misc_feature (66)..(129): Pfam Id: WRKY Pfam Desc: WRKY DNA -binding domain
  misc_feature (1)..(263): NCBI GI: 56201706 NCBI Desc: wrky transcription factor 18-like protein [oryza sativa (japonica cultivar-group)]
  misc_feature (22)..(201): NCBI GI: 46394290 NCBI Desc: tpa: wrky transcription factor 18 [oryza sativa (japonica cultivar-group)]
  misc_feature (28)..(213): NCBI GI: 115483857 NCBI Desc: os11g0116900 [oryza sativa (japonica cultivar-group)]
  misc_feature (21)..(145): NCBI GI: 19571054 NCBI Desc: wrky transcription factor 64-like protein [oryza sativa (japonica cultivar-group)]
  misc_feature (46)..(155): NCBI GI: 125491399 NCBI Desc: wrky transcription factor [triticum aestivum]
  misc_feature: The sequence is a functional homolog of SEQ ID NO 10 in the 10/412,699US patent application
  misc_feature: The sequence is a functional homolog of SEQ ID NO 100 in the 10/412,699US patent application
  misc_feature: The sequence is a functional homolog of SEQ ID NO 1197 in the 10/666,642US patent application
  misc_feature: The sequence is a functional homolog of SEQ ID NO 1198 in the 10/666,642US patent application
  misc_feature: The sequence is a functional homolog of SEQ ID NO 124 in the 11/479,226US patent application
  misc_feature: The sequence is a functional homolog of SEQ ID NO 243 in the 11/479,226US patent application
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 100 in the 20040045049 US patent application
  misc_feature: The sequence is a functional homolog of SEQ ID NO 1197 in the 20070033671 US patent application
MKREQSFEFGDPSAQDAMGSAASESSYSPPGAVFGLSPPESASPRSGRHNRRRDRPSWVRLTYTPYFDGHLWRKYGQKKIKDAEYPRLYFRCSYREDRQCLASKLLQQKNGDDPPLYEVTYTYEHTCGAPPVSFPDIVAEPPPAAREGLVLRFDSPGGHGGHARMQQNGHCQQSTSRSPFMMLSFGSRSQTHDQHPAVFRSDLEAGSSSFPTEAPPAPPPPANGDGGDMLSTLNSFAYDFDNQMHFGDHTYLPHNNSNYDYDDY

SEQ ID NO: 1451 - DNA, 987 bp, Sorghum bicolor
  misc_feature: Ceres ANNOT ID no. 6015910
  misc_feature: Encodes the peptide sequence at SEQ ID NO 1452
atggccgcctctctcctccacgccgccaccgcctcgctccagagccccacccagcccgcccgcgcgggcgcgggcgccgccgcctttcaccccctcgcgtccgccccgtccctacgcctcgcgcgctcctcgttctcgtccagtcgccgcctcgaggtctcgctcccggcggtctcgcccggtcaccgtttcgcggggaggggaggagcaccccgcgaccgccgcgtcgtcgccgccctagcgggggagcaaaccgagggttcagaggtgggcgatggcaaggataacagcaacggggagataaagcccgaggaggctcaggaagcatggaaggtaatgctggagcagttcaaggctgaggccctgcggatgcaagcactgtcaatgcaggcgtatgatgtctactccaagaggacgagggaggttttgctggaagcctctgagaagctgaagatacaggcagacaaagctcagaaggacctgagcgtgatcgctgccgaggttagtcaggaggggcaggaatatctgactatggcagctcggaactccccagactcgatcaaggatatcacaacgacgttcagggcccttggaaaattgaactggccatcagagtatgaggattatcatgtgggcattccgtatggtacctttcttaccgtagggggtttcttcaacttcatgttgactggaagttcctctgctctccgttttggtattgttcttggccttgcattgttggctctgggaatctcaagtttgagatcacaaagacaaggcggtcgtcggcctcgtcttctggtgaaagggcaagctgcaatagctagtgtcatcttcttcagggagttttcagtacttctccagaatggctggttcccaaaaatcttcatggttcttctcagtggagtggtagcaggcttttacttctatcgcattgcaactggtagccccaaagatctgaggagcaagagtgattcagcgaactaa

SEQ ID NO: 1452 - protein, 328 aa, Sorghum bicolor
  misc_feature: Ceres ANNOT ID no. 6015910
  misc_feature (30)..(318): NCBI GI: 1143711 NCBI Desc: non-green plastid inner envelope membrane protein precursor
  misc_feature (204)..(315): NCBI GI: 38344745 NCBI Desc: osjnba0089k21.3 [oryza sativa (japonica cultivar-group)]
  misc_feature (204)..(315): NCBI GI: 116310019 NCBI Desc: osigba0124n08.6 [oryza sativa (indica cultivar-group)]
MAASLLHAATASLQSPTQPARAGAGAAAFHPLASAPSLRLARSSFSSSRRLEVSLPAVSPGHRFAGRGGAPRDRRVVAALAGEQTEGSEVGDGKDNSNGEIKPEEAQEAWKVMLEQFKAEALRMQALSMQAYDVYSKRTREVLLEASEKLKIQADKAQKDLSVIAAEVSQEGQEYLTMAARNSPDSIKDITTTFRALGKLNWPSEYEDYHVGIPYGTFLTVGGFFNFMLTGSSSALRFGIVLGLALLALGISSLRSQRQGGRRPRLLVKGQAAIASVIFFREFSVLLQNGWFPKIFMVLLSGVVAGFYFYRIATGSPKDLRSKSDSAN

SEQ ID NO: 1453 - DNA, 453 bp, Sorghum bicolor
  misc_feature: Ceres ANNOT ID no. 6015927
  misc_feature: Encodes the peptide sequence at SEQ ID NO 1454
atggctggtgcgatatttctaggcgtcctcgcgggtctcgtggtgctcatctgcaccatcgtctgtgccgtgcgccattgccaggacggcgcgggaagcgcgaaggtcggcggcggcggcggcgtttcgtccccggcagggaagcaagaagcgctgctgaacaagaacaagaacaaggacgacgtcgacgtcgtggtcgccgtccctcatcagccgggtggcgccgccggcaagcggggcccggagccgagcgacggcgacgtggatctgtgcgcgatctgcaaggcgcggcttgcggacgcgagctggggccggtgccggcgcctgcggccgtgcgggcacgtataccacgcggactgcatcagcctgtggctccagcgcaagtggatctgccccgtgtgccgggctgccgtcgccatgtcgcggaccgagatcctcgacgcggtggtgtga

SEQ ID NO: 1454 - protein, 150 aa, Sorghum bicolor
  misc_feature: Ceres ANNOT ID no. 6015927
  misc_feature (91)..(134): Pfam Id: zf-C3HC4 Pfam Desc: Zinc finger, C3HC4 type (RING finger)
  misc_feature (90)..(137): Pfam Id: PHD Pfam Desc: PHD-finger
  misc_feature (4)..(138): NCBI GI: 20152976 NCBI Desc: similar to a. thaliana c3hc4-type ring zinc finger protein ab005237 [hordeum vulgare subsp. vulgare]
  misc_feature (13)..(140): NCBI GI: 32487554 NCBI Desc: osjnba0013k16.6 [oryza sativa (japonica cultivar-group)]
  misc_feature (36)..(135): NCBI GI: 55741101 NCBI Desc: ring-h2 zinc finger protein [zea mays]
  misc_feature (42)..(138): NCBI GI: 41056219 NCBI Desc: similar to ring finger protein 11 [danio rerio]
  misc_feature (10)..(138): NCBI GI: 115445307 NCBI Desc: os02g0248200 [oryza sativa (japonica cultivar-group)]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 468 in the 11/188,298 US application
MAGAIFLGVLAGLVVLICTIVCAVRHCQDGAGSAKVGGGGGVSSPAGKQEALLNKNKNKDDVDVVVAVPHQPGGAAGKRGPEPSDGDVDLCAICKARLADASWGRCRRLRPCGHVYHADCISLWLQRKWICPVCRAAVAMSRTEILDAVV

SEQ ID NO: 1455 - DNA, 2040 bp, Sorghum bicolor
  misc_feature: Ceres ANNOT ID no. 6015928
  misc_feature: Encodes the peptide sequence at SEQ ID NO 1456
atgcccaacccacgggcggtgttgacctccgcgccgtcaccgcccgccgcctgctcctcctcctggtcggcggcggcggagttcatggcgccggcaacgcctccgtcgccgtccgacggggagctgctgcgctcgctgcaccgcctggcgcgggacctgtccgcgacggccgcagagacgccggccccgttcctgcgcgccgcgctcgcgtccatcaccaggcggtccaggctcctggccgccgcgttcgacgacctcgtcctgtgcgccgcggcggccgaggagggcatgccccggtccgcgtcgctgtgcctccgcgaggtgctcctcgtgctgcagcggttcaaggcgttggccgccgactgcgccgcgcggagccggatgcggctgctgctgcagtcggacgagatcgaggaggaggtcagggagctgcaccaggaaatggccacgctgctcgacctcctgccgggcgtcgagctgggcctcgccgaggacgtcatggacctactcgacctcgcgtcgcgccagtgccggcggttcgcgccgtctgtgtcggtccaggccgagcaggctctcaaggccagagtgctctcgctgatacaggagattgagcgggagatcgtgccggagcgggagaggctgcgggagatcctggaggaggtgggcatcaacgactcggcgacctgcggcgaagagatcgagagcctcgagcgggagatcggtgaaaaccgcgcctcggagaggtggacggacgccatgatcgcgctcgtcggcctgctgcggtacgccaagtgcgtcctgttcagcgccacgccccggccttcttcggattccaagccggaccccgaggtcgacgaggaaggggagcctccggcgccgccgccggacttccgctgccccatcaccctcgatatcatgcgcgagcccgtcgtcgtcgccagcgggcagacgtacgaccgggagtccatcttccggtggttcgactccggcaagtcaacgtgccccaagacagggcaggtgcttaccgttctggagctcgtgcccaacaaggcgctcaagaacctcatcgccaagtggtgccgggagaacggcgtcgccatggagagcagcgaggcgagcaagagcgagcctgcgcaggcggtggccgcggacaaagccgcgctggaggcggcgcgcatgacggcgtcgttcctcgtgaagaagctcgccatctgttttctccctgagggggccaaacgcggggggcacgagatccggcggctgtccagaccggcgccgacagccgcgcgttcgtcgctgaacgccgtcacggcgctgctcaacctctccatcctcgaggccaacaagaagcgcatcatgcacgccgagggcgccgtggaggcggtcgcccacatcctgagctccggcgcgacgtggcgcgccaaggagaatgcggcggccgccgtgctcagcctggcgtccgtccacacctaccggcgccgcctcggccggaacctgtccatcgtggagaagctcgtgcacctggtccgcaccggcccgacgagcaccaagaaagacgcgctggccgcgctgctgtcgctggcgggcgagagggagaacgtgggaaagctcgtggacgccggcgtcgcgcaggcggcgctgtccgcgatcagcgaggaggagaccgcggccgcggtgctggccgcgctggcgaagcgcggcggcgcggaggcgatcgtgggcatcgacggcgccgtggcgcgtcttgtggccgagatgcggcgcggcacggagtggggccgggagaacgcgacggcggcgctggtgctcctgtgccggcggctgggcgcgcgcgcggtgacgcaggtgatggccgtgcccggcgtggagtgggccatctgggagctgatgggcaccggcacggaccgcgcacgccgcaaggccgcgtcgctcggcaggatatgccgccggtgggccgccgcctcggccgccgacggcgagcggggcagcgtgtgcccggccgccagcaccgtcgtgcctccggccatgatggcgtcgtaa

SEQ ID NO: 1456 - protein, 679 aa, Sorghum bicolor
  misc_feature: Ceres ANNOT ID no. 6015928
  misc_feature (294)..(366): Pfam Id: U-box Pfam Desc: U-box domain
  misc_feature (10)..(608): NCBI GI: 29367591 NCBI Desc: arm repeat protein [oryza sativa (japonica cultivar-group)]
  misc_feature (152)..(465): NCBI GI: 115445199 NCBI Desc: os02g0234300 [oryza sativa (japonica cultivar-group)]
  misc_feature (33)..(559): NCBI GI: 2558938 NCBI Desc: arm repeat containing protein [brassica napus]
  misc_feature (28)..(606): NCBI GI: 118490015 NCBI Desc: acre 276-like protein [solanum tuberosum]
  misc_feature (71)..(650): NCBI GI: 124360489 NCBI Desc: u box [medicago truncatula]
  misc_feature: The sequence is a functional homolog of SEQ ID NO. 309 in the 11/188,298 US application
  misc_feature: The sequence is a functional homolog of SEQ ID NO. 528 in the 11/188,298 US application
  misc_feature: The sequence is a functional homolog of SEQ ID NO. 308 in the 11/188,298 US application
MPNPRAVLTSAPSPPAACSSSWSAAAEFMAPATPPSPSDGELLRSLHRLARDLSATAAETPAPFLRAALASITRRSRLLAAAFDDLVLCAAAAEEGMPRSASLCLREVLLVLQRFKALAADCAARSRMRLLLQSDEIEEEVRELHQEMATLLDLLPGVELGLAEDVMDLLDLASRQCRRFAPSVSVQAEQALKARVLSLIQEIEREIVPERERLREILEEVGINDSATCGEEIESLEREIGENRASERWTDAMIALVGLLRYAKCVLFSATPRPSSDSKPDPEVDEEGEPPAPPPDFRCPITLDIMREPVVVASGQTYDRESIFRWFDSGKSTCPKTGQVLTVLELVPNKALKNLIAKWCRENGVAMESSEASKSEPAQAVAADKAALEAARMTASFLVKKLAICFLPEGAKRGGHEIRRLSRPAPTAARSSLNAVTALLNLSILEANKKRIMHAEGAVEAVAHILSSGATWRAKENAAAAVLSLASVHTYRRRLGRNLSIVEKLVHLVRTGPTSTKKDALAALLSLAGERENVGKLVDAGVAQAALSAISEEETAAAVLAALAKRGGAEAIVGIDGAVARLVAEMRRGTEWGRENATAALVLLCRRLGARAVTQVMAVPGVEWAIWELMGTGTDRARRKAASLGRICRRWAAASAADGERGSVCPAASTVVPPAMMAS

SEQ ID NO: 1457 - DNA, 783 bp, Sorghum bicolor
  misc_feature: Ceres ANNOT ID no. 6015939
  misc_feature: Encodes the peptide sequence at SEQ ID NO 1458
atgcaacaaaccctaagtgacagctctgcccgttggacttccaccagcagggagagagtcgatgagatcgggaagaagatcaagcgagagccggatacagccgccctcgccgtcgctgtcgcctccgcctccactgtaccggccgacaaccacatcccacaccgcctcggcctcggcctcggcggtgtcctcaacaccttgacaccgtgcgccgcgtgcaagctcctccgccgccgctgcgcgcaggagtgccccttcgccccctacttctcgccgcacgaaccccacaagttcgccgccgtccacaaggtcttcggcgccagcaacgtctccaagttgctcttggaggtggcggaaggggagagggcggacgcagcgagcagcctggtgtacgaggcgaacctccggctgcgggatccggtgtacggctgcatgggcgccatctccatgctgcagcaacaggtgaacgcgttggaggccgagctggaggcggtgagggccgagatcctcaagcacaggtaccggcaggccggcggcggcaaccgtctcattgacgacgacgcgcatgctacggccagctttgtggctcctgcgtcggctccggtgcacgttaatgacgtggtatcggtggtggaggcaggccaggaggttgcagccaccggcggcggcgcgtcggggatgtcgacgtcgtcggcggtgtacgttgcggaagccgagcagccggcgagtactaatcactatagctcccgtaacccaagtgagcatcctgcatactttggttga

SEQ ID NO: 1458 - protein, 260 aa, Sorghum bicolor
  misc_feature: Ceres ANNOT ID no. 6015939
  misc_feature (14)..(260): NCBI GI: 60476773 NCBI Desc: lob1 [triticum aestivum]
  misc_feature (14)..(177): NCBI GI: 21618113 NCBI Desc: lob domain 13 [arabidopsis thaliana]
  misc_feature (68)..(206): NCBI GI: 51972120 NCBI Desc: at1g31320 [arabidopsis thaliana]
  misc_feature (38)..(226): NCBI GI: 60476771 NCBI Desc: as2 [triticum aestivum]
  misc_feature (54)..(180): NCBI GI: 29427827 NCBI Desc: lob domain protein 25
  misc_feature: Useful for making plants with modulated biomass
  misc_feature: Functional homolog of the protein sequence given in SEQ ID NO 12922
MQQTLSDSSARWTSTSRERVDEIGKKIKREPDTAALAVAVASASTVPADNHIPHRLGLGLGGVLNTLTPCAACKLLRRRCAQECPFAPYFSPHEPHKFAAVHKVFGASNVSKLLLEVAEGERADAASSLVYEANLRLRDPVYGCMGAISMLQQQVNALEAELEAVRAEILKHRYRQAGGGNRLIDDDAHATASFVAPASAPVHVNDVVSVVEAGQEVAATGGGASGMSTSSAVYVAEAEQPASTNHYSSRNPSEHPAYFG

SEQ ID NO: 1459 - DNA, 1872 bp, Sorghum bicolor
  misc_feature: Ceres ANNOT ID no. 6015946
  misc_feature: Encodes the peptide sequence at SEQ ID NO 1460
atgtacccgtcgggggccatggtgggggcggcgcccgcgacgcggccgagcgcgtcgtcgcgggtggagaaggccacgagccacctgctgatggggcccgactgggccgtcaacctcgaaatctgcgacatcctcaacgccgacgtctggcaaacaaaggatgtggtgaaggcagtgaaaaagagattgcagaacaaggacccaaaggttcagttttttgctttgacgcttttggagacaatgatgaagaactgtggtgaatatgttcagtttgaagttgctgaacagcatgttctgcaagaaatggttaaaattatccagaagaaggtaagggataaaatattattacttttagactcttggcaagaggcatttggtggtcctggaagtaaatacccacaatatcattgggcatatcttgaagtaaaggcgacaggtgtggtgttcccaaaacgtcctatagatgccccgccaatatttactcctccagctacacataattctcagacctatggttcacccagatatgctgcaggaagtctaagtgacagaatgtcctcggatgttgagaatctgagcttaggagattttaataagattcgaaatgtgacagacctactgaaggatatggtgtatgctttaaacccatctgatcgaacggctattaacgatgaaattatcacagatcttgtgaccgagtgtcgctcaaatcaacaaaagcttctgcagtttgtcagttcatcagggaatgaacagttactaaagcaaggactggagataaatgatctcttacaaagtgtactggcaaagtatgatgctgtggcctctggtgctcctttggcagttgaagcacctgtgcgagaggcaatcgaggctcctatggaggctcctgcagtaaagccatctgcacccccagaacataatgataatgttaacgaagaggaagatgagtttgcccagctagctcaaaggaaaaacaaatccgtagtaagtagtgacgatgcatcgtccagcactggggcggaccttgcccttgtacccattgatcaagcagtttcagaatcgtcatcttctgttgcaagcaatgcactggttcttcttgatcctgctcccagtactagcactgaaccaaaagagctggacatgatcgaccttctaagcctcaccttgtgcagccctactcctgaaacttcaacagattcttcagcacaggatcaaaatggaccccagcaacctgcagttacacataatcaaaatgggccccatgaacctacagttacaaatgggcaacgatatccttctagtgtgccacagtatccttcaaactaccagcctcacgctgcaagccagggttatgctccacagaacagcaactacgttgcaccttgggcccagactggagcatatccacctcagcctccagcatatgcatctggctatggctaccctgcaccaccatgggtggcacctacacaacctgttgattctaaccctttcctttcggttaattaccaagatcctcgccctgctgccactcctgttgctcaaccagccacatatgcacctcccccagcttcataccccccttcttcaatatcttatacaccatttgcagccccccagttaatccagcataacagtcctgtgggttcaccaagcaatgggcagactgcaaatcaagcacaactgagtgtgaatcatcaacaaccaaaagattcttcggcagcatctaccagaccatactacatacctgataatctattcagcgatttgatcgatgtgaaaagttttggtggtggaaataagatgggcggacccactacaatgggtagctcaaatggtggtcagcctatgattggtggaaagaaatag

SEQ ID NO: 1460 - protein, 623 aa, Sorghum bicolor
  misc_feature: Ceres ANNOT ID no. 6015946
  misc_feature (15)..(146): Pfam Id: VHS Pfam Desc: VHS domain
  misc_feature (187)..(284): Pfam Id: GAT Pfam Desc: GAT domain
  misc_feature (11)..(545): NCBI GI: 92887452 NCBI Desc: epsin, n-terminal; gat; enth/vhs [medicago truncatula]
  misc_feature (4)..(487): NCBI GI: 42567576 NCBI Desc: vhs domain-containing protein / gat domain-containing protein [arabidopsis thaliana]
  misc_feature (19)..(569): NCBI GI: 82791812 NCBI Desc: vhs and gat domain protein [glycine max]
  misc_feature (321)..(560): NCBI GI: 46367662 NCBI Desc: vhs2 protein [oryza sativa (japonica cultivar-group)]
  misc_feature (18)..(392): NCBI GI: 140065047 NCBI Desc: gat; enth/vhs [medicago truncatula]
MYPSGAMVGAAPATRPSASSRVEKATSHLLMGPDWAVNLEICDILNADVWQTKDVVKAVKKRLQNKDPKVQFFALTLLETMMKNCGEYVQFEVAEQHVLQEMVKIIQKKVRDKILLLLDSWQEAFGGPGSKYPQYHWAYLEVKATGVVFPKRPIDAPPIFTPPATHNSQTYGSPRYAAGSLSDRMSSDVENLSLGDFNKIRNVTDLLKDMVYALNPSDRTAINDEIITDLVTECRSNQQKLLQFVSSSGNEQLLKQGLEINDLLQSVLAKYDAVASGAPLAVEAPVREAIEAPMEAPAVKPSAPPEHNDNVNEEEDEFAQLAQRKNKSVVSSDDASSSTGADLALVPIDQAVSESSSSVASNALVLLDPAPSTSTEPKELDMIDLLSLTLCSPTPETSTDSSAQDQNGPQQPAVTHNQNGPHEPTVTNGQRYPSSVPQYPSNYQPHAASQGYAPQNSNYVAPWAQTGAYPPQPPAYASGYGYPAPPWVAPTQPVDSNPFLSVNYQDPRPAATPVAQPATYAPPPASYPPSSISYTPFAAPQLIQHNSPVGSPSNGQTANQAQLSVNHQQPKDSSAASTRPYYIPDNLFSDLIDVKSFGGGNKMGGPTTMGSSNGGQPMIGGKK

SEQ ID NO: 1461 - DNA, 1050 bp, Sorghum bicolor
  misc_feature: Ceres ANNOT ID no. 6015964
  misc_feature: Encodes the peptide sequence at SEQ ID NO 1462
atggcacaggcacaccctgttctactcctcctgctcttcctctcctccactgccgtttcttcctccaagagaattcagccgaagttctcggctatcttctacttcggcgactcggttcttgacaccggcaacaacaatcatctccccacggtggctgtagcgaaccatgttccttacggaagagatttcccagggaagaaaccgacggggaggttttccaatggccggcttatcccagacctgctcaacgagaagctgcaactcaaagagttctcgccgccatttctggacacaaggctgtcgagcaacgacatggtgacaggggtgaactttgcatcagctggttcaggattagatgaccagacgtcgcagctgtccaatactctaccaatgtccaaacaggtgggcctcttcaaggactacctcctcaggctcagggacattgttggggataaggaggcttccaggatcattgccagctctctgatctttatcagctcaggaaccaacgatttctcacattactaccgttcgtcgaagaagaggaagatggacatcggtgactaccaagatattgttctccagatggtacaagttcatgtcaaggaattatatgaccttggggggcgacaattctgtttggcaggccttccaccgtttggttgcacacctatccaaatcacattgagcagagaccctgacagggcatgtgtggatgagcaaaactgggatgctcaggtctataactctaaatttcagaagttacttacaacgttgcaaggctcactccatggaagcagaattgtgtacttggatgcatacagagctctcatggagatcctggagtacccggcaaaacacggatttacagagacaacacgaggatgttgcgggactgggctcagagaggttgctctgttttgcaatgcattgactcctatctgcaaaaatgtgtcatcctatgtattttacgatgctgtgcacccaacagagagggtttacatgttagtaaatgattacatagtcaaatacgttattccacagttttaa

SEQ ID NO: 1462 - protein, 349 aa, Sorghum bicolor
  misc_feature: Ceres ANNOT ID no. 6015964
  misc_feature (32)..(341): Pfam Id: Lipase_GDSL Pfam Desc: GDSL-like Lipase/Acylhydrolase
  misc_feature (14)..(341): NCBI GI: 6573287 NCBI Desc: rxf26 [arabidopsis thaliana]
  misc_feature (8)..(341): NCBI GI: 145360286 NCBI Desc: carboxylic ester hydrolase [arabidopsis thaliana]
  misc_feature (29)..(345): NCBI GI: 18390708 NCBI Desc: gdsl-motif lipase/hydrolase family protein [arabidopsis thaliana]
  misc_feature (29)..(345): NCBI GI: 8954046 NCBI Desc: contains similarity to proline-rich protein apg homolog t27e13.4 gi7488229 from arabidopsis thaliana bac t27e13 gbac002338. it contains a lipase/acylhydrolase with gdsl-like
  misc_feature (29)..(345): NCBI GI: 8954046 (continued) motif pf00657
  misc_feature (29)..(345): NCBI GI: 21554186 NCBI Desc: contains similarity to proline-rich protein apg [arabidopsis thaliana]
MAQAHPVLLLLLFLSSTAVSSSKRIQPKFSAIFYFGDSVLDTGNNNHLPTVAVANHVPYGRDFPGKKPTGRFSNGRLIPDLLNEKLQLKEFSPPFLDTRLSSNDMVTGVNFASAGSGLDDQTSQLSNTLPMSKQVGLFKDYLLRLRDIVGDKEASRIIASSLIFISSGTNDFSHYYRSSKKRKMDIGDYQDIVLQMVQVHVKELYDLGGRQFCLAGLPPFGCTPIQITLSRDPDRACVDEQNWDAQVYNSKFQKLLTTLQGSLHGSRIVYLDAYRALMEILEYPAKHGFTETTRGCCGTGLREVALFCNALTPICKNVSSYVFYDAVHPTERVYMLVNDYIVKYVIPQF

SEQ ID NO: 1463 - DNA, 987 bp, Sorghum bicolor
  misc_feature: Ceres ANNOT ID no. 6015970
  misc_feature: Encodes the peptide sequence at SEQ ID NO 1464
atggcatctcacggagacggcggcggcggcagcagcctcgtctgcgtgacgggcggcagcggcttcatcggctcctggctcgtccgcctccttctcggtcgcggctacaccgtccacgccaccgtcaagaacctccaggacgagagcgagacgaagcacctgcaggcaatggacggagcgaactcgcggctccggctgttccagatggacctcctcgaacccgcctccatccggccggcggtcgagggcgcccgcggcgtcttccacgttgcttctccggtcatcctgcaccgtgcacaggacccagagaatgagttggtggagcctgcgttgaagggcacgctgagcgtcctccgcgccgcgaaagactgtggagtcggccgtgttgtcatggtgtcatcgcagacggccatggtgccaaatccagcgtggcctgctgacaaggtcgtggatgaggactcctgggccgacattgagcagctcaagaaacttcagctttggtacaacgtctccaaaacactggcagagaaggccgcatgggacttcgccgaaaaggaaggtttggagctcgttgtgctcaatccagctctggtgttgggccctactttgacgcccaatatcatggccagtctccaaatgtttcttcagatcatgggagggaagaagtatgacatggacgagttcttcattggctgtgttgatgtccgagacgtcgcacagtctctgatagtgctgtatgagaacacatctgccgagggacgccacttatgcctggagtcctctgaacggatggtcgatttcaccaatagacttgctcatctctaccctgaattttcagtttacagaatccaagaggacaaacaagactgggtggtgagggccaaggacccctccaagaaactgatcaatttgggtgtccgtttcactccattggacaaaactatcgcggacactatggactgctttaggagcaaaggactcatctag

SEQ ID NO: 1464 - protein, 328 aa, Sorghum bicolor
  misc_feature: Ceres ANNOT ID no. 6015970
  misc_feature (14)..(259): Pfam Id: Epimerase Pfam Desc: NAD dependent epimerase/dehydratase family
  misc_feature (16)..(242): Pfam Id: NAD_binding_4 Pfam Desc: Male sterility protein
  misc_feature (15)..(246): Pfam Id: 3Beta_HSD Pfam Desc: 3-beta hydroxysteroid dehydrogenase/isomerase family
  misc_feature (56)..(328): NCBI GI: 115440809 NCBI Desc: os01g0828100 [oryza sativa (japonica cultivar-group)]
  misc_feature (11)..(328): NCBI GI: 68159360 NCBI Desc: cinnamoyl-coa reductase [acacia mangium x acacia auriculiformis]
  misc_feature (13)..(328): NCBI GI: 92897570 NCBI Desc: lipocalin [medicago truncatula]
  misc_feature (9)..(328): NCBI GI: 15217528 NCBI Desc: cinnamyl-alcohol dehydrogenase family / cad family [arabidopsis thaliana]
  misc_feature (9)..(328): NCBI GI: 3482923 NCBI Desc: highly similar to cinnamyl alcohol dehydrogenase, gi1143445 [arabidopsis thaliana]
  misc_feature: Useful for making plants with altered cell wall content and/or composition
  misc_feature: Functional homolog of the protein sequence encoded by LOCUS at5g58490
  misc_feature: Useful for making plants with altered carbohydrate content
  misc_feature: Functional homolog of the protein sequence given in SEQ ID NO 13679
  misc_feature: The sequence is a functional homolog of SEQ ID NO. 453 in the 11/188,298 US application
MASHGDGGGGSSLVCVTGGSGFIGSWLVRLLLGRGYTVHATVKNLQDESETKHLQAMDGANSRLRLFQMDLLEPASIRPAVEGARGVFHVASPVILHRAQDPENELVEPALKGTLSVLRAAKDCGVGRVVMVSSQTAMVPNPAWPADKVVDEDSWADIEQLKKLQLWYNVSKTLAEKAAWDFAEKEGLELVVLNPALVLGPTLTPNIMASLQMFLQIMGGKKYDMDEFFIGCVDVRDVAQSLIVLYENTSAEGRHLCLESSERMVDFTNRLAHLYPEFSVYRIQEDKQDWVVRAKDPSKKLINLGVRFTPLDKTIADTMDCFRSKGLI

SEQ ID NO: 1465 - DNA, 798 bp, Sorghum bicolor
  misc_feature: Ceres ANNOT ID no. 6015979
  misc_feature: Encodes the peptide sequence at SEQ ID NO 1466
atgtggttgccctgggtgaagacgcgcccttcatccgcctccccctcctccgccacctccacctcttcctcctccaccgcgctcatcgccgccgcctcaccgcgcctgtctctctcctcgccctcactcaaggacctccaggcgctgctcctgtccgacgccgcaccgccctccccgccgcccgccgcgccctgctccccgtcctcctccgtccgcgtcttccaccgggtccgcgtcgccgcctcggccctccgcgcgctccgcaccctccaggcgccgccgtccgccgccgacggcggcggcggcggcggcgcctccgaggccgaccgccgcgtagtgctctacttcacctcgctccacgtggtccgcagcacgtacgaggactgccgcgccgtgcgcgccatcctgcgcgggctccgcgtcgccgtcgacgagcgcgacctcgccatggacccgcgctacctccaggagctggcggcgctgctcccgcgcctcgcgtccccgcggcgcgtcacgctgccccaggtcttcgtcgggggccgccacctcggcggcgccgacgaggtccggcgcctccacgaggccggcgagctccgccgcgtcgtggccggcgccgtcgccgcctcctccctcgccgtctgcggccggtgcggcggcgagcggtacgtgctctgcggcagctgcaatggcagccacaagcggtacagcgtcaagggcggcggcggcttccgcacctgcgccggctgtaacgagaacggcctcgtccgatgccccgactgctcgccgccggacgtctga

SEQ ID NO: 1466 - protein, 265 aa, Sorghum bicolor
  misc_feature: Ceres ANNOT ID no. 6015979
  misc_feature (113)..(183): Pfam Id: Glutaredoxin Pfam Desc: Glutaredoxin
  misc_feature (1)..(265): NCBI GI: 15624060 NCBI Desc: glutaredoxin-like [oryza sativa (japonica cultivar-group)]
  misc_feature (1)..(260): NCBI GI: 115463369 NCBI Desc: os05g0353600 [oryza sativa (japonica cultivar-group)]
  misc_feature (141)..(238): NCBI GI: 115481596 NCBI Desc: os10g0343900 [oryza sativa (japonica cultivar-group)]
  misc_feature (109)..(260): NCBI GI: 124359980 NCBI Desc: thioredoxin fold [medicago truncatula]
  misc_feature (109)..(261): NCBI GI: 53370707 NCBI Desc: glutaredoxin domain containing protein [oryza sativa (japonica cultivar-group)]
MWLPWVKTRPSSASPSSATSTSSSSTALIAAASPRLSLSSPSLKDLQALLLSDAAPPSPPPAAPCSPSSSVRVFHRVRVAASALRALRTLQAPPSAADGGGGGGASEADRRVVLYFTSLHVVRSTYEDCRAVRAILRGLRVAVDERDLAMDPRYLQELAALLPRLASPRRVTLPQVFVGGRHLGGADEVRRLHEAGELRRVVAGAVAASSLAVCGRCGGERYVLCGSCNGSHKRYSVKGGGGFRTCAGCNENGLVRCPDCSPPDV

SEQ ID NO: 1467 - DNA, 1608 bp, Sorghum bicolor
  misc_feature: Ceres ANNOT ID no. 6015983
  misc_feature: Encodes the peptide sequence at SEQ ID NO 1468
atggtgatcgcggcggattctgccgccgatcaggacccaaaccctgtacccgacgaggccgcgggcgaatccgtcgaggcacccgcgtaccctgaccacggggaacccaatgcggatgctgctgacgtggagtatgaggatgaagaggaggagctggacggggaggcggcggaagcagcggcgagagagaaggtggaggcggtgttccggcggctgtcggaagcccccgttggcatccgcgtccatgaagttatcatcaagggcaacaccaagacccgcgacgcgctcatcgaggcggaggtcgtggggctcatccgctccgccgccaccgtgcaggacctggtgcgcaccgccagcatcgccaacgcgcggctcaggcgcctcgacgtgttcgactccgtccacgtcctcctggatgctggccctcccgagctgcccggcaccactaacgtcgtaattgaagtcgtcgaggccgctaaccccatccatggaagcgtcggctgcttctccaagcctgaggcaaggtcatggacagttgaaggatcagtcagatggaagaacatatttggttatggtgacatctgggatgcttccggagcatatgggtgggaccagtcatcagagataggcattggagtatccttgccaagatttagatcgataacaacccccttgactgctcgggcatcactgttgtctcatgactggctgaaattctcatcatacaaggaacgtttgcttggcctttcctttggtttgttttcagacgtgcaccatgatttatcttacagtctgacttggcgtaccttgactgatccttcacaagaggcatcaaaatcaataagaagacaattaggacataaccttctttctgcattaagatatacatatacaatagatcaaagggattcccatctcaggccaaccaaaggatatgcatttgtctcaacttcacaagttggtggtctatggggcagcaaaggattgagattcttccgccaggagttcgatattcgtggggctgttccattgggcttttacaatgctgccctaaatgctggcatctcagcaggggtgcttttaccattggggagggggtttatggaatcaccttcatctgtacctgatagatttttcatgggagggcattcttctccagtaatcagtcttggtagtttaacttctctactgggtttcaaaacaagaggagttgggccaacagagctacggagatttgtcccaagtgaatctgttacagatgaatctgcagcctctccaggatgggattatttgggaggtgattttgcagtctctgcatttgctgatctatcctttaatttgcccttaaagttattccaggatgctggcatacatggccatgcattcctaactgctggaaatcttgccaagttgtccgagggtgagttcaggaatttctcattttccaagtttgggcgcacatttaggagctcagctggtgttggcattatcttacccactaagcttctccgtgtggagataaactactgttatatactgaaacagtttgagcacgatcgtggaaagaccgggattcagttcagtttctcgtctccaactccaatgtag

SEQ ID NO: 1468 - protein, 535 aa, Sorghum bicolor
  misc_feature: Ceres ANNOT ID no. 6015983
  misc_feature (187)..(533): Pfam Id: Bac_surface_Ag Pfam Desc: Surface antigen
  misc_feature (11)..(532): NCBI GI: 115483753 NCBI Desc: os11g0106200 [oryza sativa (japonica cultivar-group)]
  misc_feature (175)..(532): NCBI GI: 144923817 NCBI Desc: bacterial surface antigen (d15) [medicago truncatula]
  misc_feature (81)..(406): NCBI GI: 38511778 NCBI Desc: cgi-51 protein [xenopus tropicalis]
  misc_feature (81)..(406): NCBI GI: 38014784 NCBI Desc: mgc68698 protein [xenopus laevis]
  misc_feature (54)..(406): NCBI GI: 62896873 NCBI Desc: cgi-51 protein variant [homo sapiens]
MVIAADSAADQDPNPVPDEAAGESVEAPAYPDHGEPNADAADVEYEDEEEELDGEAAEAAAREKVEAVFRRLSEAPVGIRVHEVIIKGNTKTRDALIEAEVVGLIRSAATVQDLVRTASIANARLRRLDVFDSVHVLLDAGPPELPGTTNVVIEVVEAANPIHGSVGCFSKPEARSWTVEGSVRWKNIFGYGDIWDASGAYGWDQSSEIGIGVSLPRFRSITTPLTARASLLSHDWLKFSSYKERLLGLSFGLFSDVHHDLSYSLTWRTLTDPSQEASKSIRRQLGHNLLSALRYTYTIDQRDSHLRPTKGYAFVSTSQVGGLWGSKGLRFFRQEFDIRGAVPLGFYNAALNAGISAGVLLPLGRGFMESPSSVPDRFFMGGHSSPVISLGSLTSLLGFKTRGVGPTELRRFVPSESVTDESAASPGWDYLGGDFAVSAFADLSFNLPLKLFQDAGIHGHAFLTAGNLAKLSEGEFRNFSFSKFGRTFRSSAGVGIILPTKLLRVEINYCYILKQFEHDRGKTGIQFSFSSPTPM

SEQ ID NO: 1469 - DNA, 1512 bp, Sorghum bicolor
  misc_feature: Ceres ANNOT ID no. 6015986
  misc_feature: Encodes the peptide sequence at SEQ ID NO 1470
atggccgcctcctctctgctccgctcgctcacccgccgcggctgcgcgggcccgagcgctttcgcttaccgctaccaccaacaacaaccttggtcgcccttctccaccaccgccgctggggcggcggctgcgggtacgcgggacgaagcggcgaagcggttccctggactagggccgacggcgaagggggagaaggccagggtggtggtgttggggacagggtgggcggggtctcggctcatgaaggacctcgacacgcacggctacgacatggtctgcgtcgccccgcgcaaccacatggtgttcacgccgctgctcgcctccacctgcgtcggcacgctcgagttccgctccgtcgccgagccgatcgcgcgcatccagcccgccgtgtccaagtcgccgggctcctacttcctcctcgcccgttgcaccggcgtcgaccccgacagccacacgattgattgcgaaacagttacagatggtgagaaagattccttggagccatggaaattcaaggttgcttatgacaagttggtttttgcctgtggagctgaggcatcaacttttgggatacatggtgttaccgaccatgcaatctttcttcgcgaagttcaccatgctcaagagattcggagacggctcctccttaatctgatgttgtctgatgtccctggaatttcagaagaagaaaagcgcagactattgcactgtgttgttgttggaggtggtccaacaggggtggaatttagtggtgaacttagtgattttattatacgagatgtcaaacaacgttattcacatgtgaaggattatatccatgtgaccctgattgaggcaaatgagatattgtcatcatttgatgttcggctcaggcaatatgctataaagcaactaattaagtcaggtgttaggcttgtgcaaggaattgttaaggatgtacagcccagcaaaataattcttgacaatggagaggaagttccttatggtttactggtatggtccactggagttggtgcttcaccattcgttaagtcattgccatttcctaagtcacctggtggaaggatcggtgtcaatgagtggttacgtgtcccttctgttcaggatgtttatgccattggtgactgcagtgggtttctcgagagcaccggcaaggaagttctccctgctttagctcaggttgcggaacgacaaggcaagtacctggcaagcctgctcaatcatgtcatgaaagctggaggagggcatgcaaactctgtgactgaagcagatctgggtccaccctttgtgtacaagcatctaggcagcatggcaactgttggaagatacaaagctctagtcgatctgaggaaaagcaaggagtcaagggggatatctcttgcaggatttgtgagctggttcatctggcgctcggcatacttaacccgtgttattagctggaggaataggttctatgtggctatcaattggctgaccacactcttatttggccgggacataagcagaatctag

SEQ ID NO: 1470 - protein, 503 aa, Sorghum bicolor
  misc_feature: Ceres ANNOT ID no. 6015986
  misc_feature (67)..(380): Pfam Id: Pyr_redox_2 Pfam Desc: Pyridine nucleotide-disulphide oxidoreductase
  misc_feature (236)..(336): Pfam Id: Pyr_redox Pfam Desc: Pyridine nucleotide-disulphide oxidoreductase
  misc_feature (65)..(503): NCBI GI: 71748224 NCBI Desc: nadh dehydrogenase [trypanosoma brucei]
  misc_feature (65)..(503): NCBI GI: 70832835 NCBI Desc: nadh dehydrogenase [trypanosoma brucei]
  misc_feature (62)..(397): NCBI GI: 5734587 NCBI Desc: external rotenone-insensitive nadph dehydrogenase [solanum tuberosum]
  misc_feature (49)..(398): NCBI GI: 42567013 NCBI Desc: pyridine nucleotide-disulphide oxidoreductase family protein [arabidopsis thaliana]
  misc_feature (64)..(394): NCBI GI: 18417151 NCBI Desc: nadh dehydrogenase-related [arabidopsis thaliana]
MAASSLLRSLTRRGCAGPSAFAYRYHQQQPWSPFSTTAAGAAAAGTRDEAAKRFPGLGPTAKGEKARVVVLGTGWAGSRLMKDLDTHGYDMVCVAPRNHMVFTPLLASTCVGTLEFRSVAEPIARIQPAVSKSPGSYFLLARCTGVDPDSHTIDCETVTDGEKDSLEPWKFKVAYDKLVFACGAEASTFGIHGVTDHAIFLREVHHAQEIRRRLLLNLMLSDVPGISEEEKRRLLHCVVVGGGPTGVEFSGELSDFIIRDVKQRYSHVKDYIHVTLIEANEILSSFDVRLRQYAIKQLIKSGVRLVQGIVKDVQPSKIILDNGEEVPYGLLVWSTGVGASPFVKSLPFPKSPGGRIGVNEWLRVPSVQDVYAIGDCSGFLESTGKEVLPALAQVAERQGKYLASLLNHVMKAGGGHANSVTEADLGPPFVYKHLGSMATVGRYKALVDLRKSKESRGISLAGFVSWFIWRSAYLTRVISWRNRFYVAINWLTTLLFGRDISRI

SEQ ID NO: 1471 - DNA, 945 bp, Sorghum bicolor
  misc_feature: Ceres ANNOT ID no. 6016005
  misc_feature: Encodes the peptide sequence at SEQ ID NO 1472
atggcggcagcggaggtgtactcgccgaccgctgcggcggcggcgcagcagcagcagcgggggaaggcggcgtcgcaggcgtggcgagcggtggtggggtggatcggcttcctcctccaggtcctgctccagatcctccgaggcacgccctcctgcgcccagctcctgtccttcgtcggcttccgctaccctctcctttccgggcccgcggcttcggagccgtcgccggaggtggccttcatgccgctccactccgagatcccagctgacgcggacgcggcgcctgccccgatacctgcgcctgagcccctgggccgcctcacggtagtgcttgacttggatgagactttagtttctgcatatgaatcatctagtcttcctgctattgtgcgcacacaagcagttgaagcaggattacattgttttgatatggaatgtatatcgtctgataaggatgttgaaggaaaacagaaggtgaatcatgtgactgtttttgagcgccctggtttgcatgagttcttgctgaaaactagtgaatttgcagatcttattctttttacagcaggtttagaaggttatgctagacctttagtcgaccgaatagatgttcacaatagattcagacttcgtctctatcgcccatcaactgttaccacggaatacagagaacatgtgaaagatctttcttgcgtgtcaaaagatttcggcaggattgtcattgtcgacaacaatccgttcagtttcattcttcagcctttgaatggaataccttgtgttccattttcagctggacaacattctgatgaccagctcatgacggttatatttccactcctgaagcatctttccctccagaaagatgtcagacctgtattgcatgaaaggtttcatatgccagaatggttccaaaagcatgggatccccccaactaatcaggctgtgtaa

SEQ ID NO: 1472 - protein, 314 aa, Sorghum bicolor
  misc_feature: Ceres ANNOT ID no. 6016005
  misc_feature (98)..(294): Pfam Id: NIF Pfam Desc: NLI interacting factor-like phosphatase
  misc_feature (1)..(314): NCBI GI: 56202314 NCBI Desc: nli interacting factor (nif) family protein-like [oryza sativa (japonica cultivar-group)]
  misc_feature (97)..(300): NCBI GI: 89308120 NCBI Desc: nli interacting factor-like phosphatase family protein [tetrahymena thermophila sb210]
  misc_feature (153)..(292): NCBI GI: 108881086 NCBI Desc: nuclear lim interactor-interacting factor (nli-interacting factor) (nli-if) [aedes aegypti]
  misc_feature (152)..(293): NCBI GI: 55740287 NCBI Desc: nuclear lim factor interactor-interacting protein [phytophthora sojae]
  misc_feature (153)..(293): NCBI GI: 55740285 NCBI Desc: nuclear lim factor interactor-interacting protein [phytophthora sojae]
MAAAEVYSPTAAAAAQQQQRGKAASQAWRAVVGWIGFLLQVLLQILRGTPSCAQLLSFVGFRYPLLSGPAASEPSPEVAFMPLHSEIPADADAAPAPIPAPEPLGRLTVVLDLDETLVSAYESSSLPAIVRTQAVEAGLHCFDMECISSDKDVEGKQKVNHVTVFERPGLHEFLLKTSEFADLILFTAGLEGYARPLVDRIDVHNRFRLRLYRPSTVTTEYREHVKDLSCVSKDFGRIVIVDNNPFSFILQPLNGIPCVPFSAGQHSDDQLMTVIFPLLKHLSLQKDVRPVLHERFHMPEWFQKHGIPPTNQAV

SEQ ID NO: 1473 - DNA, 1497 bp, Sorghum bicolor
  misc_feature: Ceres ANNOT ID no. 6016012
  misc_feature: Encodes the peptide sequence at SEQ ID NO 1474
atgggtaagaaaggaaagtggtttagtgcggtgaagaaagtcttcagctcctctggtacagatggaaaggaagcaaaggctgagaaagcagacaagtcaaaatccaagaggagatggccattcggaaaaacgaagaagcactccgagccttcgatctcaacggtggcagggactgctccggtagctccgttgccatcaccaccaccaactcagccccactctctggagattaaagatgtcaatccacttgaaacagacagtgagcagaacaagcatgcctactctgttgcgcttgcatctgctgtcgctgctgaagctgcagcggttgctgcccaggctgctgcggaggttgtccgcctcacagcagttaccacggctgcaccaaaaatgcctgttagttcaatggaagaacttgctgccaccaagattcagactgccttcaggggttatctggcaaggagagcattgcgggcactaagagggctagttagattgaagtcgcttgttgatggaaatgctgtcaaacgccaaaccgctcacaccttgcaatgcacacaaacaatgacaagagttcaaactcaaatctattctagaagggtgaagttggaggaggagaaacaggctcttcaaaggcagctccaattgaaacatcaaagagaacttgagaaaatgaagattgatgaagactgggatcacagccatcaatccaaagagcaaattgaggccaaccttatgatgaaacaggaagctgcaatgagacgagaaagagcccttgcatatgcattttctcaccagtggaggacttctggtcgaactataacccctacttttacggaacctgggaaccctaactggggctggagctggatggaacgctggatgaccgctagaccttgggagagccgattggtggcatcagacaaggatcctaaagaacgtgctctgacaaagaatccaagcaccattactgttcaagccgcatctgtaccccgtgccatctcaatccagagaccagctacaccaaacaagtcaagccggccaccaagccggcagtcaccttcaactccaccatcgaaggccccatcaacctcaggaaagaccaggccagcaagtccaaggggcaattggctgtacaaggaggatgacctgaggagcatcacaagcatccgctctgagcgcccaaggaggcagagcacaggtggaggaggctcagtccgggatgatgcaagcctgacgagcacaccacctctccccagttacatgcaatcgacagagtctgcaagggcgaagtctcgataccgcagtctactgactgagaagcttgaggttcctgagagagcacctttggtccactctgttgttaagaagcgcctgtcgttccctgtcgtcgataagccaagtgttgtgccgacagataagccaaaggaaagagtgagacgccattcagatcctccgaaggtcgatcctgcaacactgaaggatgtccctgctgcttga

SEQ ID NO: 1474 - protein, 498 aa, Sorghum bicolor
  misc_feature: Ceres ANNOT ID no. 6016012
  misc_feature (137)..(157): Pfam Id: IQ Pfam Desc: IQ calmodulin-binding motif
  misc_feature (26)..(496): NCBI GI: 92868235 NCBI Desc: iq calmodulin-binding region [medicago truncatula]
  misc_feature (1)..(432): NCBI GI: 140068222 NCBI Desc: iq calmodulin-binding region [medicago truncatula]
  misc_feature (26)..(461): NCBI GI: 23506103 NCBI Desc: at5g03040/f15a17_70 [arabidopsis thaliana]
  misc_feature (36)..(337): NCBI GI: 115461823 NCBI Desc: os05g0123200 [oryza sativa (japonica cultivar-group)]
  misc_feature (134)..(398): NCBI GI: 15233296 NCBI Desc: calmodulin-binding family protein [arabidopsis thaliana]
  misc_feature: Useful for making plants with altered sterol content
  misc_feature: Useful for making plants with modulated biomass
  misc_feature: Useful for making plants with modulated heat sensitivity
  misc_feature: Useful for making plants with modulated oxidative stress sensitivity
  misc_feature: Useful for making plants with modulated salt sensitivity
  misc_feature: Useful for making plants with modulated salt sensitivity
  misc_feature: GREAT-hit functional homolog of the protein sequence given in SEQ ID NO 13434
  misc_feature: GREAT-hit functional homolog of the protein sequence given in SEQ ID NO 13435
  misc_feature: GREAT-hit functional homolog of the protein sequence given in SEQ ID NO 13441
  misc_feature: Useful for making plants with modulated oxidative stress sensitivity
  misc_feature: Useful for making plants with modulated salt sensitivity
  misc_feature: Functional homolog of the protein sequence given in SEQ ID NO 13441
MGKKGKWFSAVKKVFSSSGTDGKEAKAEKADKSKSKRRWPFGKTKKHSEPSISTVAGTAPVAPLPSPPPTQPHSLEIKDVNPLETDSEQNKHAYSVALASAVAAEAAAVAAQAAAEVVRLTAVTTAAPKMPVSSMEELAATKIQTAFRGYLARRALRALRGLVRLKSLVDGNAVKRQTAHTLQCTQTMTRVQTQIYSRRVKLEEEKQALQRQLQLKHQRELEKMKIDEDWDHSHQSKEQIEANLMMKQEAAMRRERALAYAFSHQWRTSGRTITPTFTEPGNPNWGWSWMERWMTARPWESRLVASDKDPKERALTKNPSTITVQAASVPRAISIQRPATPNKSSRPPSRQSPSTPPSKAPSTSGKTRPASPRGNWLYKEDDLRSITSIRSERPRRQSTGGGGSVRDDASLTSTPPLPSYMQSTESARAKSRYRSLLTEKLEVPERAPLVHSVVKKRLSFPVVDKPSVVPTDKPKERVRRHSDPPKVDPATLKDVPAA

SEQ ID NO: 1475 - DNA, 507 bp, Sorghum bicolor
  misc_feature: Ceres ANNOT ID no. 6016016
  misc_feature: Encodes the peptide sequence at SEQ ID NO 1476
atggcggacgacggcgggagccacgagggcggcggcggcggcggcggcggcggaggctaccgggagcaggaccggttcctgcccatcgccaacatcagccggatcatgaagaaggccgtcccggccaacggcaagatcgctaaggacgctaaggagaccctgcaggagtgcgtctccgagttcatatcctttgtcaccagcgaggccagcgacaaatgtcagaaggaaaagagaaagacgatcaacggggacgatttgctttgggcgatggctacattaggattcgaggagtacgtcgagcctctcaagatttacctgcaaaagtacagagagggtgatagtaagctgtctacaaaggctggcgagggctctataaagaaggatgcgatcagttcccatggtggcaccagtagctcaagtaaccagttggttcagcatggagtttacaaccaagggatgggctatatgcagccacaggtaatctatcatactgtaatttgtcagtaa

SEQ ID NO: 1476 - protein, 168 aa, Sorghum bicolor
  misc_feature: Ceres ANNOT ID no. 6016016
  misc_feature (25)..(90): Pfam Id: CBFD_NFYB_HMF Pfam Desc: Histone-like transcription factor (CBF/NF-Y) and archaealhistone
  misc_feature (5)..(163): NCBI GI: 73919925 NCBI Desc: probable ccaat-binding transcription factor subunit hap3b (transcriptional activator hap3b)
  misc_feature (11)..(163): NCBI GI: 30409461 NCBI Desc: hap3 [oryza sativa (japonica cultivar-group)]
  misc_feature (5)..(163): NCBI GI: 22380 NCBI Desc: caat-box dna binding protein subunit b (nf-yb) [zea mays]
  misc_feature (5)..(163): NCBI GI: 115840 NCBI Desc: ccaat-binding transcription factor subunit a (cbf-a) (nf-y protein chain b) (nf-yb) (caat-box dna binding protein subunit b)
  misc_feature (1)..(166): NCBI GI: 33242897 NCBI Desc: ccaat-binding protein [oryza sativa (japonica cultivar-group)]
  misc_feature: The plant is abnormally small.
  misc_feature: The sequence is a functional homolog of SEQ ID NO 10 in the 10/675,852US patent application
  misc_feature: The sequence is a functional homolog of SEQ ID NO 116 in the 10/412,699US patent application
  misc_feature: The sequence is a functional homolog of SEQ ID NO 1167 in the 10/412,699US patent application
  misc_feature: The sequence is a functional homolog of SEQ ID NO 1168 in the 10/412,699US patent application
  misc_feature: The sequence is a functional homolog of SEQ ID NO 12 in the 10/675,852US patent application
  misc_feature: The sequence is a functional homolog of SEQ ID NO 14 in the 10/675,852US patent application
  misc_feature: The sequence is a functional homolog of SEQ ID NO 1440 in the 10/666,642US patent application
  misc_feature: The sequence is a functional homolog of SEQ ID NO 1502 in the 10/666,642US patent application
  misc_feature: The sequence is a functional homolog of SEQ ID NO 18 in the 10/412,699US patent application
  misc_feature: The sequence is a functional homolog of SEQ ID NO 1856 in the 10/412,699US patent application
  misc_feature: The sequence is a functional homolog of SEQ ID NO 1910 in the 10/412,699US patent application
  misc_feature: The sequence is a functional homolog of SEQ ID NO 2102 in the 10/374,780US patent application
  misc_feature: The sequence is a functional homolog of SEQ ID NO 2135 in the 10/666,642US patent application
  misc_feature: The sequence is a functional homolog of SEQ ID NO 2137 in the 10/666,642US patent application
  misc_feature: The sequence is a functional homolog of SEQ ID NO 2149 in the 10/666,642US patent application
  misc_feature: The sequence is a functional homolog of SEQ ID NO 2171 in the 10/666,642US patent application
  misc_feature: The sequence is a functional homolog of SEQ ID NO 2172 in the 10/374,780US patent application
  misc_feature: The sequence is a functional homolog of SEQ ID NO 2173 in the 10/666,642US patent application
  misc_feature: The sequence is a functional homolog of SEQ ID NO 2185 in the 10/666,642US patent application
  misc_feature: The sequence is a functional homolog of SEQ ID NO 24 in the 10/675,852US patent application
  misc_feature: The sequence is a functional homolog of SEQ ID NO 26 in the 10/675,852US patent application
  misc_feature: The sequence is a functional homolog of SEQ ID NO 28 in the 10/675,852US patent application
  misc_feature: The sequence is a functional homolog of SEQ ID NO 280 in the 11/479,226US patent application
  misc_feature: The sequence is a functional homolog of SEQ ID NO 290 in the 10/225,066US patent application
  misc_feature: The sequence is a functional homolog of SEQ ID NO 308 in the 11/435,388US patent application
  misc_feature: The sequence is a functional homolog of SEQ ID NO 310 in the 10/714,887US patent application
  misc_feature: The sequence is a functional homolog of SEQ ID NO 32 in the 10/675,852US patent application
  misc_feature: The sequence is a functional homolog of SEQ ID NO 320 in the 11/435,388US patent application
  misc_feature: The sequence is a functional homolog of SEQ ID NO 322 in the 10/714,887US patent application
  misc_feature: The sequence is a functional homolog of SEQ ID NO 330 in the 11/435,388US patent application
  misc_feature: The sequence is a functional homolog of SEQ ID NO 332 in the 10/714,887US patent application
  misc_feature: The sequence is a functional homolog of SEQ ID NO 332 in the 11/435,388US patent application
  misc_feature: The sequence is a functional homolog of SEQ ID NO 334 in the 10/714,887US patent application
  misc_feature: The sequence is a functional homolog of SEQ ID NO 36 in the 10/675,852US patent application
  misc_feature: The sequence is a functional homolog of SEQ ID NO 362 in the 11/435,388US patent application
  misc_feature: The sequence is a functional homolog of SEQ ID NO 364 in the 10/714,887US patent application
  misc_feature: The sequence is a functional homolog of SEQ ID NO 38 in the 10/675,852US patent application
  misc_feature: The sequence is a functional homolog of SEQ ID NO 394 in the 11/435,388US patent application
  misc_feature: The sequence is a functional homolog of SEQ ID NO 396 in the 10/714,887US patent application
  misc_feature: The sequence is a functional homolog of SEQ ID NO 396 in the 11/435,388US patent application
  misc_feature: The sequence is a functional homolog of SEQ ID NO 398 in the 10/714,887US patent application
  misc_feature: The sequence is a functional homolog of SEQ ID NO 40 in the 10/675,852US patent application
  misc_feature: The sequence is a functional homolog of SEQ ID NO 408 in the 11/435,388US patent application
  misc_feature: The sequence is a functional homolog of SEQ ID NO 410 in the 10/714,887US patent application
  misc_feature: The sequence is a functional homolog of SEQ ID NO 42 in the 10/675,852US patent application
  misc_feature: The sequence is a functional homolog of SEQ ID NO 44 in the 10/675,852US patent application
  misc_feature: The sequence is a functional homolog of SEQ ID NO 46 in the 10/675,852US patent application
  misc_feature: The sequence is a functional homolog of SEQ ID NO 54 in the 10/675,852US patent application
  misc_feature: The sequence is a functional homolog of SEQ ID NO 56 in the 10/675,852US patent application
  misc_feature: The sequence is a functional homolog of SEQ ID NO 58 in the 10/675,852US patent application
  misc_feature: The sequence is a functional homolog of SEQ ID NO 60 in the 10/675,852US patent application
  misc_feature: The sequence is a functional homolog of SEQ ID NO 64 in the 10/675,852US patent application
  misc_feature: The sequence is a functional homolog of SEQ ID NO 66 in the 10/675,852US patent application
  misc_feature: The sequence is a functional homolog of SEQ ID NO 74 in the 10/675,852US patent application
  misc_feature: The sequence is a functional homolog of SEQ ID NO 78 in the 10/675,852US patent application
  misc_feature: The sequence is a functional homolog of SEQ ID NO 783 in the 10/374,780US patent application
  misc_feature: The sequence is a functional homolog of SEQ ID NO 784 in the 10/374,780US patent application
  misc_feature: The sequence is a functional homolog of SEQ ID NO 785 in the 10/374,780US patent application
  misc_feature: The sequence is a functional homolog of SEQ ID NO 786 in the 10/374,780US patent application
  misc_feature: The sequence is a functional homolog of SEQ ID NO 787 in the 10/374,780US patent application
  misc_feature: The sequence is a functional homolog of SEQ ID NO 790 in the 10/374,780US patent application
  misc_feature: The sequence is a functional homolog of SEQ ID NO 791 in the 10/374,780US patent application
  misc_feature: The sequence is a functional homolog of SEQ ID NO 792 in the 10/374,780US patent application
  misc_feature: The sequence is a functional homolog of SEQ ID NO 8 in the 10/675,852US patent application
  misc_feature: The sequence is a functional homolog of SEQ ID NO 802 in the 10/374,780US patent application
  misc_feature: The sequence is a functional homolog of SEQ ID NO 803 in the 10/374,780US patent application
  misc_feature: The sequence is a functional homolog of SEQ ID NO 806 in the 10/374,780US patent application
  misc_feature: The sequence is a functional homolog of SEQ ID NO 810 in the 10/666,642US patent application
  misc_feature: The sequence is a functional homolog of SEQ ID NO 811 in the 10/666,642US patent application
  misc_feature: The sequence is a functional homolog of SEQ ID NO 84 in the 10/675,852US patent application
  misc_feature: The sequence is a functional homolog of SEQ ID NO 88 in the 10/675,852US patent application
  misc_feature: Useful for making plants with altered alkaloid content
  misc_feature: Useful for making plants with altered terpenoid content
  misc_feature: Useful for making plants with modulated biomass
  misc_feature: Useful for making plants with modulated drought sensitivity
  misc_feature: Useful for making plants with modulated growth and phenotype characteristics
  misc_feature: GREAT-hit functional homolog of the protein sequence given in SEQ ID NO 13228
  misc_feature: Functional homolog of the protein sequence given in SEQ ID NO 13247
  misc_feature: Functional homolog of the protein sequence given in SEQ ID NO 13421
  misc_feature: The sequence is a functional homolog of SEQ ID NO 116 in the 20040045049 US patent application
  misc_feature: The sequence is a functional homolog of SEQ ID NO 116 in the 20040045049 US patent application
  misc_feature: The sequence is a functional homolog of SEQ ID NO 1167 in the 20040045049 US patent application
  misc_feature: The sequence is a functional homolog of SEQ ID NO 1168 in the 20040045049 US patent application
  misc_feature: The sequence is a functional homolog of SEQ ID NO 18 in the 20040045049 US patent application
  misc_feature: The sequence is a functional homolog of SEQ ID NO 1856 in the 20040045049 US patent application
  misc_feature: The sequence is a functional homolog of SEQ ID NO 1910 in the 20040045049 US patent application
  misc_feature: The sequence is a functional homolog of SEQ ID NO 12 in the 20050086718 US patent application
  misc_feature: The sequence is a functional homolog of SEQ ID NO 14 in the 20050086718 US patent application
  misc_feature: The sequence is a functional homolog of SEQ ID NO 24 in the 20050086718 US patent application
  misc_feature: The sequence is a functional homolog of SEQ ID NO 26 in the 20050086718 US patent application
  misc_feature: The sequence is a functional homolog of SEQ ID NO 28 in the 20050086718 US patent application
  misc_feature: The sequence is a functional homolog of SEQ ID NO 36 in the 20050086718 US patent application
  misc_feature: The sequence is a functional homolog of SEQ ID NO 38 in the 20050086718 US patent application
  misc_feature: The sequence is a functional homolog of SEQ ID NO 40 in the 20050086718 US patent application
  misc_feature: The sequence is a functional homolog of SEQ ID NO 42 in the 20050086718 US patent application
  misc_feature: The sequence is a functional homolog of SEQ ID NO 44 in the 20050086718 US patent application
  misc_feature: The sequence is a functional homolog of SEQ ID NO 46 in the 20050086718 US patent application
  misc_feature: The sequence is a functional homolog of SEQ ID NO 54 in the 20050086718 US patent application
  misc_feature: The sequence is a functional homolog of SEQ ID NO 60 in the 20050086718 US patent application
  misc_feature: The sequence is a functional homolog of SEQ ID NO 64 in the 20050086718 US patent application
  misc_feature: The sequence is a functional homolog of SEQ ID NO 66 in the 20050086718 US patent application
  misc_feature: The sequence is a functional homolog of SEQ ID NO 310 in the 20060015972 US patent application
  misc_feature: The sequence is a functional homolog of SEQ ID NO 787 in the 20060162006 US patent application
  misc_feature: The sequence is a functional homolog of SEQ ID NO 791 in the 20060162006 US patent application
  misc_feature: The sequence is a functional homolog of SEQ ID NO 803 in the 20060162006 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 791 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 42 in the 10/675,852 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 60 in the 10/675,852 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 64 in the 10/675,852 US patent application
  misc_feature: Useful for making plants with modulated biomass
  misc_feature: Functional homolog of the protein sequence given in SEQ ID NO 13228
  misc_feature: The sequence is a functional homolog of SEQ ID NO 14 in the 10/675,852 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 12 in the 10/675,852 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 38 in the 10/675,852 US patent application
  misc_feature: Useful for making plants with modulated drought sensitivity
  misc_feature: Functional homolog of the protein sequence given in SEQ ID NO 13743
  misc_feature: Useful for making plants with altered alkaloid content
  misc_feature: Useful for making plants with altered terpenoid content
  misc_feature: Functional homolog of the protein sequence given in SEQ ID NO 13247
  misc_feature: The sequence is a functional homolog of SEQ ID NO 44 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 66 in the 10/675,852 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 803 in the 10/374,780 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 62 in the 10/675,852 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 793 in the 10/374,780 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 795 in the 10/374,780 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 22 in US patent 7166765
  misc_feature: The sequence is a functional homolog of SEQ ID NO 788 in the 10/374,780 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: The sequence is a functional homolog of SEQ ID NO. 318 in the 11/188,298 US application
MADDGGSHEGGGGGGGGGGYREQDRFLPIANISRIMKKAVPANGKIAKDAKETLQECVSEFISFVTSEASDKCQKEKRKTINGDDLLWAMATLGFEEYVEPLKIYLQKYREGDSKLSTKAGEGSIKKDAISSHGGTSSSSNQLVQHGVYNQGMGYMQPQVIYHTVICQ

SEQ ID NO: 1477 - DNA, 2523 bp, Sorghum bicolor
  misc_feature: Ceres ANNOT ID no. 6016025
  misc_feature: Encodes the peptide sequence at SEQ ID NO 1478
atgaaggccaaggccctccccttcatcgccttcgagcacaagcgagacgcctatggcttcgccgtgcgcccacaacacctgcagcggtacagagagtatgcaaacatctacaaggtggaggaggaagaggaaaggtccgacagatggaagaattttctggatcggcaggctgaggatggagaatcatctggagaggatgccaaggttgcaccatccaacgaggatgaaggagctgctggcaagaatgccaggacagagccaagaccacataagatccaaatatggtctgaaatcaggccctctttgggccatattgaggagatgatgaactcacgtgtgaagaagaagcaatcttctgttaacgaggggtatacgagggatgaacctcgccctgataattctgaagagagcaagccgtcggaggattctgatgatgagttctatgatgtagagaaggttgatcctagccaagaagtgcctgcaactgacatagccaatgctgactcaggtacaaataaaggtgcagatcaagaagaacattatccttggaaagaagaattagaatgcttagtccgtgatgggcttccaatggctctgagaggagagctatggcaagcttttattggtattggagctcgtcgggttaaagggtactatgagggcctccttgcagcggatggtgaaagagaagacaacaaatgttctgattctccaactacagaatgtgctgatggcaaaccgaaagcatctcaaccattttcttctgaaaaatggaaagggcaaatagagaaggatttgcctagaacatttccaggacaccctgcccttgatgaggatggcagaaatgccttaagacgcttgctcacagcttatgctcgacataatccatcagttggttactgccaagcaatgaacttctttgctggtttgctacttctattgatgacagaggagaatgcattttgggcattgacaggcattatggatgactattttgatggttacttctctgaagaaatgatcgaatctcaggtggatcagcttgttttagaggagttagtccgagagagattcccaaagttagtaaatcatcttgattaccttggtgtacaagttgcgtgggtcactggtccatggttcctatctatttttatgaacatgcttccctgggaaagtgtgcttcgtgtgtgggatgttcttctctttgagggaaaccgtgtgatgctgttccggacagcccttgcactgatggagttgtatggtcctgcacttgtgacaacaaaagatgctggggatgcagtaacccttttgcagtctttagctggttccacttttgacagtagccagcttgttttaacagcttgcatgggatatcaagctgtaggtgaagcaagactgcaagaattgaggaataaacaccgaccatctgttatctcttcaatggaacagagagcaaaaggtcttcgtgtctggagggacaccaacagtcttgcatctaagctatataatttcaagcgtgacactgaaccattggtgtcgttatcagaagaacagtcaaatgatttaaaagatggtgataagaaccaagaagccaattctaataatgtggatgatatgtatcatggcctcactgtcaactctgagattgactctctgcctgatcctaaagaccaggtagtctggctgaagggtgagctgtgccaactgctagaggagagaagatcagctgttctgagggctgatgaattagagacagcacttatggagatggttaagcaagataacagaagagaattaagtgcaaaggttgagcaattggaacaagagttatccgagctaaggcaagctctatcagacaagcaggaacaggaacaagcaatgcttcaggttctgatgcgtgtagagcaagagcagaaagtcacagaggatgcccgtatctgtgcggagcaagatgctgctgctcaaaaatatgctgcacatatactccaggagaagtacgaggaagctatggcttcacttacgcaaatggagaacagagcagttatggcagaaactatgttagaggcaaccattcagtaccaatctagtcagcagaaagcacagctgccatcaccctctccttctccaaggacctcaactcgagatgcatcaccaggccaagggaaccaagattcatcacaggagttccagcctagaaggataagtttgcttgccccattttcccttggatggcgagacaagaacaagggcaagcagaacggcactgatgagtcaacaaacggtaagctcaataataacaccgatcaaggggttgaaacacccaaaaaggacgatgaaaagaaaggtgattcaccaaaagaggactcaccaaaagagggtgaacagatgatccaaacaccccaaagagacagcgagcccagattagagacgcccaagatggatagtgagccaccaagtgtcgaaacgacgacaagcaatatgaatgggcaggaagaccagttggaggaaataaaattggattga

SEQ ID NO: 1478 - protein, 840 aa, Sorghum bicolor
  misc_feature: Ceres ANNOT ID no. 6016025
  misc_feature (191)..(427): Pfam Id: TBC Pfam Desc: TBC domain
  misc_feature (1)..(840): NCBI GI: 56201938 NCBI Desc: rabgap/tbc domain-containing protein-like [oryza sativa (japonica cultivar-group)]
  misc_feature (28)..(812): NCBI GI: 115440889 NCBI Desc: os01g0835000 [oryza sativa (japonica cultivar-group)]
  misc_feature (35)..(714): NCBI GI: 42565945 NCBI Desc: rabgap/tbc domain-containing protein [arabidopsis thaliana]
  misc_feature (81)..(756): NCBI GI: 115452313 NCBI Desc: os03g0283800 [oryza sativa (japonica cultivar-group)]
  misc_feature (32)..(705): NCBI GI: 42569762 NCBI Desc: rabgap/tbc domain-containing protein [arabidopsis thaliana]
MKAKALPFIAFEHKRDAYGFAVRPQHLQRYREYANIYKVEEEEERSDRWKNFLDRQAEDGESSGEDAKVAPSNEDEGAAGKNARTEPRPHKIQIWSEIRPSLGHIEEMMNSRVKKKQSSVNEGYTRDEPRPDNSEESKPSEDSDDEFYDVEKVDPSQEVPATDIANADSGTNKGADQEEHYPWKEELECLVRDGLPMALRGELWQAFIGIGARRVKGYYEGLLAADGEREDNKCSDSPTTECADGKPKASQPFSSEKWKGQIEKDLPRTFPGHPALDEDGRNALRRLLTAYARHNPSVGYCQAMNFFAGLLLLLMTEENAFWALTGIMDDYFDGYFSEEMIESQVDQLVLEELVRERFPKLVNHLDYLGVQVAWVTGPWFLSIFMNMLPWESVLRVWDVLLFEGNRVMLFRTALALMELYGPALVTTKDAGDAVTLLQSLAGSTFDSSQLVLTACMGYQAVGEARLQELRNKHRPSVISSMEQRAKGLRVWRDTNSLASKLYNFKRDTEPLVSLSEEQSNDLKDGDKNQEANSNNVDDMYHGLTVNSEIDSLPDPKDQVVWLKGELCQLLEERRSAVLRADELETALMEMVKQDNRRELSAKVEQLEQELSELRQALSDKQEQEQAMLQVLMRVEQEQKVTEDARICAEQDAAAQKYAAHILQEKYEEAMASLTQMENRAVMAETMLEATIQYQSSQQKAQLPSPSPSPRTSTRDASPGQGNQDSSQEFQPRRISLLAPFSLGWRDKNKGKQNGTDESTNGKLNNNTDQGVETPKKDDEKKGDSPKEDSPKEGEQMIQTPQRDSEPRLETPKMDSEPPSVETTTSNMNGQEDQLEEIKLD

SEQ ID NO: 1479 - DNA, 1086 bp, Sorghum bicolor
  misc_feature: Ceres ANNOT ID no. 6016044
  misc_feature: Encodes the peptide sequence at SEQ ID NO 1480
atggctcctcctccatccgacggacagcttgggagcgagccgacgatggaagataccaagtctcttctcccgtaccgcaccgtggactcctcgctgcgcgctctggccgggcaggccgagggcttcggccggcacgccatcggcggcctccacggcgacgtctaccacgtcacgaacctggacgcagatgacggccccggttccctccgagagggatgccgacggcgcgagccgctatggatcgtcttcgacctgtccgggaccatcaacctctcctcgggcgtgcgcgtgtcgtcctacaagaccatcgacgggcgcgggcagcgcgtgaaggtgtccggctggggcctgcagctgagcgagtgcgagcacgtgatcgtgtgcgcgctggaggtggagggcgggcgcgggcacgacgcggacgcggtgcagatcaagccccggtccaggcacgtctgggtggaccgctgcacgctgcgggacttcgacgacggcctcgtggacgtgaccggcggcagcacggacgtgaccatctcccgctgccacctcgcgtcgcacgacaaggccgtgctcatcggcgccagcagcgcccacgtcgaggaccgcggcatccgggtcaccatccaccactgcttcttcgacagcaccaggcagaggcacccgcgcgtcaggttcggcagggtgcacctctacaacaacttcaccagggactggggcatctacgctgtctgtgccagcgttgaagcacagtgcaacatttacgaggcaggaaagaagagcgaggtcttcaggtacaaggaagagcaggcagcagacaaggaacaaagcgcaagggggtacatcaggtccgaaggcgacctgttcctgaatgatgcaaagcagcacgctgctgctgcttcagaatcagacgctgcaagagatgagccatgggacttcaaggtccaggactcctacgaatcttgttcggtccagcccgcgtcagcggcgctcaaggtgctcctgcagagctacgccggttggcagccggttccgctcccggcagacgtttctcttacagaagttgaccctgctgatgataccgcctga

SEQ ID NO: 1480 - protein, 361 aa, Sorghum bicolor
  misc_feature: Ceres ANNOT ID no. 6016044
  misc_feature (92)..(263): Pfam Id: Pec_lyase_C Pfam Desc: Pectate lyase
  misc_feature (23)..(348): NCBI GI: 30694193 NCBI Desc: pectate lyase family protein [arabidopsis thaliana]
  misc_feature (23)..(348): NCBI GI: 7019647 NCBI Desc: pectate lyase-like protein [arabidopsis thaliana]
  misc_feature (63)..(348): NCBI GI: 42572687 NCBI Desc: pectate lyase family protein [arabidopsis thaliana]
  misc_feature (35)..(292): NCBI GI: 4678301 NCBI Desc: pectate lyase-like protein [arabidopsis thaliana]
  misc_feature (116)..(316): NCBI GI: 56965886 NCBI Desc: chain b, 1.7 angstrom crystal structure of jun a 1, the major allergen from cedar pollen
  misc_feature: Useful for making plants with altered cell wall content and/or composition
  misc_feature: Functional homolog of the protein sequence encoded by LOCUS at3g55140
  misc_feature: Useful for making plants with altered cell wall content and/or composition
  misc_feature: Functional homolog of the protein sequence given in SEQ ID NO 13741
  misc_feature: Useful for making plants with altered carbohydrate content
  misc_feature: Functional homolog of the protein sequence given in SEQ ID NO 13742
MAPPPSDGQLGSEPTMEDTKSLLPYRTVDSSLRALAGQAEGFGRHAIGGLHGDVYHVTNLDADDGPGSLREGCRRREPLWIVFDLSGTINLSSGVRVSSYKTIDGRGQRVKVSGWGLQLSECEHVIVCALEVEGGRGHDADAVQIKPRSRHVWVDRCTLRDFDDGLVDVTGGSTDVTISRCHLASHDKAVLIGASSAHVEDRGIRVTIHHCFFDSTRQRHPRVRFGRVHLYNNFTRDWGIYAVCASVEAQCNIYEAGKKSEVFRYKEEQAADKEQSARGYIRSEGDLFLNDAKQHAAAASESDAARDEPWDFKVQDSYESCSVQPASAALKVLLQSYAGWQPVPLPADVSLTEVDPADDTA

SEQ ID NO: 1481 - DNA, 897 bp, Sorghum bicolor
  misc_feature: Ceres ANNOT ID no. 6016045
  misc_feature: Encodes the peptide sequence at SEQ ID NO 1482
atggatcaccaaagcgaggatgttaagtacgaagaggagtttattgtgaattcccggggcaacgagctgttcacttgcagatggacaccacagaattgtcagccaaaagctttgatcttcatctgtcatgataccgcggctcgattggtgaaggcaggatatggtgtttatgggatagaccatgagggtcatggcagatcatctggaagcaggtgctacataccaaactttggctacatcatcgcagattgctccagtcatttcacaagtatctgcgagaaaacagagaacagagggaagaagaggttcctgtacggcatttccatgggcggcagcgtggcttttctcctccataggaaggcaccggactactgggacggtgccatcttgcttgctcctatgtgcaagatctctgatgacatgaagcctcacccaatagtggtcagcgctctgaaaatgatttgtgctgttgcgcctagttggaagatcatacctacacctgacatcattgacaaagtctgcaaagacccagaaatgagaaaagaggttcgttccaatccgtatatatacagaggaaagctccccctgaaaacttgtcatgaactcctgatggtcagcctagatattgagaagaacttgaatcaggtgacgatgccattcctggtcctgcacggtggagatgacatcgtgaccgatccttcagtcagcaagctgctattcgagaaagcatcgagcaaggacaaaaccttcaagctctaccctgggatgtggcatgcgctgacagctgaactccctgacgacgttgagcgtgtgtacgctgacattatcacttggctagaggaaagagcgatttgtacagctagtgtttcaagtgccacatcacatgtcagagtctaa

SEQ ID NO: 1482 - protein, 298 aa, Sorghum bicolor
  misc_feature: Ceres ANNOT ID no. 6016045
  misc_feature (54)..(274): Pfam Id: Abhydrolase_1 Pfam Desc: alpha/beta hydrolase fold
  misc_feature (8)..(296): NCBI GI: 7019651 NCBI Desc: lipase-like protein [arabidopsis thaliana]
  misc_feature (9)..(295): NCBI GI: 30695682 NCBI Desc: esterase/lipase/thioesterase family protein [arabidopsis thaliana]
  misc_feature (9)..(291): NCBI GI: 92878320 NCBI Desc: alpha/beta hydrolase [medicago truncatula]
  misc_feature (1)..(295): NCBI GI: 7019652 NCBI Desc: lipase-like protein [arabidopsis thaliana]
  misc_feature (8)..(294): NCBI GI: 9755822 NCBI Desc: lipase-like protein [arabidopsis thaliana]
MDHQSEDVKYEEEFIVNSRGNELFTCRWTPQNCQPKALIFICHDTAARLVKAGYGVYGIDHEGHGRSSGSRCYIPNFGYIIADCSSHFTSICEKTENRGKKRFLYGISMGGSVAFLLHRKAPDYWDGAILLAPMCKISDDMKPHPIVVSALKMICAVAPSWKIIPTPDIIDKVCKDPEMRKEVRSNPYIYRGKLPLKTCHELLMVSLDIEKNLNQVTMPFLVLHGGDDIVTDPSVSKLLFEKASSKDKTFKLYPGMWHALTAELPDDVERVYADIITWLEERAICTASVSSATSHVRV

SEQ ID NO: 1483 - DNA, 957 bp, Sorghum bicolor
  misc_feature: Ceres ANNOT ID no. 6016046
  misc_feature: Encodes the peptide sequence at SEQ ID NO 1484
atggctcagtacagagacaatatcaagtatgaagaggacttctttgtgaattcacgaggaaacaggctgttcacctgcagttggacgccgaggaaatcacagagcagagctctgatctttatctgccatgggtacggaggtgagtgcagcatatccatgggagatacggccgctcgattagtacaccgtggctatgctgttcacggaatcgaccacgagggccacggcaaatcttcaggctcgaaaggctacatatcgagcttcagcgacatcgtcagagactgctctgaccatttcaagagtgtctgtgagaaacaggagaacgggctaaagaagaggttcctctacggcttctccatgggaggaaccgtggtgcttcagctgcatcggaaggaccctctctattgggacggtgccgtgttgcttgcccctttttgcaagatgttcgataacatgcgtcctcacccgatcatcgtcagcacactgaagatgatcagcaccgttgcgcctagctggagagtcatccctgccatagacatgattgacaaagtctgcaaagatccccagttcaagaaagagatccgttccaacccgtacatgtacaaaggaaacctcgcactgcaaacaggccgcgaactcctctccgtcggcctagacaccgagaagaacctgcacgaggtctcgttgccgttcttggtcctgcacggcactgacgacgtcgtcgctgatccttgtgggagcaagctgctgcacgagagggcgtcgagcagggacaagacactgaagctgtatcccgggatgtggcacgtgctcatgggcgaactgccggaggacgtcgagcgcgtcttcgccgacgtgatctcgtggctcgacgacagggtgggcggtacagctaccgttcccggcggcatggcagatcgtcatgagctagtagagtgtagagatgcagtagaatag

SEQ ID NO: 1484 - protein, 318 aa, Sorghum bicolor
  misc_feature: Ceres ANNOT ID no. 6016046
  misc_feature (65)..(285): Pfam Id: Abhydrolase_1 Pfam Desc: alpha/beta hydrolase fold
  misc_feature (8)..(297): NCBI GI: 7019651 NCBI Desc: lipase-like protein [arabidopsis thaliana]
  misc_feature (9)..(300): NCBI GI: 30695682 NCBI Desc: esterase/lipase/thioesterase family protein [arabidopsis thaliana]
  misc_feature (9)..(296): NCBI GI: 92878320 NCBI Desc: alpha/beta hydrolase [medicago truncatula]
  misc_feature (1)..(294): NCBI GI: 7019652 NCBI Desc: lipase-like protein [arabidopsis thaliana]
  misc_feature (6)..(292): NCBI GI: 140063294 NCBI Desc: alpha/beta hydrolase [medicago truncatula]
MAQYRDNIKYEEDFFVNSRGNRLFTCSWTPRKSQSRALIFICHGYGGECSISMGDTAARLVHRGYAVHGIDHEGHGKSSGSKGYISSFSDIVRDCSDHFKSVCEKQENGLKKRFLYGFSMGGTVVLQLHRKDPLYWDGAVLLAPFCKMFDNMRPHPIIVSTLKMISTVAPSWRVIPAIDMIDKVCKDPQFKKEIRSNPYMYKGNLALQTGRELLSVGLDTEKNLHEVSLPFLVLHGTDDVVADPCGSKLLHERASSRDKTLKLYPGMWHVLMGELPEDVERVFADVISWLDDRVGGTATVPGGMADRHELVECRDAVE

SEQ ID NO: 1485 - DNA, 1182 bp, Sorghum bicolor
  misc_feature: Ceres ANNOT ID no. 6016047
  misc_feature: Encodes the peptide sequence at SEQ ID NO 1486
atgaagcagctccacaagtcctcccccacccacgcgccatcgtcggcgcacgcgccggctcccaaggccgccaagccggcgcgccccggcccgcgctcctggatcgggtatgtcctccgcgagcagcgcctcctcttcgtcctcctcggcgcgctcatcgcctccaccttcttcctcctccggccctacctctcgctctccccgtcctcccacctgccagatgcccgcccgctcttctccttcgccgcccgctccggtgtccccgctggcttccgcccgccgccgcgccgcgtcgtcgttaccggcggggcagggttcgtcgggagccacctcgtggaccggctcctggagcagggggacagcgtgatcgtggtcgacaacttcttcaccggcaggaaggagaacgtcgcgcaccacctccggaaccccaggttcgagctgctccgccacgatgtggtcgagccaatcctcctcgaggtcgaccggatctaccacctcgcgtgccccgcgtcgcccacaaatgtcatgggaactttgaatatgttgggtctggcaaagcgaattggtgcaaggtttttgttgactagcacaagtgaagtttatggtgatccccttgagcatccacagaaggagtcatactgggggcatgttaatcctataggtgttaggagctgttatgatgaggggaagagaacagcagagactttaactatggactatcatcgtggtggtggtgttgaggtgcgtattgcacgcattttcaatacatatggtcctcgtatgtgcctcgatgatggccgcgtcgtcagcaattttgttgcacaggcactgcgaagacaaccgatgacagtttatggtgacgggaaacaaactcgaagtttccaatatgtttctgatctggttgctgggttgatggctctaatggagagtgatcatattggtcctttcaacttgggtaacccaggagagtttaccatgttggagctagcacaggttgtgaaggaaacaattgacccaatggcaaccattgaattcaaacccaatacagctgatgatccccatatgagaaagccagatatcaccaaggctaagcaactgctacattgggagccaaaggtctctctcaaagaaggccttccgctaatggtaaatgacttccgtcaaaggatctcggatgagtaa

SEQ ID NO: 1486 - protein, 393 aa, Sorghum bicolor
  misc_feature: Ceres ANNOT ID no. 6016047
  misc_feature (98)..(319): Pfam Id: Epimerase Pfam Desc: NAD dependent epimerase/dehydratase family
  misc_feature (100)..(301): Pfam Id: NAD_binding_4 Pfam Desc: Male sterility protein
  misc_feature (99)..(318): Pfam Id: 3Beta_HSD Pfam Desc: 3-beta hydroxysteroid dehydrogenase/isomerase family
  misc_feature (1)..(393): NCBI GI: 50659024 NCBI Desc: udp-d-glucuronate decarboxylase [hordeum vulgare]
  misc_feature (5)..(393): NCBI GI: 25396402 NCBI Desc: udp-glucuronic acid decarboxylase [oryza sativa (japonica cultivar-group)]
  misc_feature (5)..(393): NCBI GI: 56201956 NCBI Desc: udp-glucuronic acid decarboxylase [oryza sativa (japonica cultivar-group)]
  misc_feature (1)..(393): NCBI GI: 45421834 NCBI Desc: udp-glucuronic acid decarboxylase [oryza sativa (japonica cultivar-group)]
  misc_feature (73)..(393): NCBI GI: 28058970 NCBI Desc: dtdp-glucose 4-6-dehydratase-like protein [arabidopsis thaliana]
  misc_feature (96)..(390): SWISSPROT Homolog: EC 4.1.1.35 UDP-glucuronic acid decarboxylase 1
  misc_feature: Useful for making plants with altered cell wall content and/or composition
  misc_feature: Functional homolog of the protein sequence encoded by LOCUS at3g53520
  misc_feature: Useful for making plants with altered cell wall content and/or composition
  misc_feature: Functional homolog of the protein sequence given in SEQ ID NO 13746
  misc_feature: Useful for making plants with altered carbohydrate content
  misc_feature: Functional homolog of the protein sequence given in SEQ ID NO 13747
MKQLHKSSPTHAPSSAHAPAPKAAKPARPGPRSWIGYVLREQRLLFVLLGALIASTFFLLRPYLSLSPSSHLPDARPLFSFAARSGVPAGFRPPPRRVVVTGGAGFVGSHLVDRLLEQGDSVIVVDNFFTGRKENVAHHLRNPRFELLRHDVVEPILLEVDRIYHLACPASPTNVMGTLNMLGLAKRIGARFLLTSTSEVYGDPLEHPQKESYWGHVNPIGVRSCYDEGKRTAETLTMDYHRGGGVEVRIARIFNTYGPRMCLDDGRVVSNFVAQALRRQPMTVYGDGKQTRSFQYVSDLVAGLMALMESDHIGPFNLGNPGEFTMLELAQVVKETIDPMATIEFKPNTADDPHMRKPDITKAKQLLHWEPKVSLKEGLPLMVNDFRQRISDE

SEQ ID NO: 1487 - DNA, 1374 bp, Sorghum bicolor
  misc_feature: Ceres ANNOT ID no. 6016049
  misc_feature: Encodes the peptide sequence at SEQ ID NO 1488
atgaggatcgaggaggtgcagtcgacgtcgaagaagcagcgcatcgccacccatacccacatcaagggcctcggtctcgacaccaatgggatggcgatttcgttggcggcagggttcgtgggccaggcggcggcgcgcgaggcggctgggctggtggtcgacatgattcgccagaagaagatggccggccgcgcgctgctacttgcgggcccgcccgccacgggcaagacggcgctatcgctcggcgtagcccaggagctcggcagcaaggtccctttctgtcctatggtaggatcagaagtgtactcctcagaggtcaagaaaactgaggtgctgatggaaaatttccgtagagctataggtttgcgtataaaggaaaagaaagaagtttacgaaggagaggttacagaactttccccagaagaggctgaaagtacaaccggtggatatgtgaaaagcattagccatgtaatcattggcctaaagactgtgaaagggactaagcaactgaagttagagccttcagtttatgatgctttgatcaaggaaaaggtggcagtgggtgatgttatatacatcgaagcaaatagtggtgcagtgaaaagagttggtagatgtgattcttttgctacagaatacgatcttgaagctgaagagtatgttcctatccccaaaggcgaagtccataagaaaaaggaaatagtgcaggttctggatgtcacacttcatgaccttgatgcagcaaatgcacagccacaaggaggccaagatattttatcccttatgggccagatgatgaaaccacgaaagactgaaatcaccgaaaagctacgtcaagaaatcaataaggtggtgaatagatatattgaggaaggaattgcagagcttgtacctggtgttttgttcattgatgaggtccacatgttggatatcgaatgcttttcttatcttaatcgtgcactggagagccctttatcaccaattgtgatacttgctacgaataggggaatatgtaatgtaagaggaactgatatgacaagtccacatggtataccagtggatcttctagataggttggtgattattcggacagaaacatatggccctgctgagatgatacagatattggcaatccgagcacaagtggaggagattgatatcgatgaagaaagtcttgcttatttaggcgagatcggacagcagacatctttgagacatgctattcagttgctatcacctgccagcgtggttgcaaagactaatggaagagaaaagatctgcaaggctgatcttgaggaagttagtggtctctatttggatgccaaatcttcggctcgtctgctccaggagcaacaagacagatacatcacctag

SEQ ID NO: 1488 - protein, 457 aa, Sorghum bicolor
  misc_feature: Ceres ANNOT ID no. 6016049
  misc_feature (117)..(441): Pfam Id: TIP49 Pfam Desc: TIP49 C-terminus
  misc_feature (1)..(405): NCBI GI: 115470865 NCBI Desc: os07g0178900 [oryza sativa (japonica cultivar-group)]
  misc_feature (1)..(457): NCBI GI: 121077833 NCBI Desc: pontin [volvox carteri f. nagariensis]
  misc_feature (1)..(456): NCBI GI: 49256030 NCBI Desc: ruvbl1 protein [xenopus laevis]
  misc_feature (1)..(456): NCBI GI: 60652563 NCBI Desc: ruvb-like 1 [synthetic construct]
  misc_feature (1)..(456): NCBI GI: 30582953 NCBI Desc: ruvb-like 1 (e. coli) [homo sapiens]
MRIEEVQSTSKKQRIATHTHIKGLGLDTNGMAISLAAGFVGQAAAREAAGLVVDMIRQKKMAGRALLLAGPPATGKTALSLGVAQELGSKVPFCPMVGSEVYSSEVKKTEVLMENFRRAIGLRIKEKKEVYEGEVTELSPEEAESTTGGYVKSISHVIIGLKTVKGTKQLKLEPSVYDALIKEKVAVGDVIYIEANSGAVKRVGRCDSFATEYDLEAEEYVPIPKGEVHKKKEIVQVLDVTLHDLDAANAQPQGGQDILSLMGQMMKPRKTEITEKLRQEINKVVNRYIEEGIAELVPGVLFIDEVHMLDIECFSYLNRALESPLSPIVILATNRGICNVRGTDMTSPHGIPVDLLDRLVIIRTETYGPAEMIQILAIRAQVEEIDIDEESLAYLGEIGQQTSLRHAIQLLSPASVVAKTNGREKICKADLEEVSGLYLDAKSSARLLQEQQDRYIT

SEQ ID NO: 1489 - DNA, 1230 bp, Sorghum bicolor
  misc_feature: Ceres ANNOT ID no. 6016051
  misc_feature: Encodes the peptide sequence at SEQ ID NO 1490
atggcttcggcagcggcggaggcgaacggcggggagggggaggagctcctcctgctctcggccgcggaggctggccgcggcggcggcgcgaccgccgaggcggaggagtcgtggcggctcaacttcgaggggttccgcccgccggaggcgcaccaggagaggccgccgaccggtccgctccaccactgcctcggcgttctagctcaaggtcctgaggatgtggttgctgagtactaccaacagcaagtggagatgctggagggttttagtgagatggacacacttacagatcgtggtttccttcctggaatgtccaaggaagaacgagaaaaagttgccaggagtgaaacattagccatacggctgtctaacattgcaaatatggttctctttgctgcaaaagtgtatgcttcagtaaggagtggctcacttgctatcatcgcatctactttggattctcttctagacttgttgtcaggatttatcttgtggtttactgccttttcaatgcaaacaccaaatccctacagatacccaattggaaaaaagcgtatgcagccgctgggaatacttgtttttgcttctgttatggcaacccttggccttcagataattctagaatcaatacgctcattggcgtctgatggagacgaattcagcttaacaagtgatcaagaaaagtggcttgtggacatcatgctttctgtgacattggtaaaacttgccctggttatatattgccgctcattcaccaacgaaattgtcaaagcatatgcacaggatcacttttttgatgtcatcacaaatataattggcctggttgctgcactacttgccaattatattgagggctggatcgacccacttggtgcaattgttctggcaatctacacgatcagaacatggtcgatgacggtgctggagaacgtacactccctggtggggcagtccgcctcgccggagtacctccagaagctgacttacctgtgctggaaccaccacaaggccgtgcggcacatcgacacggtgcgcgcctacacgtttggttcccactacttcgtggaggtggacatcgtgctgccgtcaaacatgccgctgcgggaggctcacgacatcggcgaggccctgcaggagaagctggagcgcctgccagagatcgagcgtgcgtttgtccacctcgactacgagttcacccaccggcccgaacacgccttgtcccacgagaaatag

SEQ ID NO: 1490 - protein, 409 aa, Sorghum bicolor
  misc_feature: Ceres ANNOT ID no. 6016051
  misc_feature (120)..(400): Pfam Id: Cation_efflux Pfam Desc: Cation efflux family
  misc_feature (9)..(407): NCBI GI: 145453064 NCBI Desc: mn-specific cation diffusion facilitator transporter [populus trichocarpa]
  misc_feature (9)..(406): NCBI GI: 145453066 NCBI Desc: mn-specific cation diffusion facilitator transporter [populus trichocarpa]
  misc_feature (37)..(403): NCBI GI: 30699426 NCBI Desc: cation efflux family protein [arabidopsis thaliana]
  misc_feature (37)..(403): NCBI GI: 4835757 NCBI Desc: est gbaa404917 comes from this gene. [arabidopsis thaliana]
  misc_feature (3)..(403): NCBI GI: 28628306 NCBI Desc: cation diffusion facilitator 10 [stylosanthes hamata]
MASAAAEANGGEGEELLLLSAAEAGRGGGATAEAEESWRLNFEGFRPPEAHQERPPTGPLHHCLGVLAQGPEDVVAEYYQQQVEMLEGFSEMDTLTDRGFLPGMSKEEREKVARSETLAIRLSNIANMVLFAAKVYASVRSGSLAIIASTLDSLLDLLSGFILWFTAFSMQTPNPYRYPIGKKRMQPLGILVFASVMATLGLQIILESIRSLASDGDEFSLTSDQEKWLVDIMLSVTLVKLALVIYCRSFTNEIVKAYAQDHFFDVITNIIGLVAALLANYIEGWIDPLGAIVLAIYTIRTWSMTVLENVHSLVGQSASPEYLQKLTYLCWNHHKAVRHIDTVRAYTFGSHYFVEVDIVLPSNMPLREAHDIGEALQEKLERLPEIERAFVHLDYEFTHRPEHALSHEK

SEQ ID NO: 1491 - DNA, 696 bp, Sorghum bicolor
  misc_feature: Ceres ANNOT ID no. 6016055
  misc_feature: Encodes the peptide sequence at SEQ ID NO 1492
atggccaagagggagagggcggcgtgggaggtggaggcgggcgccgccgcggacacggcccgcctgctcatgctcctcgcgcaggcgcagcagcagcacctcctgcagcagcacgcccaccaccaccaccaccaccaccacggggtcggggtgccgccgttccccgcggggcgcgccgcagtgcacgggcgcgtgttcgagtgcaagacgtgcagccggcagttccccacgttccaggcgctcgggggccaccgcgccagccacaagcgcccgagggtgctccagcagcagcagctacagcagcagcagacagtcgtcgccgatcacgcggggcagctctgcctcgggcgccagccgctgcagctgccgctgccgacgacgacgacgccgcagcaggccaagccgagggtgcacgagtgccccgtatgcgggctggagttcgccgtcggccaggcgctcggcggccacatgcgccggcaccgcgccgaggccgaggccgaggccaccgaggcgcccagcaaggtgatgatgcgcccggcgcacgacaagacctgcgacgtcgccggtgggatctgcctggacctcaacctcacgccgtcggagaactgcgccaagtgccggagcgtggtggtgctaggcgccgccgccgggcagggtgtacataagacgctcgccatgttagattgctcgctgtag

SEQ ID NO: 1492 - protein, 231 aa, Sorghum bicolor
  misc_feature: Ceres ANNOT ID no. 6016055
  misc_feature (1)..(231): NCBI GI: 56784648 NCBI Desc: zinc finger transcription factor zfp19 [oryza sativa (japonica cultivar-group)]
  misc_feature (1)..(231): NCBI GI: 115440935 NCBI Desc: os01g0838600 [oryza sativa (japonica cultivar-group)]
  misc_feature (1)..(231): NCBI GI: 30420734 NCBI Desc: zinc finger transcription factor zfp19 [oryza sativa (japonica cultivar-group)]
  misc_feature (131)..(199): NCBI GI: 2346974 NCBI Desc: zpt2-12 [petunia x hybrida]
  misc_feature (133)..(202): NCBI GI: 55734106 NCBI Desc: zinc finger dna-binding protein [catharanthus roseus]
  misc_feature: The plant flowers significantly late compared to wild-type.
  misc_feature: The plant is abnormally large.
  misc_feature: The plant is abnormally small.
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1212 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 14 in the 10/666,642US patent application
  misc_feature: The sequence is a functional homolog of SEQ ID NO 1492 in the 10/666,642US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 903 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated nitrogen use efficiency
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13271
  misc_feature: The sequence is a functional homolog of SEQ ID NO 12 in the 20040045049 US patent application
  misc_feature: The sequence is a functional homolog of SEQ ID NO 1212 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 14 in the 20070033671 US patent application
  misc_feature: The sequence is a functional homolog of SEQ ID NO 1492 in the 20070033671 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: Functional homolog of the protein sequence given in SEQ ID NO 13580
  misc_feature: The sequence is a functional homolog of SEQ ID NO 1291 in the 10/666,642 US patent application
  misc_feature: The sequence is a functional homolog of SEQ ID NO 625 in the 10/374,780 US patent application
  misc_feature: The sequence is a functional homolog of SEQ ID NO. 457 in the 11/188,298 US application
  misc_feature: The sequence is a functional homolog of SEQ ID NO. 351 in the 11/188,298 US application
MAKRERAAWEVEAGAAADTARLLMLLAQAQQQHLLQQHAHHHHHHHHGVGVPPFPAGRAAVHGRVFECKTCSRQFPTFQALGGHRASHKRPRVLQQQQLQQQQTVVADHAGQLCLGRQPLQLPLPTTTTPQQAKPRVHECPVCGLEFAVGQALGGHMRRHRAEAEAEATEAPSKVMMRPAHDKTCDVAGGICLDLNLTPSENCAKCRSVVVLGAAAGQGVHKTLAMLDCSL

SEQ ID NO: 1493 - DNA, 579 bp, Sorghum bicolor
  misc_feature: Ceres ANNOT ID no. 6016061
  misc_feature: Encodes the peptide sequence at SEQ ID NO 1494
atgacgcttacgagacacgaagcggaggagagcaaggagatggagggcctccgggcgcacgccgaggcgctgctcacgctgtcggcgcccgcgtcgtcgtcgtcgttgggcaccggcggcacgccgccggcgccgtcctcggccgcggcccgcagggccatggcggccgagggcgtgttcgagtgcaagacgtgcagcaagcgcttcccgtcgttccaggcgctcggcgggcaccgcaccagccacacgcggctgcaggcgaggatgctcagcgacccagcggcggccgcggccgcggccgagagggacagggcgcgggtgcacgagtgcgccgtctgcggcctcgagttctccatgggccaggcgctcggcgggcacatgcgccgccacaggggcgaggcgccgccagccgcgcacgacgacgaccccgcgcaggcgcagccggaccgggacatgccggacctcaacttgccgccgctggacgacggcagcggcggcggtagcggcgatggccaaggtccacaacagtcggattatgatcgcggctcggagcctcagctgcttaatctgcttgtatag

SEQ ID NO: 1494 - protein, 192 aa, Sorghum bicolor
  misc_feature: Ceres ANNOT ID no. 6016061
  misc_feature (1)..(192): NCBI GI: 56784659 NCBI Desc: c2h2 zinc finger protein [oryza sativa (japonica cultivar-group)]
  misc_feature (42)..(113): NCBI GI: 115479837 NCBI Desc: os09g0483800 [oryza sativa (japonica cultivar-group)]
  misc_feature (46)..(113): NCBI GI: 32172484 NCBI Desc: c2h2 type zinc finger transcription factor zfp21 [oryza sativa (japonica cultivar-group)]
  misc_feature (10)..(138): NCBI GI: 56784648 NCBI Desc: zinc finger transcription factor zfp19 [oryza sativa (japonica cultivar-group)]
  misc_feature (10)..(138): NCBI GI: 115440935 NCBI Desc: os01g0838600 [oryza sativa (japonica cultivar-group)]
  misc_feature: The plant flowers significantly late compared to wild-type.
  misc_feature: The plant is abnormally large.
  misc_feature: The plant is abnormally small.
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated nitrogen use efficiency
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13271
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: Functional homolog of the protein sequence given in SEQ ID NO 13580
  misc_feature: The sequence is a functional homolog of SEQ ID NO. 457 in the 11/188,298 US application
  misc_feature: The sequence is a functional homolog of SEQ ID NO. 351 in the 11/188,298 US application
MTLTRHEAEESKEMEGLRAHAEALLTLSAPASSSSLGTGGTPPAPSSAAARRAMAAEGVFECKTCSKRFPSFQALGGHRTSHTRLQARMLSDPAAAAAAAERDRARVHECAVCGLEFSMGQALGGHMRRHRGEAPPAAHDDDPAQAQPDRDMPDLNLPPLDDGSGGGSGDGQGPQQSDYDRGSEPQLLNLLV

SEQ ID NO: 1495 - DNA, 486 bp, Sorghum bicolor
  misc_feature: Ceres ANNOT ID no. 6016064
  misc_feature: Encodes the peptide sequence at SEQ ID NO 1496
atgggtaaattccgcaagcttggccgcgattactcccaccgcctctccatgctcaggacgatggtgtcgcagctggtgaagcacgagcgcatcgagaccaccgtcgccaaggcgaaggaggtccggcggaaggcggatcagatggtgcagctagggaaggagggtactgagcatgcagcaagacgagctgcttcctttgttcggggtgatgatgttgttcataagctattcactgagctggcttaccgctacagaaatcgagctggcggatacacaagaatgttaagaaccaagatacgtactagtgatgcttcaacaatggcatacatcgagttcgtggatagggagaatgagctccgagagcccaaacctgcaacaccgccgccgcctcaacgagtccctcttgatccatggaccaagtctcgttctagccaacagtgggcaggacctaaaatcaccaagacctcggaatcagacagcttatga

SEQ ID NO: 1496 - protein, 161 aa, Sorghum bicolor
  misc_feature: Ceres ANNOT ID no. 6016064
  misc_feature (17)..(113): Pfam Id: Ribosomal_L17 Pfam Desc: Ribosomal protein L17
  misc_feature (1)..(159): NCBI GI: 18424850 NCBI Desc: ribosomal protein l17 family protein [arabidopsis thaliana]
  misc_feature (1)..(160): NCBI GI: 92897844 NCBI Desc: ribosomal protein l17 [medicago truncatula]
  misc_feature (1)..(159): NCBI GI: 21555473 NCBI Desc: 50s ribosomal protein l17 [arabidopsis thaliana]
  misc_feature (1)..(159): NCBI GI: 21592350 NCBI Desc: ribsomal protein-like [arabidopsis thaliana]
  misc_feature (1)..(159): NCBI GI: 10178068 NCBI Desc: 50s ribosomal protein l17 [arabidopsis thaliana]
  misc_feature: Useful for making plants with modulated heat sensitivity
  misc_feature: GREAT-hit functional homolog of the protein sequence encoded by LOCUS at5g09770
  misc_feature: Useful for making plants with modulated heat sensitivity
  misc_feature: Functional homolog of the protein sequence given in SEQ ID NO 13748
MGKFRKLGRDYSHRLSMLRTMVSQLVKHERIETTVAKAKEVRRKADQMVQLGKEGTEHAARRAASFVRGDDVVHKLFTELAYRYRNRAGGYTRMLRTKIRTSDASTMAYIEFVDRENELREPKPATPPPPQRVPLDPWTKSRSSQQWAGPKITKTSESDSL

SEQ ID NO: 1497 - DNA, 1287 bp, Sorghum bicolor
  misc_feature: Ceres ANNOT ID no. 6016090
  misc_feature: Encodes the peptide sequence at SEQ ID NO 1498
  misc_feature: Up-regulated in shoot tissues in response to methyl jasmonate treatment
atggggagaggcttgagcgccgctcccgtctcgccgcgcctcgtgctcggggcagcggcgctggtgctgctcgcggcggcggcgctgccttctccagcagctggggtcaacgtgacggccgtgctctcggcgttccccaacttcgccgacttcgcgcggctgctggcatccacctccgtggccggggagctgtccgggaggtcgtccctgacgctcctggccgtgccgaatgccaacctgccgcagtcaccctcggctttcgtagctggcgccggcgccgacatcgccgacgtgctgaggtaccacgtccttctggagtacctctccccgtccgacctcgcccacctctccccctccgggaagctcgtgacgacgctgtttcagaccacgggccgcgcaccctccgacttcggcgccgtcaacctcaccctgggggccaactccactgtcgtggtccgctcgccggcgccgacaccgggatcgaatgccacggtcctcggcgccgtgaccgcggttccgtacaatctcagcgtgctcgcggtgggtggccttatcctaccctccggattcgacctcgcggcctctgaaacccgcccgccaccgccggtgaacatcacccgggttctcaccgacgcgcgggggttcaacgtggcggcctccatgctgcaggcttccggtgtggcgagtgagtttgaggccgacgagcacggtgctggaatcaccgtcttcgtccccaccgacgacgcctttgccggcctccctgccaccgaccgcctccagtccctacccgctgagcgcaaggccgtcgtgctccgcttccatgtgctgcactcttactacccgctgggttcccttgagtccatcgtgaaccctgtccagcccactctcgcgacagagcacactgaggctggccacttcaccctaaacataacccgtgtcaatggctccattgccattgacacaggcatcgtgcaggcatccatcacccgcacagtgttcgaccaaaatcctgtggcagtctttgccgtctccaaggttctactgcccaaggaaatgttcagtcggggggattccggcagcactgccattgtgccaccttcggttgcgatggcgcccggcgacaccagcagcgagcagacaccacagacgaggctctcatccccgcctgacctccacggcgaagatagcgagtcgtcggctgctttggcgacagcaaagggggcttcttggtggcgtataggactcatgtatctacagctgcatctattatttctatctctggtatga

SEQ ID NO: 1498 - protein, 428 aa, Sorghum bicolor
  misc_feature: Ceres ANNOT ID no. 6016090
  misc_feature (214)..(349): Pfam Id: Fasciclin Pfam Desc: Fasciclin domain
  misc_feature (1)..(428): NCBI GI: 56784671 NCBI Desc: endosperm specific protein-like [oryza sativa (japonica cultivar-group)]
  misc_feature (8)..(428): NCBI GI: 115464305 NCBI Desc: os05g0459700 [oryza sativa (japonica cultivar-group)]
  misc_feature (1)..(423): NCBI GI: 115349924 NCBI Desc: fasciclin-like protein fla20 [triticum aestivum]
  misc_feature (10)..(423): NCBI GI: 115349928 NCBI Desc: fasciclin-like protein fla22 [triticum aestivum]
  misc_feature (21)..(401): NCBI GI: 115349894 NCBI Desc: fasciclin-like protein fla5 [triticum aestivum]
  misc_feature: Useful for making plants with altered cell wall content and/or composition
  misc_feature: GREAT-hit functional homolog of the protein sequence encoded by LOCUS at3g46550
  misc_feature: Useful for making plants with altered carbohydrate content
  misc_feature: Functional homolog of the protein sequence given in SEQ ID NO 13744
  misc_feature: Useful for making plants with altered cell wall content and/or composition
  misc_feature: Useful for making plants with modulated salt sensitivity
  misc_feature: Functional homolog of the protein sequence given in SEQ ID NO 13745
  misc_feature: Up-regulated in shoot tissues in response to methyl jasmonate treatment
MGRGLSAAPVSPRLVLGAAALVLLAAAALPSPAAGVNVTAVLSAFPNFADFARLLASTSVAGELSGRSSLTLLAVPNANLPQSPSAFVAGAGADIADVLRYHVLLEYLSPSDLAHLSPSGKLVTTLFQTTGRAPSDFGAVNLTLGANSTVVVRSPAPTPGSNATVLGAVTAVPYNLSVLAVGGLILPSGFDLAASETRPPPPVNITRVLTDARGFNVAASMLQASGVASEFEADEHGAGITVFVPTDDAFAGLPATDRLQSLPAERKAVVLRFHVLHSYYPLGSLESIVNPVQPTLATEHTEAGHFTLNITRVNGSIAIDTGIVQASITRTVFDQNPVAVFAVSKVLLPKEMFSRGDSGSTAIVPPSVAMAPGDTSSEQTPQTRLSSPPDLHGEDSESSAALATAKGASWWRIGLMYLQLHLLFLSLV

SEQ ID NO: 1499 - DNA, 2427 bp, Sorghum bicolor
  misc_feature: Ceres ANNOT ID no. 6016104
  misc_feature: Encodes the peptide sequence at SEQ ID NO 1500
atgagcctctcctccctctcccgtgccctcctcgctcggtccgcgcgctcctcccggccgctgcggcagggttctctgctcgaggggtatgccgggctccgcgcggcgccggcgccgcggtcgacgatccctggtggcgatgaacgtggcttggggtttgcgcgcagctacttgacgtcagcactagggagccgggcggccgcgcccaccggggcgggaaaggtcggagattggaggttcctgctcgccagctcgcagttccggcggttattctctgatgggtccaacaaggattatgagaagtaccatccaaaggagaaggagcagaagcccgagggggacgggagtgacaagtctgactccaaaaaggattcaaattcaaacaatcaatggaatttccaggaggatgtcatgaaaaaattccaggaattccttgctcctatacttcttcttgggctaatgttggcaaccttacccaaggggtcatctgtgcaggagataagcttccaagaatttaagaacaagttattggaacctggtttagttgatcacattgttgttgcaaagaaatcagttgcaaaagtttatgtcaggagttcaccctcaagcaaccaaagccaggatggtaatatccatatcacaaccagtcatctccctggtacaggctctcctagcaaatacaagtactacttcaatattggaagtgttgactcctttgaagagaagttagaagaggcccaacaagcattggggagagatccgcatgtctatgttccagtaacttacacttctgaagtcaattggttccaggagttgatgaggtttgccccaacaattttgcttgttggattagtttatgtggcggggaaaaagatgaaaggcggaattagtattggtggtcctgggggaggagctcgtggtatttttaatattggaaaagcccaagtgacaaagatggacaaaaattcaaaaaacaaggtgttctttaaggacgtagctggctgtgatgaagctaaacaagaaataatggaatttgtgcatttcctgaaaaatcccaagaaatatgaagatctgggagctaaaataccaaagggtgctcttcttgtgggcccccctggtacagggaaaacactccttgctaaagctactgcaggagagtccgatgtgcccttcttgtctatttctggctcagacttcatggagatgtttgttggtgtcggaccatccagggtgcggaatttatttcaagaagctcgacaatgtgcaccgagcattgtattcattgatgaaattgatgcaattggtcgtgcaagggatcgtggtggattttctgggggaaaccatgagcgtgaaagcacattgaaccagttgcttgtagagatggatggatttggaacaacatctggagttgttgttcttgctggtaccaacagacctgacattctagataaggctttgctcagacctgggagatttgaccgtcagataagcattgataaaccagacataaatggccgtgatcaaatatttcgcatttatcttaaaaaacttaaactggacaaggagccatcattttattctcaaagattagcagctttgacacctgggtttgcgggggcagatattgctaatgtttgtaatgaggctgctttaattgctgcaagaagtgaggatgcccaaattacaattcagcattttgaagctgcaattgacagggtcatcggaggactagagaagaaaaataaggttattagcaagctggagcgacggactgtcgcatatcatgaatctggccatgccgttgctggatggtttttggagcatgcagaaccactccttaaagttacaattgttcctcgtggaacagctgctttaggatttgctcagtatgtcccaaatgatagtcttttgatgacaaaagagcagctgtttgacatgacatgtatgacactaggtggaagagctgctgaggagattttgatcgggaagatctctactggtgctcaaaatgacctggagaaagttacccagatgacttatgctcaagttgcagtatatggctttagtgaaaaggttgggcttctttccttcccacaaaagggttttgaaatgagcaaaccatatagcagtcatactgcatccatcattgacaccgaggtgagagaatgggtggccaaggcgtaccaaagaaccgtggacctgatcaagacgcacaaggagcaggttgcacagattgcagaattgctgcttgagaaggaggttctccaccatgatgatctagttcgggtactaggggaacgcccatttaagacggctgagccaacaaactatgatcgtttcaaacaaggtttccaggctgaagttgttgacaagagttctgaagtcgcagatgctaatccgtcacccctgggggttgtgccaacatga

SEQ ID NO: 1500 - protein, 808 aa, Sorghum bicolor
  misc_feature: Ceres ANNOT ID no. 6016104
  misc_feature (562)..(763): Pfam Id: Peptidase_M41 Pfam Desc: Peptidase family M41
  misc_feature (365)..(555): Pfam Id: AAA Pfam Desc: ATPase family associated with various cellular activities(AAA)
  misc_feature (165)..(339): Pfam Id: FtsH_ext Pfam Desc: FtsH Extracellular
  misc_feature (1)..(808): NCBI GI: 115464291 NCBI Desc: os05g0458400 [oryza sativa (japonica cultivar-group)]
  misc_feature (1)..(808): NCBI GI: 15021761 NCBI Desc: aaa-metalloprotease ftsh [pisum sativum]
  misc_feature (10)..(808): NCBI GI: 92873588 NCBI Desc: aaa atpase; bacterial luciferase-like; peptidase m41, ftsh extracellular [medicago truncatula]
  misc_feature (1)..(663): NCBI GI: 8778569 NCBI Desc: f22g5.10 [arabidopsis thaliana]
  misc_feature (304)..(790): NCBI GI: 92868752 NCBI Desc: aaa atpase; peptidase m41, ftsh extracellular [medicago truncatula]
  misc_feature: The sequence is a functional homolog of SEQ ID NO. 462 in the 11/188,298 US application
  misc_feature: The sequence is a functional homolog of SEQ ID NO. 471 in the 11/188,298 US application
MSLSSLSRALLARSARSSRPLRQGSLLEGYAGLRAAPAPRSTIPGGDERGLGFARSYLTSALGSRAAAPTGAGKVGDWRFLLASSQFRRLFSDGSNKDYEKYHPKEKEQKPEGDGSDKSDSKKDSNSNNQWNFQEDVMKKFQEFLAPILLLGLMLATLPKGSSVQEISFQEFKNKLLEPGLVDHIVVAKKSVAKVYVRSSPSSNQSQDGNIHITTSHLPGTGSPSKYKYYFNIGSVDSFEEKLEEAQQALGRDPHVYVPVTYTSEVNWFQELMRFAPTILLVGLVYVAGKKMKGGISIGGPGGGARGIFNIGKAQVTKMDKNSKNKVFFKDVAGCDEAKQEIMEFVHFLKNPKKYEDLGAKIPKGALLVGPPGTGKTLLAKATAGESDVPFLSISGSDFMEMFVGVGPSRVRNLFQEARQCAPSIVFIDEIDAIGRARDRGGFSGGNHERESTLNQLLVEMDGFGTTSGVVVLAGTNRPDILDKALLRPGRFDRQISIDKPDINGRDQIFRIYLKKLKLDKEPSFYSQRLAALTPGFAGADIANVCNEAALIAARSEDAQITIQHFEAAIDRVIGGLEKKNKVISKLERRTVAYHESGHAVAGWFLEHAEPLLKVTIVPRGTAALGFAQYVPNDSLLMTKEQLFDMTCMTLGGRAAEEILIGKISTGAQNDLEKVTQMTYAQVAVYGFSEKVGLLSFPQKGFEMSKPYSSHTASIIDTEVREWVAKAYQRTVDLIKTHKEQVAQIAELLLEKEVLHHDDLVRVLGERPFKTAEPTNYDRFKQGFQAEVVDKSSEVADANPSPLGVVPT

SEQ ID NO: 1501 - DNA, 201 bp, Sorghum bicolor
  misc_feature: Ceres ANNOT ID no. 6016112
  misc_feature: Encodes the peptide sequence at SEQ ID NO 1502
atgcgattcctcccagccgaggagaagccgtgcaggctgttcaggaagaggagcggcggcaaggccgccatgggcggcgacggcggcaagggccgatccttctccgggcggtgcgcgcggctcgtcaaggagcagcgcgcgcggttctacatcatgcgccggtgcgtcacgatgctggtgtgctggcgcgagtacgcctga

SEQ ID NO: 1502 - protein, 66 aa, Sorghum bicolor
  misc_feature: Ceres ANNOT ID no. 6016112
  misc_feature (43)..(61): Pfam Id: DVL Pfam Desc: DVL family
  misc_feature (34)..(65): NCBI GI: 42822049 NCBI Desc: tpa: dvl8 [arabidopsis thaliana]
  misc_feature (30)..(62): NCBI GI: 145325419 NCBI Desc: rtfl9 (rotundifolia like 9) [arabidopsis thaliana]
  misc_feature (35)..(65): NCBI GI: 115442523 NCBI Desc: os01g0972300 [oryza sativa (japonica cultivar-group)]
  misc_feature (30)..(66): NCBI GI: 42822063 NCBI Desc: tpa: dvl15 [arabidopsis thaliana]
  misc_feature (34)..(66): NCBI GI: 42822053 NCBI Desc: tpa: dvl10 [arabidopsis thaliana]
MRFLPAEEKPCRLFRKRSGGKAAMGGDGGKGRSFSGRCARLVKEQRARFYIMRRCVTMLVCWREYA

SEQ ID NO: 1503 - DNA, 3174 bp, Sorghum bicolor
  misc_feature: Ceres ANNOT ID no. 6016116
  misc_feature: Encodes the peptide sequence at SEQ ID NO 1504
atgatgagcaccagcgccgtggctatgcgtggggagattggcggcgggggcggcgagggaggggaggaagagttggaggacgagctcgaagcgctgctcagctccggcgccggtggccagcggcggcgaccagcggacgcgggcgagagggagagagagcgtgagctcagcatgttccggagcggctcggcgccgccgaccatagagggttctctgaacgccatcagcggcctgctccgcggtgacggggaggtggcggtgacggctgccccgattcctgttgctgaggcgttgaacgggcatagtgacctgctctcggaggaggagctccgggccgatccagcctacctgtcttactactactctcatggaaatcttaacccgaggctgccaccaccggtgctgtccaaggaggattggcggtcaacccagcgcctgaaatctggggtggttggggggattggggacaagagaaagcctattcaggaggacgccggacaagggacggcgactgcagtagggaggtctctgttctcactgcatcctggttttgagcgggaggaggaagccaggaatgatgggggtggtgctgcagagtgggtggatggtggaggggatgggctcattggtttatcactcgggcggcagcgtagctttgcagatatactgcaggacaatattggccgcagaacacctaattcagagcatccttcccgcacggccagtcgcaattcttttcttgacaatcaggagccagtgaatcctgctgagaaccaatattctatacataatgatattttggatgtgcatcatcctattgggaacgtgcaaaatgtcagtggccttcacaaccttaacacatccacatctcaaacatttgcatctattatgggttcatctgtttccagaaatgctacgccagatcctcattatgttgcaagggttcctagccctggccttccaccagttggtgttaggatcacttccaatgataagaaactgaactgctccccatcaccattcaacaccgtatcttcaaaagcagttgggactgatgatattttatctgcattgtcaaacatgaagttatcaaaaagtggttctctgaacgataataacaacatcagtcgatcgaactttcagagagatataagtgatcagcagaaattttcacttgactcacaaggagctcaagtccataataagcagcattctgtgatgttagaaaccgatgatggatatttgggcataccatcgatgtcgcaaccatctaattcttcgtttgctgacgttaataacagtgttgctggtctagcagagtttagaaatactaccaacacaaggttagatggacgttcggaaatgcagagatcttctaatttgtctgctcgttcgtatcagaagtccccatcttcttctaatgaaagcccaggtggttctcctgctcaacatcacagttttgacagtataaattcagcttttttgaactatgggctcagtggatacccactcagcccaggattgccttctatgatgccccctttgtttgagagtgctgctgctgcatctgctatagcttcacttggtgcagattcaagaaaccttggaaaccatagtttatcttcatctactttgagcctaactgatgcgcataaccttggtcggggtggtaatcaagctcccactggtcttcagtctcctctttctgaccccttttatgtccaatacttgaaggcaactcagtatgcagcacagggagctggcagctacggtgatccctccttggaaagaggttacatgggtaactcatatgctaatttaaatgcagttcaaaaagcttatattgaagccttgcttcagcagcagaaacaatttgaaatgccacttcttggtaaatcaaccacttcaaatcatgggtattatggcaatttggcttttggcatgggcatggcatacccaggaagcccattgaacagtcctgttgcttctcaatctggtcctggcagtccacttaggcttggtgagcgaaatctgaggtttccatctaacttaagaaacttaggtggctggaactctgatccaagtggctacatgaatgagaacttcccatcctcgcttttggatgaatttaaaagtaacaaagccagaagttttgagcttgctgagatcgctgggcatgtggttgagtttagtgctgaccaatacggaagccgtttcatacagcaaaaacttgaaactgccacagttgaagaaaagaacatggtctttgaggagatcatgccccatgcactatcattgatgactgatgtatttggaaattatgtagtacagaagttttttgagcatgggagtgcagaacaacggagggagttggctgataaactacttggacatgtattagctctcagtcttcagatgtatggatgccgagttatccaaaaggcaatagaggtggttgatctggaccaaaaaacaaagatggttactgagcttgatggtcatatcatgaaatgtgtacgtgatcaaaatggaaatcatgttatccagaaatgtattgaatgtgtcccagaagattctatccagtttataatatcaacattctatggtcatgttgttccattatcaacccacccatatggctgcagagtcatacagagagtacttgagcactgtgctgatccaaaaacacagcaaatagttatggatgagatattgcaatctgtatgcatgttggcacaggatcaatatggaaattatgttgtccagcatgttttagagcacgggaagcctcatgaaagatccatcattattgagaaattagctggacagatcattcagatgagccaacagaaatttgcctcgaacgtggttgagaagtgtctaacatttgggggagctacagagcgagaagttctcataagtgaaatgcttgggaccactgatgagaatgagcctctgcaggccatgatgaaggatcagtttggtaactatgttgtacagaaagtactcgagacttgtgatgaccagcaacgtgagttgatcctgtcacgggtaaaggttcacttaaatgctctgaagaaatatacatatgggaagcacatagttgctcgtgtagaaaaacttgttgccgctggtgagaggaggattgcacttcaaccgcaaaatccttcttaa

SEQ ID NO: 1504 - protein, 1057 aa, Sorghum bicolor
  misc_feature: Ceres ANNOT ID no. 6016116
  misc_feature (722)..(756): Pfam Id: PUF Pfam Desc: Pumilio-family RNA binding repeat
  misc_feature (758)..(792): Pfam Id: PUF Pfam Desc: Pumilio-family RNA binding repeat
  misc_feature (794)..(828): Pfam Id: PUF Pfam Desc: Pumilio-family RNA binding repeat
  misc_feature (830)..(864): Pfam Id: PUF Pfam Desc: Pumilio-family RNA binding repeat
  misc_feature (866)..(900): Pfam Id: PUF Pfam Desc: Pumilio-family RNA binding repeat
  misc_feature (903)..(937): Pfam Id: PUF Pfam Desc: Pumilio-family RNA binding repeat
  misc_feature (939)..(973): Pfam Id: PUF Pfam Desc: Pumilio-family RNA binding repeat
  misc_feature (981)..(1015): Pfam Id: PUF Pfam Desc: Pumilio-family RNA binding repeat
  misc_feature (314)..(721): Pfam Id: NABP Pfam Desc: Nucleic acid binding protein NABP
  misc_feature (1)..(1057): NCBI GI: 115441005 NCBI Desc: os01g0844800 [oryza sativa (japonica cultivar-group)]
  misc_feature (10)..(1052): NCBI GI: 87241276 NCBI Desc: nucleic acid binding nabp [medicago truncatula]
  misc_feature (517)..(1053): NCBI GI: 20513851 NCBI Desc: bpm [hordeum vulgare]
  misc_feature (534)..(1051): NCBI GI: 92885524 NCBI Desc: nucleic acid binding nabp [medicago truncatula]
  misc_feature (516)..(1053): NCBI GI: 115461673 NCBI Desc: os05g0109600 [oryza sativa (japonica cultivar-group)]
MMSTSAVAMRGEIGGGGGEGGEEELEDELEALLSSGAGGQRRRPADAGERERERELSMFRSGSAPPTIEGSLNAISGLLRGDGEVAVTAAPIPVAEALNGHSDLLSEEELRADPAYLSYYYSHGNLNPRLPPPVLSKEDWRSTQRLKSGVVGGIGDKRKPIQEDAGQGTATAVGRSLFSLHPGFEREEEARNDGGGAAEWVDGGGDGLIGLSLGRQRSFADILQDNIGRRTPNSEHPSRTASRNSFLDNQEPVNPAENQYSIHNDILDVHHPIGNVQNVSGLHNLNTSTSQTFASIMGSSVSRNATPDPHYVARVPSPGLPPVGVRITSNDKKLNCSPSPFNTVSSKAVGTDDILSALSNMKLSKSGSLNDNNNISRSNFQRDISDQQKFSLDSQGAQVHNKQHSVMLETDDGYLGIPSMSQPSNSSFADVNNSVAGLAEFRNTTNTRLDGRSEMQRSSNLSARSYQKSPSSSNESPGGSPAQHHSFDSINSAFLNYGLSGYPLSPGLPSMMPPLFESAAAASAIASLGADSRNLGNHSLSSSTLSLTDAHNLGRGGNQAPTGLQSPLSDPFYVQYLKATQYAAQGAGSYGDPSLERGYMGNSYANLNAVQKAYIEALLQQQKQFEMPLLGKSTTSNHGYYGNLAFGMGMAYPGSPLNSPVASQSGPGSPLRLGERNLRFPSNLRNLGGWNSDPSGYMNENFPSSLLDEFKSNKARSFELAEIAGHVVEFSADQYGSRFIQQKLETATVEEKNMVFEEIMPHALSLMTDVFGNYVVQKFFEHGSAEQRRELADKLLGHVLALSLQMYGCRVIQKAIEVVDLDQKTKMVTELDGHIMKCVRDQNGNHVIQKCIECVPEDSIQFIISTFYGHVVPLSTHPYGCRVIQRVLEHCADPKTQQIVMDEILQSVCMLAQDQYGNYVVQHVLEHGKPHERSIIIEKLAGQIIQMSQQKFASNVVEKCLTFGGATEREVLISEMLGTTDENEPLQAMMKDQFGNYVVQKVLETCDDQQRELILSRVKVHLNALKKYTYGKHIVARVEKLVAAGERRIALQPQNPS

SEQ ID NO: 1505 - DNA, 2055 bp, Sorghum bicolor
  misc_feature: Ceres ANNOT ID no. 6016129
  misc_feature: Encodes the peptide sequence at SEQ ID NO 1506
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
atggaccccacctcgccgtcgcccgcggcccgccgcgccgccgccgtcgcgcgccacctcgctggcgccaccgcccccttcccggcgagcactcccctggaaccttcctgctgcctgagctacgtcccgccggagtccaccgaacggccggcggcgttcgcgccgggcgacctcaggcttctgctggacgggcacgacctgcccgcgcgcgattggctcttccgcgccatggaggagagcccccttttccgcagcccgagcgcgcggacgggctccagggtgttcgtgggggcggacttgaacgacggcaaggaagggcagcgggaggccaccatgcggcggatcgcgtacctgaagcagcgcggcgtgttccgcgggtggctcaccaaggacggcgctgacgccgagctccgcaaactagcgctccttgactgcatcgccatctatgaccactctctcgccatcaagattggcgtccacttcttcctctggggcagtgccatcaagtttcttggaacaaagcgccaccatgacaagtggttggttgccacagaaaattatgatatcatgggttgttttgcaatgacagaactaggccatggaagcaatgtacgaggaatagaaacaatagcaacttatgattcagaaacaagagagttcatcataaatactccatgtgaatcagctcagaagtactggattggtggagctgctaatcatgcaacacatacaatagtcttttgtcaacttcatataaatgggagaaatgaaggagtccatgcttttgtagctcaaattagggatgaagatggaactgtgttgcctaatatccgtatagctgactgtggccataagattggactgaatggcgttgataatgggcggatttggtttcagaatatacgtgttcctcgtgagaacttgcttaatttggttgctgacgttttgccagatgggcaatatgttagcatgatagatgatccagatcagaggtttgcagctttcctctctccgcttacacttggtcgagtaaacattgcagttgactcagtctacatttcaaaggtcagcctagcgattgctgtgagatacagtttgtcaaggagagccttttcaattacaccagatggccctgaaacgttgttgcttgattatcccagtcaccagcgacgccttctaccacttctagcaaaagtatgtctgatgagtagtgctgctaattttatgaaaaatatgtatgtaaagagaactcctgaaatgagcaaagccatacatatttactctagtgctctgaaggcaacactaacttggcagaatatgatgactcttcaggagtgtcgtgaggcctgtggcggtcaaggtctaaagactgagaaccgcgtaggagttttcaaagctgaatttgatgtccagtccacatttgagggtgataataatgttctaatgcagcaggtaagcaaagcactttatgctgaatttttgggtgcacaaaagaagaagcggccattcaagggattgggtttggaacacttaaatggctcaacccctgttattcctgataagctgacaagtaacatattaaggagctccaagttccagatggacctattctgcttaagggagagagatttactgaagcagtttgcagaggaggtttctctccatcttgcacaaggcgaaagcagagaaaaggctttgatgctgagttaccaacttgctgaagacttagctagagcgtttactgagcgtacaatcctccaaatatttctggaggatgagaggaatgtcccttctggttccctaaaggaggtactgggtttgctgaggtctctatatgttatggtgaacatagatgaatccacatcttttctaagatacgggtatctatcacgtgacaatgtagcccttgtgcggaaagaagtcttgaaaatgtgcagtgaactcaggccccatgcgcttgctgttgtcagttctttcggaatccctgatgccttccttagtccacttgcttttgactggattgaggcaaatacactgtcaaccgggagccactga

SEQ ID NO: 1506 - protein, 684 aa, Sorghum bicolor
  misc_feature: Ceres ANNOT ID no. 6016129
  misc_feature (192)..(252): Pfam Id: Acyl-CoA_dh_M Pfam Desc: Acyl-CoA dehydrogenase, middle domain
  misc_feature (535)..(685): Pfam Id: ACOX Pfam Desc: Acyl-CoA oxidase
  misc_feature (329)..(490): Pfam Id: Acyl-CoA_dh_1 Pfam Desc: Acyl-CoA dehydrogenase, C-terminal domain
  misc_feature (5)..(681): NCBI GI: 8163758 NCBI Desc: acyl-coa oxidase acx3 [arabidopsis thaliana]
  misc_feature (264)..(681): NCBI GI: 8927668 NCBI Desc: contains similarity to an acyl-coa oxidase from myxococcus xanthus gbaf013216 and contains an acyl-coa oxidase pf01756 domain. est gbai997124 comes from this gene. [arabidopsis
  misc_feature (264)..(681): NCBI GI: 8927668 (continued) thaliana]
  misc_feature (5)..(298): NCBI GI: 8844134 NCBI Desc: contains similarity to an acyl-coenzyme a oxidase i precursor from candida tropicalis gbm12161. [arabidopsis thaliana]
  misc_feature (95)..(667): NCBI GI: 115374407 NCBI Desc: acyl-coenzyme a oxidase, peroxisomal [stigmatella aurantiaca dw4/3-1]
  misc_feature (38)..(677): NCBI GI: 21166169 NCBI Desc: similar to arabidopsis thaliana (mouse-ear cress). acyl-coa oxidase acx3 [dictyostelium discoideum]
  misc_feature (5)..(681): SWISSPROT Homolog: EC 1.3.3.6 Acyl-coenzyme A oxidase 3, peroxisomal precursor
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
MDPTSPSPAARRAAAVARHLAGATAPFPASTPLEPSCCLSYVPPESTERPAAFAPGDLRLLLDGHDLPARDWLFRAMEESPLFRSPSARTGSRVFVGADLNDGKEGQREATMRRIAYLKQRGVFRGWLTKDGADAELRKLALLDCIAIYDHSLAIKIGVHFFLWGSAIKFLGTKRHHDKWLVATENYDIMGCFAMTELGHGSNVRGIETIATYDSETREFIINTPCESAQKYWIGGAANHATHTIVFCQLHINGRNEGVHAFVAQIRDEDGTVLPNIRIADCGHKIGLNGVDNGRIWFQNIRVPRENLLNLVADVLPDGQYVSMIDDPDQRFAAFLSPLTLGRVNIAVDSVYISKVSLAIAVRYSLSRRAFSITPDGPETLLLDYPSHQRRLLPLLAKVCLMSSAANFMKNMYVKRTPEMSKAIHIYSSALKATLTWQNMMTLQECREACGGQGLKTENRVGVFKAEFDVQSTFEGDNNVLMQQVSKALYAEFLGAQKKKRPFKGLGLEHLNGSTPVIPDKLTSNILRSSKFQMDLFCLRERDLLKQFAEEVSLHLAQGESREKALMLSYQLAEDLARAFTERTILQIFLEDERNVPSGSLKEVLGLLRSLYVMVNIDESTSFLRYGYLSRDNVALVRKEVLKMCSELRPHALAVVSSFGIPDAFLSPLAFDWIEANTLSTGSH

SEQ ID NO: 1507 - DNA, 2067 bp, Sorghum bicolor
  misc_feature: Ceres ANNOT ID no. 6016130
  misc_feature: Encodes the peptide sequence at SEQ ID NO 1508
atgaaggccctgggcgcgcacggcgccgacctgctccgcggcccgcacctcctccgcgccgccgttctcgctttcgccgttgcgctcgccttcctcgttggctaccactggcccaacgcctccccgcgccttgtcttcttctcgtccgccgcctcctcgtcggcgcccaggtcctcctcccgctctcctgccgtcgcgctctcccccaactccaacatctccttcgaccagtccctgatccctacccccgccaccccgcctgcttctcctgctcccaatgcctggcccccgccctcactaccaccgccgacaccggcgccgccgcctcccctcctccctcctccaccaccagcgcgcctcggcatcgtcggcgaggatggcgctatgcaggacgagttcgacatcggcagcatcggcgccaacgacactgatctggccaccgacgacaccgccccgcaggagcctagcaacgggggcgccagcggcggaccacccagggtgcggattgggaggttcccggtctgccccgagagcatgagggagtacataccctgcctcgacaacgaggaggagatcaagcggctgccctcgacggagcgcggggagcggtttgagcggcactgccctgccaaggacaagggtctcagttgcctggtgccggcgcccaacgggtacaaggcgcccatcccctggcctcggagtagagatgaggtctggtttagcaatgtgcctcacacaagattggttgatgacaaaggaggacagaattggatcaccaaggtcaaagataagttcagatttcctggaggcggaactcaattcattcatggagctaatcaatacttagaccagatttcccagatggtacctaatgttgcatttggatctcatactagagttgtcctggacgttggctgcggagtagcaagttttggtgcatatttactttcacgtgatgtcctgacattgtccatagctccaaaagatgttcatgaaaatcagatacagtttgctcttgaacgtggtgtgcctgcaatggtagcagcatttgcaacacgccgattattatatccaagccaggcgtttgacataatccattgctcacgttgccgaataaattggactcgtgatgatggtatcctgctcctggaagttaatagattgcttagagctggaggctactttgcttgggcagcccaacctgtttataagcatgaagaggcccaacaagaggcatggaaagagatggaagacctcactacccgactttgttgggagcttgtgaagaaagagggatatattgctatgtggaggaaacccttaaataactcttgctacatgaatcgtggtcctgcagtcaaacctccactttgtgatgctgatgataacccagatgatgtctggtatgttagtctgaaagcatgtattagtcggcttccagagaatgccgaagcaccaactcctgttcaatggcctgcacgcttaatggagccaccaaagaggcttcaaggtgttgaaatggatgcctactcatcaaagaatgagcttttcaaagcagaaacaaaattttgggaggacataattgatggttatatccgtgtctttaagtggaggaagttcaaactccgaaatgtaatggatatgagggctggatttggagggtttgcagctgcattgatcagccggaaacttgattggtgggtgatgaatgttgttcctattagtgagccaaatacattacctgtaatttttgatcgggggcttcttggagtagctcatgactggtgtgagccctttgatacataccctaggacgtatgatctgctgcacgcatctggtcttttctcaaaggagcagaaaaggtgtaatatctctagcatcttgctggagatggaccggatactcagaccaggtggtaaagcatatattcgtgaccggaaagaagttatacaggagatcaaagaaataacaaacgccatggggtggcgtggtactatacgtgacactgccgaaggtgcatacgccagtaggaaggttttgatgtgtgacaagcctatggggcgttag

SEQ ID NO: 1508 - protein, 688 aa, Sorghum bicolor
  misc_feature: Ceres ANNOT ID no. 6016130
  misc_feature (302)..(397): Pfam Id: Methyltransf_11 Pfam Desc: Methyltransferase domain
  misc_feature (302)..(395): Pfam Id: Methyltransf_12 Pfam Desc: Methyltransferase domain
  misc_feature (1)..(688): NCBI GI: 15408875 NCBI Desc: ankyrin-like protein [oryza sativa (japonica cultivar-group)]
  misc_feature (60)..(684): NCBI GI: 58652086 NCBI Desc: at5g06050 [arabidopsis thaliana]
  misc_feature (67)..(684): NCBI GI: 20334726 NCBI Desc: at1g77260/t14n5_19 [arabidopsis thaliana]
  misc_feature (181)..(678): NCBI GI: 21928175 NCBI Desc: at5g64030/mbm17_13 [arabidopsis thaliana]
  misc_feature (118)..(678): NCBI GI: 115441471 NCBI Desc: os01g0883900 [oryza sativa (japonica cultivar-group)]
  misc_feature: The sequence is a functional homolog of SEQ ID NO 556 in the 10/412,699US patent application
  misc_feature: The sequence is a functional homolog of SEQ ID NO 64 in the 10/666,642US patent application
  misc_feature: Useful for making plants with modulated growth and phenotype characteristics
  misc_feature: The sequence is a functional homolog of SEQ ID NO 556 in the 20040045049 US patent application
  misc_feature: The sequence is a functional homolog of SEQ ID NO 64 in the 20070033671 US patent application
  misc_feature: The sequence is a functional homolog of SEQ ID NO 64 in the 10/666,642 US patent application
  misc_feature: The sequence is a functional homolog of SEQ ID NO 556 in the 10/412,699 US patent application
MKALGAHGADLLRGPHLLRAAVLAFAVALAFLVGYHWPNASPRLVFFSSAASSSAPRSSSRSPAVALSPNSNISFDQSLIPTPATPPASPAPNAWPPPSLPPPTPAPPPPLLPPPPPARLGIVGEDGAMQDEFDIGSIGANDTDLATDDTAPQEPSNGGASGGPPRVRIGRFPVCPESMREYIPCLDNEEEIKRLPSTERGERFERHCPAKDKGLSCLVPAPNGYKAPIPWPRSRDEVWFSNVPHTRLVDDKGGQNWITKVKDKFRFPGGGTQFIHGANQYLDQISQMVPNVAFGSHTRVVLDVGCGVASFGAYLLSRDVLTLSIAPKDVHENQIQFALERGVPAMVAAFATRRLLYPSQAFDIIHCSRCRINWTRDDGILLLEVNRLLRAGGYFAWAAQPVYKHEEAQQEAWKEMEDLTTRLCWELVKKEGYIAMWRKPLNNSCYMNRGPAVKPPLCDADDNPDDVWYVSLKACISRLPENAEAPTPVQWPARLMEPPKRLQGVEMDAYSSKNELFKAETKFWEDIIDGYIRVFKWRKFKLRNVMDMRAGFGGFAAALISRKLDWWVMNVVPISEPNTLPVIFDRGLLGVAHDWCEPFDTYPRTYDLLHASGLFSKEQKRCNISSILLEMDRILRPGGKAYIRDRKEVIQEIKEITNAMGWRGTIRDTAEGAYASRKVLMCDKPMGR

SEQ ID NO: 1509 - DNA, 1665 bp, Sorghum bicolor
  misc_feature: Ceres ANNOT ID no. 6016142
  misc_feature: Encodes the peptide sequence at SEQ ID NO 1510
atggcggatccgccgcccgtggccgcctccgcctcgccggcgcagcccgaccagctcgcggccacggcggcctccgtgtccaccccgcagaaccccaaccctaaccccctcctctccccgcaaatccccccgtccccgaccgtctccgacctctccgcgcacatctcgtccccgcagcagctcgaccaggcggccgctgccgcttcgggcggcggaggatccatggattaccccccgcgcccgccgcagctgcaggcgccttcgcccacgcaggccggggccggcgccgccgggtttggccagatcccccgctcggggtcggcctcacgcctctccacggctagccagctccagcagtacgcggcggctaggatgtacggcgggcagatgagcttctcgggtggcggagggctcgtgggccagcagcaacagcagcagctggcggggcgcgcccccatgcttgggcagggccagctggggatgctgcaaggccagggtaacgcggcatctgcggcacattttgggcttcagtcgcagatgatggcgcaggccaggcagaagggcatggcacaaggcacacaattgaataatgctaatacagctcaagcgctgcaagggatgcagcccatgggtgtcatgggtaccatggggatgaaccagatgagaccgaatggaactattccctatggtgctcaacaaaggtttgctcatgcgcaaatgaggccacaagcgtctcaacaacctgcactgtctccacagaaggtacctggtcaaggtctgtcgaggaccgcgtctattacagcattaaattcacaactgtctggatcatcacaaaatggacagatggtggcaatgtctgtgcctcagcaacagcagcagcagtggttgaagcaaatgcaatcatccatgggctcaccagtttccccacagcaacaatatcagcaccagcagaggctcctgttgatgcagcaacttcagcagaagacaggattgagccaacagcaacttctccaagtccaacaacagcatccacatctcagtgcccaacagctgattcagcagcaacattttctgcagcagttgcagcagcagcaaccgctacaatctccacgtgtttcagcatctggttcgcagaagtctgcgaaccttacaggctcacaaccgggtacacctttgtcagttggaactatgactggtggaagtgcaagtcagggagctgaaggaactagccaacttcttgggaaaagaaaaatacaagatcttgttgcgcaggtagatcccctaggtaaagttgaccctgaagtggaggatttacttctagaaatcgctgatgacttcattgactcggtgactgcatttgcttgtaccttggcaaagcacaggaaatcatcagttgttgaagccaaggatgtgttgctgcacttagaaagaaattggcatttatctgttcctggtttctcaagggaggataagaatcctcaaagaaattctgtaaagccattggtagatccccaacaatcagaaagtgatgctactggtatcagaggcacaagcaataaacttggtgctaataattcggttggcaaccatcaaatacgacctccgatggcagaaccttcagcaatgccaacagtgggccctctatcgaaagccccccgcttctaa

SEQ ID NO: 1510 - protein, 554 aa, Sorghum bicolor
  misc_feature: Ceres ANNOT ID no. 6016142
  misc_feature (414)..(481): Pfam Id: TFIID_20kDa Pfam Desc: Transcription initiation factor TFIID subunit A
  misc_feature (1)..(554): NCBI GI: 56784706 NCBI Desc: transcription initiation factor iid (tfiid) subunit a-like protein [oryza sativa (japonica cultivar-group)]
  misc_feature (142)..(538): NCBI GI: 77403675 NCBI Desc: tata binding protein associated factor [solanum tuberosum]
  misc_feature (13)..(502): NCBI GI: 8778478 NCBI Desc: f1l3.13 [arabidopsis thaliana]
  misc_feature (16)..(537): NCBI GI: 92894903 NCBI Desc: histone-fold [medicago truncatula]
  misc_feature (284)..(535): NCBI GI: 115441161 NCBI Desc: os01g0858500 [oryza sativa (japonica cultivar-group)]
MADPPPVAASASPAQPDQLAATAASVSTPQNPNPNPLLSPQIPPSPTVSDLSAHISSPQQLDQAAAAASGGGGSMDYPPRPPQLQAPSPTQAGAGAAGFGQIPRSGSASRLSTASQLQQYAAARMYGGQMSFSGGGGLVGQQQQQQLAGRAPMLGQGQLGMLQGQGNAASAAHFGLQSQMMAQARQKGMAQGTQLNNANTAQALQGMQPMGVMGTMGMNQMRPNGTIPYGAQQRFAHAQMRPQASQQPALSPQKVPGQGLSRTASITALNSQLSGSSQNGQMVAMSVPQQQQQQWLKQMQSSMGSPVSPQQQYQHQQRLLLMQQLQQKTGLSQQQLLQVQQQHPHLSAQQLIQQQHFLQQLQQQQPLQSPRVSASGSQKSANLTGSQPGTPLSVGTMTGGSASQGAEGTSQLLGKRKIQDLVAQVDPLGKVDPEVEDLLLEIADDFIDSVTAFACTLAKHRKSSVVEAKDVLLHLERNWHLSVPGFSREDKNPQRNSVKPLVDPQQSESDATGIRGTSNKLGANNSVGNHQIRPPMAEPSAMPTVGPLSKAPRF

SEQ ID NO: 1511 - DNA, 1086 bp, Sorghum bicolor
  misc_feature: Ceres ANNOT ID no. 6016144
  misc_feature: Encodes the peptide sequence at SEQ ID NO 1512
atgaaggcgctcattcttgttgggggtttcggaacccgccttcggcctttgactcttagcttcccgaagccccttgtggattttgcaaacaagcccatgattctgcatcagatcgaagctttgaaagaagttggggtcacagaggtggttttggccatcaactaccgccctgaggtaatgattaatttcttgaaggactttgaggataagcttggcatcacaatcacatgctcccaagagacggagcccttaggaactgctggtcctcttgctctagcaagggacaagcttgcggatgggtcgggcgagccattctttgtcctcaacagtgatgtcataagcgaatacccatttgctgaactcatcaaatttcacaaatgtcatggtggtgaggcaacaattatggtcactaaggtggatgaaccatcaaaatatggtgttgtggttatggaggaggcaactggcagggtggaaagatttgttgagaagccaaaagtatttgtgggcaacaagatcaatgctgggatttacttactgaacccatctgtccttgaccgcattgaactgaggccaacttcaattgagaaagaggtcttccctcaaattgcagctgatcagaagctctatgcaatggtccttccaggtttttggatggatgttggtcagccaagggactacattactggcttgcgtctttatctagactcacttaggaagaaatcagctgccaggctagctactggaacacatgttgttggcaatgtgctggtgcatgagagcgccaagattggagaaggttgtctgattggtcctgatgtcgccattggacctggatgtgttgtggaggatggcgtgaggctttcccgctgcactgtcatgcgtggtgtgcgcatcaagaagcatgcttgcatctcaaacagcattatcgggtggcactcaactgttggaaaatgggcacggatagagaatatgactatcctgggggaggatgttcatgtgtgtgatgaggtatacagcaatggcggtgttgttctcccacataaagagatcaagtcaagcattctgaagcctgagatcgtcatgtga

SEQ ID NO: 1512 - protein, 361 aa, Sorghum bicolor
  misc_feature: Ceres ANNOT ID no. 6016144
  misc_feature (2)..(236): Pfam Id: NTP_transferase Pfam Desc: Nucleotidyl transferase
  misc_feature (1)..(361): NCBI GI: 80973464 NCBI Desc: gdp-mannose pyrophosphorylase [malpighia glabra]
  misc_feature (1)..(361): NCBI GI: 113952525 NCBI Desc: gdp-d-mannose pyrophosphorylase [viola baoshanensis]
  misc_feature (1)..(361): NCBI GI: 49246467 NCBI Desc: gmpase [medicago sativa]
  misc_feature (1)..(361): NCBI GI: 57340416 NCBI Desc: gdp-mannose pyrophosphorylase [lycopersicon esculentum]
  misc_feature (1)..(361): NCBI GI: 4103324 NCBI Desc: gdp-mannose pyrophosphorylase [solanum tuberosum]
  misc_feature (1)..(361): SWISSPROT Homolog: EC 2.7.7.13 Mannose-1-phosphate guanyltransferase
  misc_feature: The sequence is a functional homolog of SEQ ID NO. 451 in the 11/188,298 US application
  misc_feature: The sequence is a functional homolog of SEQ ID NO. 521 in the 11/188,298 US application
MKALILVGGFGTRLRPLTLSFPKPLVDFANKPMILHQIEALKEVGVTEVVLAINYRPEVMINFLKDFEDKLGITITCSQETEPLGTAGPLALARDKLADGSGEPFFVLNSDVISEYPFAELIKFHKCHGGEATIMVTKVDEPSKYGVVVMEEATGRVERFVEKPKVFVGNKINAGIYLLNPSVLDRIELRPTSIEKEVFPQIAADQKLYAMVLPGFWMDVGQPRDYITGLRLYLDSLRKKSAARLATGTHVVGNVLVHESAKIGEGCLIGPDVAIGPGCVVEDGVRLSRCTVMRGVRIKKHACISNSIIGWHSTVGKWARIENMTILGEDVHVCDEVYSNGGVVLPHKEIKSSILKPEIVM

SEQ ID NO: 1513 - DNA, 936 bp, Sorghum bicolor
  misc_feature: Ceres ANNOT ID no. 6016146
  misc_feature: Encodes the peptide sequence at SEQ ID NO 1514
atggcgaggcgcttcgtgctcaacaccggcgcggagatcccctcggtggggtacggcacctggcagtccaagccggacgtggtcggggactccgtctacgccgccgtcaaggcggggtaccgacacatcgattgcgccagggcgtaccgcaacgaaaaggagattggtttggcgctgcagaggctattcgaagagggtgtggtgaagcgtgaagaattgtttatcacctctaagctatggcatgatcatcatgctccagaagatgtgccggagtcactggacaagagtctgaacgacctgcagcttgagtacttggatctataccttatacattggccatttagactcaagaaggggaccgactggagtagccctgataactttcttccacctgacatcccagctacttggggagcaatggaaaaattatatgatactggcaaagctcgcgcaatcggtgtgagtaacttctcaacaaagaaattgggtgacctgcttgccatagctcgtgtacgtccagctgttaatcaggtggaatgtcatccgggttggcagcaaactaagctccatagcttttgtcagtcaactggtattcatctctctgcgtactcaccgctgggttcacctggtacggcttggatgaaaagtaacatcctgaatgaaccagtcgtcacctcgatagcagaaaaacttgggaaatctcctgcacaggtggcgctgcgctggaacattcagatgggtcacagcgtactaccaaagagcctgaacgagggaaggataaagcagaatcttgatgtttatgattggtctattccagatgacttgcttgcaaagttctctgagattgaacaggttcggctggtcagaggcgacttcacggttaatccaaagagcgtttacaagacccttgaggagctctgggatggggaaatttag

SEQ ID NO: 1514 - protein, 311 aa, Sorghum bicolor
  misc_feature: Ceres ANNOT ID no. 6016146
  misc_feature (7)..(284): Pfam Id: Aldo_ket_red Pfam Desc: Aldo/keto reductase family
  misc_feature (1)..(311): NCBI GI: 99033786 NCBI Desc: aldose reductase [zea mays]
  misc_feature (1)..(311): NCBI GI: 115441039 NCBI Desc: os01g0847700 [oryza sativa (japonica cultivar-group)]
  misc_feature (1)..(311): NCBI GI: 115464263 NCBI Desc: os05g0456300 [oryza sativa (japonica cultivar-group)]
  misc_feature (5)..(311): NCBI GI: 79324628 NCBI Desc: oxidoreductase [arabidopsis thaliana]
  misc_feature (3)..(311): NCBI GI: 13160397 NCBI Desc: aldose reductase [digitalis purpurea]
MARRFVLNTGAEIPSVGYGTWQSKPDVVGDSVYAAVKAGYRHIDCARAYRNEKEIGLALQRLFEEGVVKREELFITSKLWHDHHAPEDVPESLDKSLNDLQLEYLDLYLIHWPFRLKKGTDWSSPDNFLPPDIPATWGAMEKLYDTGKARAIGVSNFSTKKLGDLLAIARVRPAVNQVECHPGWQQTKLHSFCQSTGIHLSAYSPLGSPGTAWMKSNILNEPVVTSIAEKLGKSPAQVALRWNIQMGHSVLPKSLNEGRIKQNLDVYDWSIPDDLLAKFSEIEQVRLVRGDFTVNPKSVYKTLEELWDGEI

SEQ ID NO: 1515 - DNA, 933 bp, Sorghum bicolor
  misc_feature: Ceres ANNOT ID no. 6016147
  misc_feature: Encodes the peptide sequence at SEQ ID NO 1516
atggcgcggcacttcgtgctcaacaccggcgccaagatcccctccgtggggctcggcacctggcagtctgaccccggcgtcgttggcaacgccgtctacgccgccgtcaaggcgggttaccgacacatcgattgtgccagagtttacggcaatgaaaaggagattggtgtggcgctgaagaagctatttgaagagggtgtagtgaagcgagaagatctgtttatcacctctaagctatggaatgatcatcatgctcctgaagatgtgcctgaggcactaaatgaaagtctgaatgatttgcagcttgagtacttggatctttatcttatccattggccagttagagtcaagaagggaacaaaccacagtcctgagaattttgttacacctgacatccctgctacctggggggcaatggaaaagttatatgatgctggcaaagctcgtgctattggtgtcagtaacttctcctcgaagaaattgggtgacttgcttgctgtagctcgtgtacctccagctgtggatcaggtggaatgtcatcctgcttggcagcaaactaagctccataacttttgtcagtcaactggtgttcatcttactgcttactcaccactaggttcacctggtacaacttggatgaatagtaatgtccttaaagaaccaataatcatctcaatagctgagaaacttgggaaaactccagcacaagtggctctgcgctggaacattcagatgggtcacagtgtacttccgaagagcacaaatgaagaaaggataaagcaaaaccttgatgtttatgattggtcaattccagatgacttgcttgcaaagttctctgagattaagcaggctaggctacttagaggcaacttcgctgttaacccagcgagcgtttacaagacccatgaggagctctgggatggtgaactttag

SEQ ID NO: 1516 - protein, 310 aa, Sorghum bicolor
  misc_feature: Ceres ANNOT ID no. 6016147
  misc_feature (7)..(283): Pfam Id: Aldo_ket_red Pfam Desc: Aldo/keto reductase family
  misc_feature (1)..(310): NCBI GI: 99033786 NCBI Desc: aldose reductase [zea mays]
  misc_feature (1)..(310): NCBI GI: 115441039 NCBI Desc: os01g0847700 [oryza sativa (japonica cultivar-group)]
  misc_feature (1)..(310): NCBI GI: 115464263 NCBI Desc: os05g0456300 [oryza sativa (japonica cultivar-group)]
  misc_feature (5)..(310): NCBI GI: 79324628 NCBI Desc: oxidoreductase [arabidopsis thaliana]
  misc_feature (3)..(308): NCBI GI: 13160397 NCBI Desc: aldose reductase [digitalis purpurea]
MARHFVLNTGAKIPSVGLGTWQSDPGVVGNAVYAAVKAGYRHIDCARVYGNEKEIGVALKKLFEEGVVKREDLFITSKLWNDHHAPEDVPEALNESLNDLQLEYLDLYLIHWPVRVKKGTNHSPENFVTPDIPATWGAMEKLYDAGKARAIGVSNFSSKKLGDLLAVARVPPAVDQVECHPAWQQTKLHNFCQSTGVHLTAYSPLGSPGTTWMNSNVLKEPIIISIAEKLGKTPAQVALRWNIQMGHSVLPKSTNEERIKQNLDVYDWSIPDDLLAKFSEIKQARLLRGNFAVNPASVYKTHEELWDGEL

SEQ ID NO: 1517 - DNA, 882 bp, Sorghum bicolor
  misc_feature: Ceres ANNOT ID no. 6016148
  misc_feature: Encodes the peptide sequence at SEQ ID NO 1518
atggccacctatttcacgctcaacaccggggctcgcatcccctcggtagggctcggcacctacaaggccggccccggcgtcgtcgccgacgcagtcaccgccgccgtcaaggccgggtaccggcacatcgactgcgcgccgctatacaagaacgagaaggagattggcgttgctctgaacaagctcttcgatgacggcgtcgtcaagtgcagcgatctcgcacctgaagatgttccgttggcaatggacagcactctgaataatctgcagctggagtatattgacctgtacctgattcattggccctttcagataaagaaaggcagcgaactcagtccagaaaactttgtccagcttgatatgcccaagacctggcaggcaatggagaagctgtacggttcaggcaaagctcacgcagtaggcgtaagcaatttttcgaccaagaagctggccgatttgcttgctgtagcccgtgttcctccagctgttaatcaggtggagtgccaccccggctggcaacaggccaagctcagagcgttctgccgctccaatggagttcatttctctgcgtatgcgccgctaggcaggatgaaagccgttgccaataatccggtggttgcatcggtagccgagagattggagaaaacgccggcacagattgctctgcgatggggtatccagcagggtcagagcgtgcttcccaaaagtgccaatgagtcgaggttgaaggagaacattgacctcttcggttggtccattcctgcagagctgtgtgccaaattttctgaaattgaacaggttaagcaaatcagaaatgatgcatttgtgcaccctcagagtatttacaaaacaattgacgaactctgggatggtgagatctaa

SEQ ID NO: 1518 - protein, 293 aa, Sorghum bicolor
  misc_feature: Ceres ANNOT ID no. 6016148
  misc_feature (7)..(266): Pfam Id: Aldo_ket_red Pfam Desc: Aldo/keto reductase family
  misc_feature (1)..(293): NCBI GI: 99033786 NCBI Desc: aldose reductase [zea mays]
  misc_feature (1)..(293): NCBI GI: 115464263 NCBI Desc: os05g0456300 [oryza sativa (japonica cultivar-group)]
  misc_feature (1)..(293): NCBI GI: 115441039 NCBI Desc: os01g0847700 [oryza sativa (japonica cultivar-group)]
  misc_feature (1)..(293): NCBI GI: 92874687 NCBI Desc: aldo/keto reductase [medicago truncatula]
  misc_feature (3)..(293): NCBI GI: 79324628 NCBI Desc: oxidoreductase [arabidopsis thaliana]
MATYFTLNTGARIPSVGLGTYKAGPGVVADAVTAAVKAGYRHIDCAPLYKNEKEIGVALNKLFDDGVVKCSDLAPEDVPLAMDSTLNNLQLEYIDLYLIHWPFQIKKGSELSPENFVQLDMPKTWQAMEKLYGSGKAHAVGVSNFSTKKLADLLAVARVPPAVNQVECHPGWQQAKLRAFCRSNGVHFSAYAPLGRMKAVANNPVVASVAERLEKTPAQIALRWGIQQGQSVLPKSANESRLKENIDLFGWSIPAELCAKFSEIEQVKQIRNDAFVHPQSIYKTIDELWDGEI

SEQ ID NO: 1519 - DNA, 2190 bp, Sorghum bicolor
  misc_feature: Ceres ANNOT ID no. 6016154
  misc_feature: Encodes the peptide sequence at SEQ ID NO 1520
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
atggggagaggagggatcggaggcgcggtgggcatggccatggagaacgccgattccgcccgcgcattcgtcaaggacgtcaagcgaatcattatcaaggtgggcacagctgttgtcactgggcagaatggccgattggcaatgggcaggctcggttctctctgtgaacaggtgaagcaactgaattttcaagggtatgaggtgattctggtaacctcaggagctgttggtgttgggaggcagaggctccaataccgtaagcttatccatagcagctttgcagatctgcaaaatcctcagatgaactttgatggaaaggcctgtgctgctgtgggtcaaagtggcctgatggctatctatgacacattatttagccaacttgatgtaacatcatctcaacttcttgtaacggatcgtgatttcaaggatccaagttttggggaccagctccgcgagactgtttttgcactattaaatcttaaagtaataccgttatttaatgagaatgatgccatcagtacccggagacaatcagatgaggattcatctggtgtattctgggataatgacagtctagcagctctgttggcagccgaacttaatgctgatcttcttatcatgcttagtgatgtggagggactctatagtggtccaccaagcgatcctcagtcaaagattatccacacatatgtcaatgaaaagcatgggaagctaattagttttggagagaagtctaatgttggaagaggtggcatgcaagctaaagtggctgctgctgctaatgctgcatcaaaaggtgtacctgttgtcattgcaagtggatttgcaacggatagcatcattaaagttctcaaaggagaaaagattggtacacttttccacaatgaagcaaatttgtgggaatgttccaaggaagctacagcccgagagatggcagttgcggcaagagactgttcgagacgtctacagaagttgtcatcagatgaacgcaaaaagattttgctagatattgctgatgctctggaagcaaatgagggtgcaattaggtctgaaaatgaagccgatgttgaggcagcacaaggtgctggttatgaaaagtcgttggttgctaggatgaccctaaagccaggaaagataacaaaccttgcaagatccattcgtgccattgctgacatggaggaccctatttcccatacattgaaaagaacagaggttgctaaagatctggtttttgagaaagcatattgcccattgggtgttctgctcattatttttgagtctcgtcctgatgcattggtccagattgcatctctggcaatccgaagtggtaatggtcttcttttgaaaggaggaaaagaagctatgcgatcaaacgcaatattacacaaggtcataactggggttattccagatattgttggtaaaaagctcataggccatgtgactagcaaagatgaaattgctgatttgctagcgcttgatgatgtgattgatcttgtcattcctagaggcagcaagaatctagtctcccaaatcaaagcaacaactaagattccagttttaggtcatgctgatggtatctgccatgtttatattgacaaatcagccgacatggatatggcaaaacggatagtattggacgccaaggttgattatccagcagcatgtaatgcaatggaaacactacttgttcataaagatcttaacaagagtgagggccttgatgatctattagtggaacttgaaaaggaaggagtagttatttatggtgggcctgttgcacatgacaaattgaaagtaccaaaggtagattcatttcgccatgagtatagctcaatggcatgcactctcgaatttgttgatgatgtgcagtcagctatcgatcacataaatcgttatggaagtgcacacacagactgcatcatcacaactgatgaaagtgctgcggaggcttttctgcagcaagtcgatagtgctgctgtgtttcataatgcaagcacaaggttttgtgatgggacacgctttgggctaggtgcagaggttggcataagtacagggcgcatacatgcccgcggacctgttggagttgatggacttctaactactcgctgcattttacgcggtagtggacaagtggtgaatggtgacaagggagtggtttacacccacaaggatcttcctttgcaatga

SEQ ID NO: 1520 - protein, 729 aa, Sorghum bicolor
  misc_feature: Ceres ANNOT ID no. 6016154
  misc_feature (28)..(273): Pfam Id: AA_kinase Pfam Desc: Amino acid kinase family
  misc_feature (293)..(683): Pfam Id: Aldedh Pfam Desc: Aldehyde dehydrogenase family
  misc_feature (14)..(729): NCBI GI: 115510969 NCBI Desc: delta 1-pyrroline-5-carboxylate synthetase (p5cs) [includes: glutamate 5-kinase (gamma-glutamyl kinase) (gk); gamma-glutamyl phosphate reductase (gpr)
  misc_feature (14)..(729): NCBI GI: 115510969 (continued) (glutamate-5-semialdehyde dehydrogenase) (glutamyl-gamma-semialdehyde dehydrogenase)]
  misc_feature (14)..(729): NCBI GI: 2081612 NCBI Desc: deltal-pyrroline-5-carboxylate synthetase [oryza sativa]
  misc_feature (14)..(729): NCBI GI: 46360428 NCBI Desc: delta-1-pyrroline-5-carboxylate synthetase [oryza sativa (japonica cultivar-group)]
  misc_feature (14)..(729): NCBI GI: 60686892 NCBI Desc: delta 1-pyrroline-5-carboxylate synthetase [triticum aestivum]
  misc_feature (14)..(729): NCBI GI: 62898529 NCBI Desc: delta1-pyrroline-5-carboxylate synthetase [triticum aestivum]
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
MGRGGIGGAVGMAMENADSARAFVKDVKRIIIKVGTAVVTGQNGRLAMGRLGSLCEQVKQLNFQGYEVILVTSGAVGVGRQRLQYRKLIHSSFADLQNPQMNFDGKACAAVGQSGLMAIYDTLFSQLDVTSSQLLVTDRDFKDPSFGDQLRETVFALLNLKVIPLFNENDAISTRRQSDEDSSGVFWDNDSLAALLAAELNADLLIMLSDVEGLYSGPPSDPQSKIIHTYVNEKHGKLISFGEKSNVGRGGMQAKVAAAANAASKGVPVVIASGFATDSIIKVLKGEKIGTLFHNEANLWECSKEATAREMAVAARDCSRRLQKLSSDERKKILLDIADALEANEGAIRSENEADVEAAQGAGYEKSLVARMTLKPGKITNLARSIRAIADMEDPISHTLKRTEVAKDLVFEKAYCPLGVLLIIFESRPDALVQIASLAIRSGNGLLLKGGKEAMRSNAILHKVITGVIPDIVGKKLIGHVTSKDEIADLLALDDVIDLVIPRGSKNLVSQIKATTKIPVLGHADGICHVYIDKSADMDMAKRIVLDAKVDYPAACNAMETLLVHKDLNKSEGLDDLLVELEKEGVVIYGGPVAHDKLKVPKVDSFRHEYSSMACTLEFVDDVQSAIDHINRYGSAHTDCIITTDESAAEAFLQQVDSAAVFHNASTRFCDGTRFGLGAEVGISTGRIHARGPVGVDGLLTTRCILRGSGQVVNGDKGVVYTHKDLPLQ

SEQ ID NO: 1521 - DNA, 1941 bp, Sorghum bicolor
  misc_feature: Ceres ANNOT ID no. 6016156
  misc_feature: Encodes the peptide sequence at SEQ ID NO 1522
atgtccgccactgcctccccgcacacctccctcctccacctcccccaccgcccgttcgggcccaggcgaccgaggctgacccgcctaaggtgcctcgcgtcgctcgcgccggcgtcgtcgggcgcttcgccggagaacgaggaccacctcatacaaacgctctgcgcccacgggcgcctcgcccgggccgcggcgctcttgcaggggcttcccgcgccaacgcagcgcacctacgagtcgctcctgctcgcggccgcgcgggcgggggacaccgcgctcgccgcggccgtgcaccgcaggctcgaggcggacccggtgttccgctcggaccccttcctgtcgacccgcctcatcgacgcctatgctgcgctcagagcgctcccggccgcgcgccaggtgttcgacgaggcgcctgtgaagaacatcttcgtgtggaacgcgatgctcaaggcgctcgcgctcgccgaccatggagaggaggctctcgcgtgcctttctgacatgggccgggtcggtgtccccgtcgacagctacagctacgcgcatggtcttaaggcctgcattgcagcgtcagcatcgcacgtgccggcctctgcccgggtacgggagatgcacgctcatgccatccgtcgcggctatggatcacacacgcatgttgccaccactcttattgattgctacgcgaagcttgggatggtcagctatgctgagcgtgtgttcgcttcaatgcctgataggaatcttgtgtcatggagtgccatgattgggtgctatgccaagaatgagcgtcctggtgatgcgattcagatctttcaggagatgatggcttctgatgcagacctggtaccaaactcgatcacaattgttagcgtcttgcatgcctgtgctggggtaaatgcactcggtcagggcaaagtacttcatgcatatatccttcggaggggttttgactcacttgtctcagtgctgaatgcactgatggcaatgtacatgaaatgtgggtgccttgagattgggcgctacatcttcaattggataggacgcagaaggaatgttgtgtcatggaattcacttatctggatatggaatgtgtttgaagagatgattcaggaaggcatttcgccaagtatcatcacatttatcagcgtacttggggcttgtagccatgctggacttgtggagcagggaaagaagctatttgaatcaatggtggagtacaatgtcacacctcgtgctgagcactatgcttgcatggttgaccttcttggtcgtgctgggcgtctggatgaagctgtggagctgatacagagcatgcgcattcaaccaagccctcaagtttggggctcacttcttggagcttgcagaattcatggccatgttgagtatgctgagatggcatgctctcatctctttgatcttgagccccgaaatgctggaaactatgttctcctggcagatatttatgcccgagctaagttgcagaaccaagttgatgtactaaaggagttacttgaggagcatgcactggagaaggtgccaggctgtagctggatagaggtgaagaagaagctgtactcatttgcttcagttgacaagaacccacaggtggaggagctgcaagcattgattggtgagtttgtgacacagatgaaaaacgagggctatgtccctgacacaggatcagttctgtatgatattgaagaagaggagaaggagaggattttgcttggccacagtgagaagttggctgttgctttcgggcttatcaacacgggcagtggagaggttatcaggatcacaaagaacctcaggctttgtgaggactgtcattcagtcaccaagttcatctccaaattcacaaatcgggagattgttgtgagggacgtgaatcgatttcaccacttcagggatggagtttgctcgtgcagggattactggtga

SEQ ID NO: 1522 - protein, 646 aa, Sorghum bicolor
  misc_feature: Ceres ANNOT ID no. 6016156
  misc_feature (143)..(177): Pfam Id: PPR Pfam Desc: PPR repeat
  misc_feature (249)..(283): Pfam Id: PPR Pfam Desc: PPR repeat
  misc_feature (378)..(412): Pfam Id: PPR Pfam Desc: PPR repeat
  misc_feature (46)..(646): NCBI GI: 87241485 NCBI Desc: tetratricopeptide-like helical [medicago truncatula]
  misc_feature (50)..(646): NCBI GI: 18418348 NCBI Desc: pentatricopeptide (ppr) repeat-containing protein [arabidopsis thaliana]
  misc_feature (50)..(646): NCBI GI: 54695180 NCBI Desc: ppr986-12 [physcomitrella patens]
  misc_feature (71)..(646): NCBI GI: 87240430 NCBI Desc: tetratricopeptide-like helical [medicago truncatula]
  misc_feature (73)..(646): NCBI GI: 87240699 NCBI Desc: tetratricopeptide-like helical [medicago truncatula]
MSATASPHTSLLHLPHRPFGPRRPRLTRLRCLASLAPASSGASPENEDHLIQTLCAHGRLARAAALLQGLPAPTQRTYESLLLAAARAGDTALAAAVHRRLEADPVFRSDPFLSTRLIDAYAALRALPAARQVFDEAPVKNIFVWNAMLKALALADHGEEALACLSDMGRVGVPVDSYSYAHGLKACIAASASHVPASARVREMHAHAIRRGYGSHTHVATTLIDCYAKLGMVSYAERVFASMPDRNLVSWSAMIGCYAKNERPGDAIQIFQEMMASDADLVPNSITIVSVLHACAGVNALGQGKVLHAYILRRGFDSLVSVLNALMAMYMKCGCLEIGRYIFNWIGRRRNVVSWNSLIWIWNVFEEMIQEGISPSIITFISVLGACSHAGLVEQGKKLFESMVEYNVTPRAEHYACMVDLLGRAGRLDEAVELIQSMRIQPSPQVWGSLLGACRIHGHVEYAEMACSHLFDLEPRNAGNYVLLADIYARAKLQNQVDVLKELLEEHALEKVPGCSWIEVKKKLYSFASVDKNPQVEELQALIGEFVTQMKNEGYVPDTGSVLYDIEEEEKERILLGHSEKLAVAFGLINTGSGEVIRITKNLRLCEDCHSVTKFISKFTNREIVVRDVNRFHHFRDGVCSCRDYW

SEQ ID NO: 1523 - DNA, 468 bp, Sorghum bicolor
  misc_feature: Ceres ANNOT ID no. 6016162
  misc_feature: Encodes the peptide sequence at SEQ ID NO 1524
atggagccgaagaagtcctctgctcagcaccagccccatgccatggagcccaagaagtcctctcctcgcggcgccggggccgccgccgccaccgaagccgagtccccgttgagcagcttgttctacccgccggcgcccgcggcaaatgggaaagatcaggacttgtacagcattctttacaaagggcagagcgggagcgcacaagctggcatgacagatggtaaaccacaatggtctccttccaaaagtcgtactgcgtacgcaaaggatggtaaacattcaccgccttatgattcagttgatacgtcgtgttttggatcatctgtgcattatggtggtcgagaatatttctacggcagctctacaaccaagaaagcatcagaatcctccactgattacaaaggggacaagaaagatccagccgcagattctcatggtgactggtggcaaggtatatcattattttaa

SEQ ID NO: 1524 - protein, 155 aa, Sorghum bicolor
  misc_feature: Ceres ANNOT ID no. 6016162
  misc_feature (1)..(151): NCBI GI: 115441053 NCBI Desc: os01g0848900 [oryza sativa (japonica cultivar-group)]
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
  misc_feature: GREAT-hit functional homolog of the protein sequence given in SEQ ID NO 13014
  misc_feature: Useful for making plants with modulated biomass
  misc_feature: Useful for making plants with modulated flowering time
  misc_feature: Functional homolog of the protein sequence given in SEQ ID NO 13014
MEPKKSSAQHQPHAMEPKKSSPRGAGAAAATEAESPLSSLFYPPAPAANGKDQDLYSILYKGQSGSAQAGMTDGKPQWSPSKSRTAYAKDGKHSPPYDSVDTSCFGSSVHYGGREYFYGSSTTKKASESSTDYKGDKKDPAADSHGDWWQGISLF

SEQ ID NO: 1525 - DNA, 357 bp, Sorghum bicolor
  misc_feature: Ceres ANNOT ID no. 6016164
  misc_feature: Encodes the peptide sequence at SEQ ID NO 1526
  misc_feature: Up-regulated in root tissues in response to salicylic acid treatment
atggagctccaggcgaggtgcctctgcgtcgtcgcgatgctcctggtggccggcctcgccgggctggagacggcgcacggtgcgggggagtgcggccgcgtcccggtggaccaggtggcgctcaagcttgccccgtgcgcggcggccacgcagaacccgcgcgccgcggtgccgccgagctgctgcgcgcaggtgcgcgccatcgggagaagccccaagtgcctgtgcgccgtcatgctgtccgacaccgcgcggaaggccggcgtcaagcctgccgtcgccatgaccatccccaagcgctgcgccatagccaaccgccccgtcggctacaagtgcggcccatatactctgccatga

SEQ ID NO: 1526 - protein, 118 aa, Sorghum bicolor
  misc_feature: Ceres ANNOT ID no. 6016164
  misc_feature (31)..(112): Pfam Id: Tryp_alpha_amyl Pfam Desc: Protease inhibitor/seed storage/LTP family
  misc_feature (11)..(118): NCBI GI: 38344032 NCBI Desc: oj991214_12.12 [oryza sativa (japonica cultivar-group)]
  misc_feature (11)..(113): NCBI GI: 116310801 NCBI Desc: osigba0092m08.3 [oryza sativa (indica cultivar-group)]
  misc_feature (10)..(103): NCBI GI: 115469910 NCBI Desc: os06g0711900 [oryza sativa (japonica cultivar-group)]
  misc_feature (1)..(116): NCBI GI: 25992534 NCBI Desc: fiber lipid transfer protein [gossypium barbadense]
  misc_feature (1)..(116): NCBI GI: 2829204 NCBI Desc: lipid transfer protein precursor [gossypium hirsutum]
  misc_feature: Up-regulated in root tissues in response to salicylic acid treatment
MELQARCLCVVAMLLVAGLAGLETAHGAGECGRVPVDQVALKLAPCAAATQNPRAAVPPSCCAQVRAIGRSPKCLCAVMLSDTARKAGVKPAVAMTIPKRCAIANRPVGYKCGPYTLP

SEQ ID NO: 1527 - DNA, 1038 bp, Sorghum bicolor
  misc_feature: Ceres ANNOT ID no. 6016181
  misc_feature: Encodes the peptide sequence at SEQ ID NO 1528
atggggcgtcggaacaatccggcgacgtggctcctcgccttggtcgtgctagctctagcccttttcgccgggccgtgtgccgcggcacagatcaagaccaccgacacgcgctggagcttccaccttcctttaccaagcggcatcaccggcgccgagagcctcgccttcgacggcaagggcgaggggccctacgccggcgtctcggacggccgcgtcctcaagtggggcggcaccaccgtcggctggaccacgttcgcgcacagcgcgaactaccggaagatacccctgtgcacggcgggcgtggtgccgtcggaggagaccgagagcatgtgcggccggccgctgggcctccagttccacgccaagacgggcgacctctacatcgccgacgcctacctggggctcatgagggtcggccctggcggcggcgaggccgaggtgctggcgaccggcgcggatggcgtcccgttcaacttcgtcaacggcctggacgtcgaccaggccaccggcgacgtctacttcaccgactcgagcacgacgtatcccaggaggtttaacaccgagatcatgatgaacgcggatgcgacgggccggcttctcaagtacgacgcgcggaccaagaccgtcgccgtgctgaaggccgacctgccgtacccgaacggcgtggcggtcagccgcgacggggcgcaggtcgtggtcgcgcacaccgtgccttgccaagcgttcaggtactttctccgcggcgccagggcggggcagtacgagctgctggcggacctgccggggtacccggacaacgtgaggcgggacgacaagggtggctactgggtggccctcaaccaggagaagcagaggctggacgcgacgccggcgacggctcctgtgaagcacctggtcggcgtccgcctgaacgctgacggggtggagatcgaggagctcacggcggccaagggcgtcacgctgagcgacgtggcggagatgaaggggaagctgtggttaggctccgtggagctcgagtatgtcggcctggttgcttga

SEQ ID NO: 1528 - protein, 345 aa, Sorghum bicolor
  misc_feature: Ceres ANNOT ID no. 6016181
  misc_feature (161)..(249): Pfam Id: Str_synth Pfam Desc: Strictosidine synthase
  misc_feature (52)..(337): Pfam Id: SGL Pfam Desc: SMP-30/Gluconolaconase/LRE-like region
  misc_feature (8)..(344): NCBI GI: 115478879 NCBI Desc: os09g0374900 [oryza sativa (japonica cultivar-group)]
  misc_feature (46)..(283): NCBI GI: 30694556 NCBI Desc: strictosidine synthase family protein [arabidopsis thaliana]
  misc_feature (48)..(280): NCBI GI: 140040327 NCBI Desc: strictosidine synthase [medicago truncatula]
  misc_feature (48)..(280): NCBI GI: 115455371 NCBI Desc: os03g0750700 [oryza sativa (japonica cultivar-group)]
  misc_feature (48)..(280): NCBI GI: 61104883 NCBI Desc: strictosidine synthase family protein [brassica napus]
MGRRNNPATWLLALVVLALALFAGPCAAAQIKTTDTRWSFHLPLPSGITGAESLAFDGKGEGPYAGVSDGRVLKWGGTTVGWTTFAHSANYRKIPLCTAGVVPSEETESMCGRPLGLQFHAKTGDLYIADAYLGLMRVGPGGGEAEVLATGADGVPFNFVNGLDVDQATGDVYFTDSSTTYPRRFNTEIMMNADATGRLLKYDARTKTVAVLKADLPYPNGVAVSRDGAQVVVAHTVPCQAFRYFLRGARAGQYELLADLPGYPDNVRRDDKGGYWVALNQEKQRLDATPATAPVKHLVGVRLNADGVEIEELTAAKGVTLSDVAEMKGKLWLGSVELEYVGLVA

SEQ ID NO: 1529 - DNA, 633 bp, Sorghum bicolor
  misc_feature: Ceres ANNOT ID no. 6016184
  misc_feature: Encodes the peptide sequence at SEQ ID NO 1530
atggactccccctgccaaagctgccggctgtttggtgcccagagatcgccgcacgacctcctcggcggcgtggcggatgtggtgctgtggaggaggaaggagctggccggcgggatgctggcggccgtggtggcgtcatgggcgctcttctactgcgtgcccggcaacacgctgctctccttcgtgtcccaggtgctcatgatcctgctcaccgtcctcttcgtctgggccaaggctgcgcagctgctcaacagggcacctccacctattccattgatgaaaatttctgacgagtcaatgagtgaagcagcagaaatagttggtagcttcatgaataaggtgctcaaggattttgaaaacattgcacttggaaaggattccagcctcttctacaaggtggcttttgtgttgttgctgacctccatagttggccgactgactgatcttatcactttggtatatacaagtgttgttattgctctcacggtccctgcattgctggagaaatccgaagaacacattgtcaggtccttcaagaaagcttctatatatgttcaggcatgtggcagagcgtgcaaagagtataaatgtaacatgacaaatatgatatcggaaacgaagaagctgcgttga

SEQ ID NO: 1530 - protein, 210 aa, Sorghum bicolor
  misc_feature: Ceres ANNOT ID no. 6016184
  misc_feature (24)..(196): Pfam Id: Reticulon Pfam Desc: Reticulon
  misc_feature (1)..(186): NCBI GI: 115457912 NCBI Desc: os04g0367400 [oryza sativa (japonica cultivar-group)]
  misc_feature (29)..(186): NCBI GI: 116309603 NCBI Desc: osigba0092j07.5 [oryza sativa (indica cultivar-group)]
  misc_feature (13)..(174): NCBI GI: 38345298 NCBI Desc: osjnba0043a12.26 [oryza sativa (japonica cultivar-group)]
  misc_feature (9)..(208): NCBI GI: 115463129 NCBI Desc: os05g0312500 [oryza sativa (japonica cultivar-group)]
  misc_feature (24)..(135): NCBI GI: 145332641 NCBI Desc: reticulon family protein (rtnlb11) [arabidopsis thaliana]
MDSPCQSCRLFGAQRSPHDLLGGVADVVLWRRKELAGGMLAAVVASWALFYCVPGNTLLSFVSQVLMILLTVLFVWAKAAQLLNRAPPPIPLMKISDESMSEAAEIVGSFMNKVLKDFENIALGKDSSLFYKVAFVLLLTSIVGRLTDLITLVYTSVVIALTVPALLEKSEEHIVRSFKKASIYVQACGRACKEYKCNMTNMISETKKLR

SEQ ID NO: 1531 - DNA, 984 bp, Sorghum bicolor
  misc_feature: Ceres ANNOT ID no. 6016185
  misc_feature: Encodes the peptide sequence at SEQ ID NO 1532
atggaggcgccgagcaacggcgggctgctgtaccacgaggttcaggaggggaagctctgcgccgtgcactgcgtcaacaccgccctgcagggccccttcttctccgagttcgacctcgccgcgctcgccgccgacctcgatcagcgggagcgcctggtgatgctcgagggctcccgaagccccggcgtggccaaccctgccgcaggggacttcttcgcggagggcgagggatcccacaacgtctccctcggcggcgatttcagcatccagaaggcgctggaggtttgggacctccaagttatcccccttgattccccagctgcagggtcgtccctatttgaccctgagcaggaggttgctttcatttgccacctgcaggaccactggttttgcatcaggaaggtgaatggggagtggtataactttaatagtctctatccagctcccgagcacctgtcaaagttttacctctcagctttcattgacaccctgaaggggtcaggctggagtatctttgcagttagaggcaatttccccaaggagtgccctatggcaactgaagggtctaacggttttggtcaatggcttacccctgatgacgcccagaagataacagcttcctgtaaccaggtgcaaacacccactcagcagccccctctacttggtgaacaatcagaagggatgagtgaaatggacatgattgcagcgcagcaagaagaggctgatctgaatgctgctatagctgctagcttgatggacagtgggggtccatttgccagctataatgcagttcaaggatccagcaattcacaagatgctcctgctactgaagcagctccaagtaaagataataaccaggaagaagctgctaaatctgagccgagtgcacctccctgtgaggacactcaggagttggcttcaggaagtgacaccaaaagggaggtttcttctgtagaggagaaaggatcagcgaaagaagaatag

SEQ ID NO: 1532 - protein, 327 aa, Sorghum bicolor
  misc_feature: Ceres ANNOT ID no. 6016185
  misc_feature (10)..(203): Pfam Id: Josephin Pfam Desc: Josephin
  misc_feature (89)..(327): NCBI GI: 115441083 NCBI Desc: os01g0851400 [oryza sativa (japonica cultivar-group)]
  misc_feature (3)..(327): NCBI GI: 20805182 NCBI Desc: ataxin 3-like protein [oryza sativa (japonica cultivar-group)]
  misc_feature (1)..(271): NCBI GI: 38604054 NCBI Desc: at3g54130 [arabidopsis thaliana]
  misc_feature (10)..(182): NCBI GI: 45383440 NCBI Desc: machado-joseph disease protein [gallus gallus]
  misc_feature (15)..(295): NCBI GI: 63053592 NCBI Desc: ataxin-3 [danio rerio]
MEAPSNGGLLYHEVQEGKLCAVHCVNTALQGPFFSEFDLAALAADLDQRERLVMLEGSRSPGVANPAAGDFFAEGEGSHNVSLGGDFSIQKALEVWDLQVIPLDSPAAGSSLFDPEQEVAFICHLQDHWFCIRKVNGEWYNFNSLYPAPEHLSKFYLSAFIDTLKGSGWSIFAVRGNFPKECPMATEGSNGFGQWLTPDDAQKITASCNQVQTPTQQPPLLGEQSEGMSEMDMIAAQQEEADLNAAIAASLMDSGGPFASYNAVQGSSNSQDAPATEAAPSKDNNQEEAAKSEPSAPPCEDTQELASGSDTKREVSSVEEKGSAKEE

SEQ ID NO: 1533 - DNA, 1554 bp, Sorghum bicolor
  misc_feature: Ceres ANNOT ID no. 6016189
  misc_feature: Encodes the peptide sequence at SEQ ID NO 1534
atgacgcctcccggccaactgctccccttggcccggccgcctccgccgcctcccgtcctatccagccgccgcagccggtgcccgcctcccgcccacgcgcacgccggagactcgcctctgcctccatggcgggcccaccgcctccatggccgcttcatgccttctccccagctgttccgggctccagcctggccccctcgtgccccgacatctccaggggtttcggccgccgcaggtggcgaggctcaggcggctgcggtggcggagttcgtgacgtcggagagggtgaaggtggcggcgatgctggggctagccctcgcgctctgcaacgccgaccgcgtcgtcatgtccgtcgccatcgtccctctctcgcaggcgtacgggtggaccccgtcattcgccggcgtcgtgcagtcatcctttctttggggatatctgatgtcgccgataattggtggagcgcttgttgactactatggtggaaaacgagtcatggcttacggtgtagccttatggtccttggctacattcctgtctccctgggcagctggtcgatctatctggttgtttctctttaccagagtcctgctgggtattgcagaaggagtggcactcccaagcatgaacaacatggtgttgaggtggtttcctcgtacagagagatctagtgctgtgggtattgcaatggctggctttcagcttggcaatgccattgggttacttctttccccaattatcatgtcacgaactggaatctttggaccttttgcgatatttggattatttggatttctgtgggtgttggtgtggataccagctatatctggcacaccaagtgaacatgcacagatatcagcatatgaactggaatatataaccaaaggtcagaaattggtgaaacctcaaattggaagtgaaaaaacgaaaaaggttccccctttgagtaaactgctttccaaatggccaacatgggctttgatttgtgcaaacgccatgcatagctggggttattttgttattctttcatggatgccagtctattttaaaacaatatatcatgtcaatctgagagaagctgcttggttcagtgcactcccttgggtgatgatggcagttttaggctatgtggctggtgttgtatcggacatgcttattagaaatggtacaaacattactttaacacggaagataatgcagtcaattggctttctggggccaggtattgctttgctctgtctgaatgcagcaaagagtccaatcattgcttcagcctggcttacaattgctgttggtttgaaatccttcggccactcaggtttcttagtaaatctacaggagattgccccacaatatgctggagtcctacacggaatgtcaaatacagctgggacatttgctgccattctaggaactattggagcaggattttttgttgatcagatgggttctttccgtggatttttgatattgacgtcggttttatacttcagcagtgctattttctgggatatctttgctactggagagcgtgttgattttgatggcactggctag

SEQ ID NO: 1534 - protein, 517 aa, Sorghum bicolor
  misc_feature: Ceres ANNOT ID no. 6016189
  misc_feature (102)..(471): Pfam Id: MFS_1 Pfam Desc: Major Facilitator Superfamily
  misc_feature (98)..(509): Pfam Id: Sugar_tr Pfam Desc: Sugar (and other) transporter
  misc_feature (1)..(517): NCBI GI: 20805189 NCBI Desc: p0529h11.31 [oryza sativa (japonica cultivar-group)]
  misc_feature (139)..(517): NCBI GI: 115441093 NCBI Desc: os01g0852200 [oryza sativa (japonica cultivar-group)]
  misc_feature (88)..(516): NCBI GI: 51536596 NCBI Desc: at3g46980 [arabidopsis thaliana]
  misc_feature (88)..(516): NCBI GI: 79314547 NCBI Desc: carbohydrate transporter/ sugar porter [arabidopsis thaliana]
  misc_feature (88)..(445): NCBI GI: 42572593 NCBI Desc: transporter-related [arabidopsis thaliana]
  misc_feature: The sequence is a functional homolog of SEQ ID NO. 296 in the 11/188,298 US application
MTPPGQLLPLARPPPPPPVLSSRRSRCPPPAHAHAGDSPLPPWRAHRLHGRFMPSPQLFRAPAWPPRAPTSPGVSAAAGGEAQAAAVAEFVTSERVKVAAMLGLALALCNADRVVMSVAIVPLSQAYGWTPSFAGVVQSSFLWGYLMSPIIGGALVDYYGGKRVMAYGVALWSLATFLSPWAAGRSIWLFLFTRVLLGIAEGVALPSMNNMVLRWFPRTERSSAVGIAMAGFQLGNAIGLLLSPIIMSRTGIFGPFAIFGLFGFLWVLVWIPAISGTPSEHAQISAYELEYITKGQKLVKPQIGSEKTKKVPPLSKLLSKWPTWALICANAMHSWGYFVILSWMPVYFKTIYHVNLREAAWFSALPWVMMAVLGYVAGVVSDMLIRNGTNITLTRKIMQSIGFLGPGIALLCLNAAKSPIIASAWLTIAVGLKSFGHSGFLVNLQEIAPQYAGVLHGMSNTAGTFAAILGTIGAGFFVDQMGSFRGFLILTSVLYFSSAIFWDIFATGERVDFDGTG

SEQ ID NO: 1535 - DNA, 879 bp, Sorghum bicolor
  misc_feature: Ceres ANNOT ID no. 6016205
  misc_feature: Encodes the peptide sequence at SEQ ID NO 1536
atgatggcggaggcagcgtggacgccggtgctgtttccgccgacggtgccctgtttctggcagcctgacacgcacccggttttttggcggagaggagacgcgtggacggcggaggagaacaagaagttcgagaaggcgctggcgctgatcgaccggaacgcgcccgaccggtgggagaaggtggcggagctgctgcccaggaagacggccgacgacgtgaggaaccactaccacgacctcgagaacgacgtcggctacatcgaggccgggctcgtgccgttcccgcactacagcagctcggtcccgtcgtccgggttcaccctcgaggactgggacgcgtacggcggcggcggcggcgggttcaggcgcggcggctactgcctcaagcgctcgcgcgggtcggaccaggagcggaagaagggtgtcccctggacggaggaggagcacaagcttttcttgatgggactgaagaagtacgggagaggggactggcggaacatctcgcgcaagtacgtgacgacccggacgccgacgcaggtggccagccacgcgcagaagtacttcatccggctcaactctggcggcaaggacaagcgccggtccagcatccacgacatcaccaccgtgaacctccccgacgaagaccgcggcaacgccacgccgccctcgccgccgtccgcggtcaccgccgccaacccctccgtcgccgccctggtggacgtgaagcccttcatggcgccgctcccagctggcgcgctcggcggcgtgacgcacccctacgtcaacgtgaagctggagcccaagagctcgctcgtggccggcctcggcctgggcttcgacgactccgtcttcctgcagatgcattgcgggcagttgtga

SEQ ID NO: 1536 - protein, 292 aa, Sorghum bicolor
  misc_feature: Ceres ANNOT ID no. 6016205
  misc_feature (32)..(81): Pfam Id: Myb_DNA-binding Pfam Desc: Myb-like DNA-binding domain
  misc_feature (141)..(188): Pfam Id: Myb_DNA-binding Pfam Desc: Myb-like DNA-binding domain
  misc_feature (35)..(244): NCBI GI: 18874263 NCBI Desc: myb-like transcription factor divaricata [antirrhinum majus]
  misc_feature (29)..(290): NCBI GI: 115434468 NCBI Desc: os01g0142500 [oryza sativa (japonica cultivar-group)]
  misc_feature (31)..(238): NCBI GI: 51557078 NCBI Desc: myb transcription factor [hevea brasiliensis]
  misc_feature (31)..(238): NCBI GI: 84314023 NCBI Desc: myb transcription factor [hevea brasiliensis]
  misc_feature (31)..(233): NCBI GI: 124494160 NCBI Desc: transcription factor div2 [bournea leiophylla]
  misc_feature: The sequence is a functional homolog of SEQ ID NO 1000 in the 10/225,066US patent application
  misc_feature: The sequence is a functional homolog of SEQ ID NO 120 in the 11/375,241US patent application
  misc_feature: The sequence is a functional homolog of SEQ ID NO 1885 in the 11/479,226US patent application
  misc_feature: The sequence is a functional homolog of SEQ ID NO 1897 in the 11/479,226US patent application
  misc_feature: The sequence is a functional homolog of SEQ ID NO 2680 in the 10/374,780US patent application
  misc_feature: The sequence is a functional homolog of SEQ ID NO 274 in the 10/714,887US patent application
  misc_feature: The sequence is a functional homolog of SEQ ID NO 274 in the 11/435,388US patent application
  misc_feature: The sequence is a functional homolog of SEQ ID NO 2850 in the 10/374,780US patent application
  misc_feature: The sequence is a functional homolog of SEQ ID NO 290 in the 10/374,780US patent application
  misc_feature: The sequence is a functional homolog of SEQ ID NO 306 in the 10/374,780US patent application
  misc_feature: The sequence is a functional homolog of SEQ ID NO 50 in the 10/286,264US patent application
  misc_feature: The sequence is a functional homolog of SEQ ID NO 6 in the 10/225,066US patent application
  misc_feature: The sequence is a functional homolog of SEQ ID NO 654 in the 10/225,066US patent application
  misc_feature: The sequence is a functional homolog of SEQ ID NO 694 in the 10/225,066US patent application
  misc_feature: The sequence is a functional homolog of SEQ ID NO 928 in the 10/412,699US patent application
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13278
  misc_feature: The sequence is a functional homolog of SEQ ID NO 50 in the 20030093837 US patent application
  misc_feature: The sequence is a functional homolog of SEQ ID NO 6 in the 20050160493 US patent application
  misc_feature: The sequence is a functional homolog of SEQ ID NO 654 in the 20050160493 US patent application
  misc_feature: The sequence is a functional homolog of SEQ ID NO 694 in the 20050160493 US patent application
  misc_feature: The sequence is a functional homolog of SEQ ID NO 1897 in the 20070022495 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: The sequence is a functional homolog of SEQ ID NO 1897 in the 11/479,226 US patent application
  misc_feature: The sequence is a functional homolog of SEQ ID NO 22 in the 10/225,066 US patent application
  misc_feature: The sequence is a functional homolog of SEQ ID NO 2870 in the 10/374,780 US patent application
  misc_feature: The sequence is a functional homolog of SEQ ID NO 886 in the 11/435,388 US patent application
  misc_feature: The sequence is a functional homolog of SEQ ID NO 1000 in the 10/225,066 US patent application
  misc_feature: The sequence is a functional homolog of SEQ ID NO 1885 in the 11/479,226 US patent application
  misc_feature: The sequence is a functional homolog of SEQ ID NO 274 in the 10/714,887 US patent application
  misc_feature: The sequence is a functional homolog of SEQ ID NO 274 in the 11/435,388 US patent application
  misc_feature: The sequence is a functional homolog of SEQ ID NO 306 in the 10/374,780 US patent application
  misc_feature: The sequence is a functional homolog of SEQ ID NO 50 in the 10/286,264 US patent application
  misc_feature: The sequence is a functional homolog of SEQ ID NO 928 in the 10/412,699 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
  misc_feature: Useful for making plants with altered alkaloid content
  misc_feature: Functional homolog of the protein sequence given in SEQ ID NO 13278
  misc_feature: The sequence is a functional homolog of SEQ ID NO 36 in the 10/286,264 US patent application
  misc_feature: The sequence is a functional homolog of SEQ ID NO 864 in the 10/412,699 US patent application
  misc_feature: The sequence is a functional homolog of SEQ ID NO 1893 in the 11/479,226 US patent application
  misc_feature: The sequence is a functional homolog of SEQ ID NO 2678 in the 10/374,780 US patent application
  misc_feature: The sequence is a functional homolog of SEQ ID NO 340 in the 10/225,066 US patent application
  misc_feature: Useful for making plants with altered lignin content
  misc_feature: Functional homolog of the protein sequence given in SEQ ID NO 13095
  misc_feature: The sequence is a functional homolog of SEQ ID NO. 514 in the 11/188,298 US application
MMAEAAWTPVLFPPTVPCFWQPDTHPVFWRRGDAWTAEENKKFEKALALIDRNAPDRWEKVAELLPRKTADDVRNHYHDLENDVGYIEAGLVPFPHYSSSVPSSGFTLEDWDAYGGGGGGFRRGGYCLKRSRGSDQERKKGVPWTEEEHKLFLMGLKKYGRGDWRNISRKYVTTRTPTQVASHAQKYFIRLNSGGKDKRRSSIHDITTVNLPDEDRGNATPPSPPSAVTAANPSVAALVDVKPFMAPLPAGALGGVTHPYVNVKLEPKSSLVAGLGLGFDDSVFLQMHCGQL

SEQ ID NO: 1537 - DNA, 1281 bp, Sorghum bicolor
  misc_feature: Ceres ANNOT ID no. 6016219
  misc_feature: Encodes the peptide sequence at SEQ ID NO 1538
atgcggcaccaccaagcctgcagccgcgctcaccaggtgggcgctctgctcctcgtcgctgccaccttcctcctcacccgcctcttcgaccgcctcctcctcgacacatcttcctccgccgccataaaccccggcaggccctcctctcccgctgacctccgcatctacgtctacgctgaggacgagatccagggccttcgcgctctgctccggggacgcgacggcaccatcaccgccgccacatgcctcaagggccaatggggcacccaggtcaagatccaccagtttcttctaaagtcaaggttcaggacattcaacaaggatcaagcaaatctcttctttgttccaagctatgtcaagtgtgttcgcatgacaggggcactaagtgacaaggaaatcaatcagacctatgtcaaggttctgagtcagatgccatatttccgtagatcaggtgggcgtgaccacatttttgtcttcccaagtggtgcaggagctcatctgtttcgctcgtgggcaacatttctgaatcgatctattatccgtactccagagggcgaccggactgataaacgcggtacgagtgcatttaatacatggaaagatattattatacctgggaacgtggatgattctatggtgaagtctgatgctcgtgctgtccaaccaatcccactaacaaaaaggaagtacttggccaacttccttggacgtgcccaggggaaagcagggcgccttcaactggtagagcttgcaaagcagtatcctgacaagctggaatctcctgtactcaagttatctggccccaacaaattgggaaggatcgagtacttcaagcacctgagaaatgcaaagttctgcttggctccacgtggagagtcatcttggacacttcggttctatgagtccttctttgtggaatgtgtgccggtgattttgtcagatgaagttgagcttcctttccagaatgtgatcgactacggtgaaatctcgataaagtggccatcgtccaggattggacctgaactccttgagtaccttgaatcaatatcagatgaaaggatcgaggaaatgattggtcatgggcgtcagatgagatgcttgtgggtgtatgcagctgatactgagccgtgctctgccatgagcggtatcctgacagagctgcagaagaaagttcggcggttccatcaatcgcctgaaacgttctggctgcacaacagatcgattgtgaatagggatctgattgagttccacagctggaggacgcctgttccgttgccatga

SEQ ID NO: 1538 - protein, 426 aa, Sorghum bicolor
  misc_feature: Ceres ANNOT ID no. 6016219
  misc_feature (55)..(361): Pfam Id: Exostosin Pfam Desc: Exostosin family
  misc_feature (49)..(426): NCBI GI: 18394994 NCBI Desc: exostosin family protein [arabidopsis thaliana]
  misc_feature (49)..(426): NCBI GI: 18650643 NCBI Desc: at1g21480/f24j8_23 [arabidopsis thaliana]
  misc_feature (49)..(350): NCBI GI: 42571577 NCBI Desc: exostosin family protein [arabidopsis thaliana]
  misc_feature (54)..(365): NCBI GI: 15239388 NCBI Desc: exostosin family protein [arabidopsis thaliana]
  misc_feature (95)..(376): NCBI GI: 55297674 NCBI Desc: exostosin family protein-like [oryza sativa (japonica cultivar-group)]
  misc_feature: Useful for making plants with altered cell wall content and/or composition
  misc_feature: GREAT-hit functional homolog of the protein sequence encoded by LOCUS at1g21480
  misc_feature: Useful for making plants with altered cell wall content and/or composition
  misc_feature: Functional homolog of the protein sequence given in SEQ ID NO 13749
  misc_feature: Useful for making plants with altered carbohydrate content
  misc_feature: Functional homolog of the protein sequence given in SEQ ID NO 13750
MRHHQACSRAHQVGALLLVAATFLLTRLFDRLLLDTSSSAAINPGRPSSPADLRIYVYAEDEIQGLRALLRGRDGTITAATCLKGQWGTQVKIHQFLLKSRFRTFNKDQANLFFVPSYVKCVRMTGALSDKEINQTYVKVLSQMPYFRRSGGRDHIFVFPSGAGAHLFRSWATFLNRSIIRTPEGDRTDKRGTSAFNTWKDIIIPGNVDDSMVKSDARAVQPIPLTKRKYLANFLGRAQGKAGRLQLVELAKQYPDKLESPVLKLSGPNKLGRIEYFKHLRNAKFCLAPRGESSWTLRFYESFFVECVPVILSDEVELPFQNVIDYGEISIKWPSSRIGPELLEYLESISDERIEEMIGHGRQMRCLWVYAADTEPCSAMSGILTELQKKVRRFHQSPETFWLHNRSIVNRDLIEFHSWRTPVPLP

SEQ ID NO: 1539 - DNA, 1362 bp, Sorghum bicolor
  misc_feature: Ceres ANNOT ID no. 6016235
  misc_feature: Encodes the peptide sequence at SEQ ID NO 1540
atggcaacgcccaagctgtccccggtctcaccggtgcggcgggacgacaagccgtgcgcgccatcctcctcctcgtcgactgttctgagggtgcaggacgcgtccgcggccgaggcgtacgagcagtacctacgcctgccggagctgtcgagcctgtggaaggccgggtgcttccctgagtgggcgggcgagggcctggtcaagccggcgctgcaggcgctcgaggtcaccttccgcttcgcgtccctcgcgctctccgacccgcgcggctacgccagccgccgcgagctcgcgcgccggctcgagtccctcgcggcgcgggaggtggagctggtgtccgcgctctgcgagggcgacgaccgcagcgcgccgctcgccgagctgagcgcctccgggggcgtgctcccgcgggagcgcagcgcgtccgaggtgtggcagctgcccgggagcgccgccgccgtcgtgtgccaggtcagcgaggccagcctgctcccgcgcctcgccgcgtgggacaagtccgagacgctcgctgccaagatcatgtacgccatcgagagccagatgcagggctgcgccttcacgctcggcctcggcgagcccaacctcgccggcaagcccgtgctccagtacgaccgcgtcgtgcgcccgcacgagctgcacgcgctcaagcccaagccggcgccggagcccaagtctgggtaccgcaaccgggagcacgagacgctgttcaccatgtaccagatactcgagtcatggctgcgcgccgcgtcgcagctcctcacccgcctcaacgaacggatcgaagccagagctgggaggcggcggccagcgactgctggatcctggagcgcgtgtggaagctgctcgccgacgtcgaggacctccacctgctcatggacccggacgacttcctgcggctcaagagccagctcgctggcgcttctgcacgtcgctaacaccactagggacctcaagaagcgtgtgccctgggtgcttggtgtcgaggtcgatcccaacggcggcccacgggtgcaggaggcggccatgaagctgtaccacagccgtaggcgcggcgagggtgaggatgcaggcaaggtggggctgctccaggccttccaggcagtggaggtggccgtgagaggattcttcttcgcgtaccggcagctggtggcggcggtgatgggcacggcggaggcgtcgggcaaccgggcgctgttcgtgccggcggaggggatggatccgctcgcccagatgttcctcgagccgccctactaccccagcctggacgccgccaagacgttcttggcggattactgggttcagcagatggcgggggcctctgctccgtcaagacaaagctag

SEQ ID NO: 1540 - protein, 453 aa, Sorghum bicolor
  misc_feature: Ceres ANNOT ID no. 6016235
  misc_feature (188)..(442): Pfam Id: Hs1pro-1_C Pfam Desc: Hs1pro-1 protein C-terminus
  misc_feature (1)..(185): Pfam Id: Hs1pro-1_N Pfam Desc: Hs1pro-1 N-terminus
  misc_feature (311)..(441): NCBI GI: 75037088 NCBI Desc: akinbetagamma-interacting protein 1 [arabidopsis thaliana]
  misc_feature (311)..(441): NCBI GI: 21553529 NCBI Desc: nematode resistance protein-like protein [arabidopsis thaliana]
  misc_feature (1)..(223): NCBI GI: 71725939 NCBI Desc: nematode resistance protein [beta procumbens]
  misc_feature (311)..(447): NCBI GI: 1850968 NCBI Desc: hs1pro-1 [beta procumbens]
MATPKLSPVSPVRRDDKPCAPSSSSSTVLRVQDASAAEAYEQYLRLPELSSLWKAGCFPEWAGEGLVKPALQALEVTFRFASLALSDPRGYASRRELARRLESLAAREVELVSALCEGDDRSAPLAELSASGGVLPRERSASEVWQLPGSAAAVVCQVSEASLLPRLAAWDKSETLAAKIMYAIESQMQGCAFTLGLGEPNLAGKPVLQYDRVVRPHELHALKPKPAPEPKSGYRNREHETLFTMYQILESWLRAASQLLTRLNERIEARAGRRRPATAGSWSACGSCSPTSRTSTCSWTRTTSCGSRASSLALLHVANTTRDLKKRVPWVLGVEVDPNGGPRVQEAAMKLYHSRRRGEGEDAGKVGLLQAFQAVEVAVRGFFFAYRQLVAAVMGTAEASGNRALFVPAEGMDPLAQMFLEPPYYPSLDAAKTFLADYWVQQMAGASAPSRQS

SEQ ID NO: 1541 - DNA, 864 bp, Sorghum bicolor
  misc_feature: Ceres ANNOT ID no. 6016246
  misc_feature: Encodes the peptide sequence at SEQ ID NO 1542
atgccgttctcccaccactccccagctgctacaagtcagctactcgccccttcccgccgcacgctcctattgccattgccatgcccgcgagccggcgcgaccccggcggccgaagctgtgctcctacccggcgggctgcgagcggagtcgctgccacgacacgtggctgtagtgatggacgggaactcgcggtgggcgcgcgcgcgcgggctgccgtccgcggccgggcacgaggccgggcgccgcgcgctggaggaggtggtgcggctctcccgcgcctggggcgtccgcgcgctcaccgcctttgccttctcccacgagaactggagccggcccagggtggaagtggaattcttgatggggcagtttgagcgagcgatccgcgaaagcgtagctgaatttctgagggacggaattcggctacgtgtaatcggcgactcctcaagactgccggtttctcttcagaagatcgcgagagaagccgaggaggccacacggagcaactcgcagctcgacctgacactggcaatcagctacagcgggcggagggacatagtccaagcatgccggaacctcgctcagaaggtgcacgacaagctgctcaggccggaggacatcgacgaaactatcttcgccgatgagctcgagacgagccatgccaacgccgagctccctaattaccctgacctgctcatcagaaccagcggcgagctgcggctgagcaacttcctgctgtggcagtcggcgtacgcggagctcttcttcacggacacgctgtggcccgacttcggagaggccgactacctcgaggcactggtctccttccagagcagagacaggcgtttcggggtaaggaaattgtag

SEQ ID NO: 1542 - protein, 287 aa, Sorghum bicolor
  misc_feature: Ceres ANNOT ID no. 6016246
  misc_feature (58)..(284): Pfam Id: Prenyltransf Pfam Desc: Putative undecaprenyl diphosphate synthase
  misc_feature (42)..(283): NCBI GI: 75907137 NCBI Desc: di-trans-poly-cis-decaprenylcistransferase [anabaena variabilis atcc 29413]
  misc_feature (42)..(283): NCBI GI: 17230487 NCBI Desc: undecaprenyl pyrophosphate synthetase [nostoc sp. pcc 7120]
  misc_feature (42)..(283): NCBI GI: 86607493 NCBI Desc: undecaprenyl diphosphate synthase [cyanobacteria bacterium yellowstone a-prime]
  misc_feature (37)..(283): NCBI GI: 86609106 NCBI Desc: undecaprenyl diphosphate synthase [cyanobacteria bacterium yellowstone b-prime]
  misc_feature (34)..(283): NCBI GI: 42559749 NCBI Desc: undecaprenyl pyrophosphate synthetase (upp synthetase) (di-trans-poly-cis-decaprenylcistransferase) (undecaprenyl diphosphate synthase) (uds)
  misc_feature (42)..(283): SWISSPROT Homolog: EC 2.5.1.31 Undecaprenyl pyrophosphate synthetase
MPFSHHSPAATSQLLAPSRRTLLLPLPCPRAGATPAAEAVLLPGGLRAESLPRHVAVVMDGNSRWARARGLPSAAGHEAGRRALEEVVRLSRAWGVRALTAFAFSHENWSRPRVEVEFLMGQFERAIRESVAEFLRDGIRLRVIGDSSRLPVSLQKIAREAEEATRSNSQLDLTLAISYSGRRDIVQACRNLAQKVHDKLLRPEDIDETIFADELETSHANAELPNYPDLLIRTSGELRLSNFLLWQSAYAELFFTDTLWPDFGEADYLEALVSFQSRDRRFGVRKL

SEQ ID NO: 1543 - DNA, 2094 bp, Sorghum bicolor
  misc_feature: Ceres ANNOT ID no. 6016249
  misc_feature: Encodes the peptide sequence at SEQ ID NO 1544
atgtcgtcgacctccggcgctctgccgcagcctcgccgcgggcgtcccggcccctggccccctgcgccgcccccgcagccgcaggcgcagcccctctcctgggctaagcgcacgggcttccagtcccgcgtctccggcgagtcactgccttcggcttccgcccccaactccggtcaggtccccctccctcgacccggtgagcgcccttccgatctagagtcgggcccgccggcccggcccagctccactctccctgcccctcctgccgccgcgggaaatggcgagcggcagcatcccccgccgccgcctcctcaggcgaggacgaggaggagggactccgatggcggaaggccgaacggccaggcggccgcgccttcgcttccgcggctacaggaggaggaggaggcgccggagcggtcggctcatgtgaagtacgagctccgtgacactcctggaatgcgtaagtgcccgacgggggaagagaaatgtgcacgggtgatgtgtgttcctctggtggtatacggattccagcattacatttccatggtcggttcaatcatcctgatccctctcgtgatggtccctgctatgggcggctcggctgatgacatggcggcagtggtgtccacagtgttgctcgtcaccgggatgactacattgctgcacatgtttgttggaacgagactgccacttgtacagggtccatcctttgtatacctggctcctgcactcgcgatcatcaactccccagaattctttgggctcaatgataataattttaaacacataatgaagcacctgcagggagctataataattggaggtgcattccaagtggtattgggatatacaggactcatgtcactatttcttaggttgataaatccagttgtcgtctcaccaacagttgcagctgttgggctttcatttttcagttatggttttgctaaaatagggacatgtatagagatgggaattttgcagttgttgatggtggttatttttgcactttatctccggaaaataaagttatttgggtacagagtatttcttatttatgcggttcctcttggattaggaatcacatgggctgttgcttttgttctcaccgcaactggagtttatagctacaaaggttgtgatgcaaatattcctgcctcaaacaatgtatcagccttttgtcggaagcatgtattgaggatgaaatcttgccgtgtagacacttcacatgccttaagatcttcaccctggttcagatttccctatccattgcaatggggaactccagtttttagctggaaaatgggccttgtgatgtgtgttgtatcagttattgcttctgttgattcagtcggttcctaccatgcatcatctttgtttgtggctacccggccaccaacatctggagttgttagcagaggtattggtgttgagggtgtatctacagtattggctggtctttggggtacaggagttggttctgcaacgataacagagaatgtacacacaattgctgtgactaaaatgggtagccgaagagcagttggatttggtgctattttactcgtactgctttctattattggaaaagtcggtgccttcattgcttctattcctgatgttatggttgctgctctcctttgcttcatgtgggctatgctctgtgctcttggcttgtccaaccttcgttacagtgctactggaagctctaggaacagcattatagttgggctggctctattcttgtccctatcagttccttcatacttccagcagtacggtgtacatcctagcgcaaactcatcagtgccaacttactttcaaccatacattgttgcatctcatggacctgttcacactggatctggcggggtgaactatgtcctcaacacggtactttcactcaacatggtcattgcatttctggttgctctgatacttgacaacacagtccctggcggtcgtcaagagcgggggttgtatgtatggtcagaagtggaggcagcgaagagagaatcggctttcatcaaagactatgaacttcctttcaatattggacgcctgttcaggtgggtgaagtgtgttggcctatag

SEQ ID NO: 1544 - protein, 697 aa, Sorghum bicolor
  misc_feature: Ceres ANNOT ID no. 6016249
  misc_feature (169)..(592): Pfam Id: Xan_ur_permease Pfam Desc: Permease family
  misc_feature (3)..(577): NCBI GI: 79602299 NCBI Desc: permease [arabidopsis thaliana]
  misc_feature (15)..(689): NCBI GI: 79499196 NCBI Desc: permease [arabidopsis thaliana]
  misc_feature (3)..(530): NCBI GI: 145329969 NCBI Desc: xanthine/uracil permease family protein [arabidopsis thaliana]
  misc_feature (400)..(696): NCBI GI: 124359581 NCBI Desc: xanthine/uracil/vitamin c permease [medicago truncatula]
  misc_feature (451)..(697): NCBI GI: 56784827 NCBI Desc: nucleobase-ascorbate transporter-like protein [oryza sativa (japonica cultivar-group)]
MSSTSGALPQPRRGRPGPWPPAPPPQPQAQPLSWAKRTGFQSRVSGESLPSASAPNSGQVPLPRPGERPSDLESGPPARPSSTLPAPPAAAGNGERQHPPPPPPQARTRRRDSDGGRPNGQAAAPSLPRLQEEEEAPERSAHVKYELRDTPGMRKCPTGEEKCARVMCVPLVVYGFQHYISMVGSIILIPLVMVPAMGGSADDMAAVVSTVLLVTGMTTLLHMFVGTRLPLVQGPSFVYLAPALAIINSPEFFGLNDNNFKHIMKHLQGAIIIGGAFQVVLGYTGLMSLFLRLINPVVVSPTVAAVGLSFFSYGFAKIGTCIEMGILQLLMVVIFALYLRKIKLFGYRVFLIYAVPLGLGITWAVAFVLTATGVYSYKGCDANIPASNNVSAFCRKHVLRMKSCRVDTSHALRSSPWFRFPYPLQWGTPVFSWKMGLVMCVVSVIASVDSVGSYHASSLFVATRPPTSGVVSRGIGVEGVSTVLAGLWGTGVGSATITENVHTIAVTKMGSRRAVGFGAILLVLLSIIGKVGAFIASIPDVMVAALLCFMWAMLCALGLSNLRYSATGSSRNSIIVGLALFLSLSVPSYFQQYGVHPSANSSVPTYFQPYIVASHGPVHTGSGGVNYVLNTVLSLNMVIAFLVALILDNTVPGGRQERGLYVWSEVEAAKRESAFIKDYELPFNIGRLFRWVKCVGL

SEQ ID NO: 1545 - DNA, 945 bp, Sorghum bicolor
  misc_feature: Ceres ANNOT ID no. 6016259
  misc_feature: Encodes the peptide sequence at SEQ ID NO 1546
atggctggatccattaacacatcccagatgaggccaggagcaatatctggtccgcagcagcccagacctggacttccatcatcaacaactactatcccatctggtagccaaatgccaggttcacaaagagccccctctcagtctttaatgaggccgatgactgtgagttctccttctcctttgccggcttcacagcaaactccacaaagttcatcttcaacatttaggccccaacagaggccacaaatttcgcaaccaagaccacaacaatctgcacctgtgactccacctcaacagaacataattttaacacagcagcagcagcagcagcagcagcagcatcagaagcaacaacaacagagttcctcacatcaaaatcaacaaagtactgccccaaaaaatcagccacaactttctcagcagccagccgctcgtactccaatatcaatgacaccaaagcctgattcaccagctgtaccaaatgttgctgttttacaatctgtggatgcagctgcaactgatgcaaatggtagtgaaactggtgctcgactaatcaccaagagaagcatacatgaattagttgcacagattgatcctaatgaaaaactggatcctgaagttgaagatgttcttattgacatcgcggaagattttgttgagtctgtcacaacatttgcttgttctttagcaaagcataggaagtcaagcacattagaagcaaaagatgtacttctccatgcagagagaagctggaatatcaccttgccaggcttcagtggtgatgaaatcaaactatacaagaaacagcacataaatgatattcacagggagaggcttgctctgatcaagaagtccatggcgactgacacaagaatctctgctgcccaagcagcagctaaccagaaaaaccagactccgaaaccacctgccccagcttccccgtga

SEQ ID NO: 1546 - protein, 314 aa, Sorghum bicolor
  misc_feature: Ceres ANNOT ID no. 6016259
  misc_feature (186)..(253): Pfam Id: TFIID_20kDa Pfam Desc: Transcription initiation factor TFIID subunit A
  misc_feature (16)..(314): NCBI GI: 115441161 NCBI Desc: os01g0858500 [oryza sativa (japonica cultivar-group)]
  misc_feature (2)..(310): NCBI GI: 77403675 NCBI Desc: tata binding protein associated factor [solanum tuberosum]
  misc_feature (15)..(312): NCBI GI: 92894903 NCBI Desc: histone-fold [medicago truncatula]
  misc_feature (28)..(262): NCBI GI: 8778478 NCBI Desc: f1l3.13 [arabidopsis thaliana]
  misc_feature (41)..(258): NCBI GI: 56784706 NCBI Desc: transcription initiation factor iid (tfiid) subunit a-like protein [oryza sativa (japonica cultivar-group)]
  misc_feature: The sequence is a functional homolog of SEQ ID NO 824 in the 10/374,780US patent application
  misc_feature: Useful for making plants with modulated growth and phenotype characteristics
  misc_feature: The sequence is a functional homolog of SEQ ID NO 824 in the 20060162006 US patent application
MAGSINTSQMRPGAISGPQQPRPGLPSSTTTIPSGSQMPGSQRAPSQSLMRPMTVSSPSPLPASQQTPQSSSSTFRPQQRPQISQPRPQQSAPVTPPQQNIILTQQQQQQQQQHQKQQQQSSSHQNQQSTAPKNQPQLSQQPAARTPISMTPKPDSPAVPNVAVLQSVDAAATDANGSETGARLITKRSIHELVAQIDPNEKLDPEVEDVLIDIAEDFVESVTTFACSLAKHRKSSTLEAKDVLLHAERSWNITLPGFSGDEIKLYKKQHINDIHRERLALIKKSMATDTRISAAQAAANQKNQTPKPPAPASP

SEQ ID NO: 1547 - DNA, 1158 bp, Sorghum bicolor
  misc_feature: Ceres ANNOT ID no. 6016263
  misc_feature: Encodes the peptide sequence at SEQ ID NO 1548
atggggccgcggacttgtgcggccatggaaggtgaggccgtcggcggctcgcctttcttccagtggctcaagccgcggcgatcgtcgtcgccatcgtcttcgcggtcgtcgtctggctcctcctcctcgtcgtcgtcgaccacgatggcggcgtcggctgggcatcatgaagcagtgaggccgagcagcatgacgtgcctgccgctgctcagcaggctcggtgaggggaaaggggccagtgacgatcacgagcagcagtgcacagtcaaagaagagatcatgagcggcggcggagacggcggtgcgaccagcgatctggccaagtccggcgtcgatttgaacatcggcttgccggttggtggatcctgcagcattgaggatgccatcatggaagaaaagggtgacgaggaggaggaagacgacgaagtggatcaggaggcgggtgaggacgagagcgaggagtggaagcatatgcatggcggctgcaaggtggaggggatggatctgcagcaggaggatgacgatcgggaagtggtgccgtcgtcggtggacggccgatcaaacaacatcgtcgtcggcgtgggggaattcggcgtggtgggtgaggagagcggcctgccgatcgccggctgccagtactggatcccgacgccggcgcagatcctcatcgggccggtgcagtttatctgccatgtctgtaacaagaccttcaacagatacaacaacatgcagatgcacatgtggggccacggccgcgagtaccgcaagggcccggagtcgctcaaggggacgcagacgctggcgctgctgaagctgccgtgctactgctgcgcggcggggtgcaagaacaacgtggcgcacccgcgcgcgcggccgctcaaggacttccgaaccctgcagacgcactacaagcgcaagcacggcgccaagcccttccgctgccgccgctgcgccaagcccttcgccgtcaagggcgactggcgcacgcacgagaagaactgcggcaagcgatggttctgcgcctgcggctccgacttcaagcacaagcgatccctcaacgaccacgtccgatccttcggcgccgaccacggccccgtcgacgagcccgccgccgccgccggagcaaaggatcgcatcgtacgtttccacaatcggtga

SEQ ID NO: 1548 - protein, 385 aa, Sorghum bicolor
  misc_feature: Ceres ANNOT ID no. 6016263
  misc_feature (1)..(382): NCBI GI: 115441169 NCBI Desc: os01g0859100 [oryza sativa (japonica cultivar-group)]
  misc_feature (213)..(365): NCBI GI: 9294415 NCBI Desc: zinc finger-like protein [arabidopsis thaliana]
  misc_feature (213)..(365): NCBI GI: 18376500 NCBI Desc: wip4 protein [arabidopsis thaliana]
  misc_feature (200)..(364): NCBI GI: 59958298 NCBI Desc: at3g57670 [arabidopsis thaliana]
  misc_feature (210)..(365): NCBI GI: 18376498 NCBI Desc: wip5 protein [arabidopsis thaliana]
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1785 in the 10/374,780US patent application
  misc_feature: Useful for making plants with modulated growth and phenotype characteristics
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: The sequence is a functional homolog of SEQ ID NO 1079 in the 10/666,642 US patent application
  misc_feature: The sequence is a functional homolog of SEQ ID NO 630 in the 10/666,642 US patent application
  misc_feature: The sequence is a functional homolog of SEQ ID NO 1074 in the 10/666,642 US patent application
  misc_feature: The sequence is a functional homolog of SEQ ID NO. 455 in the 11/188,298 US application
MGPRTCAAMEGEAVGGSPFFQWLKPRRSSSPSSSRSSSGSSSSSSSTTMAASAGHHEAVRPSSMTCLPLLSRLGEGKGASDDHEQQCTVKEEIMSGGGDGGATSDLAKSGVDLNIGLPVGGSCSIEDAIMEEKGDEEEEDDEVDQEAGEDESEEWKHMHGGCKVEGMDLQQEDDDREVVPSSVDGRSNNIVVGVGEFGVVGEESGLPIAGCQYWIPTPAQILIGPVQFICHVCNKTFNRYNNMQMHMWGHGREYRKGPESLKGTQTLALLKLPCYCCAAGCKNNVAHPRARPLKDFRTLQTHYKRKHGAKPFRCRRCAKPFAVKGDWRTHEKNCGKRWFCACGSDFKHKRSLNDHVRSFGADHGPVDEPAAAAGAKDRIVRFHNR

SEQ ID NO: 1549 - DNA, 1236 bp, Sorghum bicolor
  misc_feature: Ceres ANNOT ID no. 6016268
  misc_feature: Encodes the peptide sequence at SEQ ID NO 1550
atggcgtcggatatgagcaagaacgtgagggccctcgacgagcaggaggtcacctcgcagcagcgcgccggcaggaccagcgccgccgccaccgaggagcaggatccgctggcgcggcagtcgtccatcatgtcgctgacgctggaggagctgcagaactcgctgtgcgagccggggcgcaacttcgggtccatgaacatggacgagttcatggccaacatatggaacgccgaggagttccaggccgccaccggcaccggcggatgcagcaaggagggaacggagcgggagcccatgatgatgcccgtggcggcggcggcggcggggacaggtgagaacggagcaggagcgagcgggttggttcggcaggggtcgttcgcgctgccgccgccgctgtcccggaagacggtggaggaggtctgggccgagatcaaccaggaccccgcggattcccaggccaacgccaacgcgacgccgcaggccgtggtgcagccccagatggggagcggcggcgtcggcggtgtcgcgggcagcgggcggcaggtgacgctgggcgagatgacgctggaggacttcctggtgaaggccggcgtcgtgcggggggccttcgccggccacggcggccaggccgtcggcatggtcccggccgggccgatgggcatgcagcacgccgcggctcccatgatgtaccaagtggcggcgccggtgccgcacaacgccgtgtacccggtgatgggtgacggcatggggtaccacaacgggtaccctgggggcatggcggtggtgccgcctccgccgccgtctcagtgcgtggcggccgccgccgtcagcccggggtcgtcggacgggatgagcgcgatgacgcaggcggagatgatgaactgcattggcaacggagggatggtccggaacggcggtggcggcggcgcgcggaagcgcgactcccccgaggacgggtgcaccgagaagaccgtggagcgccggcagcggcgcatgatcaagaaccgcgaatcagcggcccggtcacgagccaggaagcaggcatataccgtggagcttgaggctgaactgaaccatctcaaggaggagaacgagcgcctcagagcagaggagaagacgattctgttatcgaagaaaaagatgctggtggagaagatgatggagcaggcaagggagaatgtgagcgccaagaagggcggtcgcgggctgcgccgctggggcagcgccatgtggtga

SEQ ID NO: 1550 - protein, 411 aa, Sorghum bicolor
  misc_feature: Ceres ANNOT ID no. 6016268
  misc_feature (323)..(377): Pfam Id: bZIP_2 Pfam Desc: Basic region leucine zipper
  misc_feature (322)..(386): Pfam Id: bZIP_1 Pfam Desc: bZIP transcription factor
  misc_feature (5)..(411): NCBI GI: 111115690 NCBI Desc: aba responsive element binding factor 1 [hordeum vulgare subsp. vulgare]
  misc_feature (38)..(411): NCBI GI: 117307414 NCBI Desc: bzip type transcription factor taabi5 [triticum aestivum]
  misc_feature (32)..(411): NCBI GI: 146275401 NCBI Desc: bzip type transcription factor tmabi5 [triticum monococcum]
  misc_feature (45)..(411): NCBI GI: 21693583 NCBI Desc: aba response element binding factor [triticum aestivum]
  misc_feature (32)..(411): NCBI GI: 21693585 NCBI Desc: aba response element binding factor [triticum aestivum]
  misc_feature: The sequence is a functional homolog of SEQ ID NO 1761 in the 10/374,780US patent application
  misc_feature: The sequence is a functional homolog of SEQ ID NO 1762 in the 10/374,780US patent application
  misc_feature: The sequence is a functional homolog of SEQ ID NO 338 in the 10/374,780US patent application
  misc_feature: The sequence is a functional homolog of SEQ ID NO 770 in the 10/225,066US patent application
  misc_feature: Useful for making plants with modulated growth and phenotype characteristics
  misc_feature: The sequence is a functional homolog of SEQ ID NO 770 in the 20050160493 US patent application
  misc_feature: The sequence is a functional homolog of SEQ ID NO 1761 in the 20060162006 US patent application
  misc_feature: The sequence is a functional homolog of SEQ ID NO 1762 in the 20060162006 US patent application
  misc_feature: The sequence is a functional homolog of SEQ ID NO 1761 in the 10/374,780 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MASDMSKNVRALDEQEVTSQQRAGRTSAAATEEQDPLARQSSIMSLTLEELQNSLCEPGRNFGSMNMDEFMANIWNAEEFQAATGTGGCSKEGTEREPMMMPVAAAAAGTGENGAGASGLVRQGSFALPPPLSRKTVEEVWAEINQDPADSQANANATPQAVVQPQMGSGGVGGVAGSGRQVTLGEMTLEDFLVKAGVVRGAFAGHGGQAVGMVPAGPMGMQHAAAPMMYQVAAPVPHNAVYPVMGDGMGYHNGYPGGMAVVPPPPPSQCVAAAAVSPGSSDGMSAMTQAEMMNCIGNGGMVRNGGGGGARKRDSPEDGCTEKTVERRQRRMIKNRESAARSRARKQAYTVELEAELNHLKEENERLRAEEKTILLSKKKMLVEKMMEQARENVSAKKGGRGLRRWGSAMW

SEQ ID NO: 1551 - DNA, 771 bp, Sorghum bicolor
  misc_feature: Ceres ANNOT ID no. 6016270
  misc_feature: Encodes the peptide sequence at SEQ ID NO 1552
atgggttggggaatatccaggttgattggactgaaggctgctgtcctgctttctgtggcgtgttttttccaaggactaggagtgacccttatctcatttcctctcatatatgcatccgtgattgcaatactaatctcgatagcttcccacccatcgattgatcttcctttactccttggcaaagcatctgatggaagttttccgttgtggtcatggatcatgttctcaccatttcttcttttcattcacctgtttgtgctgctacgaagatttgtgaaaaatgagcctttatacactgaggttgcagatggagtgtttgttggaggatggccttcttcggttgaacacctgccaccaggtgaccctgcaatcatagattgcacgtgtgagctgccaaaaagctcgactatatctaacaatgcatatctgtgtgttgctacctgggatacgagggctcctcagccatcacaaattgagtctgccgtgcgatgggctgtgagaaagcggtcacagaacaagcctgtctatgtccactgtgcctatggtcatggcagaagtgtctgtgtgatgtgcgcgcttcttgttgcattaggattggctgaagattggaaagctgctgagcaaatgatccgtgagaagcgaccttatattagcatgaacactcttcaccgcaaaagcttggaggaatggtcaaaacatttgctctcctctaaaagaagtggggaatcggatgtgagttctgttatccattcggattataaccagaaataa

SEQ ID NO: 1552 - protein, 256 aa, Sorghum bicolor
  misc_feature: Ceres ANNOT ID no. 6016270
  misc_feature (97)..(233): Pfam Id: DSPc Pfam Desc: Dual specificity phosphatase, catalytic domain
  misc_feature (5)..(228): NCBI GI: 113868069 NCBI Desc: membrane-associated ser/thr and tyr protein phosphatase (dual specificity) [ralstonia eutropha h16]
  misc_feature (8)..(238): NCBI GI: 109900386 NCBI Desc: diacylglycerol kinase, catalytic region [pseudoalteromonas atlantica t6c]
  misc_feature (11)..(229): NCBI GI: 88796605 NCBI Desc: methylglyoxal synthase [alteromonas macleodii 'deep ecotype']
  misc_feature (13)..(252): NCBI GI: 73537846 NCBI Desc: phosphoesterase, pa-phosphatase related:dual specificity protein phosphatase [ralstonia eutropha jmp134]
  misc_feature (15)..(242): NCBI GI: 119468673 NCBI Desc: methylglyoxal synthase [alteromonadales bacterium tw-7]
MGWGISRLIGLKAAVLLSVACFFQGLGVTLISFPLIYASVIAILISIASHPSIDLPLLLGKASDGSFPLWSWIMFSPFLLFIHLFVLLRRFVKNEPLYTEVADGVFVGGWPSSVEHLPPGDPAIIDCTCELPKSSTISNNAYLCVATWDTRAPQPSQIESAVRWAVRKRSQNKPVYVHCAYGHGRSVCVMCALLVALGLAEDWKAAEQMIREKRPYISMNTLHRKSLEEWSKHLLSSKRSGESDVSSVIHSDYNQK

SEQ ID NO: 1553 - DNA, 1566 bp, Sorghum bicolor
  misc_feature: Ceres ANNOT ID no. 6016271
  misc_feature: Encodes the peptide sequence at SEQ ID NO 1554
atggtgcacggcgaggagagttcttggaggatggagagggcagcgctgcctctcaaccaggcgttcgcgtatggagcccaagcccacgccgccgccgcaccgccgacctgcttcctggacttccagcctgcggcggcagccgctgcctacttcgggttcggggagctggaggaggccctcatccatggcggcggcggcgctggcaacgcccacggcgtcgatcccggcgtgatcatcaagaacgacgtcgcgcaggcaaagtcggcggcagcggcaggatatctcgcgggcgctggcaggccccccacgctggagatcttcccttcgtggcctgaggggaattcgcagtcagtagggagcaccactgactcgagctcagctcagaacacaatgtctcagatggagttggtgtccccagcctcctctgcgccgaggcaggaggtcatgatggtgaccactgatgattacagctacaagccaggcctcgccgctgcgcccgctgctgctgccgccccgccaccgagctttcagcagcaccacccgctcccgctgcagctgcacggaggagacggaggaggaggagggggagaccatgacaagaggaagcatggatccacaagaaaagatggcaagttggtagatgccaagacggaacggcggctggcgcagaacagagaggctgcgaggaagagcaggctgaggaagaagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggctggacgacgacagcaagcggctggcggagctccgagctgggctgcaggcgcagctgctggacggcaacctggggctcatcgtggaggagtgcatgcagcactacgacgagctgttccagctcaaggcggcgctcgcgcgctccgatgtcttccacctcctcaccggcgcctgggccaccgccgccgagcgctgcttcttctggatgggcggcttccgcccgtctgagctgctcaagatcctgataccgcagctggacccgctgacggagcagcagctgctggggatctgcaacctgcagcagtcgtcggagcaggcggaggaggcgctcgcccagggcctgcaccagctgcaccagtccctggccgacacagtcgccaccggcacgctcaacgacggcgccgccacccccaactacatgaacatcatggccgtcgcaattgataagctcgcctgcctagaaaacttctatcaacaggccgacaatctaaggcagcagacgttgcatcagatgcgccggatcctgaccactcggcaggctgcacggtgcttcctctccattggggagtactacagccgcctcagagctctcagcaacctctgggcttcccgtccccgcgacaacttcatcgggacagagagcctcagccccacagcaacggaactgcaagccctgcaccaccagcagcagaaccagttcactggattttga

SEQ ID NO: 1554 - protein, 521 aa, Sorghum bicolor
  misc_feature: Ceres ANNOT ID no. 6016271
  misc_feature (1)..(521): NCBI GI: 2865394 NCBI Desc: basic leucine zipper protein [zea mays]
  misc_feature (1)..(521): NCBI GI: 28630433 NCBI Desc: liguleless2-like protein [zea mays]
  misc_feature (38)..(521): NCBI GI: 115464157 NCBI Desc: os05g0443900 [oryza sativa (japonica cultivar-group)]
  misc_feature (203)..(521): NCBI GI: 62732726 NCBI Desc: bzip transcription factor [oryza sativa (japonica cultivar-group)]
  misc_feature (78)..(521): NCBI GI: 14272369 NCBI Desc: bzip transcription factor [arabidopsis thaliana]
  misc_feature: The sequence is a functional homolog of SEQ ID NO 1016 in the 10/225,066US patent application
  misc_feature: The sequence is a functional homolog of SEQ ID NO 1496 in the 10/374,780US patent application
  misc_feature: The sequence is a functional homolog of SEQ ID NO 1498 in the 10/374,780US patent application
  misc_feature: The sequence is a functional homolog of SEQ ID NO 156 in the 10/412,699US patent application
  misc_feature: The sequence is a functional homolog of SEQ ID NO 1566 in the 10/412,699US patent application
  misc_feature: The sequence is a functional homolog of SEQ ID NO 1568 in the 10/412,699US patent application
  misc_feature: The sequence is a functional homolog of SEQ ID NO 164 in the 10/412,699US patent application
  misc_feature: The sequence is a functional homolog of SEQ ID NO 1754 in the 10/412,699US patent application
  misc_feature: The sequence is a functional homolog of SEQ ID NO 1978 in the 10/374,780US patent application
  misc_feature: The sequence is a functional homolog of SEQ ID NO 2240 in the 10/374,780US patent application
  misc_feature: The sequence is a functional homolog of SEQ ID NO 242 in the 10/374,780US patent application
  misc_feature: The sequence is a functional homolog of SEQ ID NO 353 in the 11/479,226US patent application
  misc_feature: The sequence is a functional homolog of SEQ ID NO 369 in the 11/479,226US patent application
  misc_feature: The sequence is a functional homolog of SEQ ID NO 40 in the 10/374,780US patent application
  misc_feature: The sequence is a functional homolog of SEQ ID NO 580 in the 11/435,388US patent application
  misc_feature: The sequence is a functional homolog of SEQ ID NO 76 in the 10/412,699US patent application
  misc_feature: The sequence is a functional homolog of SEQ ID NO 764 in the 10/412,699US patent application
  misc_feature: The sequence is a functional homolog of SEQ ID NO 776 in the 10/225,066US patent application
  misc_feature: The sequence is a functional homolog of SEQ ID NO 826 in the 10/225,066US patent application
  misc_feature: The sequence is a functional homolog of SEQ ID NO 950 in the 11/435,388US patent application
  misc_feature: The sequence is a functional homolog of SEQ ID NO 96 in the 11/375,241US patent application
  misc_feature: Useful for making plants with modulated biomass
  misc_feature: Useful for making plants with modulated growth and phenotype characteristics
  misc_feature: GREAT-hit functional homolog of the protein sequence given in SEQ ID NO 13416
  misc_feature: The sequence is a functional homolog of SEQ ID NO 156 in the 20040045049 US patent application
  misc_feature: The sequence is a functional homolog of SEQ ID NO 1566 in the 20040045049 US patent application
  misc_feature: The sequence is a functional homolog of SEQ ID NO 1568 in the 20040045049 US patent application
  misc_feature: The sequence is a functional homolog of SEQ ID NO 76 in the 20040045049 US patent application
  misc_feature: The sequence is a functional homolog of SEQ ID NO 764 in the 20040045049 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: Useful for making plants with modulated flowering time
  misc_feature: Functional homolog of the protein sequence given in SEQ ID NO 13559
  misc_feature: Useful for making plants with altered lignin content
  misc_feature: Functional homolog of the protein sequence given in SEQ ID NO 13093
  misc_feature: The sequence is a functional homolog of SEQ ID NO 1798 in the 10/412,699 US patent application
  misc_feature: The sequence is a functional homolog of SEQ ID NO 2044 in the 10/374,780 US patent application
  misc_feature: The sequence is a functional homolog of SEQ ID NO 408 in the 10/412,699 US patent application
  misc_feature: The sequence is a functional homolog of SEQ ID NO 48 in the 10/286,264 US patent application
  misc_feature: The sequence is a functional homolog of SEQ ID NO 938 in the 11/435,388 US patent application
  misc_feature: The sequence is a functional homolog of SEQ ID NO 957 in the 11/479,226 US patent application
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
MVHGEESSWRMERAALPLNQAFAYGAQAHAAAAPPTCFLDFQPAAAAAAYFGFGELEEALIHGGGGAGNAHGVDPGVIIKNDVAQAKSAAAAGYLAGAGRPPTLEIFPSWPEGNSQSVGSTTDSSSAQNTMSQMELVSPASSAPRQEVMMVTTDDYSYKPGLAAAPAAAAAPPPSFQQHHPLPLQLHGGDGGGGGGDHDKRKHGSTRKDGKLVDAKTERRLAQNREAARKSRLRKKQLETSRIRLQQVEHELQRARSQGLFVGGCSAAGDMSSGAAMFDMEYARWLDDDSKRLAELRAGLQAQLLDGNLGLIVEECMQHYDELFQLKAALARSDVFHLLTGAWATAAERCFFWMGGFRPSELLKILIPQLDPLTEQQLLGICNLQQSSEQAEEALAQGLHQLHQSLADTVATGTLNDGAATPNYMNIMAVAIDKLACLENFYQQADNLRQQTLHQMRRILTTRQAARCFLSIGEYYSRLRALSNLWASRPRDNFIGTESLSPTATELQALHHQQQNQFTGF

SEQ ID NO: 1555 - DNA, 1254 bp, Sorghum bicolor
  misc_feature: Ceres ANNOT ID no. 6016273
  misc_feature: Encodes the peptide sequence at SEQ ID NO 1556
atggagcttctccctgttgaagtcgttggcaacattctttcccatcttggtgttgcgcgtgatgtcatggttgcctctgcggtatgccgcaagtggcgagatgcatgcaggaggcacctccgttcgctgtccttcaactccgatgactttccacgggacatgactacacgtcagttggagattgtcatcacacagactatatttcagactatggggctgcaatgcctttcgattcatatcgataacacccatgagttttctgcagcaccagtgattgcatggctcatgtataccagggagacactccggagcttgtcttacaatgtcaggacaacacccaatgtaaacattctggaaaagtgtggtaggcagaagctcgaagtgctagatttggatcataacaccatcacaggtgttgaaccaagctatcagaggttcacttgtctgaaatccctttccctgaggcatgtcagcatttcggccttggatttgagccttttagttgctgcttgcccgagaatagaatcattagcacttgatgtccttgaggttgtcacttcagactcacagtctacgatggagctcacatgccatacattgaaaagtctctttgcaaaatcggtaggtgtaaataagatcatacttgatgcagataatttggaagttctgcacctgaatgctttaaatcttgatctgtttgagcttaatgggaaaggaacactaaagcatcttaagattgatgatgtcagtgttactcatttggatattggggacaatactgatcatctggaggcagtagatgtgagcaatttcacaatagtctggccaaaattctatagcatgatatccagagcatctaatttgcttatgctacggttttggggtgttgtatttgatgacgaggatgagattgtggattcagaaactatagctgtttcatttcctcttcttaggcatctttcattgagttatgaattacgagatgggttacttcactacagccttcagggatcatcaccactggagaatgtctcagttctggaacttggttggacagtaataagtgagcactttggaccctgggtgtttggtatgattggaaggtgtccaaatctcaagaaacttgttattcatggtgttctttctgaggcaaaaacgcgagaggagcgccagatgttggcaagctttacctcattcatagtctgcctcatgaggaagtatgtgcatgttgatgtacaatttgagtatgagtga

SEQ ID NO: 1556 - protein, 417 aa, Sorghum bicolor
  misc_feature: Ceres ANNOT ID no. 6016273
  misc_feature (1)..(417): NCBI GI: 92867661 NCBI Desc: cyclin-like f-box [medicago truncatula]
  misc_feature (1)..(353): NCBI GI: 53850513 NCBI Desc: at1g10780 [arabidopsis thaliana]
  misc_feature (1)..(353): NCBI GI: 6573744 NCBI Desc: f20b24.20 [arabidopsis thaliana]
  misc_feature (1)..(288): NCBI GI: 124360281 NCBI Desc: cyclin-like f-box [medicago truncatula]
MELLPVEVVGNILSHLGVARDVMVASAVCRKWRDACRRHLRSLSFNSDDFPRDMTTRQLEIVITQTIFQTMGLQCLSIHIDNTHEFSAAPVIAWLMYTRETLRSLSYNVRTTPNVNILEKCGRQKLEVLDLDHNTITGVEPSYQRFTCLKSLSLRHVSISALDLSLLVAACPRIESLALDVLEVVTSDSQSTMELTCHTLKSLFAKSVGVNKIILDADNLEVLHLNALNLDLFELNGKGTLKHLKIDDVSVTHLDIGDNTDHLEAVDVSNFTIVWPKFYSMISRASNLLMLRFWGVVFDDEDEIVDSETIAVSFPLLRHLSLSYELRDGLLHYSLQGSSPLENVSVLELGWTVISEHFGPWVFGMIGRCPNLKKLVIHGVLSEAKTREERQMLASFTSFIVCLMRKYVHVDVQFEYE

SEQ ID NO: 1557 - DNA, 1209 bp, Sorghum bicolor
  misc_feature: Ceres ANNOT ID no. 6016288
  misc_feature: Encodes the peptide sequence at SEQ ID NO 1558
atgggcaattgctccccgtccccgcgccgccgccgccgcccgacggagccgggctcgccggcgctcggcagcaacgtgtccgcgcccaccgtgacggtcaactccgtctccgtctccacctacgcgctcgccagatccccctccgtctccgccgccgcggtggacgccgaggacgccggcgtcgtgcgcgtctacggctccgacgggtgccccgtcgcgtggcgcctccgcgtctcgctcctctacaaggcggcggcgcccctccacttcacgccctccgaggcggccccgctcggccgccccgtgctccgactctccgccgccgacccggaggtctgcggcaccgccgacgagctgctgcgcctggtggacgcgcggttcgagggcaagccgcgcgtcgcgccgccggagaggccccgcgcggcgtctccgtcggccgcggccgccgcggaggtcgccgagctggtgcggctgcagcaccgcagcgccgagcggcacctcgagggcgtggcggcgaaggtggcggagatggttaagaaagggaagaagtccgggaagggcaggaatgttgtggagggcgctgaggtcaggaggctcggcaagtggtacggggacgcaatggaggtgatgctggagcacgcaaggatggaggagaccctcatcttccctgacatacagagggcatcgtttccaggggtgtgcgataaggttaacgagcagcatgggaggcacctgccaatgatgaatggaatcaaggaggatataaaaacactgctgacgttggaattagggagccccctattccatgaagtggcggtcaacctctcggttcgcctcaaagcgttgcaggatcacaccaaagagcacttcaaggaagaagagagtgacctcctcccacggctagaacaagtacgacggatgcagcgggaggaggggaaggtttctgacaagtctagttctgcatgggcttcggaggcggtagctacaatggagatgacacactcgaagctcttccccttcttcatgactggtctccttcctcaggaggccatgcaatacttggacctagtgtgccgatgcacgaagaacacgcgccatctggtctccatgctcagatctcttgcagagcgccttgaagacgcaaacccgtcaattatacacaacaaccctaccaaactgtatgagcacctacttgtaaagtccccataa

SEQ ID NO: 1558 - protein, 402 aa, Sorghum bicolor
  misc_feature: Ceres ANNOT ID no. 6016288
  misc_feature (1)..(401): NCBI GI: 115441195 NCBI Desc: os01g0861700 [oryza sativa (japonica cultivar-group)]
MGNCSPSPRRRRRPTEPGSPALGSNVSAPTVTVNSVSVSTYALARSPSVSAAAVDAEDAGVVRVYGSDGCPVAWRLRVSLLYKAAAPLHFTPSEAAPLGRPVLRLSAADPEVCGTADELLRLVDARFEGKPRVAPPERPRAASPSAAAAAEVAELVRLQHRSAERHLEGVAAKVAEMVKKGKKSGKGRNVVEGAEVRRLGKWYGDAMEVMLEHARMEETLIFPDIQRASFPGVCDKVNEQHGRHLPMMNGIKEDIKTLLTLELGSPLFHEVAVNLSVRLKALQDHTKEHFKEEESDLLPRLEQVRRMQREEGKVSDKSSSAWASEAVATMEMTHSKLFPFFMTGLLPQEAMQYLDLVCRCTKNTRHLVSMLRSLAERLEDANPSIIHNNPTKLYEHLLVKSP

SEQ ID NO: 1559 - DNA, 1206 bp, Sorghum bicolor
  misc_feature: Ceres ANNOT ID no. 6016293
  misc_feature: Encodes the peptide sequence at SEQ ID NO 1560
atggggctctcgcaggagaggagctcgtcacagagcccgcggtcgccggcggcggcggcgggggcgccgttcctgtcgatatccgtcacggatcccgtcaagatgggcaccggcgtgcaggcctacatctcctaccgcgtcatcaccaggaccaacctccctgaatttgagggaccagagaaaattgttattcgacgctatagtgattttgaatggttgcatgaccggcttgctgagaggtacaaaggcgtttttatacctccccttccggagaagaatgctgttgagaaattccggtttagcaaggagttcattgaattgcggcgtcaagctctggatttattcgttaacaggatagcttcacaccctgaactcaagcaaagtgatgtcttgaggacatttttgcaggcagatgaagagataatggatagggcaagatcttacgagactggtatttttaagaaaccagcagatttcttacagatgtttaaggatgtacagtcaaaagtcagtgatgttgttctgggaaaagaaaagcctgtggaggaatctagtcctgaatatgagaagcttaaaaattacatatttgagctagaaaatcatttagcagaggcccaaaaacaagcataccgtcttgtgaaaagacacagagaacttgggcaatccttggcggacttcggaaaggcaattaagcttttaggtgcttgtgaaggagatttgatggaaaaggtgttttctgaagttggttctaagtcagagatgttgtcaataaagctgcaaagagaggcagacaaccttctctttaactttgaagaacccttgaaagattatgtgcgtgctgtacaatctataaaagccactatgctggatcgagccaatgctttcaggcagcactttgatttggatcaggagaggaagtataaagagcttaaccttgaaaaattgaagttcatgaaccctgagaagtatgccgaagcagagtctgagtttagagagttgaaagcagacagtgaggaggccacaaagaagtttgaacacatagttagactaatgaatgaagagctcgctcgtttccaggagcaaaagacggctgatattggactcgcattccatgagtttgccaagggtcaggctaagctagccaaagacattgctgatgcttggcgcagcatcctcccaaagcttgaagcttgttccacatcgtaa

SEQ ID NO: 1560 - protein, 401 aa, Sorghum bicolor
  misc_feature: Ceres ANNOT ID no. 6016293
  misc_feature (22)..(138): Pfam Id: PX Pfam Desc: PX domain
  misc_feature (163)..(394): Pfam Id: Vps5 Pfam Desc: Vps5 C terminal like
  misc_feature (5)..(401): NCBI GI: 37936234 NCBI Desc: sorting nexin 1 [brassica oleracea]
  misc_feature (9)..(397): NCBI GI: 15239935 NCBI Desc: phox (px) domain-containing protein [arabidopsis thaliana]
  misc_feature (27)..(388): NCBI GI: 60502217 NCBI Desc: sorting nexin 1 [acetabularia peniculus]
  misc_feature (27)..(391): NCBI GI: 60502215 NCBI Desc: sorting nexin 1 [acetabularia acetabulum]
  misc_feature (25)..(399): NCBI GI: 62897145 NCBI Desc: sorting nexin 1 isoform a variant [homo sapiens]
MGLSQERSSSQSPRSPAAAAGAPFLSISVTDPVKMGTGVQAYISYRVITRTNLPEFEGPEKIVIRRYSDFEWLHDRLAERYKGVFIPPLPEKNAVEKFRFSKEFIELRRQALDLFVNRIASHPELKQSDVLRTFLQADEEIMDRARSYETGIFKKPADFLQMFKDVQSKVSDVVLGKEKPVEESSPEYEKLKNYIFELENHLAEAQKQAYRLVKRHRELGQSLADFGKAIKLLGACEGDLMEKVFSEVGSKSEMLSIKLQREADNLLFNFEEPLKDYVRAVQSIKATMLDRANAFRQHFDLDQERKYKELNLEKLKFMNPEKYAEAESEFRELKADSEEATKKFEHIVRLMNEELARFQEQKTADIGLAFHEFAKGQAKLAKDIADAWRSILPKLEACSTS

SEQ ID NO: 1561 - DNA, 819 bp, Sorghum bicolor
  misc_feature: Ceres ANNOT ID no. 6016296
  misc_feature: Encodes the peptide sequence at SEQ ID NO 1562
atggcgggcggcctgcccccagggtaccgcttctacccgacggaagaggagctgatatccttctacctgcgcaacaagctggacaacctccgccgcgacgacatcgagcgcgtcatccccgtcgtcgacgtctactccgtcgacccctggcagctcccagggatccacgagatgctgcgcggcggcggcgctgccggggagggggagccgtggttctacttctgcccgcggcaggagcgggaggcgcggggcgggcggcccagccggacgacgccgtcggggtactggaaggccgcgggcacgcccggggtcgtctactcctcctcggcggcgccggccgaccgccgcgccatcgggatgaagaagaccatggtcttctaccgcggccgcgcgccgtcggggaccaagaccaactggaagatgaacgagtacagggcgctccagtacgacgaagcccccgccggccccctaaggagcgagtttagcctgtgtcgactctacaccaaatctgggagcctgagacagtttgaccggcggccgctcggagctgcgggaggcgtcgtcgtcgtccctggcgaggacccggcggggccatccacggcaggagtcgccgcgtcgccgccggacgatgacgatggctccggcagcagctccatgcaacaacagcagcggcagcaggtgacggaggagagagctgccaacgatccatacggtgacgacatggtggtgacgacggagagagaagatgcccacggccacgatcctttcggtgacgacgtggccatcttggatgcccttttatactggcccggagactag

SEQ ID NO: 1562 - protein, 272 aa, Sorghum bicolor
  misc_feature: Ceres ANNOT ID no. 6016296
  misc_feature (5)..(147): Pfam Id: NAM Pfam Desc: No apical meristem (NAM) protein
  misc_feature (5)..(181): NCBI GI: 4996349 NCBI Desc: nac-domain protein [nicotiana tabacum]
  misc_feature (1)..(182): NCBI GI: 21592559 NCBI Desc: nac-domain protein-like [arabidopsis thaliana]
  misc_feature (7)..(179): NCBI GI: 2264373 NCBI Desc: nam (no apical meristem)-like protein [arabidopsis thaliana]
  misc_feature (7)..(222): NCBI GI: 115463937 NCBI Desc: os05g0418800 [oryza sativa (japonica cultivar-group)]
  misc_feature (1)..(230): NCBI GI: 62546193 NCBI Desc: nac6 protein [glycine max]
  misc_feature: The sequence is a functional homolog of SEQ ID NO 1170 in the 10/666,642US patent application
  misc_feature: The sequence is a functional homolog of SEQ ID NO 1171 in the 10/666,642US patent application
  misc_feature: The sequence is a functional homolog of SEQ ID NO 1400 in the 10/666,642US patent application
  misc_feature: The sequence is a functional homolog of SEQ ID NO 151 in the 11/479,226US patent application
  misc_feature: The sequence is a functional homolog of SEQ ID NO 32 in the 10/412,699US patent application
  misc_feature: The sequence is a functional homolog of SEQ ID NO 320 in the 10/412,699US patent application
  misc_feature: The sequence is a functional homolog of SEQ ID NO 432 in the 10/666,642US patent application
  misc_feature: The sequence is a functional homolog of SEQ ID NO 752 in the 11/479,226US patent application
  misc_feature: Useful for making plants with modulated growth and phenotype characteristics
  misc_feature: The sequence is a functional homolog of SEQ ID NO 32 in the 20040045049 US patent application
  misc_feature: The sequence is a functional homolog of SEQ ID NO 320 in the 20040045049 US patent application
  misc_feature: The sequence is a functional homolog of SEQ ID NO 1170 in the 20070033671 US patent application
  misc_feature: The sequence is a functional homolog of SEQ ID NO 1171 in the 20070033671 US patent application
  misc_feature: The sequence is a functional homolog of SEQ ID NO 432 in the 20070033671 US patent application
  misc_feature: The sequence is a functional homolog of SEQ ID NO 1170 in the 10/666,642 US patent application
  misc_feature: The sequence is a functional homolog of SEQ ID NO 1400 in the 10/666,642 US patent application
  misc_feature: The sequence is a functional homolog of SEQ ID NO 320 in the 10/412,699 US patent application
  misc_feature: The sequence is a functional homolog of SEQ ID NO 752 in the 11/479,226 US patent application
  misc_feature: The sequence is a functional homolog of SEQ ID NO 1171 in the 10/666,642 US patent application
  misc_feature: The sequence is a functional homolog of SEQ ID NO 432 in the 10/666,642 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MAGGLPPGYRFYPTEEELISFYLRNKLDNLRRDDIERVIPVVDVYSVDPWQLPGIHEMLRGGGAAGEGEPWFYFCPRQEREARGGRPSRTTPSGYWKAAGTPGVVYSSSAAPADRRAIGMKKTMVFYRGRAPSGTKTNWKMNEYRALQYDEAPAGPLRSEFSLCRLYTKSGSLRQFDRRPLGAAGGVVVVPGEDPAGPSTAGVAASPPDDDDGSGSSSMQQQQRQQVTEERAANDPYGDDMVVTTEREDAHGHDPFGDDVAILDALLYWPGD

SEQ ID NO: 1563 - DNA, 1227 bp, Sorghum bicolor
  misc_feature: Ceres ANNOT ID no. 6016315
  misc_feature: Encodes the peptide sequence at SEQ ID NO 1564
atggcgagcgcgcctgctggcgaggtgccgtcccacttcctctgccccatctcgctgcagctcatgcgggaacccgtcacgctgcccaccggcatctcctacgaccgcgccgctatctcccgctggctggccgcgcccgcgcccgccggcggccgcacatgcccggtcacgcgcgtgccgctcccgccgcagccccagctgacgcccaaccacaccctccgccgcctcatccacgcctggctcgcgtccctctcccccgaggcggaggtcgacgaggacgtggccgcgctgcggaggcccgtgccgggcgccgaggtggccgcgctgctgtcccacgccgccgcggcacaggttgaggcgctcaagaggctgcgggagctggtggccgagtgcgaggacaaccgggcggttctcgagtcccaggacggggtgttcgacgccttgtctcgcgtcgtcagcagtgccgacgcgtgctcgacggcgcgcgaggaggcggtcggggtgctcgcgtcgctgcggatcccggagccggagctggccgccgtcgtggccaggcacagcaacctgggggaggcactcacggccgtcctccgctcgtcgaacgtgaagtcgcgcgcgaacgccgctctgctcgttcggtccctctcggaagcggcctggccggcctgggtgatcgggctgagccaggagcttctcgccgaggttgtccgcgtggtccgcgaccgtgtctcgacgcaggcgaccaaggcagcgctgcacgccctcgccgcgctctgcccctacggccggacccgcgtcaagatcgtgggcgcgggctcggtgccggcgatcgtggacctcctgctcgacgaccccgagaggcgtgtcaacgaggtcgcgctcgtggcgctggaccggttgtgcacgtgcgccgagggtcgcgctgagctggtcgcgcacgcggcggggctggccgtggtgggcaagaaggtgctgagggtgtcggaggccgcgagcgagcgcgcggtgcgcgtgctgcgctccgtggcgcgccacgcggcgacgcctgccgtgctgcaggagatggcgcagtccggcgtcgtggccaagctctgcgcggcgctgcggtccgagcagtgcggggtgaggaccaaggagagggcgcatgaggtgctcaagctgcactccaggacctggaggagctcgccctgcctgtctccaaaatttttggagctctacccttcatga

SEQ ID NO: 1564 - protein, 408 aa, Sorghum bicolor
  misc_feature: Ceres ANNOT ID no. 6016315
  misc_feature (8)..(87): Pfam Id: U-box Pfam Desc: U-box domain
  misc_feature (8)..(408): NCBI GI: 90399175 NCBI Desc: h0723c07.7 [oryza sativa (indica cultivar-group)]
  misc_feature (8)..(407): NCBI GI: 76884939 NCBI Desc: u-box protein [capsicum annuum]
  misc_feature (8)..(407): NCBI GI: 87240319 NCBI Desc: u box [medicago truncatula]
  misc_feature (6)..(406): NCBI GI: 38346713 NCBI Desc: osjnba0086o06.11 [oryza sativa (japonica cultivar-group)]
  misc_feature (6)..(406): NCBI GI: 115446611 NCBI Desc: os02g0548700 [oryza sativa (japonica cultivar-group)]
  misc_feature: The sequence is a functional homolog of SEQ ID NO. 528 in the 11/188,298 US application
  misc_feature: The sequence is a functional homolog of SEQ ID NO. 308 in the 11/188,298 US application
  misc_feature: The sequence is a functional homolog of SEQ ID NO. 309 in the 11/188,298 US application
MASAPAGEVPSHFLCPISLQLMREPVTLPTGISYDRAAISRWLAAPAPAGGRTCPVTRVPLPPQPQLTPNHTLRRLIHAWLASLSPEAEVDEDVAALRRPVPGAEVAALLSHAAAAQVEALKRLRELVAECEDNRAVLESQDGVFDALSRVVSSADACSTAREEAVGVLASLRIPEPELAAVVARHSNLGEALTAVLRSSNVKSRANAALLVRSLSEAAWPAWVIGLSQELLAEVVRVVRDRVSTQATKAALHALAALCPYGRTRVKIVGAGSVPAIVDLLLDDPERRVNEVALVALDRLCTCAEGRAELVAHAAGLAVVGKKVLRVSEAASERAVRVLRSVARHAATPAVLQEMAQSGVVAKLCAALRSEQCGVRTKERAHEVLKLHSRTWRSSPCLSPKFLELYPS

SEQ ID NO: 1565 - DNA, 984 bp, Sorghum bicolor
  misc_feature: Ceres ANNOT ID no. 6016316
  misc_feature: Encodes the peptide sequence at SEQ ID NO 1566
atgctgccgtatgcgccggggccgccgccgtcgctgctggtggatcggcggtacaagcagggcggcgaggcggcgcccaactgcccgcgctgcgactcgcccaacaccaagttttgctactacaacaactacagcctcagccagccgcgctacttctgcaagggctgccgccgctactggaccaagggcggctccctccggaacgtgcccgtcggcggcgggtgccggaagaaccgccggggcaagtcgtccttgcgctcggcggcggacgccgccatcgcgagcggcggcggccgtgatgcggcgttcggccaccaccggttcccgggccctgtccggccggacctggtcctggaaggcatggttggcaacccgtcgaacccagctggccaggcgatgcccggcggcgtacccgctgctaccgatggctccaccattgatctcgcaatgctgtacgccaagtttctcaaccacccgccggcggaggaaggtgtcaatgccgtgacaccggagtcggcagggcaggtcgtcgacgaggcattcgacacgttcagcgcgtccagcgacctgagccccggcgttctggcgccgctgcagttcgatccgtgccacgacgggttcggtgagtggtcagcaggcgggccagtgagcagcactggcccctcgagtacggctagtactaccgccgcaaccaccatgctgtgcgctgatgtgagcgtgcaagctgcgttcggcgagctcaacttcgccatggatcagagctgcttcgactcgctagggttgcccacggacgacgtcgtcggcaacctctcgtcgtcgtggtgttcgatcgtgccaggcttgtcgacgttagaggacaccaagtatgactcgttggattcgttccctgacgacgccctcagccttcacgaggacatgattagcgggactgatcatgattggagcgtggattgccaaggattggaggctctctacatgccgtaa

SEQ ID NO: 1566 - protein, 327 aa, Sorghum bicolor
  misc_feature: Ceres ANNOT ID no. 6016316
  misc_feature (21)..(83): Pfam Id: zf-Dof Pfam Desc: Dof domain, zinc finger
  misc_feature (1)..(323): NCBI GI: 115464133 NCBI Desc: os05g0440000 [oryza sativa (japonica cultivar-group)]
  misc_feature (13)..(82): NCBI GI: 112363386 NCBI Desc: dof16 [glycine max]
  misc_feature (17)..(87): NCBI GI: 112363402 NCBI Desc: dof23 [glycine max]
  misc_feature (6)..(88): NCBI GI: 112363376 NCBI Desc: dof11 [glycine max]
  misc_feature (23)..(92): NCBI GI: 21538793 NCBI Desc: dof zinc finger protein [hordeum vulgare subsp. vulgare]
  misc_feature: The sequence is a functional homolog of SEQ ID NO 1038 in the 10/225,066US patent application
  misc_feature: The sequence is a functional homolog of SEQ ID NO 1133 in the 10/374,780US patent application
  misc_feature: The sequence is a functional homolog of SEQ ID NO 1142 in the 11/479,226US patent application
  misc_feature: The sequence is a functional homolog of SEQ ID NO 136 in the 10/666,642US patent application
  misc_feature: The sequence is a functional homolog of SEQ ID NO 174 in the 10/225,066US patent application
  misc_feature: The sequence is a functional homolog of SEQ ID NO 1790 in the 10/374,780US patent application
  misc_feature: The sequence is a functional homolog of SEQ ID NO 2408 in the 10/374,780US patent application
  misc_feature: The sequence is a functional homolog of SEQ ID NO 2754 in the 10/374,780US patent application
  misc_feature: The sequence is a functional homolog of SEQ ID NO 490 in the 10/412,699US patent application
  misc_feature: The sequence is a functional homolog of SEQ ID NO 502 in the 10/412,699US patent application
  misc_feature: The sequence is a functional homolog of SEQ ID NO 8 in the 10/286,264US patent application
  misc_feature: Useful for making plants with altered sterol content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated heat sensitivity
  misc_feature: Useful for making plants with modulated nitrogen use efficiency
  misc_feature: Functional homolog of the protein sequence given in SEQ ID NO 13212
  misc_feature: Functional homolog of the protein sequence given in SEQ ID NO 13434
  misc_feature: Functional homolog of the protein sequence given in SEQ ID NO 13435
  misc_feature: Functional homolog of the protein sequence given in SEQ ID NO 13440
  misc_feature: The sequence is a functional homolog of SEQ ID NO 8 in the 20030093837 US patent application
  misc_feature: The sequence is a functional homolog of SEQ ID NO 490 in the 20040045049 US patent application
  misc_feature: The sequence is a functional homolog of SEQ ID NO 174 in the 20050160493 US patent application
  misc_feature: The sequence is a functional homolog of SEQ ID NO 1133 in the 20060162006 US patent application
  misc_feature: The sequence is a functional homolog of SEQ ID NO 1790 in the 20060162006 US patent application
  misc_feature: The sequence is a functional homolog of SEQ ID NO. 489 in the 11/188,298 US application
  misc_feature: The sequence is a functional homolog of SEQ ID NO. 486 in the 11/188,298 US application
  misc_feature: The sequence is a functional homolog of SEQ ID NO. 379 in the 11/188,298 US application
MLPYAPGPPPSLLVDRRYKQGGEAAPNCPRCDSPNTKFCYYNNYSLSQPRYFCKGCRRYWTKGGSLRNVPVGGGCRKNRRGKSSLRSAADAAIASGGGRDAAFGHHRFPGPVRPDLVLEGMVGNPSNPAGQAMPGGVPAATDGSTIDLAMLYAKFLNHPPAEEGVNAVTPESAGQVVDEAFDTFSASSDLSPGVLAPLQFDPCHDGFGEWSAGGPVSSTGPSSTASTTAATTMLCADVSVQAAFGELNFAMDQSCFDSLGLPTDDVVGNLSSSWCSIVPGLSTLEDTKYDSLDSFPDDALSLHEDMISGTDHDWSVDCQGLEALYMP

SEQ ID NO: 1567 - DNA, 300 bp, Sorghum bicolor
  misc_feature: Ceres ANNOT ID no. 6016327
  misc_feature: Encodes the peptide sequence at SEQ ID NO 1568
atggctgcggcggaggaggaaatcgcggtgaaggagccgctggatctgatacggctcagcctcgacgagcgcatctacgtcaagctccgatccgaccgcgagctccgcggcaagctccatgcgtatgatcaacatttaaacatgatacttggtgatgtggaagaggtcgtgacaactgttgagatagatgatgaaacatatgaagaaattgtaccacaaaacgcactatccccttcctttttgtccgaggtgatggtgtcatattggtttctccaccccttcgaacggcatgaagtttga

SEQ ID NO: 1568 - protein, 99 aa, Sorghum bicolor
  misc_feature: Ceres ANNOT ID no. 6016327
  misc_feature (15)..(62): Pfam Id: LSM Pfam Desc: LSM domain
  misc_feature (1)..(81): NCBI GI: 92891719 NCBI Desc: sm-like protein [imported] - arabidopsis thaliana [medicago truncatula]
  misc_feature (10)..(70): NCBI GI: 7657315 NCBI Desc: lsm3 protein [homo sapiens]
  misc_feature (10)..(70): NCBI GI: 119584594 NCBI Desc: lsm3 homolog, u6 small nuclear rna associated (s. cerevisiae) [homo sapiens]
  misc_feature (4)..(70): NCBI GI: 108874209 NCBI Desc: snrnp sm protein [aedes aegypti]
  misc_feature (1)..(70): NCBI GI: 95102812 NCBI Desc: lsm sm-like protein family member [bombyx mori]
MAAAEEEIAVKEPLDLIRLSLDERIYVKLRSDRELRGKLHAYDQHLNMILGDVEEVVTTVEIDDETYEEIVPQNALSPSFLSEVMVSYWFLHPFERHEV

SEQ ID NO: 1569 - DNA, 4626 bp, Sorghum bicolor
  misc_feature: Ceres ANNOT ID no. 6016348
  misc_feature: Encodes the peptide sequence at SEQ ID NO 1570
atggaagactcacccgccgatgccgccggctccggccgccgcacgcgcacgcgcacgcggggcgcggaggcgtcggggcgggccgccaggctccagcagctccgcgccgtccgcaacggtgagatccgcgcttccgacgtcatccaggtgaaggttgacgccccgatctacgacaccgtcccggaggaggagtacaacgtgctcgtcgctcgccgcaagaaggaagccggcgagttcatcatcgacgacgacgggctcggttacgtcgatgacggccgcgaggaggactggagccaccgcgctctcccttcctcctccgatgaaggatcagatgacgaggacggcgccccccgcaagcggaagcagccgcgccctccccaggcgaagcgccagccgcagcagtccgccaaggcggcggcgtctttctccgccgctgccgcaaagacgggccagcagatctcctctttgttcacatcctcggtatttaagaggaccggcagcgaccgcaccaagagcttggcgctggccgccgacagcatcgtggacgacatcatcgccgagttcgcgcccgacgagaacgaccgtgaggagaggcgtcggcgggttggtagggtttctgcgccgcagccgcctcctccaacagtttcctacgtcaagcctcaaaaggtaattgtcgatgctgaaatggttagatcggacaatggaaatgatatggcggtggaattgaagaacgatactgagatggaaaccaatttggaggaaattcctggttctagtgctgaattggtggttgataatctggaagaaattcctggttctagtgctgaattggtgtttgataataagagtttggaggaaccaaagcaggaggctaatggggaagtaaaggtagaaaagacacaccgcctcaatgcaaagattaaggcggaggagagcagaaataatgatgtgacgagtgcaacagcaggatggatgaagatatgtgggaatgggcagaatgcagtaggtgaagaaggagtgacagttgatggtaacaccaatgtggatgaaagttcagagtttgagctgaaagatggagcactgccattctacatacttgatgcatacgaggaaccatttggtgctaattcaggcacagtgtatttatttgggaaggttgaagttggcaagcggttccatagttgctgcgtcattgtgaaaaatattcaaagatgcatatatgctattccaaaccattcagtgtttccaagggactccatatcagggatagaaagaaaccccacaagtgctgatcttttgccatcacttcgagcaactctacatgagttggcgtcaggattaaagagtgaaatagctgacaaattgtcagacctcaatgtgtcaaatttcgtaatgactccagtcaagaggaactatgcatttgagaggactgatctaccaaatggagagcagtatgtcctgaaaattaattatccttacaaggatcctgctctaccagcagacctcaggggtgaacattttcatgcactgcttgggacaaacaatagtgctcttgaattatttcttatcaagaggaaggtcaaggggccttcatggctgtcggtttccaaatttgtgacacggccatccactcagcgggtcagctggtgtaaatttgaagttacagttgattgcccaaaggatatatctgttttgacgacaagtacaaatctagaagttcctactgttgtagttgcagcagttaatctcaaaactatcataaatgagaaacacaatgtgcatgagattgtgtcagcatctctcatatgctgtcatggggtgaagattgatagtccaatgcgtccagaagattggcagaaacggggaatgctcagccattttactgttatgcgcaaacttgaaggtagcatatttcctataggccttgctaagggtgcttctgataggaacgagcaggctggtagcaatgtgctggcactagaaagcagtgaacgtgcattattaaatcgcttgatgattgagcttagcaaacttgactgcgacgtacttgtgggacacaatatttcaggattcgatttggatgtgcttctacaccgtgctcagacatgcaaagtgctaagcagcatgtggtccaagattggtcgtctcaggcgatcgtcaatgcccaggcttaccaaaggaagtacactctatggttctggagcaagtccaggaattatgtcctgtattgctggccgtcttctctgtgacacctatttatgctctcgtgaccttctgaaggaggtgagttattccttgacacaacttgcagaaacacaattaaaaaaggtcaggagagaggtttctccacatgatatacctctgatgttccagtcttcgactgaactgctcaaactggttgaatatggtgagacagatgcatggctttctttggagctcatgtttcacttgagtgttctcccactgacacggcaactgaccaacattagtggtaacctgtgggggaaaactcttcagggtgctagggctcagagagtagaatatctactactgcattcatttcatgcaagaaaatttattgtaccggataaatttgcacgcaacaaagagctgaactccacaaaaagaaaaatgaatgctgatactgagggtgcaaatgctgatgatggtgctgctgatccttccgttgatgatgaagtgcataatggtgatcaaggtaaagccagaaaaggaccttcatatgctggtggattagttttggagcctaagaagggtctatatgacaagtatgttctacttcttgacttcaacagcctttatccttcaataattcaggaatacaacatctgctttaccaccgttgagcgttcttctgatggcagtgtacctaatttgccagcatcaaaagctactggtgttttacctgagttgctgaggagtttggtggagaggagaaggatggttaaatcatggttgaagactgcttctggtcttaaaaggcagcagtttgatattcaacaacaagcattgaaactcactgcaaatagcatgtatggttgcttgggcttttccaattccaggttttatgcaaagccacttgctgagcttattacactccaaggtagagagatattgcaaaacactgtagatctggttcagaataatttgaatttggaggttatctatggtgatacggattccatcatgatacatactggacttgatgacatctccagggcaaaagcaattgcaggaaaagttattcaggaggtgaacaaaaagtaccgttgtctggagattgatcttgatggcatatacaagagaatgttacttcttaaaaagaagaaatatgctgctattaaagtggcactggatggcagcttacgagagaacattgaacgcaaggggctcgatatggtcagacgtgattggaatttgctgtcaaaagacattggagatttttgtctcaatcaaattttgtctggagggacatgtgatgatgttgttgagtcaatacacagttctcttgtccaggtgcaagagcaaatgagaagtggtcaaatagaacttgaaaaatatgttatcacaaagagcttaacgaaagcgccagaagattatccagatgctaaaaatcagcctcatgttcaggttgctttgagactcaagcaaaatggttactctggctgctcagctggtgacacagtcccttatataatttgctctcagcaggactcagataatacacattctgtgggaatagctcagagagctagacatcccgaggagttaaaaagagaccctgacaagtggatgattgacattgactattatttgtcacaacagattcatcctgttgtttctcgtctgtgtgcttccatccagggtactagtccagctcgtctggctgaatgtttgggacttgattcggctaagttccaatcaagagtgactgagtctagcaatcaagatacatctacgatgctgttatctgtgatcgatgatgaagatgagagatatcgtggttgtgagccactgcgtttatcatgcccaagctgttctggtaccttcgactgccctcctgtatctagtctgattactagtgctacaagtgtatcagatccaaatgaaggaaaggatgctactgctaatttctggcgccatatgcggtgcccaagatgcccagataacgctgacgagtccaaaatttctcctccaatgcttgccaatcagatgaaaagacaagctgataatttcattagtctatattataaaggtctgcagatgtgtgacgatgagggttgcaaatactcgactcacagcgtaaaccttagagttatgggggattctgagagaggaaccatctgccctaactacccactctgcaatggtcgcctagtaagacagtacacggaggcagatctatacaggcaactgtcatacttttgctatgtacttgatgcaacccggtgtcttgaaaagctggaccagaaggcaaggctccccttcgagagagagtttgtagcagtaggccaaacaattaacttggcactgcaagagatccagaaaatccgagatagatgtgcatttggatgggttcagctaaaggaccttgccgtgtcaatatga

SEQ ID NO: 1570 - protein, 1541 aa, Sorghum bicolor
  misc_feature: Ceres ANNOT ID no. 6016348
  misc_feature (841)..(1312): Pfam Id: DNA_pol_B Pfam Desc: DNA polymerase family B
  misc_feature (1328)..(1538): Pfam Id: zf-DNA_Pol Pfam Desc: DNA Polymerase alpha zinc finger
  misc_feature (388)..(769): Pfam Id: DNA_pol_B_exo Pfam Desc: DNA polymerase family B, exonuclease domain
  misc_feature (1)..(1541): NCBI GI: 85541645 NCBI Desc: dna polymerase alpha catalytic subunit
  misc_feature (298)..(1541): NCBI GI: 115441281 NCBI Desc: os01g0868300 [oryza sativa (japonica cultivar-group)]
  misc_feature (306)..(1541): NCBI GI: 2826900 NCBI Desc: dna polymerase alpha catalytic subunit [oryza sativa]
  misc_feature (59)..(977): NCBI GI: 144923692 NCBI Desc: dna-directed dna polymerase b [medicago truncatula]
  misc_feature (625)..(1355): NCBI GI: 122889323 NCBI Desc: polymerase (dna directed), alpha 1 [mus musculus]
  misc_feature (1)..(1541): SWISSPROT Homolog: EC 2.7.7.7 DNA polymerase alpha catalytic subunit
MEDSPADAAGSGRRTRTRTRGAEASGRAARLQQLRAVRNGEIRASDVIQVKVDAPIYDTVPEEEYNVLVARRKKEAGEFIIDDDGLGYVDDGREEDWSHRALPSSSDEGSDDEDGAPRKRKQPRPPQAKRQPQQSAKAAASFSAAAAKTGQQISSLFTSSVFKRTGSDRTKSLALAADSIVDDIIAEFAPDENDREERRRRVGRVSAPQPPPPTVSYVKPQKVIVDAEMVRSDNGNDMAVELKNDTEMETNLEEIPGSSAELVVDNLEEIPGSSAELVFDNKSLEEPKQEANGEVKVEKTHRLNAKIKAEESRNNDVTSATAGWMKICGNGQNAVGEEGVTVDGNTNVDESSEFELKDGALPFYILDAYEEPFGANSGTVYLFGKVEVGKRFHSCCVIVKNIQRCIYAIPNHSVFPRDSISGIERNPTSADLLPSLRATLHELASGLKSEIADKLSDLNVSNFVMTPVKRNYAFERTDLPNGEQYVLKINYPYKDPALPADLRGEHFHALLGTNNSALELFLIKRKVKGPSWLSVSKFVTRPSTQRVSWCKFEVTVDCPKDISVLTTSTNLEVPTVVVAAVNLKTIINEKHNVHEIVSASLICCHGVKIDSPMRPEDWQKRGMLSHFTVMRKLEGSIFPIGLAKGASDRNEQAGSNVLALESSERALLNRLMIELSKLDCDVLVGHNISGFDLDVLLHRAQTCKVLSSMWSKIGRLRRSSMPRLTKGSTLYGSGASPGIMSCIAGRLLCDTYLCSRDLLKEVSYSLTQLAETQLKKVRREVSPHDIPLMFQSSTELLKLVEYGETDAWLSLELMFHLSVLPLTRQLTNISGNLWGKTLQGARAQRVEYLLLHSFHARKFIVPDKFARNKELNSTKRKMNADTEGANADDGAADPSVDDEVHNGDQGKARKGPSYAGGLVLEPKKGLYDKYVLLLDFNSLYPSIIQEYNICFTTVERSSDGSVPNLPASKATGVLPELLRSLVERRRMVKSWLKTASGLKRQQFDIQQQALKLTANSMYGCLGFSNSRFYAKPLAELITLQGREILQNTVDLVQNNLNLEVIYGDTDSIMIHTGLDDISRAKAIAGKVIQEVNKKYRCLEIDLDGIYKRMLLLKKKKYAAIKVALDGSLRENIERKGLDMVRRDWNLLSKDIGDFCLNQILSGGTCDDVVESIHSSLVQVQEQMRSGQIELEKYVITKSLTKAPEDYPDAKNQPHVQVALRLKQNGYSGCSAGDTVPYIICSQQDSDNTHSVGIAQRARHPEELKRDPDKWMIDIDYYLSQQIHPVVSRLCASIQGTSPARLAECLGLDSAKFQSRVTESSNQDTSTMLLSVIDDEDERYRGCEPLRLSCPSCSGTFDCPPVSSLITSATSVSDPNEGKDATANFWRHMRCPRCPDNADESKISPPMLANQMKRQADNFISLYYKGLQMCDDEGCKYSTHSVNLRVMGDSERGTICPNYPLCNGRLVRQYTEADLYRQLSYFCYVLDATRCLEKLDQKARLPFEREFVAVGQTINLALQEIQKIRDRCAFGWVQLKDLAVSI

SEQ ID NO: 1571 - DNA, 1719 bp, Sorghum bicolor
  misc_feature: Ceres ANNOT ID no. 6016368
  misc_feature: Encodes the peptide sequence at SEQ ID NO 1572
atgtcggaggccgtcgccgagggcgagtcggccgtcgagctgctgctccgcgcggcggcgatggtgcccgcggagcgctacgcgctggccgccatcatcgtggcgttcgtctttctgtaccgcttcctcgagctccacgtcattggcgacatcctccgcggcttccggggcggccgcgtcgagctcaccttccaccccgcctcggagatctaccaccgcgtcgcgtccaggtgccgcttgctccacggcaggtatctggcgacgccatggctggcgagcccgcatttgcagacattgttcctgggaatccacgggatgccgccttcattcacgtacaaaagacagttgtacacagtttgtgatggtggaaccattgctttggattggctgctcgcatctgatttcgaagttgcggacggattcatttctgaagatgcttcaacaccccttgtagttgtggttcctggattaactagtgattcttccgctgcttatgcaaaacacttggtttattccatggcaagcaaaggatggaatgttgttgtaagcaaccacagaggtcttggtggtgtgtccattacttcagattgcttctataatggtggttggacagaagatgtcagagaggtcattaaatacctgcatcacagatatccgaaaaccccactgttttgcattggtacaagcataggtgccaatattgtggtcaagtatcttggagaagaaggagagaatactcctgtagctggtgcagtatctatttgctctccatgggatctgttgataggtgacagatttatttcccgcaagcttgtgcagcgtatttacgacaaagcacttgcaattggtctgaagggctatgcaaaattacatcaacctgtcttggcccgacttgcaaactgggaaggtattagaaagtcacgatctatccgggagtttgaccaccatgctacttgtgttattgcaagatatgagacagtggatacctactaccgccggtgcagcagtgctagttacgttggaaatgtttcagttcccttgctttgtatcagtgctttggatgatcccctttgcacaagggaggctattccttgggatgaatgcagggccaataagaacattgttttagcaactactccgaatggtggtcatcttgcattctttcaaggactaactgctcgaagactatggtgggttggagctacttctgagttcctttctgctcttcatgacagctcctacatgcataggcaaaaggcaaatgatcatgttttgcactcttctttggaatcctccattgataagagtccgtatgttaatctcatggaagatggaatggtagctgcagtaacagaagatggccctggcaatgatggctcacctttgaaccatgcagttgatgaagaacaattaagtaacgaggtgggcggtagacgacagaatgtggtatctgcgttgaaccacaatgaaaaggccagtggagtggggaacgaatgccctgcagcggcaacaaaacagcaaggtgatgacgtccacagcaataagcttcatgagatcattgctcctgtcaagagatctataaaccaactgactcgataccaagggaggtcagtctggttgcttgcctatattgcttttgtaacatcctggccgctccttggctccctagctttcatcacctttcggaaaaagttcaggaatccgttgcgagctaaatga

SEQ ID NO: 1572 - protein, 572 aa, Sorghum bicolor
  misc_feature: Ceres ANNOT ID no. 6016368
  misc_feature (178)..(427): Pfam Id: Abhydrolase_1 Pfam Desc: alpha/beta hydrolase fold
  misc_feature (83)..(390): NCBI GI: 1350545 NCBI Desc: emb8 [picea glauca]
  misc_feature (53)..(370): NCBI GI: 115447607 NCBI Desc: os02g0649400 [oryza sativa (japonica cultivar-group)]
  misc_feature (78)..(421): NCBI GI: 28302356 NCBI Desc: abhd1-prov protein [xenopus laevis]
  misc_feature (78)..(411): NCBI GI: 50415370 NCBI Desc: abhd3 protein [xenopus laevis]
  misc_feature (69)..(409): NCBI GI: 18203711 NCBI Desc: alpha/beta hydrolase domain containing protein 3 [homo sapiens]
MSEAVAEGESAVELLLRAAAMVPAERYALAAIIVAFVFLYRFLELHVIGDILRGFRGGRVELTFHPASEIYHRVASRCRLLHGRYLATPWLASPHLQTLFLGIHGMPPSFTYKRQLYTVCDGGTIALDWLLASDFEVADGFISEDASTPLVVVVPGLTSDSSAAYAKHLVYSMASKGWNVVVSNHRGLGGVSITSDCFYNGGWTEDVREVIKYLHHRYPKTPLFCIGTSIGANIVVKYLGEEGENTPVAGAVSICSPWDLLIGDRFISRKLVQRIYDKALAIGLKGYAKLHQPVLARLANWEGIRKSRSIREFDHHATCVIARYETVDTYYRRCSSASYVGNVSVPLLCISALDDPLCTREAIPWDECRANKNIVLATTPNGGHLAFFQGLTARRLWWVGATSEFLSALHDSSYMHRQKANDHVLHSSLESSIDKSPYVNLMEDGMVAAVTEDGPGNDGSPLNHAVDEEQLSNEVGGRRQNVVSALNHNEKASGVGNECPAAATKQQGDDVHSNKLHEIIAPVKRSINQLTRYQGRSVWLLAYIAFVTSWPLLGSLAFITFRKKFRNPLRAK

SEQ ID NO: 1573 - DNA, 1560 bp, Sorghum bicolor
  misc_feature: Ceres ANNOT ID no. 6016370
  misc_feature: Encodes the peptide sequence at SEQ ID NO 1574
atggaaggcaggatgacaagtttggaagccgccatgaaagcttcttcgtcaatggcaagcagcatggcaaggaatgctgaccctgaccatcagactctccgctccaattcagtggagcagttttattttccaagacctggccaatctttgccaggcattcctccattctttgggcctccctcctccagtttgtatcctcctaatgacaatgaagctaaatttggcagccagtttgaatcaaatccttcacagaatacagattgggacccgcaggctatagtgagcaacctaaccttccttgagcagaagatcaaacaggtaaaagatattgtgcagtccatgaataatcgagagaaccaagtagctggtggttccagtgagctagcggcaaagcagcagctcataaccgctgatctcactagcattataatccagctcatatctactgctggttccctgctcccttcaatgaagaacccacttcttagcagcaatccggcagtcaggcagctcggcaacactcttggttctcctatgggctttggcatgaatgctaatcagcgaccaagtgtagacagcaagactgatattcctgacacaggaaaaacttctgattatgatgaactgatgaatagccttaatactgctcaagatgaaagagatgagctgatcaaatgcccaaatctctgtggtggtgaagggtctgaaccgactccgatggaggaccatgatgtgaaggagagtgatgatggtggtgagggagagaatcttcctcctggttcatatgtagtcttgcaattggaaaaggaggagattttagcaccacatactcatttctgcttgatctgtggtaagggtttcaaaagagatgctaacctaaggatgcacatgaggggccatggagatgagtacaagactccagctgctcttgccaagcccacaaaggattctggtgcagatcatgcaccggttacaaggtactcatgcccatttgtgggttgcaaacggaacaaagagcacaagaagttccagcctctcaaaacaatattgtgtgtgaagaaccattacaagagaagccattgtgacaagagctacacctgcagccgttgcaacaccaagaagttctctgtcattgccgacttgaagactcatgagaagcactgtggtcgtgataagtggctctgttcttgtggaacaaccttctccaggaaggacaagctttttgggcatgttgcccttttccaaggccacacacctgcgctccccatggaagatgtgaaggtatcagaagcatcagagctacctcaggacagtgagccaacgaatgaaatggcgaggagcatggtgtatagcttccccagtagctcgtctgatggtatatcgaacctcgacatgaaaatggctgatgatgtgcgtggttatttctcgccactgaactttgatccttgctttggtgcgcttgacgacttcactcgccctgggtttgacatctctgagaaccccttctccttcctgccttcaggatcttgcagttatgggcagcaaaacggagatagctaa

SEQ ID NO: 1574 - protein, 519 aa, Sorghum bicolor
  misc_feature: Ceres ANNOT ID no. 6016370
  misc_feature (278)..(300): Pfam Id: zf-C2H2 Pfam Desc: Zinc finger, C2H2 type
  misc_feature (240)..(519): NCBI GI: 146455139 NCBI Desc: c2-h2 zinc finger protein [arabidopsis thaliana]
  misc_feature (240)..(519): NCBI GI: 79319178 NCBI Desc: nucleic acid binding / zinc ion binding [arabidopsis thaliana]
  misc_feature (249)..(447): NCBI GI: 38346456 NCBI Desc: osjnba0019g23.4 [oryza sativa (japonica cultivar-group)]
  misc_feature (241)..(439): NCBI GI: 59958298 NCBI Desc: at3g57670 [arabidopsis thaliana]
  misc_feature (190)..(436): NCBI GI: 9294415 NCBI Desc: zinc finger-like protein [arabidopsis thaliana]
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1785 in the 10/374,780US patent application
  misc_feature: The sequence is a functional homolog of SEQ ID NO 552 in the 10/666,642US patent application
  misc_feature: Useful for making plants with modulated growth and phenotype characteristics
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: The sequence is a functional homolog of SEQ ID NO 552 in the 20070033671 US patent application
  misc_feature: The sequence is a functional homolog of SEQ ID NO 552 in the 10/666,642 US patent application
  misc_feature: The sequence is a functional homolog of SEQ ID NO. 455 in the 11/188,298 US application
MEGRMTSLEAAMKASSSMASSMARNADPDHQTLRSNSVEQFYFPRPGQSLPGIPPFFGPPSSSLYPPNDNEAKFGSQFESNPSQNTDWDPQAIVSNLTFLEQKIKQVKDIVQSMNNRENQVAGGSSELAAKQQLITADLTSIIIQLISTAGSLLPSMKNPLLSSNPAVRQLGNTLGSPMGFGMNANQRPSVDSKTDIPDTGKTSDYDELMNSLNTAQDERDELIKCPNLCGGEGSEPTPMEDHDVKESDDGGEGENLPPGSYVVLQLEKEEILAPHTHFCLICGKGFKRDANLRMHMRGHGDEYKTPAALAKPTKDSGADHAPVTRYSCPFVGCKRNKEHKKFQPLKTILCVKNHYKRSHCDKSYTCSRCNTKKFSVIADLKTHEKHCGRDKWLCSCGTTFSRKDKLFGHVALFQGHTPALPMEDVKVSEASELPQDSEPTNEMARSMVYSFPSSSSDGISNLDMKMADDVRGYFSPLNFDPCFGALDDFTRPGFDISENPFSFLPSGSCSYGQQNGDS

SEQ ID NO: 1575 - DNA, 1773 bp, Sorghum bicolor
  misc_feature: Ceres ANNOT ID no. 6016414
  misc_feature: Encodes the peptide sequence at SEQ ID NO 1576
atggcagaggagacgcagccagaggccgccgccgccgccgccgccgccgcgccccccgcggccgaggtggtcgtgaccgaggcggtggcggcggaggtggaggtgcctgcggcggcggaagccgaagccgagcccgagacggagaagaaagctgatgaggcggcggtcaccgccgatgacgcgggggaggggaccggctcgttcaaggaggagagcaacctggtggaggacctgcccgacccggagaagaaggcgctcgacgagttcaagcagctgatcgctgctgccctcgccgccggtgagttcaacctgcctcccccgccgccgccgccgaaggccaaggaggaacccaaggccgaggagacgaagacggaggaagccaagaccgaggagacgaagacggaggaagccaagaccgaggagccggtcaaagaagagcccaaggccgaggccgaggctgcggcggaggagcccaaggccgaggtggctgcggatgccccggctgaggaggtcaagacggaggtgccgccgccagaggaggccaaggctgagacagtggctgaggaagccaagcctgccgagcccgagccgcaggagaagaccgtcgtggtcgctgaggaggagaccgccaccaagacggtggaaacaatcgaggaaaccgtcgtgtccgcccccgccgccacctcggaggaggcagtggcgccggaggcggcggccgagagtgatgcggccgcgcctgagcccgtgctgatctggggcgtgccgctggtgggcgacgacgagtgcacggatacggttctgctcaagttcctgcgagcgcgggagttcaaggtgaaggaggccatggcgatgctcaagtccgcggtgctgtggcgcaagcgcttcggcatcacctcgctcctcgacgccgacctcggcctgccggagttggagaacgtggtgttctaccgcggcgccgaccgcgagggccaccccgtgtgctacaacgtctacggcgagttccaggacaaggatctctacgagaaggccttcggcgacgatgagaagagggagcgcttcctcaagtggcgaatccagctgctggagcgcggcatcctgtcgaagctggacttctcgcccagcggcatctgctccatggtgcaggttaccgacctcaagaactcgccgcccatgctcggcaagcaccgcgccgtcacccgccaggccgtcacgctgctccaggacaactaccccgagttcattgccaagaaggtgttcatcaatgtgccgtggtggtatctcgctgcaaacaagatgatgagcccattcctcacacagcgcaccaagagcaagttcgtttttgctagcccagccaagtcagcagaaactctattcaggtacatcgcaccggagcaagttcctgtccaatttggaggcctcttcaaggtggacgaccctgagttcaccacctccgacattgtcactgagctcactatcaaaccatcgtcaaaagaaaccattgagatccctgtcaccgagaactccacaattgtatgggaactccgggtgctcggttgggaggtgagctatggcgctgagttcacccccgacgctgagggtgggtacactgtcattgtacagaaatcaaggaaggtgcccgctaacgaggaaccaatcatgaagggaagcttcaaggtaggcgagcccggcaaacttgtgctaactgtgaacaaccctgcatccaagaagaagaagctcctttacagatcaaaggtgaagagcaccagtgaatga

SEQ ID NO: 1576 - protein, 590 aa, Sorghum bicolor
  misc_feature: Ceres ANNOT ID no. 6016414
  misc_feature (504)..(585): Pfam Id: EMP24_GP25L Pfam Desc: emp24/gp25L/p24 family/GOLD
  misc_feature (313)..(499): Pfam Id: CRAL_TRIO Pfam Desc: CRAL/TRIO domain
  misc_feature (232)..(300): Pfam Id: CRAL_TRIO_N Pfam Desc: CRAL/TRIO, N-terminus
  misc_feature (1)..(590): NCBI GI: 82469976 NCBI Desc: patellin 1 [cucurbita pepo]
  misc_feature (246)..(586): NCBI GI: 22137076 NCBI Desc: at1g72160/t9n14_8 [arabidopsis thaliana]
  misc_feature (1)..(221): NCBI GI: 56784842 NCBI Desc: cytosolic factor-like protein [oryza sativa (japonica cultivar-group)]
  misc_feature (478)..(586): NCBI GI: 62319571 NCBI Desc: cytosolic factor [arabidopsis thaliana]
  misc_feature (3)..(247): NCBI GI: 88769927 NCBI Desc: a1l [squirrelpox virus]
  misc_feature: Useful for making plants with modulated nitrogen use efficiency
  misc_feature: Functional homolog of the protein sequence given in SEQ ID NO 13346
  misc_feature: Useful for making plants with modulated nitrogen use efficiency
  misc_feature: Functional homolog of the protein sequence given in SEQ ID NO 13346
MAEETQPEAAAAAAAAAPPAAEVVVTEAVAAEVEVPAAAEAEAEPETEKKADEAAVTADDAGEGTGSFKEESNLVEDLPDPEKKALDEFKQLIAAALAAGEFNLPPPPPPPKAKEEPKAEETKTEEAKTEETKTEEAKTEEPVKEEPKAEAEAAAEEPKAEVAADAPAEEVKTEVPPPEEAKAETVAEEAKPAEPEPQEKTVVVAEEETATKTVETIEETVVSAPAATSEEAVAPEAAAESDAAAPEPVLIWGVPLVGDDECTDTVLLKFLRAREFKVKEAMAMLKSAVLWRKRFGITSLLDADLGLPELENVVFYRGADREGHPVCYNVYGEFQDKDLYEKAFGDDEKRERFLKWRIQLLERGILSKLDFSPSGICSMVQVTDLKNSPPMLGKHRAVTRQAVTLLQDNYPEFIAKKVFINVPWWYLAANKMMSPFLTQRTKSKFVFASPAKSAETLFRYIAPEQVPVQFGGLFKVDDPEFTTSDIVTELTIKPSSKETIEIPVTENSTIVWELRVLGWEVSYGAEFTPDAEGGYTVIVQKSRKVPANEEPIMKGSFKVGEPGKLVLTVNNPASKKKKLLYRSKVKSTSE

SEQ ID NO: 1577 - DNA, 1044 bp, Sorghum bicolor
  misc_feature: Ceres ANNOT ID no. 6016415
  misc_feature: Encodes the peptide sequence at SEQ ID NO 1578
atgggtgggcagcggctcaatctgacgacgtcgtcgctcctcgccgtcgtcgtcctagcgcttctcgccgcgccgagtgccgccgccgcgcaggtcaagacgaccgacacgcggtggagcttccgcctccctctacccagcggcgtcagcggcgccgagagcctcgcgttcgacggcaagggcgagggtccctacgccggcgtgtcggacggtcgcgtcctcaagtggggcggcagctccgtcggctggaccacgtacgcgcacagcgcgaactacaggaagatcccgctatgcacggcgggtgtgctaccgtcgacagagaccgagagcctgtgcggccggcccctgggcctgcagttccacgccaagaccggcgacctctacatcgccgacgcctacctggggctcatgagggtcgggccgggcggcggcgaggcggaggtgctggcgaccggctcggacgacggcgtcccgttcaacttcgtcaacggcctcgacgtcgaccaggccacgggcgacgtctacttcaccgactcgagcgcgacgtacccgaggaggttcaacacggagatcatgatgaacgcggacgcgacggggcggctgctcaggtacgacgcgcggacggggggtgtcaccgtgctcaggtccggcctgccgtacccgaacggcgtggcggtcagccgcgacggcgcgcaggtcgtggtcgcgcacaccgttccgtgccaggcgttcaggtacttcctccgcggcgctcgggcgggacagtacgagctgctggcggacctgccggggtacccggacaacgtgaggcgggacggtaagggtggctactgggtggcgctgaaccaggagaagcagcgcctggacgcgacgtcggagacggctcccgtgaagcacctggtcggggtccgcttggacgctcaaggggtggaggtcgaggagctcacggcggccaagggtgtcacgctgagcgacgtggcggagaggagggggaaactgtggctgggctccgtcgagctcgagtacgtcggactcgttgcttga

SEQ ID NO: 1578 - protein, 347 aa, Sorghum bicolor
  misc_feature: Ceres ANNOT ID no. 6016415
  misc_feature (163)..(251): Pfam Id: Str_synth Pfam Desc: Strictosidine synthase
  misc_feature (53)..(339): Pfam Id: SGL Pfam Desc: SMP-30/Gluconolaconase/LRE-like region
  misc_feature (13)..(346): NCBI GI: 115478879 NCBI Desc: os09g0374900 [oryza sativa (japonica cultivar-group)]
  misc_feature (47)..(285): NCBI GI: 30694556 NCBI Desc: strictosidine synthase family protein [arabidopsis thaliana]
  misc_feature (42)..(282): NCBI GI: 14028757 NCBI Desc: male fertility protein [zea mays]
  misc_feature (49)..(282): NCBI GI: 115455371 NCBI Desc: os03g0750700 [oryza sativa (japonica cultivar-group)]
  misc_feature (49)..(282): NCBI GI: 140040327 NCBI Desc: strictosidine synthase [medicago truncatula]
MGGQRLNLTTSSLLAVVVLALLAAPSAAAAQVKTTDTRWSFRLPLPSGVSGAESLAFDGKGEGPYAGVSDGRVLKWGGSSVGWTTYAHSANYRKIPLCTAGVLPSTETESLCGRPLGLQFHAKTGDLYIADAYLGLMRVGPGGGEAEVLATGSDDGVPFNFVNGLDVDQATGDVYFTDSSATYPRRFNTEIMMNADATGRLLRYDARTGGVTVLRSGLPYPNGVAVSRDGAQVVVAHTVPCQAFRYFLRGARAGQYELLADLPGYPDNVRRDGKGGYWVALNQEKQRLDATSETAPVKHLVGVRLDAQGVEVEELTAAKGVTLSDVAERRGKLWLGSVELEYVGLVA

SEQ ID NO: 1579 - DNA, 1053 bp, Sorghum bicolor
  misc_feature: Ceres ANNOT ID no. 6016416
  misc_feature: Encodes the peptide sequence at SEQ ID NO 1580
atgttgccactgcccaccgtgggggcgggcgccgcgtcgccggtcaccgccgcaggggtagcggcacccctcaggtctcgtccgctccgcctcgtcgcgactcgagccgccactaccccttcttctccctctgcttccacctcggccatatccagcgcgtcaccagcggggcattcccgcaagcacctgtcggtcagggacggctccccgtcgaagcccaccaagccccgggtgttcttcctcgacgtcaatcctttatgcttccgcggctcccagcgcagcctcggcgccttcgcgcgctggctggcgctcttcttcgcacacgtcagcctccgtgaccctgtcgtcgctgttttggacggggaaggaggaaacgagtaccggaggcggttgctgccttcgtacaaggcgcatagagctcgcggagtcggcactggcgctgacacgcgcgtcgttaacgttctccgcgaatgcaatgtcccggttgtaagagtcgatggatatgaggctgatgatgtggtggctaccttgacagaacaggttttacagaaaggttacagagttgtcattgcctcaccagataaagacttcaagcagctgatatctgatgatgttcagctagtcatgcccattcctgagattggccgatggtctttctatacattaaggcattatgtcgctcaatacaagtgtgatccaactgcagacttaagccttaggtgcttcatgggtgatgaaacagatggtgttccaggaatccagcacttggttccaggatttggtcgaaagactgcagtgaaactactgcaaaaacatggttcattagaaaacttgctaaacacagctgcaactagaactgttggcaaagattatgcccaggatgctctcactaagcatgcagattacttacggaaaaattacgaagttcttagtctgaagagggatgtaagtgttcagtttgatgataattggttatccacgaggaacacaagcaatgacaccaatgttctagctgacttcattcttaaatttaatggccaaggcagaagctaa

SEQ ID NO: 1580 - protein, 350 aa, Sorghum bicolor
  misc_feature: Ceres ANNOT ID no. 6016416
  misc_feature (76)..(229): Pfam Id: 5_3_exonuc_N Pfam Desc: 5'-3' exonuclease, N-terminal resolvase-like domain
  misc_feature (231)..(339): Pfam Id: 5_3_exonuc Pfam Desc: 5'-3' exonuclease, C-terminal SAM fold
  misc_feature (25)..(346): NCBI GI: 52421279 NCBI Desc: at1g34380 [arabidopsis thaliana]
  misc_feature (25)..(240): NCBI GI: 42562521 NCBI Desc: 5'-3' exonuclease family protein [arabidopsis thaliana]
  misc_feature (116)..(319): NCBI GI: 4731571 NCBI Desc: dna polymerase i [rhodothermus marinus]
  misc_feature (116)..(319): NCBI GI: 4090935 NCBI Desc: dna polymerase type i [rhodothermus sp. 'iti 518']
  misc_feature (3)..(318): NCBI GI: 67985159 NCBI Desc: dna polymerase a [kineococcus radiotolerans srs30216]
MLPLPTVGAGAASPVTAAGVAAPLRSRPLRLVATRAATTPSSPSASTSAISSASPAGHSRKHLSVRDGSPSKPTKPRVFFLDVNPLCFRGSQRSLGAFARWLALFFAHVSLRDPVVAVLDGEGGNEYRRRLLPSYKAHRARGVGTGADTRVVNVLRECNVPVVRVDGYEADDVVATLTEQVLQKGYRVVIASPDKDFKQLISDDVQLVMPIPEIGRWSFYTLRHYVAQYKCDPTADLSLRCFMGDETDGVPGIQHLVPGFGRKTAVKLLQKHGSLENLLNTAATRTVGKDYAQDALTKHADYLRKNYEVLSLKRDVSVQFDDNWLSTRNTSNDTNVLADFILKFNGQGRS

SEQ ID NO: 1581 - DNA, 4968 bp, Sorghum bicolor
  misc_feature: Ceres ANNOT ID no. 6016417
  misc_feature: Encodes the peptide sequence at SEQ ID NO 1582
atgagtaaaatgtgtcacgcatgtgcatcagaagagacaaccatggatgaagctaatatcgacctgacctgcagtacatcttgctgcaagatgtgtgaccatggtgagggatcatcaattgttactggtgagatcaactggttgaccatagactcgagcccttgcagcactccttatggcacccctatttttacccgagaaaattctttctcaagctttgccagttgcttttcaagccttgattctgattctgaagaggagattgacctccaagatactggtcaatttcatcatgataacctgttaagcaatgattttatggagcaagaagggagttcagtacgagtggaagaatgtcaattcaaggatattgctgatgactgtgctattttttccattccagtaaaacaatatatttcatctgctgaacaacagttggagagacatgaagactccaccaagggaaattttgatgccattaatatttcattggattcggatgtatcttctgaggacagaaaagatatccaatccgatgatcaactggtaagaacggaatgtggtgtaccagtggaagatattaatcataaacaatcaggtgtgatagttgttgaacagatcactagccttcccatgccaggtggtgatatttttccattgaatgaacaagttatggatgaacctggcagtactgcagaaaatgcaatagtttataacaatatatcgaataccgaacctgaaatgaaacatggtactcactttgaaaatgaaaatgaatgcctgtacccgctattattgcccagttttgatgcagatcctttcatttggttaccaccagaaccagaaaataaggaagatgactttgatactgtttctaatgatgatgacgagagtggcactaacagcactgggtggggtaggtcaagtttcaaggttaacttagcagagagaaacaaggaaagccgtgaagaccaattgcagaaagtaatgtcagaagtcatgaatgggcaattcaagatcctagtaggtcgcttcttggctgctgaagggctctctttatctgatggaggcaccgataaaaactggcttgatattcttgcgtcattgtcatgggatgctgcattacttgtcaaacctgatgccaattccggaaatgcaatggatcctggttcgtatgtgaaggtgaaatgcatagcttcaggatattaccagcagagtgaagtgatcaagggtcttgtttttaagaagagtgctgcacataaacagatgcgtgccaatgtaaagcatccaaaactgttacttcttcagggtgcccttggtcattcgtcaacaggactatcatcaataaattcgatgaaacaggaaaatgatcagctggagagaactctttatgaagtgatagtcaaatgccagcctgatgttatattggtcgagaaagcagtttcccgtaacgtaaatgaatatattcagaaacaaggagttacggttgtaagtgacatgaatactcgtcggctggaaagaattgctcgttgcattggctctccaattgtatcgttgcagagtgttcttacgaaacccagtcttattaagcagtgtgagtctctccattttgaaaagtttgttgaagagcataatattactggagaagatggaaggaaatcatgcaaaacatttttatttctagagggttttccaagacctctgggatgcacgatattgctgaaaggagcaacaagggaagaacttaagaagattaagcgtgtgcttcatttcactgtctttgcagcttaccatttgatccttgaaacttcattctttgccgatcaaaagttgtttacaacagacaaaactaccacagggaaagagaagtgctttaacactaatccacaactgcttggtcccagttatgatagttcaaaaaacagtgacaccatgaataacactccaacttgtgatgatcagtatcctaatcaggaaaagctcattcatactgaaaaatcaataccattgcatcttcatgtttccaaaactatgacatctgaagatcctgctggtgaagaacatattgacagcaaaggtattcagtcgtattcgtccctgcctgtttcagatctctcgacaaattttatgcaggacatgtcatcaccagattgtgccgagccaaacacatctgatggttttgatggctcaccattcactgatacttccaaagaggtgcagaagaagcaattgtctagtgacaattttcagggaacttttgatgtaattcgtgctgagagtggagctgctttgaacactcaggacatcttgatttcaatgtctagccaacatatcaggaaccaagctgtttgtgagcagagtcacctttcgcggataacttattatgggtattttgatacatctcttggacgatatttgcaagatactttacttaatgagaaacacaattgcctatcatgcggtgaatctccagaatctcacatgtactcttatacccaccataatggtactctcactgttcttgtgaaaagacttcccttggagttgacactttctggtgaaactcaaggaagaatttggatgtggaccagatgcttgagatgcaatgctaagccgacccatagggttataatatcttcctctgctcggaatctgtcgtttgggaagttcttggaactcagcttctcaacccaatctgctgccaagaagctaccaacatgtgggcatttgcttcatagagactgcctacgtttctttggatttggatccaaagttgctatgttcagatactcatctgtagaaatatattctgcttgtaagcctccattgagtttggagttcaataaccaaaacaaaaaggattggcttgatgtcgaagtgaataatccattgcatcctaacatcattctattctttaaggttattcttaaatggaagcaactcttcacagaaattgaaaatgtaatacaagacttaagatcaagatactctagtcaagccatgggggaagcaaccaacgtttcagtagatgagggattacttttggaggtgtctaggattctcacacaagagaaaaatgaagttgagattattttttggtatgttaacatatcctctgtatacaaggtttctctgagggagtttagccagattgccgtatccgagagttttgctcatgggatccttggtttgaactggctgtaccagcaacttcttcttgggttccacatttgggatcttcggttgcttcatattctgcagtacactaaagttaatactgcatcttcagacaattccattcatgacagcacagcaaagaatgagctgaagagtttgggaagtattgcaatccaggacacaccgtcagtgaagaaaattggaacagaaagaaaggaaacaattataaattcttctgacggctctgaagatccatttggtgatacagttttggataaggttcatcttactgataaactaataaccaaagagcacgatttgcccatttatcaagatcatgatgtaagatcagacctttcctctgtaggcgaagctgctgataagttcgaaacctctgtggagattgctaatgataattgttcagagaaattaaacactataccatttacaaatgatgaacaacctgcagcatccaatgtaaatgaaatgcatcatgttgtcattccaagtgatgatgcaggaaaatggatctggaatcaatttaatcaattggaaatggaatacaagaaagaacttcaaggtggttctttgtataaattctacctcatcaacaaatacaccccatgttcttcatcattggcacaattaaagcatcagatggacttggggcattttatagctggccgtggtggtaatattttttcaatttctgaggaagaggtttctagcattattgcttacgctctaattatatctgaacaacaagggttctattctgaagctgcatctagcaacttggatggaaatgcttctatgctgtcatccatgttgtctccaaatgagtcgttagaaaacaaccataaattttcaaggtttgcatctctagtatcacctgaggaagcaacatcagggttttatgattcatttctgtcatctttaaaagatctgcatcacgaaattgatctgaataatgaaaagatagctctgagaaacacatatactgtcgtttgtatatatgcaaaacaattccatgatcttcggaagatatgttgcccatcagaacttgcatatatttcatcaataagccgctgcaaaaactggaatgcgcagggtggaaagagtaaggttttctttgcgaagtcaatggatgacagatttatcataaaacaaatcaagaagactgagtttgactcgttcttaaagtttggtcttgagtacttcaagcattttggtgtatctcaggtttcaagcaatcctacatgtcttgcgaaaattctgggaatatatcaggttaaggaaactaggaacggcaaggagacaagggttaacttcatggttatggaaaatcttttgtttggacataatataatacgcaaatatgacctgaagggtgctcttttctcacggtatattcctgattcagaaaatcctgaaaaggtgctgttggatcaaaattttattgaagacatgcgtaccatgccaatctacattgaaggaaaaaccaaaaacttcatggaacgcgctatttggaatgacacatctttcttaagtcgcatgactgtcatggattactccctgcttgttggagttgacaaagagaagaaagagcttgtatttggaattatagattatttgagacaatatacctgggacaaacagctggaatcttgggtgaagacatctctttttgttccaaagaacctatccccaactgtaatttcccctagggagtacaaaataagattcagggcgtttatgtcacaatactttctgtcagttccagatgcttga

SEQ ID NO: 1582 - protein, 1655 aa, Sorghum bicolor
  misc_feature: Ceres ANNOT ID no. 6016417
  misc_feature (1418)..(1649): Pfam Id: PIP5K Pfam Desc: Phosphatidylinositol-4-phosphate 5-Kinase
  misc_feature (314)..(774): Pfam Id: Cpn60_TCP1 Pfam Desc: TCP-1/cpn60 chaperonin family
  misc_feature (347)..(966): NCBI GI: 49388824 NCBI Desc: 1-phosphatidylinositol-3-phosphate 5-kinase fab1-like protein [oryza sativa (japonica cultivar-group)]
  misc_feature (1207)..(1654): NCBI GI: 42407781 NCBI Desc: phosphatidylinositol 3,5-kinase-like [oryza sativa (japonica cultivar-group)]
  misc_feature (1230)..(1654): NCBI GI: 38567831 NCBI Desc: osjnbb0020j19.9 [oryza sativa (japonica cultivar-group)]
  misc_feature (1230)..(1654): NCBI GI: 115461526 NCBI Desc: os04g0691900 [oryza sativa (japonica cultivar-group)]
  misc_feature (1287)..(1654): NCBI GI: 144924365 NCBI Desc: chaperonin cpn60/tcp-1; phosphatidylinositol-4-phosphate 5-kinase [medicago truncatula]
MSKMCHACASEETTMDEANIDLTCSTSCCKMCDHGEGSSIVTGEINWLTIDSSPCSTPYGTPIFTRENSFSSFASCFSSLDSDSEEEIDLQDTGQFHHDNLLSNDFMEQEGSSVRVEECQFKDIADDCAIFSIPVKQYISSAEQQLERHEDSTKGNFDAINISLDSDVSSEDRKDIQSDDQLVRTECGVPVEDINHKQSGVIVVEQITSLPMPGGDIFPLNEQVMDEPGSTAENAIVYNNISNTEPEMKHGTHFENENECLYPLLLPSFDADPFIWLPPEPENKEDDFDTVSNDDDESGTNSTGWGRSSFKVNLAERNKESREDQLQKVMSEVMNGQFKILVGRFLAAEGLSLSDGGTDKNWLDILASLSWDAALLVKPDANSGNAMDPGSYVKVKCIASGYYQQSEVIKGLVFKKSAAHKQMRANVKHPKLLLLQGALGHSSTGLSSINSMKQENDQLERTLYEVIVKCQPDVILVEKAVSRNVNEYIQKQGVTVVSDMNTRRLERIARCIGSPIVSLQSVLTKPSLIKQCESLHFEKFVEEHNITGEDGRKSCKTFLFLEGFPRPLGCTILLKGATREELKKIKRVLHFTVFAAYHLILETSFFADQKLFTTDKTTTGKEKCFNTNPQLLGPSYDSSKNSDTMNNTPTCDDQYPNQEKLIHTEKSIPLHLHVSKTMTSEDPAGEEHIDSKGIQSYSSLPVSDLSTNFMQDMSSPDCAEPNTSDGFDGSPFTDTSKEVQKKQLSSDNFQGTFDVIRAESGAALNTQDILISMSSQHIRNQAVCEQSHLSRITYYGYFDTSLGRYLQDTLLNEKHNCLSCGESPESHMYSYTHHNGTLTVLVKRLPLELTLSGETQGRIWMWTRCLRCNAKPTHRVIISSSARNLSFGKFLELSFSTQSAAKKLPTCGHLLHRDCLRFFGFGSKVAMFRYSSVEIYSACKPPLSLEFNNQNKKDWLDVEVNNPLHPNIILFFKVILKWKQLFTEIENVIQDLRSRYSSQAMGEATNVSVDEGLLLEVSRILTQEKNEVEIIFWYVNISSVYKVSLREFSQIAVSESFAHGILGLNWLYQQLLLGFHIWDLRLLHILQYTKVNTASSDNSIHDSTAKNELKSLGSIAIQDTPSVKKIGTERKETIINSSDGSEDPFGDTVLDKVHLTDKLITKEHDLPIYQDHDVRSDLSSVGEAADKFETSVEIANDNCSEKLNTIPFTNDEQPAASNVNEMHHVVIPSDDAGKWIWNQFNQLEMEYKKELQGGSLYKFYLINKYTPCSSSLAQLKHQMDLGHFIAGRGGNIFSISEEEVSSIIAYALIISEQQGFYSEAASSNLDGNASMLSSMLSPNESLENNHKFSRFASLVSPEEATSGFYDSFLSSLKDLHHEIDLNNEKIALRNTYTVVCIYAKQFHDLRKICCPSELAYISSISRCKNWNAQGGKSKVFFAKSMDDRFIIKQIKKTEFDSFLKFGLEYFKHFGVSQVSSNPTCLAKILGIYQVKETRNGKETRVNFMVMENLLFGHNIIRKYDLKGALFSRYIPDSENPEKVLLDQNFIEDMRTMPIYIEGKTKNFMERAIWNDTSFLSRMTVMDYSLLVGVDKEKKELVFGIIDYLRQYTWDKQLESWVKTSLFVPKNLSPTVISPREYKIRFRAFMSQYFLSVPDA

SEQ ID NO: 1583 - DNA, 2532 bp, Sorghum bicolor
  misc_feature: Ceres ANNOT ID no. 6016423
  misc_feature: Encodes the peptide sequence at SEQ ID NO 1584
atggccgccgccgcggcctccttctcggcccttccgttccttctgctgttgctgctggtgccgtcgctagacgccgcctccaatgtgacgtacgaccaccgctccctcatcatctccggccgccgccgcctcatcatctccacctccatccactacccccgcagcgtccccgagatgtggcccaagctggtggctgaagccaaggacggcggcgccgactgcatcgaaacctacgtcttctggaacggccatgagatcgccccaggccagtactacttcgaggaccggttcgacctggtgcggttcgtgaaggtcgttaaagacgctgggctgctcttgatcctgcgcatcggtccctttgtcgccgccgagtggaattttggaggtgtgccggtgtggttgcactacgtgccaggaacggttttcaggacggacaatgaaccattcaagagccatatgaagagtttcacgacatacatcgtgaatatgatgaagaaagagcagctcttcgcttcccagggagggaacattatcctagctcagatagagaatgaatatggagattattatgaacaagcgtatgcacctggcggcaagccatacgcgatgtgggcagctagtatggctgttgctcaaaacactggtgtcccttggattatgtgccaggagtctgatgctcctgatcctgtgataaactcttgtaatggtttctactgtgatggattccagccaaattcaccaaccaagccaaaactttggactgagaattggccaggctggttccagacttttggtgaaagtaatccccacagaccacctgaagatgttgcattcgctgttgcacgttttttcgagaaaggtggcagcgttcagaattactatgtgtatcatggtggcacaaattttggtcgcactactgggggaccattcattacaactagctatgactatgatgcaccaattgatgaatatggcctcaggagatttccaaagtgggcacatctgagggatcttcacaaatccataagattgtgtgagcacaccctgctttatggaaacacaacatttctttctctggggcctaaacaagaggctgatatttacagtgatcagtctggaggatgtgttgcattcctggcaaatattgattcagccaatgacaaagttgtcactttccgtaacaggcaatatgatcttcctgcttggtcagttagtattcttcctgactgcaggaatgtggtgttcaacactgcaaaggtgcaatctcaaacttcgatggtggccatggttccagaaagtttgcaagcatcaaaacctgagcgatggaacattttcagggagagaactgggatttggggtaaaaatgactttgtccgaaatggatttgtggaccatattaatacaacaaaggactccactgactacctatggtacacaacaagttttagtgtggatgaaagttactcgaaagggagccatgttgtcctcaatatagactccaaaggccatggtgtccatgctttcctgaataatgagtttataggcagtgcatatggtaatggctcacaatcaagtttcagtgtgaaattgcctatcaacttgaggactgggaagaatgagcttgcccttctaagtatgactgttggtttacaaaatgcaggattctcttatgaatggataggagcgggctttacaaacgtgaacatctctggtgtgagaaatggaaccataaacttatcttcaaataattgggcatacaagattggactggaaggggaatattatagtttgttcaagcccgatcagagaaataatcaacggtggataccacaatctgagccaccgaaaaaccaacctttgacatggtataaggtaaatgttgatgttccacaaggagatgacccagttgggatagacatgcagtctatggggaaaggcttggtttggttgaacggaaatgccatcgggaggtattggcccaggactagttctattgatgataggtgcactcccagttgtgactacaggggagaatttaatccaaacaagtgcaggacaggttgtggacaaccaactcagagatggtaccatatcccacggtcatggtttcacccctcagggaacatccttgtgatctttgaggaaaagggtggggatcccacgaagatcacattctcaagaagagctgtgacaagcgtgtgctcctttgtgtcagagcactttccttccatagacttggagtcctgggatggaagtgccacaaacgaaggcacatccccagccaaagcacagctgtcttgccccattggtaaaaatatatcttccttgaagtttgcgagcttgggaacccctagtggaacttgtagatcataccaaaaggggagctgccaccacccgaactccttatctgttgttgagaaggcctgtctgaacaccaatagctgtacagtctccctatcagacgagagcttcgggaaggatttatgccctggagtcaccaaaacactcgccatcgaagcggactgttcttag

SEQ ID NO: 1584 - protein, 843 aa, Sorghum bicolor
  misc_feature: Ceres ANNOT ID no. 6016423
  misc_feature (35)..(342): Pfam Id: Glyco_hydro_35 Pfam Desc: Glycosyl hydrolases family 35
  misc_feature (765)..(842): Pfam Id: Gal_Lectin Pfam Desc: Galactose binding lectin domain
  misc_feature (11)..(843): NCBI GI: 61162196 NCBI Desc: beta-d-galactosidase [pyrus pyrifolia]
  misc_feature (28)..(843): NCBI GI: 7939621 NCBI Desc: beta-galactosidase [lycopersicon esculentum]
  misc_feature (27)..(730): NCBI GI: 144923650 NCBI Desc: galactose-binding like [medicago truncatula]
  misc_feature (14)..(843): NCBI GI: 140053716 NCBI Desc: rhodopsin-like gpcr superfamily; d-galactoside/l-rhamnose binding suel lectin; galactose-binding like [medicago truncatula]
  misc_feature (14)..(843): NCBI GI: 56201401 NCBI Desc: beta-galactosidase [raphanus sativus]
  misc_feature (14)..(842): SWISSPROT Homolog: EC 3.2.1.23 Beta-galactosidase precursor
  misc_feature: Useful for making plants with altered cell wall content and/or composition
  misc_feature: GREAT-hit functional homolog of the protein sequence encoded by LOCUS at5g63810
  misc_feature: Useful for making plants with altered cell wall content and/or composition
  misc_feature: Functional homolog of the protein sequence given in SEQ ID NO 13751
  misc_feature: Useful for making plants with altered carbohydrate content
  misc_feature: Functional homolog of the protein sequence given in SEQ ID NO 13588
MAAAAASFSALPFLLLLLLVPSLDAASNVTYDHRSLIISGRRRLIISTSIHYPRSVPEMWPKLVAEAKDGGADCIETYVFWNGHEIAPGQYYFEDRFDLVRFVKVVKDAGLLLILRIGPFVAAEWNFGGVPVWLHYVPGTVFRTDNEPFKSHMKSFTTYIVNMMKKEQLFASQGGNIILAQIENEYGDYYEQAYAPGGKPYAMWAASMAVAQNTGVPWIMCQESDAPDPVINSCNGFYCDGFQPNSPTKPKLWTENWPGWFQTFGESNPHRPPEDVAFAVARFFEKGGSVQNYYVYHGGTNFGRTTGGPFITTSYDYDAPIDEYGLRRFPKWAHLRDLHKSIRLCEHTLLYGNTTFLSLGPKQEADIYSDQSGGCVAFLANIDSANDKVVTFRNRQYDLPAWSVSILPDCRNVVFNTAKVQSQTSMVAMVPESLQASKPERWNIFRERTGIWGKNDFVRNGFVDHINTTKDSTDYLWYTTSFSVDESYSKGSHVVLNIDSKGHGVHAFLNNEFIGSAYGNGSQSSFSVKLPINLRTGKNELALLSMTVGLQNAGFSYEWIGAGFTNVNISGVRNGTINLSSNNWAYKIGLEGEYYSLFKPDQRNNQRWIPQSEPPKNQPLTWYKVNVDVPQGDDPVGIDMQSMGKGLVWLNGNAIGRYWPRTSSIDDRCTPSCDYRGEFNPNKCRTGCGQPTQRWYHIPRSWFHPSGNILVIFEEKGGDPTKITFSRRAVTSVCSFVSEHFPSIDLESWDGSATNEGTSPAKAQLSCPIGKNISSLKFASLGTPSGTCRSYQKGSCHHPNSLSVVEKACLNTNSCTVSLSDESFGKDLCPGVTKTLAIEADCS

SEQ ID NO: 1585 - DNA, 1053 bp, Sorghum bicolor
  misc_feature: Ceres ANNOT ID no. 6016430
  misc_feature: Encodes the peptide sequence at SEQ ID NO 1586
atggcgggtgaggtggacgaggacgtgctgacggagatcctcgcgaggctgccgtgcaggtcgctggcgcggttccagtgcgtctccacgtcgtggcggcgcatcatctccagcgactacctccgccgccggctgccgctcatcacgtcaggggtgctctaccacgacgacacgcaccgcggcggcgacgcggacagcggcaggaggcagcggcaggcgtacacgtacgcgtgcgcgtcaggcggcgtcggcagcggtggcggcacggcggaggccccggacatgggcttcttcccgcgccacgacacgtccaccatcatcgacggctgcaacggcctgctgctctactactcctcccgcccgacggcgttccacgtcgtgaacccaaccacgcggcggtgggcggagctgccgccgccgcgcgccaggacgctgctctccgtgctggcgttcgacccctgcgcgtcgcagcactacagggtggtgtgcttcaccgggtggcttccccggggcgccaccatcgaggtgttcgactccgagcgcggcgcgtggcgggaccacgaggtcgacttcggcctcgacaccgacgccatgtcggccaccatgcactactccggcggcgcgctccacgtgctggcctactcgggccacgtcgtccgcgtcgacctggacaccatggcgtgcgcggtcaccgcgcttccggcccccgtcagctgccgggcgcgcgccgggctctgccgcggggcggcgcgcgcctcagggatctgggagctcaaggacgccgccggaggcgagtgggcgctgaagaacgagatcggggtcagcgacgtcgtccccggcggcgcgtcccagtccatcacgttcttgttcatggcgttccaccccgagcgggagctggtgtacctgtggtcgccgtggaagctgctggcgttcgacgtggtcgagaggcgcgtcgaggaggagtgggtgtttggatcggagaaagatggcacgcatctcatacaggtttggctgtttccattctcgcgccatttggccaacgcgctggcctga

SEQ ID NO: 1586 - protein, 350 aa, Sorghum bicolor
  misc_feature: Ceres ANNOT ID no. 6016430
  misc_feature (1)..(350): NCBI GI: 20804769 NCBI Desc: p0698a10.24 [oryza sativa (japonica cultivar-group)]
  misc_feature (70)..(350): NCBI GI: 115441377 NCBI Desc: os01g0876300 [oryza sativa (japonica cultivar-group)]
  misc_feature (5)..(350): NCBI GI: 115477449 NCBI Desc: os08g0529300 [oryza sativa (japonica cultivar-group)]
  misc_feature (1)..(169): NCBI GI: 51090467 NCBI Desc: f-box domain-like [oryza sativa (japonica cultivar-group)]
  misc_feature (32)..(306): NCBI GI: 50508392 NCBI Desc: receptor-like kinase-like [oryza sativa (japonica cultivar-group)]
MAGEVDEDVLTEILARLPCRSLARFQCVSTSWRRIISSDYLRRRLPLITSGVLYHDDTHRGGDADSGRRQRQAYTYACASGGVGSGGGTAEAPDMGFFPRHDTSTIIDGCNGLLLYYSSRPTAFHVVNPTTRRWAELPPPRARTLLSVLAFDPCASQHYRVVCFTGWLPRGATIEVFDSERGAWRDHEVDFGLDTDAMSATMHYSGGALHVLAYSGHVVRVDLDTMACAVTALPAPVSCRARAGLCRGAARASGIWELKDAAGGEWALKNEIGVSDVVPGGASQSITFLFMAFHPERELVYLWSPWKLLAFDVVERRVEEEWVFGSEKDGTHLIQVWLFPFSRHLANALA

SEQ ID NO: 1587 - DNA, 1848 bp, Sorghum bicolor
  misc_feature: Ceres ANNOT ID no. 6016431
  misc_feature: Encodes the peptide sequence at SEQ ID NO 1588
  misc_feature: Up-regulated in shoot tissues in response to methyl jasmonate treatment
  misc_feature: Up-regulated in root tissues in response to methyl jasmonate treatment
atgcagaggtcgcggagggcccttctgcggaggacggcggcggcgcaggagcagagcgcggtggcggaggcggaggctgccgctaacgggaggaagaggcggctgtatggcttctccgcctccctcgtcgtcgcctcctgggtcgccgtgctcctcctccactccctcgtcggacacggcgacagtcaacgagatggaggaggctatgctgtcgatcttactgttgttgagcctgccttgaatgttggtccttttaatccggttgtacaggtagagcatggagagaatttggcagtgccaggcgatccctgtgttaattctgtcgaaaatgctgtgctttcagaggacacactggtgcaagcagatcagttgtgctccaatgatgaggtgctgagtgagaacacagaagctcttaccaaagacagtcaggttgagctttcaggagatcagggtgggtatcttcctcagtcggatgttgattctggagttcagccaggggagaaggtggagagtgaagatttgccaagaccaccaagactatcacgggttgctcctcctgatcttgatgaattcaagacaagagcaattgctgaaaggggacctggtgtttctagtcaacctggtcatgtcatccaccgaagggagcctagtgggaagttgtataattatgcagcagcatctaaaggggctaaggtcctggatttcaacaaggaggctaagggtgcttccaatatcttagataaagacaaagacaagtacctccgtaatccttgttcagcagagggaaagtttgtcatcatagagctttctgaagaaaccttagtagatacaatcgcaattgcaaattttgagcattattcttctaatccgaaagaatttgaattgctgagcagtctgacatatcccacagaaaactgggagactcttggaagattcactgctgcaaatgcaaaagtttctcagaatttcacttttctcgagccaaagtgggctagatatttgaaactgaacttggtcagccattatggttctgagttctactgtacgctcagtatgcttgaagtgtatggaatggatgctgtagaaaagatgcttgaaaacttgattccagttgagaataagaaaacggaacctgatgacaaaacgaaggagcctgttgaacaaatgcctttgaaggagtcttctggaggaaaagaatcctcacaggaacccctcgatgaagatgaatttgaaatagaagatgttaaaccaaacagtgattcaacgaagaatggcgctaatgatcaagtttcagagacaaggacacttcaggctggcaggattcctggagatacagttcttaagatgctaatgcagaaagttcaatctcttgatgtgagcttctctgtcttggagaagtacctagtggagttgaacagcagatatgggcaaatatttaaggatttcgatgccgatattgatagcaaagatgtcttgttagagaggatcaaatcagagctgaagaatcttgagagcagcaaagatagcattacgaatgaaattgaaggtatcctctcatggaagttagttgcttcctcgcaactaaaccagctggtcctggataatgctctactcagatcggaatttgaaacatttcgacaaaaacaaactgacatggagaacaggagtcttgctgttatatttctcagttttgttttcgcttgcttagctcttgctaagctgtctataggcattatgtccaaattttgtagattctatgactttgaaaagatccataatgtaagatccgggtgggttgtgttgctgcttagcagttgcatcatatccaccattttgataatacagtaa

SEQ ID NO: 1588 - protein, 615 aa, Sorghum bicolor
  misc_feature: Ceres ANNOT ID no. 6016431
  misc_feature (235)..(359): Pfam Id: Sad1_UNC Pfam Desc: Sad1 / UNC-like C-terminal
  misc_feature (1)..(615): NCBI GI: 20804770 NCBI Desc: p0698a10.25 [oryza sativa (japonica cultivar-group)]
  misc_feature (33)..(615): NCBI GI: 115441379 NCBI Desc: os01g0876400 [oryza sativa (japonica cultivar-group)]
  misc_feature (154)..(608): NCBI GI: 51477398 NCBI Desc: membrane protein-like [cucumis melo]
  misc_feature (219)..(519): NCBI GI: 3130035 NCBI Desc: spbc3e7.09 [schizosaccharomyces pombe]
  misc_feature (107)..(363): NCBI GI: 44985332 NCBI Desc: afr673cp [eremothecium gossypii]
  misc_feature: Up-regulated in shoot tissues in response to methyl jasmonate treatment
  misc_feature: Up-regulated in root tissues in response to methyl jasmonate treatment
MQRSRRALLRRTAAAQEQSAVAEAEAAANGRKRRLYGFSASLVVASWVAVLLLHSLVGHGDSQRDGGGYAVDLTVVEPALNVGPFNPVVQVEHGENLAVPGDPCVNSVENAVLSEDTLVQADQLCSNDEVLSENTEALTKDSQVELSGDQGGYLPQSDVDSGVQPGEKVESEDLPRPPRLSRVAPPDLDEFKTRAIAERGPGVSSQPGHVIHRREPSGKLYNYAAASKGAKVLDFNKEAKGASNILDKDKDKYLRNPCSAEGKFVIIELSEETLVDTIAIANFEHYSSNPKEFELLSSLTYPTENWETLGRFTAANAKVSQNFTFLEPKWARYLKLNLVSHYGSEFYCTLSMLEVYGMDAVEKMLENLIPVENKKTEPDDKTKEPVEQMPLKESSGGKESSQEPLDEDEFEIEDVKPNSDSTKNGANDQVSETRTLQAGRIPGDTVLKMLMQKVQSLDVSFSVLEKYLVELNSRYGQIFKDFDADIDSKDVLLERIKSELKNLESSKDSITNEIEGILSWKLVASSQLNQLVLDNALLRSEFETFRQKQTDMENRSLAVIFLSFVFACLALAKLSIGIMSKFCRFYDFEKIHNVRSGWVVLLLSSCIISTILIIQ

SEQ ID NO: 1589 - DNA, 654 bp, Sorghum bicolor
  misc_feature: Ceres ANNOT ID no. 6016432
  misc_feature: Encodes the peptide sequence at SEQ ID NO 1590
atggcgaggaacccaggctgcaccgtcttcataggtaacttggatgaaaaattatctgaaagggtcttgtatgagattcttattcaggcaggccatgtagtagacctacatgtacctagtgacaaggagagtaacagtcgcaaaggttacgcctttgctgagtatgaaaccgaggaaatcgcgcaatacgctgttaggcttttctcaggacttgttcggatcaatggtaaaacgcttaagttcgtgattgctggtcatgacaaaccgtcttcaaatgacaataactcagtaatgctcaatcctgtaccctcttcaaatggcaataacccagtaatgcctaagctcaaccctataccgttaccaaaacagactcaaatcttgcattgttgtgatatgcctgtgtctcgtaccccagcatatccggtggtaaacgggaggattggaggttatggtttttctcccattccttatccatatggttttcacccacaagctttatcaggtggaccagtacacagccatggccaggtaagcaacagtatgtatgattacagtaggcaatttggttctgttctgaacattgcccataggggtcctgttatgaatgcctttgtccatggacctgcgaatcagccaattatgtacccatcctag

SEQ ID NO: 1590 - protein, 217 aa, Sorghum bicolor
  misc_feature: Ceres ANNOT ID no. 6016432
  misc_feature (9)..(81): Pfam Id: RRM_1 Pfam Desc: RNA recognition motif. (a.k.a. RRM, RBD, or RNP domain)
  misc_feature (1)..(217): NCBI GI: 56784854 NCBI Desc: galactosyltransferase-like protein [oryza sativa (japonica cultivar-group)]
  misc_feature (1)..(187): NCBI GI: 115464015 NCBI Desc: os05g0427300 [oryza sativa (japonica cultivar-group)]
  misc_feature (1)..(142): NCBI GI: 86156022 NCBI Desc: rna recognition motif-containing protein [vitis pseudoreticulata]
  misc_feature (3)..(88): NCBI GI: 50604232 NCBI Desc: mgc82420 protein [xenopus laevis]
  misc_feature (3)..(88): NCBI GI: 52694662 NCBI Desc: splicing factor 3b, subunit 4 [danio rerio]
MARNPGCTVFIGNLDEKLSERVLYEILIQAGHVVDLHVPSDKESNSRKGYAFAEYETEEIAQYAVRLFSGLVRINGKTLKFVIAGHDKPSSNDNNSVMLNPVPSSNGNNPVMPKLNPIPLPKQTQILHCCDMPVSRTPAYPVVNGRIGGYGFSPIPYPYGFHPQALSGGPVHSHGQVSNSMYDYSRQFGSVLNIAHRGPVMNAFVHGPANQPIMYPS

SEQ ID NO: 1591 - DNA, 882 bp, Sorghum bicolor
  misc_feature: Ceres ANNOT ID no. 6016435
  misc_feature: Encodes the peptide sequence at SEQ ID NO 1592
atgagtccaccgagtgtgatggggcagtttggggacacaacctacaccaaggtttttgttggtggactcgcgtgggaaacccagaaggagaccatgaggaagtacttcgagcagtttggggagatcctggaggctgttgtcatcactgacaagaacactggcagatccaagggctacggatttgttaccttccgggacccggatgcggcgatgagagcttgcgttgatcccgcaccggtgattgacgggaggagggctaactgtaatcttgcttcccttggggttcaaagatctaggcctcctactccccagcatggaggggctaggaactttagagtgatgaaatctttcagccagcaggcaggaatccaaggtggactgggcgcagcttttccttctcatgccaccttccctcattatgccatcccacaaggcctcccctaccatgtctatgggtactctccatataccccagacggttatccaacaaacttctacagtatatatggaggagctcagtacccattttatggaggagcagcagctggcatggtgacaggaacaagtcccttttatccatatttccagtttgggcaatcaggaaacactactaccaactatacaagtggacaaggctacaacttgcaatatccacaaatgttccagttctcgactgtatcttctacagctgcagctgtcaccggctttgctcagcagtatggaggaccattgtcactagcagcaagccctcaagcccaagcaggcatgactatggcactcgcagctccaaccctgccaactccaacacaggctgctcatccttaccggttgattccctcgcacttcgcagtgtccgctgctccagagcaacccttggcctaa

SEQ ID NO: 1592 - protein, 293 aa, Sorghum bicolor
  misc_feature: Ceres ANNOT ID no. 6016435
  misc_feature (18)..(88): Pfam Id: RRM_1 Pfam Desc: RNA recognition motif. (a.k.a. RRM, RBD, or RNP domain)
  misc_feature (8)..(293): NCBI GI: 57900279 NCBI Desc: rna recognition motif (rrm)-containing protein-like [oryza sativa (japonica cultivar-group)]
  misc_feature (12)..(250): NCBI GI: 18655391 NCBI Desc: at1g33470/f10c21_14 [arabidopsis thaliana]
  misc_feature (11)..(239): NCBI GI: 13605871 NCBI Desc: at1g22910/f19g10_13 [arabidopsis thaliana]
  misc_feature (11)..(193): NCBI GI: 42571597 NCBI Desc: rna recognition motif (rrm)-containing protein [arabidopsis thaliana]
  misc_feature (11)..(193): NCBI GI: 42571595 NCBI Desc: rna recognition motif (rrm)-containing protein [arabidopsis thaliana]
  misc_feature: The sequence is a functional homolog of SEQ ID NO 1042 in the 10/374,780US patent application
  misc_feature: The sequence is a functional homolog of SEQ ID NO 852 in the 10/666,642US patent application
  misc_feature: Useful for making plants with modulated growth and phenotype characteristics
  misc_feature: The sequence is a functional homolog of SEQ ID NO 1042 in the 20060162006 US patent application
  misc_feature: The sequence is a functional homolog of SEQ ID NO. 339 in the 11/188,298 US application
  misc_feature: The sequence is a functional homolog of SEQ ID NO. 458 in the 11/188,298 US application
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARNFRVMKSFSQQAGIQGGLGAAFPSHATFPHYAIPQGLPYHVYGYSPYTPDGYPTNFYSIYGGAQYPFYGGAAAGMVTGTSPFYPYFQFGQSGNTTTNYTSGQGYNLQYPQMFQFSTVSSTAAAVTGFAQQYGGPLSLAASPQAQAGMTMALAAPTLPTPTQAAHPYRLIPSHFAVSAAPEQPLA

SEQ ID NO: 1593 - DNA, 2127 bp, Sorghum bicolor
  misc_feature: Ceres ANNOT ID no. 6016439
  misc_feature: Encodes the peptide sequence at SEQ ID NO 1594
atgattctccggactccaccacagaggaagcgccgcgctggctctagcgctggcgacgacgccgaccttgctcttgtcaaatccgtgggcggcgcgagcgcgaccggccgtagtccggtctccgatcgccgcctggttctctacgaccgccccaccgccctcgtgcctgccgacgcccccggggagccgttcgacgacatggtctgcacgtaccactgccgccagatggtgaaatcggagttcatggtggcactggacactgcagagaagcaagttcaggagtatcaaacaaaacttgttgcattggaggagcaattaactaagagtgaggatgaaaggatgcagttcctggataaactcaactatgtggagcaagaattagcagcaacaaaagggcgggagagttcattacaggaacggctactaaaggagttgagtgaatatcaggagcggtatcgtggtcaagcacgactcaataaagagactggttctaggatcagtgcagaatcatcagtatcatctgcgaaggaattgatcaaagacttggaagggaatttgcatcgattatctgaaagttcagaaagggagaagaaaacccttaagaaggaactttcatatgtgaaagaagacctatccttatctgcttccaaaaataatgctgagcttgagaaaacaagactcagagcagaaaactatgagagtgaggcaaagttgttgaacgagcagttgaccaacttgaaaaagcaacttgacgagtgtctccgtgagaagaatgaaatggagctcaagctattgaactctagtgctttgcttaatcaaaatgcctcaacggatgaccagaagttgatcaagctcttgcaagaggagctccggaattatgaaaaagaagtgcatgaagctaaaaggttgaagtcttcccacacgaatgttgagttgctgaaagaaaagctattggaggagcaggggcgcagggaaagagcagagcttgaattatcaaaactgcaggaaattgatgccaaagcacataagttggagcttgaattagcatcttgtacagcactgctcagcaacatacctgatgtgtcttcttatgctgacatacctcaaaagatcgcagatctgcaaaagcaagcattgacaaatttgaacaaagttggtgaggtaacatcaaggttgaaagaattagaggttgcactagaatttgctgatctcagcaagcaacgtgcagaaggtgaagccacccttgctaaagagagggctgaaactgctactagggaggtcaagcgccttgagcttatgcttgctgcaatcagtgaagaaagagataagctgagaaaggaacatcctacagagtcggatcagtctgggatggaaaaaacaataagagagctggagagcattatacacgagctgaaagaactgattagtcacaaggacactgaactcaatataatgaatgaaagattaagccttgaaacaaggaaagtgaagtctttggagagagagggagatcagctacgctctcaggtggccttactagagtccaagttaggtcatggagattactctgcctcgagcacaaaagtactgcgcatggtaaatactcttggagtcgacaatgaagccaagcagacaatagaagcactacaagctgaactaaagaaaacaaaagagaggctgcaggcagttgaggaactgaaaggacaagctgatgctggaactgtggtagacgctaatattgctgaaaagttggcacaacttaagaatcaaattgcaacacttgaaaaacgtgaagaaagatacaaggcggtgtttgcggagaggatctcagtcttccggaaagcctgctgctccctttttggttacaagatagtgatgaatgatcagcagcagtcaaatgggatccctgtaacacgctttattctgcagtcagtttacgcccaaagcgatgatgaaaagcttgagtttgactatgaatcaggaagcactaatatcgtggtcaatgactacacgtcccaacacgaaattgctcagcaggtcgacatcttcataaggaggatgaactccataccagccttcactgccaacctgacaatggagtctttcaacaaaagaagtatatgctga

SEQ ID NO: 1594 - protein, 708 aa, Sorghum bicolor
  misc_feature: Ceres ANNOT ID no. 6016439
  misc_feature (34)..(706): Pfam Id: MAD Pfam Desc: Mitotic checkpoint protein
  misc_feature (80)..(707): NCBI GI: 8777419 NCBI Desc: mitotic checkpoint protein-like [arabidopsis thaliana]
  misc_feature (93)..(707): NCBI GI: 4580767 NCBI Desc: mitotic checkpoint protein isoform mad1a [homo sapiens]
  misc_feature (93)..(707): NCBI GI: 14602944 NCBI Desc: mad1l1 protein [homo sapiens]
  misc_feature (72)..(706): NCBI GI: 4583429 NCBI Desc: spindle checkpoint protein xmad1 [xenopus laevis]
  misc_feature (93)..(706): NCBI GI: 49899935 NCBI Desc: mad1 mitotic arrest deficient-like 1 [xenopus tropicalis]
MILRTPPQRKRRAGSSAGDDADLALVKSVGGASATGRSPVSDRRLVLYDRPTALVPADAPGEPFDDMVCTYHCRQMVKSEFMVALDTAEKQVQEYQTKLVALEEQLTKSEDERMQFLDKLNYVEQELAATKGRESSLQERLLKELSEYQERYRGQARLNKETGSRISAESSVSSAKELIKDLEGNLHRLSESSEREKKTLKKELSYVKEDLSLSASKNNAELEKTRLRAENYESEAKLLNEQLTNLKKQLDECLREKNEMELKLLNSSALLNQNASTDDQKLIKLLQEELRNYEKEVHEAKRLKSSHTNVELLKEKLLEEQGRRERAELELSKLQEIDAKAHKLELELASCTALLSNIPDVSSYADIPQKIADLQKQALTNLNKVGEVTSRLKELEVALEFADLSKQRAEGEATLAKERAETATREVKRLELMLAAISEERDKLRKEHPTESDQSGMEKTIRELESIIHELKELISHKDTELNIMNERLSLETRKVKSLEREGDQLRSQVALLESKLGHGDYSASSTKVLRMVNTLGVDNEAKQTIEALQAELKKTKERLQAVEELKGQADAGTVVDANIAEKLAQLKNQIATLEKREERYKAVFAERISVFRKACCSLFGYKIVMNDQQQSNGIPVTRFILQSVYAQSDDEKLEFDYESGSTNIVVNDYTSQHEIAQQVDIFIRRMNSIPAFTANLTMESFNKRSIC

SEQ ID NO: 1595 - DNA, 1221 bp, Sorghum bicolor
  misc_feature: Ceres ANNOT ID no. 6016440
  misc_feature: Encodes the peptide sequence at SEQ ID NO 1596
atgatggcactgacggagcggcagccgcagctggagaagaagccgccgagggggaaggcgccgctgtcggggaaggctgtcgtggcgctgtgcgtgacgagcttcgttgtggggctgctgctcagcggcaatgtgtcgctcatgtcggcctcggcgtcggtgtcctcgagcagggacagtgccgagaacgagaagagcattcgtgtttccggctgcgacaacaagcgtaaactcggagagaaccaccccaacgatctcctgaacgaggtgtcgaggactcatgaagcaatccagtcgctggacaaggcagtgtccaccctggagatggagatggccgtggagcgcgcgaggagcggcggcggcagcggcgcggccgtggcatccggcggcaggactccccagaaggccttcgtcgtggtcggcatcaacacggccttcaccagcaagaagcggcgcgactcgctccgcgacacctgggtgcccagaggggataagctgaggaagctggagcaggagaaggggatcgtgatccggttcgtgatcgggcacagcggcacgcccggcggcggcgcgctggaccgcgccctggacgcggaggaggccgagaccagggacttcctgcggctggaccacgccgagggctaccacgagctgtcgtccaagaccaggacctacttcaccaccgccgtcgccacctgggacgccgacttctacgtcaaggtcgacgacgacatccacctcaacctcgggatgctgtcgagcaggctggccaaacacagaacgcggccgagggtgtacgtcggctgcatgaagtccgggcctgtcctgtcacagaaaggagtgaagtaccacgagccagagtactggaagttcggtgacgagggcaacaagtacttccgccacgccaccggccagatctacgccatctccaaggatctcgccgcctacatctccatcaaccagcccatcctgcacaggttcgcgaacgaggacgtctcgctgggcgcgtggctgatcgggctcgaggtcgagcacgtcgacgaccggagcatgtgctgcgcgacgcctccagactgcgagtggaagaagcgagctgggaacgtgtgcgtggcgtccttcgactggtcgtgcagcggcgtctgcaagtcggtggacaggatgcggcacatccacaaggcgtgcggcgaaggcgaaggggccgtctggaacgccgccacatga

SEQ ID NO: 1596 - protein, 406 aa, Sorghum bicolor
  misc_feature: Ceres ANNOT ID no. 6016440
  misc_feature (150)..(349): Pfam Id: Galactosyl_T Pfam Desc: Galactosyltransferase
  misc_feature (1)..(403): NCBI GI: 115464013 NCBI Desc: os05g0427200 [oryza sativa (japonica cultivar-group)]
  misc_feature (17)..(404): NCBI GI: 4138265 NCBI Desc: avr9 elicitor response protein [nicotiana tabacum]
  misc_feature (27)..(395): NCBI GI: 115446789 NCBI Desc: os02g0566800 [oryza sativa (japonica cultivar-group)]
  misc_feature (19)..(403): NCBI GI: 145362395 NCBI Desc: galactosyltransferase family protein [arabidopsis thaliana]
  misc_feature (22)..(404): NCBI GI: 21360399 NCBI Desc: at1g05170/yup8h12_22 [arabidopsis thaliana]
  misc_feature: Useful for making plants with altered carbohydrate content
  misc_feature: Functional homolog of the protein sequence given in SEQ ID NO 13658
MMALTERQPQLEKKPPRGKAPLSGKAVVALCVTSFVVGLLLSGNVSLMSASASVSSSRDSAENEKSIRVSGCDNKRKLGENHPNDLLNEVSRTHEAIQSLDKAVSTLEMEMAVERARSGGGSGAAVASGGRTPQKAFVVVGINTAFTSKKRRDSLRDTWVPRGDKLRKLEQEKGIVIRFVIGHSGTPGGGALDRALDAEEAETRDFLRLDHAEGYHELSSKTRTYFTTAVATWDADFYVKVDDDIHLNLGMLSSRLAKHRTRPRVYVGCMKSGPVLSQKGVKYHEPEYWKFGDEGNKYFRHATGQIYAISKDLAAYISINQPILHRFANEDVSLGAWLIGLEVEHVDDRSMCCATPPDCEWKKRAGNVCVASFDWSCSGVCKSVDRMRHIHKACGEGEGAVWNAAT

SEQ ID NO: 1597 - DNA, 2133 bp, Sorghum bicolor
  misc_feature: Ceres ANNOT ID no. 6016441
  misc_feature: Encodes the peptide sequence at SEQ ID NO 1598
atggtggtgaacggccggccgctgaagagggcgagggcgcgggtcgaggccacggacttcgctaggttcccggcggccggagactgcggggcggccggtacgttcagggaggcggtgagggggttcctcgcaaagcatgcgaggctgctcccgttgccgtccatcttctccccggcggccgcggccgccccgccgcgcctgctgatctggagggtgtccctaagggtcggggaggcgggggaggaagagagcggcggcagggtggagctcaacgtcgttgaggaggatgtgctccgatcccgatccgtgtattgcgaccagtgcagagtcgtgggttggagtgggcacccagtctgcgtgaagcggtaccatttcatcatcgagaatgatagcctttctgatcgccggcgcacctgctgcctccgctgcggaacacccatggcagctggagaatcaaggtgtgctctgtgcaatttcgatatggatggtgaggaggtcgaagagtgtgcatatctgcatctggatgactcatctcacttgctgcacgctgtagtgcatgcaaatggttatgggcaccttctcagggtaaatgggcgtgaaggtggctcaagattcctcactggccgtgacataatgagcttgtgggatcgcttgtgcaaggtgttacatgtgaggaaggtaactgtcatggacatatccaagaaacatggaatggactacagacttctacatgcagtcacaaacggacacccttggtatggccaatggggatacaagtttggtgctggcagctttgctctcacctcagacacctaccaaaatgcagtagacatgctttccaacataaacctggcgctgtactactcacaccgtagcccaattaggactgcattgcagaacacaattgctctttattgggcgctctctaatcggcagctagtgaccctccgggatcttttccgcttcattatgcacctccttcatcaaggtcaaaagatgtcaaaaccctcaactgacaagcacaaggagcttacatctaatgagctatgtgcatggactaaagaagatctacatcgagcagaaggtgcaatgctcaaggttctccaggttgtccaaactggacagtgggtatcttggcgcgcacttaggggtgctgcgtcgaaggctgttgattcgcaggagctgcttgattattctctccgagaactgggtgggaaacaactggataatggcctttctgttgctgtccgctgcaatgctgagactagtgcaattgagtacaggctggaatcttcatccactcggtctccagcaaatgcagctacatttggaccttctgttgaacaactgctgcatgatcttaggttcctctacgatgctttgctgaacccagagtccatgttgtcttcacaaccagaggtggttggtgcatcagctcacagcgcagcagcaaagattattgattgcaagcagttcatcaaacattatgatgagcatgcgctgcggactccttcaaacccatacctgctctgtgtgaggtgctccattgaactgcttgatcacccaaaagattacacaacacctccagaggaacttgtacttctaccagcaagtgctaccctaggtgacctgaaagtacaggcttcaaaggctttccaagaaacgtacctgatgttccaaagcttccagactgaacagctccctgacttcccaaacttcagtgacacaacccccgtgaatcatgtgcttggatcaggccagttgcttcgagtaaggggacgttgcactggagattacaggaggattgtacagttcaggatggagaggggtttggagaactggacggtggactgctcatgtggtgccaaggatgatgatggggaacggatgctagcatgtgacatatgtggagtctggcagcataccaggtgctcgggtataagtgattttgaggaagtccctgaaaatttcatctgcaggaagtgtgctacacgcaaaggaaaaggacgtgggggtgggggtagcaacggtgatggaacaatggaggttagtgcggctgggaggtgcaaggatgagattggatcatctgttggtggtgcaggcaagtttgggcgcatggcaacagttggatga

SEQ ID NO: 1598 - protein, 710 aa, Sorghum bicolor
  misc_feature: Ceres ANNOT ID no. 6016441
  misc_feature (617)..(665): Pfam Id: PHD Pfam Desc: PHD-finger
  misc_feature (167)..(438): NCBI GI: 15554515 NCBI Desc: male sterility 1 protein [arabidopsis thaliana]
  misc_feature (174)..(662): NCBI GI: 115454955 NCBI Desc: os03g0716200 [oryza sativa (japonica cultivar-group)]
  misc_feature (175)..(431): NCBI GI: 32140244 NCBI Desc: male meiotic chromosome organization protein [arabidopsis thaliana]
  misc_feature (88)..(637): NCBI GI: 115479451 NCBI Desc: os09g0449000 [oryza sativa (japonica cultivar-group)]
  misc_feature (607)..(671): NCBI GI: 56966777 NCBI Desc: chain a, solution structure of phd domain in phd finger family protein
MVVNGRPLKRARARVEATDFARFPAAGDCGAAGTFREAVRGFLAKHARLLPLPSIFSPAAAAAPPRLLIWRVSLRVGEAGEEESGGRVELNVVEEDVLRSRSVYCDQCRVVGWSGHPVCVKRYHFIIENDSLSDRRRTCCLRCGTPMAAGESRCALCNFDMDGEEVEECAYLHLDDSSHLLHAVVHANGYGHLLRVNGREGGSRFLTGRDIMSLWDRLCKVLHVRKVTVMDISKKHGMDYRLLHAVTNGHPWYGQWGYKFGAGSFALTSDTYQNAVDMLSNINLALYYSHRSPIRTALQNTIALYWALSNRQLVTLRDLFRFIMHLLHQGQKMSKPSTDKHKELTSNELCAWTKEDLHRAEGAMLKVLQVVQTGQWVSWRALRGAASKAVDSQELLDYSLRELGGKQLDNGLSVAVRCNAETSAIEYRLESSSTRSPANAATFGPSVEQLLHDLRFLYDALLNPESMLSSQPEVVGASAHSAAAKIIDCKQFIKHYDEHALRTPSNPYLLCVRCSIELLDHPKDYTTPPEELVLLPASATLGDLKVQASKAFQETYLMFQSFQTEQLPDFPNFSDTTPVNHVLGSGQLLRVRGRCTGDYRRIVQFRMERGLENWTVDCSCGAKDDDGERMLACDICGVWQHTRCSGISDFEEVPENFICRKCATRKGKGRGGGGSNGDGTMEVSAAGRCKDEIGSSVGGAGKFGRMATVG

SEQ ID NO: 1599 - DNA, 798 bp, Sorghum bicolor
  misc_feature: Ceres ANNOT ID no. 6016449
  misc_feature: Encodes the peptide sequence at SEQ ID NO 1600
atggacaccttcttcctatcgcacggctcgcccacgctctccatcgacgacaagatcccggcgcggcacttcttcaagtcgtgggtgccggcgaaggtcgcgggcgaccaggcaccgcgcgccatcctcgtcgtgtcggggcactgggagacggccacgccggcggtcaacgtcatccgaggcagcaacgacaccatctacgacttctatggctttcccaagcccatgtaccagctcaagtacccggctcctggcgccccggacttggccctgcggaccaaggagctcctggagcaagccgggttcggccccgtgaaggaggaccacagccgcgggctggaccacggcgcgtgggtgccgctgatgctcatgtacccggacgccaacatccccgtgtgccagctatcggtacagagcgaccgcgacggcacgtaccactacaacctcggcaaggcgctggcgccgctgcgggaggaaggcatcctcatcgtcggctccggcagcgccacccacaacctgcgcaagatgggcccgttcgacgcgcccgtgccgcggtgggtcgccgagttcgacacctggctcaaggactcgctcctgggcggacggtacgaggacgtgaaccggtacgaggagaaggcgccgcacgggagggcggcgcacccgtggccggaccacttctacccgctgcacgtcgcgctcggcgccgccggggacgccgccaaggcggagcagatccaccactgctggaccaacgccacgctctcctacgcgtcctacaggttcaccaccaacagctga

SEQ ID NO: 1600 - protein, 265 aa, Sorghum bicolor
  misc_feature: Ceres ANNOT ID no. 6016449
  misc_feature (2)..(262): Pfam Id: LigB Pfam Desc: Catalytic LigB subunit of aromatic ring-opening dioxygenase
  misc_feature (1)..(263): NCBI GI: 22202675 NCBI Desc: p0471b04.17 [oryza sativa (japonica cultivar-group)]
  misc_feature (1)..(263): NCBI GI: 115441405 NCBI Desc: os01g0878800 [oryza sativa (japonica cultivar-group)]
  misc_feature (1)..(265): NCBI GI: 22202676 NCBI Desc: p0471b04.18 [oryza sativa (japonica cultivar-group)]
  misc_feature (2)..(265): NCBI GI: 92871222 NCBI Desc: extradiol ring-cleavage dioxygenase, class iii enzyme, subunit b [medicago truncatula]
  misc_feature (2)..(263): NCBI GI: 34850080 NCBI Desc: 4,5-dopa dioxygenase extradiol [beta vulgaris]
MDTFFLSHGSPTLSIDDKIPARHFFKSWVPAKVAGDQAPRAILVVSGHWETATPAVNVIRGSNDTIYDFYGFPKPMYQLKYPAPGAPDLALRTKELLEQAGFGPVKEDHSRGLDHGAWVPLMLMYPDANIPVCQLSVQSDRDGTYHYNLGKALAPLREEGILIVGSGSATHNLRKMGPFDAPVPRWVAEFDTWLKDSLLGGRYEDVNRYEEKAPHGRAAHPWPDHFYPLHVALGAAGDAAKAEQIHHCWTNATLSYASYRFTTNS

SEQ ID NO: 1601 - DNA, 609 bp, Sorghum bicolor
  misc_feature: Ceres ANNOT ID no. 6016450
  misc_feature: Encodes the peptide sequence at SEQ ID NO 1602
atggcagctacaacgagcttgctgctctgcctgttgctcgcctttcttcacggcctccagtttcatatccctcctgtagcagctgcgacgacgtcgacgtcgcacaacaagaccgagagccgacgagatgcgcgcgggaagacgctgagcttcacgctgtaccagcacgagaccatcaacaagaccggctacatcgtggtggacggcgtcgcgggcgcgggcgtcagccagaccaccacgcccttcggcaccatctacgtcttccgcgacgacctgacggtgcacgcggacaggaagtccccggtggccggcgtcgcggaggggagctccatcaccaccagcctcgacgggctgcagagcctgtcgctggccaagatcacggtccaccaccgcggccaccggggctccgtctccgtcctcggcggcacctacaacaccaagccatcagactacccggtggtcggtggcaccggcgacttcgcgtacgcgctaggatacgtccggtcgtcgccgttggacttgcggggacggacggtgacgtacaagatggagcttcacttgtactggcctccgtacgctcactacgctccggttccgcataaagcgtga

SEQ ID NO: 1602 - protein, 202 aa, Sorghum bicolor
  misc_feature: Ceres ANNOT ID no. 6016450
  misc_feature (21)..(187): Pfam Id: Dirigent Pfam Desc: Dirigent-like protein
  misc_feature (4)..(197): NCBI GI: 22202678 NCBI Desc: p0471b04.20 [oryza sativa (japonica cultivar-group)]
  misc_feature (7)..(199): NCBI GI: 22202680 NCBI Desc: p0471b04.22 [oryza sativa (japonica cultivar-group)]
  misc_feature (30)..(193): NCBI GI: 92867316 NCBI Desc: dirigent-like protein [medicago truncatula]
  misc_feature (26)..(188): NCBI GI: 115484459 NCBI Desc: os11g0179700 [oryza sativa (japonica cultivar-group)]
  misc_feature (46)..(191): NCBI GI: 88771141 NCBI Desc: dirigent-like protein pdir9 [picea engelmannii x picea glauca]
MAATTSLLLCLLLAFLHGLQFHIPPVAAATTSTSHNKTESRRDARGKTLSFTLYQHETINKTGYIVVDGVAGAGVSQTTTPFGTIYVFRDDLTVHADRKSPVAGVAEGSSITTSLDGLQSLSLAKITVHHRGHRGSVSVLGGTYNTKPSDYPVVGGTGDFAYALGYVRSSPLDLRGRTVTYKMELHLYWPPYAHYAPVPHKA

SEQ ID NO: 1603 - DNA, 1902 bp, Sorghum bicolor
  misc_feature: Ceres ANNOT ID no. 6016456
  misc_feature: Encodes the peptide sequence at SEQ ID NO 1604
atgggttccttggaggcccggtatcggccggccggggcagctgaggacacagctaagagaaggacccagaaaagcaaaagtttcaaagaggttgaaaaatttgatgtttttgtgctggagaaaagttcaggttgcaaattccgatcgttgcaacttttgctcttcgctatcatgtctgctgcatttctaacactcctatacacaccatctgtgtatgaacatcagttgcagtcaagctctcggcttgtcaatgggtggatatgggataagagaagttctgatccccgatatgtatcttctgccagcattcaatgggaggatgtgtataaaagtatccaaaatctgaatgttggtgaacaaaagctcagtgttggactcctgaattttaatagaactgagtttggcgcttggacacatatgctcccagaaagtgatttttcaatcataaggctagagcatgccaatgaaagcattacctggcagactctgtatcctgaatggatagatgaggaggaagaaacagagataccatcttgcccttcgcttccagatccaagttttccaagagcgacacattttgatgttgttgctgttaagcttccctgttctcgtgtggcgggttggtcaagagatgttgcaaggctgcatttgcagttgtcagcagcaaaattagcggcagccacaacaagaggcaatagtggaatccatgtgctgtttgtgactgattgcttcccaattccaaatctcttctcttgcaaggacctagtgaaacgtgaaggcaatgcatggctgtacaaacctgacgtgaaggctctgaaggagaagctcaggctgcctgttggttcatgtgagcttgctgttcctctcaacgcaaaagcacgactctacacagtagacagacgcagagaagcatatgctacaatactgcattcagcaagtgaatatgtttgcggtgcaatcacagcagctcaaagcattcgtcaagcaggatcaacaagagaccttgttattcttgttgatgacaccataagtgaccaccaccgcaaggggctggaatctgcggggtggaaggtcaggataatagagaggatccggaatcccaaagctgaacgtgatgcctacaatgaatggaactacagcaaattcaggctatggcagcttacagattatgacaaggttatttttattgatgctgatctcctcatactgaggaacattgacttcttgtttgcaatgcctgaaatcactgcaactgggaacaatgcgacactcttcaactccggagtgatggtcattgagccttcaaactgcacattccagttactgatggagcacatcaatgagataacatcttacaatggtggtgaccaaggatacctcaatgagatattcacatggtggcatcggattccaaaacacatgaatttcttgaagcatttctgggagggtgatgaagaggaggtgaaagccaagaagactcgtttgtttggtgctaacccaccgatcctctatgtccttcactacttgggccgaaagccgtggttgtgttttcgggactatgattgtaactggaatgttgaaatcctgcgggagtttgcgagtgatgtagcgcatgctcgctggtggaaggtgcacaacaagatgcccaagaagcttcagagctattgccttctgaggtcaaggttgaaggctgggttggagtgggagcggcggcaggctgagaaagcaaacttcactgatgggcattggaaacggaacataactgatccgaggctgaaaacttgctttgagaagttctgcttctgggagagcatgctatggcattggggtgagaacaagaacaactcgacgcagaacagtgcagtgccggcaacacctactgcgagcctgtcgagctcatga

SEQ ID NO: 1604 - protein, 633 aa, Sorghum bicolor
  misc_feature: Ceres ANNOT ID no. 6016456
  misc_feature (306)..(518): Pfam Id: Glyco_transf_8 Pfam Desc: Glycosyl transferase family 8
  misc_feature (1)..(633): NCBI GI: 56784626 NCBI Desc: glycogenin-like protein [oryza sativa (japonica cultivar-group)]
  misc_feature (2)..(630): NCBI GI: 60657592 NCBI Desc: secondary cell wall-related glycosyltransferase family 8 [populus tremula x populus tremuloides]
  misc_feature (3)..(631): NCBI GI: 60657590 NCBI Desc: secondary cell wall-related glycosyltransferase family 8 [populus tremula x populus tremuloides]
  misc_feature (269)..(629): NCBI GI: 115464005 NCBI Desc: os05g0426400 [oryza sativa (japonica cultivar-group)]
  misc_feature (193)..(595): NCBI GI: 46389857 NCBI Desc: lycogenin glucosyltransferase (glycogenin)-like protein [oryza sativa (japonica cultivar-group)]
  misc_feature: Useful for making plants with altered cell wall content and/or composition
  misc_feature: Functional homolog of the protein sequence encoded by LOCUS at1g77130
  misc_feature: GREAT-hit functional homolog of the protein sequence encoded by LOCUS at3g18660
  misc_feature: Useful for making plants with altered carbohydrate content
  misc_feature: Functional homolog of the protein sequence given in SEQ ID NO 13653
  misc_feature: Useful for making plants with altered cell wall content and/or composition
  misc_feature: Functional homolog of the protein sequence given in SEQ ID NO 13752
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSSASIQWEDVYKSIQNLNVGEQKLSVGLLNFNRTEFGAWTHMLPESDFSIIRLEHANESITWQTLYPEWIDEEEETEIPSCPSLPDPSFPRATHFDVVAVKLPCSRVAGWSRDVARLHLQLSAAKLAAATTRGNSGIHVLFVTDCFPIPNLFSCKDLVKREGNAWLYKPDVKALKEKLRLPVGSCELAVPLNAKARLYTVDRRREAYATILHSASEYVCGAITAAQSIRQAGSTRDLVILVDDTISDHHRKGLESAGWKVRIIERIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEEEVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKTCFEKFCFWESMLWHWGENKNNSTQNSAVPATPTASLSSS

SEQ ID NO: 1605 - DNA, 1047 bp, Sorghum bicolor
  misc_feature: Ceres ANNOT ID no. 6016462
  misc_feature: Encodes the peptide sequence at SEQ ID NO 1606
atggcctccgccgatgccgacgccgggacctgcccgtgggacgccctcccgtcgcacctccaggagcgcatcctctccctcctccccatcaccgagctacttcccgtcgccgcggtgtcccgcgcgctccgccgcctcctgcggtccccggcgttccacgccctcctatccccgcaccgcctcgacgccttcttcctcctttccccacggctcgccgtccacccgctgtcccgccgcgtcctcactttgcctgcgctcgccgcgctctctcccccttcctacccgctcgtctcctccccgtccccatcgctcctcatcacctgcgcctcactccagttcctcccgccgatccccgacggagcctacctcctctccgttatcgtcccgtcgcgccgctcctccccctcctgcaccctcgtcgctgtcaccaccggcgcagccgtgcgttctcacaccctggacaccggcgatccctccccgcgttgggcgtctagaggcgatctcccgctgtctctcacgatcctgggaaacgccgcagtcgcccgtgaccgcggcaagctcttcgtcctcggccgtggtcccgacgcgctcttggcttttgatctcgtgacggggacatgggaggtgccgcctgttgtgatgccacaaggtctcactacggcgcacctgtttgtttttgatgggagcctgttcttagtaggtgggatcgagagctttggagaagtggagcgggtggtggtctggcggctggacgtcgataaggaggaggtgtggtggtggagggaggtgagcgagatgccgaccgaggttttcgatgagttgctggctggtaggtttggcagtttctggcattttcaggctgcggacagattggggattgtttgcttgtacaatgccgtggatgggaggctggtcatgtttgatgcatctgatggcgcgtggactgtgctgccacgattgtctgggttggatgcagacgagagcctcaggtggtttggacatgtcttggagccaggagttgaaatcttgatgggactacgttggtga

SEQ ID NO: 1606 - protein, 348 aa, Sorghum bicolor
  misc_feature: Ceres ANNOT ID no. 6016462
  misc_feature (11)..(58): Pfam Id: F-box Pfam Desc: F-box domain
  misc_feature (161)..(315): NCBI GI: 32488383 NCBI Desc: osjnba0043a12.13 [oryza sativa (japonica cultivar-group)]
  misc_feature (132)..(315): NCBI GI: 124361081 NCBI Desc: cyclin-like f-box; galactose oxidase, central [medicago truncatula]
  misc_feature (150)..(318): NCBI GI: 42795315 NCBI Desc: fimbriata [mimulus lewisii]
  misc_feature (162)..(334): NCBI GI: 4101570 NCBI Desc: stamina pistilloidia [pisum sativum]
  misc_feature (162)..(334): NCBI GI: 30526089 NCBI Desc: stp-h4 [pisum sativum]
MASADADAGTCPWDALPSHLQERILSLLPITELLPVAAVSRALRRLLRSPAFHALLSPHRLDAFFLLSPRLAVHPLSRRVLTLPALAALSPPSYPLVSSPSPSLLITCASLQFLPPIPDGAYLLSVIVPSRRSSPSCTLVAVTTGAAVRSHTLDTGDPSPRWASRGDLPLSLTILGNAAVARDRGKLFVLGRGPDALLAFDLVTGTWEVPPVVMPQGLTTAHLFVFDGSLFLVGGIESFGEVERVVVWRLDVDKEEVWWWREVSEMPTEVFDELLAGRFGSFWHFQAADRLGIVCLYNAVDGRLVMFDASDGAWTVLPRLSGLDADESLRWFGHVLEPGVEILMGLRW

SEQ ID NO: 1607 - DNA, 1710 bp, Sorghum bicolor
  misc_feature: Ceres ANNOT ID no. 6016469
  misc_feature: Encodes the peptide sequence at SEQ ID NO 1608
atgtcttttgctaggcgtctggacccatcagcttacacggataatctatacattcacaaatttgccacaccaagctcaacttttgctgctcgaagattctcctctgatacacagttgttccgttatgacccagaaccatacaatgagtatgggcatatgggtttcactggagcaccatccgctgcatttcaaaactccctttgtagtcaacaggcctcactaaaaccataccatgtaactaatgatggacgatctccaagtgttgcagatactcagtctaactcatgctctgatgcagcaaaagattcaccagtggtttccaatgtctctcagcagaactcccagtctgtatcagatagtcagagttctgaaatcgaagtagagttcgatgaagatgacattaggctgaagcttcaggagctggagcatgctttacttgacgatggtgatgatatcttgtttgacatttcccaggcaggtagcattaatgatgaatgggctgaccccatgaagaatgtattgcttccaaattcaccaaaagaatcagagtcaagcatcagttgtgctgttagcaacagtggagctccaaggactccaaagcaattgctctttgactgtgctactgcattgtctgaatacaacacagatgaagcacaggcgatcataacagaactccgacagatggtctccattcaaggggacccttctcaaaggattgcagcataccttgtagagggccttgctgcaagaatagtagcttcagggaacggcatctacaaggctttgacatgcaaggatcctccaactctgtatcaactttcagcaatgcaaatcctctttgaaatatgtccatgcttccgtttgggcttcatggctgctaactatgctatagttgaagcctgcaaaggagaagaaagacttcacattatcgactttgacatcaatcaaggcagccagtacattacattgatacaatttctgaaaaacaatgcaaacaagccacgccatttgaggataactggagttgatgatcccgagacagttcagaggcccattggaggtctgagggtcattgggcaacgcctagagaagcttgcagaggactgtggggtatctttcgaattcagggcagtgggtgctaacattggggatgttacacctgcaatgcttgattgccgtcctggtgaagcacttgttgtcaattttgcattccagttgcaccatcttcctgacgagagtgtttcaattatgaatgaaagggaccagctcctccgtatggtgaagggactccatccaaagctagtgaccctggttgagcaagatgccaatactaatactgcaccgtttctgccaaggttccgtgaagtctatgattactactctgcgctttttgattctttagatgcaacacttccaagggagagcccggatagaatgaatgtggagaggcaatgtcttgcacgagaaattgttaacatcttggcttgtgaaggtcctgatcgtgtggagaggtacgaagttgctgggaaatggagagcaagaatgacaatggccggtttcataccatgcgcatttaacagcaatgtcatcagtggaataaagtcgacactgaaatcatattgtgataggtacaagttccacgaggatcatggcgggcttcacttcggttggggggagaagactctcattgtctcctctgcatggcagtag

SEQ ID NO: 1608 - protein, 569 aa, Sorghum bicolor
  misc_feature: Ceres ANNOT ID no. 6016469
  misc_feature (175)..(479): Pfam Id: GRAS Pfam Desc: GRAS family transcription factor
  misc_feature (1)..(569): NCBI GI: 146147357 NCBI Desc: scarecrow [aeluropus littoralis]
  misc_feature (64)..(569): NCBI GI: 20161431 NCBI Desc: scarecrow-like protein [oryza sativa (japonica cultivar-group)]
  misc_feature (107)..(569): NCBI GI: 89474470 NCBI Desc: gras6 [solanum lycopersicum]
  misc_feature (220)..(569): NCBI GI: 4580513 NCBI Desc: scarecrow-like 1 [arabidopsis thaliana]
  misc_feature (194)..(568): NCBI GI: 73620052 NCBI Desc: chitin-inducible gibberellin-responsive protein 2
  misc_feature: The sequence is a functional homolog of SEQ ID NO 1327 in the 10/374,780US patent application
  misc_feature: Useful for making plants with altered Lignin content
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 12889
  misc_feature: The sequence is a functional homolog of SEQ ID NO 1327 in the 20060162006 US patent application
  misc_feature: Useful for making plants with altered alkaloid content
  misc_feature: Useful for making plants with altered lignin content
  misc_feature: Functional homolog of the protein sequence given in SEQ ID NO 12889
  misc_feature: Useful for making plants with modulated low light sensitivity
  misc_feature: Functional homolog of the protein sequence given in SEQ ID NO 13378
  misc_feature: The sequence is a functional homolog of SEQ ID NO 474 in the 10/666,642 US patent application
  misc_feature: Useful for making plants with modulated light quality sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: The sequence is a functional homolog of SEQ ID NO 220 in the 10/412,699 US patent application
  misc_feature: The sequence is a functional homolog of SEQ ID NO 443 in the 11/479,226 US patent application
MSFARRLDPSAYTDNLYIHKFATPSSTFAARRFSSDTQLFRYDPEPYNEYGHMGFTGAPSAAFQNSLCSQQASLKPYHVTNDGRSPSVADTQSNSCSDAAKDSPVVSNVSQQNSQSVSDSQSSEIEVEFDEDDIRLKLQELEHALLDDGDDILFDISQAGSINDEWADPMKNVLLPNSPKESESSISCAVSNSGAPRTPKQLLFDCATALSEYNTDEAQAIITELRQMVSIQGDPSQRIAAYLVEGLAARIVASGNGIYKALTCKDPPTLYQLSAMQILFEICPCFRLGFMAANYAIVEACKGEERLHIIDFDINQGSQYITLIQFLKNNANKPRHLRITGVDDPETVQRPIGGLRVIGQRLEKLAEDCGVSFEFRAVGANIGDVTPAMLDCRPGEALVVNFAFQLHHLPDESVSIMNERDQLLRMVKGLHPKLVTLVEQDANTNTAPFLPRFREVYDYYSALFDSLDATLPRESPDRMNVERQCLAREIVNILACEGPDRVERYEVAGKWRARMTMAGFIPCAFNSNVISGIKSTLKSYCDRYKFHEDHGGLHFGWGEKTLIVSSAWQ

SEQ ID NO: 1609 - DNA, 1146 bp, Sorghum bicolor
  misc_feature: Ceres ANNOT ID no. 6016470
  misc_feature: Encodes the peptide sequence at SEQ ID NO 1610
atggatggtgcacagccaccgagtgggcaattgaacaactcgttcaatactcttatggtttctggagatgagcagagtcaacagccgcaggatgctgggaatgaaaccagcttcacgaattggaaagaccttcccatggagctgcttctgcgtatcatttcactagttggagatgacaggatagtcattgtggcctctggtgtatgcacaggatggcgtgacacattagggtggggagttgcaaatctttcgctgtcatggtgccaggaccacatgaatgacttggtgatgtcactggctcacaaattcacgaagctccaagttctatctctacgccaaatcagagctcagctagaagacagtggggtggaggccgtggcgaacaactgccatgatttacgcgagctggatcttagcagaagctttaggctcagcgacctgtccttgtacgctctggcgcacgggtgccctcaccttacaaggctcaacatcagtgggtgctccaatttcagtgattcggctcttgtgttcctctctagccagtgcaagaacctcaaatgcttgaacctgtgcgggtgtgtgagggcagcttctgacagagcgctacaggccatcgcatgtaactgtggccagctgcaatcgttgaacctgggctggtgtgatagcatcactgacaagggagtgaccagcttggcttcaggatgccctgagctcagggctgtggacttgtgcggttgtgttcttataacagatgagagtgtggttgcgctggcgaacggctgccctcacctgcgttccctgggtctgtactactgccagaacatcacggaccgcgccatgtactccctggccgccaacagccgtgtgcgcagccagggcaggggatgggacgctgcagtgaagagcggcggcagcagcaaggaccgggagcgggacgggctggcgagcctgaacatcagccagtgcacggcgctgaccccgccggcggtgcaggcggtgtgcgactcgttcccggcgctgcacacgtgcccggagcggcactcactcatcatcagcgggtgcctcagcctcacctccgtgcactgcgcctgcgcgctgcaccctcaccgagccgggcgcgtcatcctctccaaccacgcctactga

SEQ ID NO: 1610 - protein, 381 aa, Sorghum bicolor
  misc_feature: Ceres ANNOT ID no. 6016470
  misc_feature (1)..(381): NCBI GI: 53981728 NCBI Desc: unknow protein [oryza sativa (japonica cultivar-group)]
  misc_feature (37)..(375): NCBI GI: 21554029 NCBI Desc: f-box protein atfbl5 [arabidopsis thaliana]
  misc_feature (6)..(366): NCBI GI: 24652783 NCBI Desc: cg9003-pa [drosophila melanogaster]
  misc_feature (42)..(366): NCBI GI: 60678087 NCBI Desc: ld12638p [drosophila melanogaster]
  misc_feature (42)..(366): NCBI GI: 125807898 NCBI Desc: ga21468-pa [drosophila pseudoobscura]
MDGAQPPSGQLNNSFNTLMVSGDEQSQQPQDAGNETSFTNWKDLPMELLLRIISLVGDDRIVIVASGVCTGWRDTLGWGVANLSLSWCQDHMNDLVMSLAHKFTKLQVLSLRQIRAQLEDSGVEAVANNCHDLRELDLSRSFRLSDLSLYALAHGCPHLTRLNISGCSNFSDSALVFLSSQCKNLKCLNLCGCVRAASDRALQAIACNCGQLQSLNLGWCDSITDKGVTSLASGCPELRAVDLCGCVLITDESVVALANGCPHLRSLGLYYCQNITDRAMYSLAANSRVRSQGRGWDAAVKSGGSSKDRERDGLASLNISQCTALTPPAVQAVCDSFPALHTCPERHSLIISGCLSLTSVHCACALHPHRAGRVILSNHAY

SEQ ID NO: 1611 - DNA, 630 bp, Sorghum bicolor
  misc_feature: Ceres ANNOT ID no. 6016483
  misc_feature: Encodes the peptide sequence at SEQ ID NO 1612
atggggcgcggcaagatcgagatcaagcggatcgagaactccaccaaccgccaggtgactttctccaagcgccgcaacgggatcctcaagaaggcgcgggagatcagcgtgctctgcgacgccgaggtcggcgtcgtcatcttctccagcgccggcaagctttacgactactgctcccccaagacatcgctatcaaaaatcttggagaagtaccagaccaactctggaaagatactgtgggatgagaagcacaagagccttagtgccgagattgatcgtataaagaaagagaacgacaccatgcagattgagctcaggcaccttaaaggtgaagatctaaactcactgcaacccaaagacctgatcatgattgaggaggcacttgataatggactgacgaaccagaatgagaaactgatggagcactgggaaaggcgtgttgcaaacaataagatgatggaagatgagaacaaattgctggcctttaaacttcaccagcaggatattgcactgagcggcagcatgagagagcttgagctgggttatcatcctgaccgggacttggcggcccagatgccaatcaccttccgcgtgcagcccagccatcccaacttgcaggacaacaattag

SEQ ID NO: 1612 - protein, 209 aa, Sorghum bicolor
  misc_feature: Ceres ANNOT ID no. 6016483
  misc_feature (9)..(59): Pfam Id: SRF-TF Pfam Desc: SRF-type transcription factor (DNA-binding and dimerisationdomain)
  misc_feature (71)..(170): Pfam Id: K-box Pfam Desc: K-box region
  misc_feature (1)..(209): NCBI GI: 13272279 NCBI Desc: mads [oryza sativa]
  misc_feature (1)..(209): NCBI GI: 45385970 NCBI Desc: mads-box protein rmads219 [oryza sativa (japonica cultivar-group)]
  misc_feature (1)..(209): NCBI GI: 20161446 NCBI Desc: mads box protein [oryza sativa (japonica cultivar-group)]
  misc_feature (1)..(209): NCBI GI: 110798209 NCBI Desc: pi2 [pharus virescens]
  misc_feature (1)..(209): NCBI GI: 45356043 NCBI Desc: pistillata-like mads box protein [triticum aestivum]
  misc_feature: Abnormal phyllotaxy, leaf number higher than wild-type
  misc_feature: The plant flowers significantly earllier than wild-type.
  misc_feature: The sequence is a functional homolog of SEQ ID NO 1957 in the 10/412,699US patent application
  misc_feature: The sequence is a functional homolog of SEQ ID NO 1959 in the 10/412,699US patent application
  misc_feature: Useful for making plants with altered Lignin content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12944
  misc_feature: Functional homolog of the protein sequence given in SEQ ID NO 12958
  misc_feature: GREAT-hit functional homolog of the protein sequence given in SEQ ID NO 13170
  misc_feature: The sequence is a functional homolog of SEQ ID NO 1957 in the 20040045049 US patent application
  misc_feature: Useful for making plants with altered lignin content
  misc_feature: Functional homolog of the protein sequence given in SEQ ID NO 13170
  misc_feature: The sequence is a functional homolog of SEQ ID NO 2 in US patent 7049489
  misc_feature: Useful for making plants with modulated biomass
  misc_feature: Functional homolog of the protein sequence given in SEQ ID NO 13659
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: The sequence is a functional homolog of SEQ ID NO 1955 in the 10/412,699 US patent application
  misc_feature: The sequence is a functional homolog of SEQ ID NO 1967 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 359 in the 11/188,298 US application
  misc_feature: The sequence is a functional homolog of SEQ ID NO. 518 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
  misc_feature: The sequence is a functional homolog of SEQ ID NO. 491 in the 11/188,298 US application
MGRGKIEIKRIENSTNRQVTFSKRRNGILKKAREISVLCDAEVGVVIFSSAGKLYDYCSPKTSLSKILEKYQTNSGKILWDEKHKSLSAEIDRIKKENDTMQIELRHLKGEDLNSLQPKDLIMIEEALDNGLTNQNEKLMEHWERRVANNKMMEDENKLLAFKLHQQDIALSGSMRELELGYHPDRDLAAQMPITFRVQPSHPNLQDNN

SEQ ID NO: 1613 - DNA, 2376 bp, Sorghum bicolor
  misc_feature: Ceres ANNOT ID no. 6016494
  misc_feature: Encodes the peptide sequence at SEQ ID NO 1614
atggcatttggccgaggtgggaagatggacggccgccggccgtcctcgacgtcgtcgtcgttctgcacgaccaccacggtcgtcgtctttgtggcgctctgcctggtcggcgcgtggatgatgacctcgtccactgtcttcccgctggagatctcctcgaataagaagccggtggtgaagcagcagcctgcgcctgtcaattttggggcctcacaggacaatgctggtgaaggttctgagaaatttgaggacaccgacaacaatgatgccacgatgccggaggagccgaataacaaggatgccacgatggaagagaagttcactgagaagccagaggagaagcctgaagagaaggagccggaagtgccgacagagaaagctgagaccaaggatatgtttgatgatgcaaatggaaaatcagaagggcggtcagatgacatgaagaacgatggtgacggggagaagagtggggagaagaaagatgatgaaatcacaaatgagagtggtgatgaaaaacctgatggagagagcaaggatgatcaagaagagaagcctgaaggtgatgccactcaggaggagcaacctcagatagaagagaaggtggaagaaaatggagagaaggatcagagctcaaactccaacgaggtatttcctgatggggcccaatcagagcttctgaaggagtcaaatacccagaatggttcattccccacacaggctgcagagtccaagaatgaaaaggaagtccaagcgtcatcaaagtcttcaggtgatgcgactagctattcctggaaactatgtaatagcagtgcctcgacagattacataccttgccttgacaacgagaaggctatcaagaagcttcgaactactaaacattatgaacatcgtgagaggcattgccctgaggagcctcctacctgccttgttccactcccagaaggatataaacgcccaattgagtggccaaggagcagggacaaggtatggtacagcaatgttcctcacactaggctcgcagagtacaagggacatcaaaattgggttaaagtatcaggtgactacctcctgttccctgggggtgggactcagttcaagaatggtgccctccactatattgatactattcagcaggcactgcctgatattgcatggggcaaacgaagccgcgtcattctagatgtcggttgtggagttgccagctttggaggctacatgtttgatagagatgtgcttaccatgtcttttgctccgaaagatgagcatgaagctcaagtacaatttgcattagaaaggggaattccagcaatatcagctgtgatgggcaccaagagacttccataccccagcagagtctttgatgtcattcattgcgctcgctgcagggtcccttggcacattgaaggtggcatgcttttgctggaattgaaccgcttgttacgccctggtggttactttgtctggtctgccactcctgtttaccaaaagctcccagaggatgttgagatttggaatgcgatgtccactttgacaaagtccatgtgctggaagatggtcaacaagactaaggataagttaaatcaagttggtatggtcatatttcagaaaccaatggacaacatttgctatgagaaaagatccgaaaacaacccaccattgtgcaaggaatctgatgatgcagatgcagcttggaatgtacctttggaagcatgcatgcacaaactgcctgttggctcgaaagttcgagggtcaaaatggccagagttttggccacaaaggcttgagaagactcctttctggattgatggttccaaggttggggtctatggaaagcctgcaaatgaagatttcgaggcagataatgctcactggaaaagggttgtaagtaaatcgtatgtgaatggcatgggaattgactggtccaaagtgagaaatgtaatggacatgagagctgtgtatggaggttttgctgcagctctgagggaccaaaaggtctgggtcatgaatattgtgccgattgattcaccagacacactgcccatcatttacgagcgtggtttgtttggtatgtaccatgactggtgcgagtctttgagcacttacccaagaacttatgaccttctgcacgcggaccatctattctcaaagctcacaaagagatgcaaattgatggcagtttttgccgaggttgatcgtgtactgaggccccaaggcaaactgattgtgagggacactgcggacacaataaacgaactggaaagcatggccaagtccctgcagtgggaggtgcgaatgacctacaccaagggcaacgagggcttgctttgcgtcgagaagtcgatgtggcggcccaaggaactcgatgcaagcacgtga

SEQ ID NO: 1614 - protein, 791 aa, Sorghum bicolor
  misc_feature: Ceres ANNOT ID no. 6016494
  misc_feature (393)..(488): Pfam Id: Methyltransf_11 Pfam Desc: Methyltransferase domain
  misc_feature (1)..(790): NCBI GI: 115441471 NCBI Desc: os01g0883900 [oryza sativa (japonica cultivar-group)]
  misc_feature (1)..(791): NCBI GI: 10176951 NCBI Desc: ankyrin-like protein [arabidopsis thaliana]
  misc_feature (70)..(791): NCBI GI: 21928175 NCBI Desc: at5g64030/mbm17_13 [arabidopsis thaliana]
  misc_feature (186)..(789): NCBI GI: 115461536 NCBI Desc: os04g0692400 [oryza sativa (japonica cultivar-group)]
  misc_feature (186)..(723): NCBI GI: 38567836 NCBI Desc: osjnbb0020j19.14 [oryza sativa (japonica cultivar-group)]
  misc_feature: The sequence is a functional homolog of SEQ ID NO 484 in the 11/435,388US patent application
  misc_feature: The sequence is a functional homolog of SEQ ID NO 508 in the 11/435,388US patent application
  misc_feature: The sequence is a functional homolog of SEQ ID NO 562 in the 10/412,699US patent application
  misc_feature: The sequence is a functional homolog of SEQ ID NO 626 in the 11/435,388US patent application
  misc_feature: Useful for making plants with altered cell wall content and/or composition
  misc_feature: Useful for making plants with modulated growth and phenotype characteristics
  misc_feature: Functional homolog of the protein sequence encoded by LOCUS at1g29470
  misc_feature: The sequence is a functional homolog of SEQ ID NO 562 in the 20040045049 US patent application
  misc_feature: The sequence is a functional homolog of SEQ ID NO 484 in the 20060272060 US patent application
  misc_feature: The sequence is a functional homolog of SEQ ID NO 626 in the 20060272060 US patent application
  misc_feature: The sequence is a functional homolog of SEQ ID NO 484 in the 11/435,388 US patent application
  misc_feature: The sequence is a functional homolog of SEQ ID NO 508 in the 11/435,388 US patent application
  misc_feature: The sequence is a functional homolog of SEQ ID NO 562 in the 10/412,699 US patent application
  misc_feature: The sequence is a functional homolog of SEQ ID NO 626 in the 11/435,388 US patent application
  misc_feature: The sequence is a functional homolog of SEQ ID NO 198 in the 10/666,642 US patent application
MAFGRGGKMDGRRPSSTSSSFCTTTTVVVFVALCLVGAWMMTSSTVFPLEISSNKKPVVKQQPAPVNFGASQDNAGEGSEKFEDTDNNDATMPEEPNNKDATMEEKFTEKPEEKPEEKEPEVPTEKAETKDMFDDANGKSEGRSDDMKNDGDGEKSGEKKDDEITNESGDEKPDGESKDDQEEKPEGDATQEEQPQIEEKVEENGEKDQSSNSNEVFPDGAQSELLKESNTQNGSFPTQAAESKNEKEVQASSKSSGDATSYSWKLCNSSASTDYIPCLDNEKAIKKLRTTKHYEHRERHCPEEPPTCLVPLPEGYKRPIEWPRSRDKVWYSNVPHTRLAEYKGHQNWVKVSGDYLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSTLTKSMCWKMVNKTKDKLNQVGMVIFQKPMDNICYEKRSENNPPLCKESDDADAAWNVPLEACMHKLPVGSKVRGSKWPEFWPQRLEKTPFWIDGSKVGVYGKPANEDFEADNAHWKRVVSKSYVNGMGIDWSKVRNVMDMRAVYGGFAAALRDQKVWVMNIVPIDSPDTLPIIYERGLFGMYHDWCESLSTYPRTYDLLHADHLFSKLTKRCKLMAVFAEVDRVLRPQGKLIVRDTADTINELESMAKSLQWEVRMTYTKGNEGLLCVEKSMWRPKELDAST

SEQ ID NO: 1615 - DNA, 999 bp, Sorghum bicolor
  misc_feature: Ceres ANNOT ID no. 6016503
  misc_feature: Encodes the peptide sequence at SEQ ID NO 1616
atgaggcagccgcacctctcgccgcagctctccccttccccggtcctctcctcccacttctcgccgccggcgacgggggcctcgccctggcggcggcggctgcaccgggggcgggccttccaaccgccgctctcctcgctgcgggagcccaacaaggccacgctccgcaaggcctcgcccaacgtacccttccgcctcggcggtggcggtggcgggagcggcagccccaaggaccgccgccccgccgccgacgacaaggaggaggaggccgagggcagcggcggcggcggcggcgccggggcactcacagggacgctgatcgcgggagcgctactggttggtttcgtaggggggtttggggcggccggatacgtgtacaaggaccagatcaacaccttcctcacgcagttctcagggtttattgacggctatggtccagccggatacgctctgttcgtacttgtatatgcagggttggaggttctcgcaattcctgcaatacctttaaccatgtcagctggtctgttgtttggtaatgtgaccggtacaattattgtctcagtcggtggaacactagctgcagccgtggccttccttattgctagatactttgccagagagagaattcttaaaatggttgaaggaaataagaagtttctggcaattgataaggcaataggtgaaaatggatttaaggtcgttactttgcttcgtttgagtcccctgttacctttctcccttgggaactatctgtatggcctgacttcagtgaagttcttgccatatgtcttgggcagttggttgggaatgcttccaggttcatgggcttacgtcagtgctggtgcattcgggcgagctataattcaagatgagtcggaaattggtttgggaggaaatggacagctatggacactgggtgttgggttattgtttacagccattgctgccacttatgtaacaaggctcgcaaaggatgctgtaaaggagatcgacgactag

SEQ ID NO: 1616 - protein, 332 aa, Sorghum bicolor
  misc_feature: Ceres ANNOT ID no. 6016503
  misc_feature (164)..(283): Pfam Id: SNARE_assoc Pfam Desc: SNARE associated Golgi protein
  misc_feature (192)..(332): NCBI GI: 115441481 NCBI Desc: os01g0884900 [oryza sativa (japonica cultivar-group)]
  misc_feature (106)..(329): NCBI GI: 93450536 NCBI Desc: deda [delta proteobacterium mlms-1]
  misc_feature (106)..(282): NCBI GI: 93453575 NCBI Desc: deda [delta proteobacterium mlms-1]
  misc_feature (132)..(329): NCBI GI: 23128177 NCBI Desc: cog0398: uncharacterized conserved protein [nostoc punctiforme pcc 73102]
  misc_feature (140)..(327): NCBI GI: 67922563 NCBI Desc: deda [crocosphaera watsonii wh 8501]
MRQPHLSPQLSPSPVLSSHFSPPATGASPWRRRLHRGRAFQPPLSSLREPNKATLRKASPNVPFRLGGGGGGSGSPKDRRPAADDKEEEAEGSGGGGGAGALTGTLIAGALLVGFVGGFGAAGYVYKDQINTFLTQFSGFIDGYGPAGYALFVLVYAGLEVLAIPAIPLTMSAGLLFGNVTGTIIVSVGGTLAAAVAFLIARYFARERILKMVEGNKKFLAIDKAIGENGFKVVTLLRLSPLLPFSLGNYLYGLTSVKFLPYVLGSWLGMLPGSWAYVSAGAFGRAIIQDESEIGLGGNGQLWTLGVGLLFTAIAATYVTRLAKDAVKEIDD

SEQ ID NO: 1617 - DNA, 339 bp, Sorghum bicolor
  misc_feature: Ceres ANNOT ID no. 6016504
  misc_feature: Encodes the peptide sequence at SEQ ID NO 1618
atggcgtcgttctctgaggcgcctccggggaacccaactgccggcgagaagatcttcaagaccaagtgcgcgcagtgccacaccgtcgacaagggcgccggccacaagcaaggtcctaatttgaatggtctatttgggaggcagtctggtacaacacctggttactcttactccacagctaacaagagcatggctgtaatttgggaggagaacactttgtatgactacctgcttaatcctaagaagtacattcctggaaccaagatggtattccctggactgaaaaagccacaggaacgtgctgatctcattgcatacctgaagaatgccactgcctga

SEQ ID NO: 1618 - protein, 112 aa, Sorghum bicolor
  misc_feature: Ceres ANNOT ID no. 6016504
  misc_feature (12)..(111): Pfam Id: Cytochrom_C Pfam Desc: Cytochrome c
  misc_feature (1)..(112): NCBI GI: 118011 NCBI Desc: cytochrome c
  misc_feature (1)..(112): NCBI GI: 169786 NCBI Desc: cytochrome c
  misc_feature (2)..(112): NCBI GI: 229737 NCBI Desc: cytochrome c
  misc_feature (2)..(112): NCBI GI: 476418 NCBI Desc: cytochrome c - maize
  misc_feature (1)..(112): NCBI GI: 140054307 NCBI Desc: cytochrome c, monohaem [medicago truncatula]
MASFSEAPPGNPTAGEKIFKTKCAQCHTVDKGAGHKQGPNLNGLFGRQSGTTPGYSYSTANKSMAVIWEENTLYDYLLNPKKYIPGTKMVFPGLKKPQERADLIAYLKNATA

SEQ ID NO: 1619 - DNA, 1185 bp, Sorghum bicolor
  misc_feature: Ceres ANNOT ID no. 6016508
  misc_feature: Encodes the peptide sequence at SEQ ID NO 1620
atgtcggcggcggcgcgcgcgctccccgcgccgtcgagaagagctccgctcggcgccgtgaccctctccgcgccgcgacccggggctagggttcgcgcggcgcggcctcgcgaggagaatttccataataattgcctgttgacatcgtctagtcagaattcaagtcctttgctatgccctccatgcaattgtgctcagatggctttggctgaaacaataattcctcaccagcctgatgttgacaagcatgctggagttctgtcctatgaactggttcaagggaaccttgtgcagtggaattcatttatggacaaatcaatacctgatccaccaacagctgttcttcttcatggaatccttgggagcaggaaaaactggggatctttcgcgaagagattggctcaggaattcccaatgtggcagttcctcttggttgatttgcgctgccatggcgactcagcatcaattaagaagcgtggaccacacactgttgcctcaactgctcttgatgtcctaaagctgatagtgcagctcaggctaacccctcgggttttggttggtcacagctttggcggaaaagtggccttgagtatggtagaacaagctgcaaaaccacttgctcgtcctgttagagtatgggttcttgatgctacgcctggcaaagttcgtgcagggggagatggtgaagatcaccctgctgaacttattgagtttctcagaagaatgcctgagcaggtttcttcaaaacaggaggttgtcgatgctcttgttaaaggacaattttctgtggatgttgcacggtgggtggccacaaatctgcgtcgaaccagtccattgggtcagcgatcatcttcaagcttctcatggacttttgacctaaatggcatctctgagatgtacaagtcctatgaggatactaacttatggaggattgtagagaatgtaccaaggggtgttcatattaattttctaaaagctgaacgaagtttgcatagatgggctcttgaagacctccaaagaattcatactgcggaggaattagctgcagatgagggtggaggagttgaaatgcatgtgcttgaagatgctggacactgggttcatgcagacaacccagatggtctctttagaattctgtcgtcaaccttccgaatcgaaactactataagaggaatgcaagactga

SEQ ID NO: 1620 - protein, 394 aa, Sorghum bicolor
  misc_feature: Ceres ANNOT ID no. 6016508
  misc_feature (140)..(381): Pfam Id: Abhydrolase_1 Pfam Desc: alpha/beta hydrolase fold
  misc_feature (2)..(394): NCBI GI: 56784309 NCBI Desc: hydrolase-like protein [oryza sativa (japonica cultivar-group)]
  misc_feature (108)..(204): NCBI GI: 115441199 NCBI Desc: os01g0862000 [oryza sativa (japonica cultivar-group)]
  misc_feature (111)..(302): NCBI GI: 90417293 NCBI Desc: hydrolase, alpha/beta fold family protein [marine gamma proteobacterium htcc2207]
  misc_feature (100)..(278): NCBI GI: 118736022 NCBI Desc: alpha/beta hydrolase fold [dinoroseobacter shibae dfl 12]
  misc_feature (111)..(298): NCBI GI: 21644577 NCBI Desc: williams-beuren syndrome critical region 21 [mus musculus]
MSAAARALPAPSRRAPLGAVTLSAPRPGARVRAARPREENFHNNCLLTSSSQNSSPLLCPPCNCAQMALAETIIPHQPDVDKHAGVLSYELVQGNLVQWNSFMDKSIPDPPTAVLLHGILGSRKNWGSFAKRLAQEFPMWQFLLVDLRCHGDSASIKKRGPHTVASTALDVLKLIVQLRLTPRVLVGHSFGGKVALSMVEQAAKPLARPVRVWVLDATPGKVRAGGDGEDHPAELIEFLRRMPEQVSSKQEVVDALVKGQFSVDVARWVATNLRRTSPLGQRSSSSFSWTFDLNGISEMYKSYEDTNLWRIVENVPRGVHINFLKAERSLHRWALEDLQRIHTAEELAADEGGGVEMHVLEDAGHWVHADNPDGLFRILSSTFRIETTIRGMQD

SEQ ID NO: 1621 - DNA, 834 bp, Sorghum bicolor
  misc_feature: Ceres ANNOT ID no. 6016517
  misc_feature: Encodes the peptide sequence at SEQ ID NO 1622
atggggaggggaaagattgagatcaagagaatcgagaacaccacgagccgccaagtgaccttctgcaagcgcaggaatgggctgctgaagaaggcctatgaactctccatcctctgcgacgctgagatcgctttggtcatcttctctagccgaggtcgcctatatgaatattccagtaacagtgtaaggtcgacgattgagaggtacaagaaagcatctgccagcacttcaggaacagctccagtgatagatgtcaactctcttcaattctttcagcaagaaacggcaaaactgcgccagcagatacaaaccttgcagaactcaaacaggcacctgatgggtgaatcaattggcaatatgaccgcaaaggagctcaagggccttgaaaacaggcttgaaagaggcattggccgaatccggtccaagaagaacgagttgctactcgcggagatcgaatatatgcagaaaagggaagcggatctgcacaatgaaaacatgttcctacgggccaaggttgcagaggttgagcgagctctgcagcaggaggcggcggcagaagaccagacgatggcaatggggccggcggccgtcggcggggctacgacggagctgaaagcgctgccggcgtcgttcgacccgcgtggctatggctactaccagcagcagcagcagcagcatgtgctggccgctgcctccgctgcctcgtcgtcgcagtactcggagcagccccagggccagggccagcaggagtacgagtaccaccaccagactgccctccacctcggctaccatgtcaagatccactccgccgccggcggcaaaggcttcctctga

SEQ ID NO: 1622 - protein, 277 aa, Sorghum bicolor
  misc_feature: Ceres ANNOT ID no. 6016517
  misc_feature (73)..(174): Pfam Id: K-box Pfam Desc: K-box region
  misc_feature (9)..(59): Pfam Id: SRF-TF Pfam Desc: SRF-type transcription factor (DNA-binding and dimerisationdomain)
  misc_feature (25)..(277): NCBI GI: 29372760 NCBI Desc: m25 [zea mays]
  misc_feature (1)..(273): NCBI GI: 45385948 NCBI Desc: mads-box protein rmads207 [oryza sativa (japonica cultivar-group)]
  misc_feature (1)..(273): NCBI GI: 115441497 NCBI Desc: os01g0886200 [oryza sativa (japonica cultivar-group)]
  misc_feature (1)..(180): NCBI GI: 57157565 NCBI Desc: mads-box transcription factor [asparagus virgatus]
  misc_feature (1)..(180): NCBI GI: 29467048 NCBI Desc: mads-box transcription factor ag [agapanthus praecox]
  misc_feature: Abnormal phyllotaxy, leaf number higher than wild-type
  misc_feature: No seed is being produced by the plant
  misc_feature: The plant flowers significantly earllier than wild-type.
  misc_feature: The plant flowers significantly late compared to wild-type.
  misc_feature: The plant is abnormally small.
  misc_feature: The plant produces a reduced number of seeds.
  misc_feature: The sequence is a functional homolog of SEQ ID NO 1243 in the 11/479,226US patent application
  misc_feature: The sequence is a functional homolog of SEQ ID NO 1366 in the 10/666,642US patent application
  misc_feature: The sequence is a functional homolog of SEQ ID NO 14 in the 10/666,642US patent application
  misc_feature: The sequence is a functional homolog of SEQ ID NO 1420 in the 10/666,642US patent application
  misc_feature: The sequence is a functional homolog of SEQ ID NO 1460 in the 10/666,642US patent application
  misc_feature: The sequence is a functional homolog of SEQ ID NO 1468 in the 10/666,642US patent application
  misc_feature: The sequence is a functional homolog of SEQ ID NO 1730 in the 10/412,699US patent application
  misc_feature: The sequence is a functional homolog of SEQ ID NO 18 in the 10/412,699US patent application
  misc_feature: The sequence is a functional homolog of SEQ ID NO 1814 in the 10/412,699US patent application
  misc_feature: The sequence is a functional homolog of SEQ ID NO 1963 in the 10/412,699US patent application
  misc_feature: The sequence is a functional homolog of SEQ ID NO 1965 in the 10/412,699US patent application
  misc_feature: The sequence is a functional homolog of SEQ ID NO 1967 in the 10/412,699US patent application
  misc_feature: The sequence is a functional homolog of SEQ ID NO 207 in the 11/479,226US patent application
  misc_feature: The sequence is a functional homolog of SEQ ID NO 282 in the 10/666,642US patent application
  misc_feature: The sequence is a functional homolog of SEQ ID NO 32 in the 10/666,642US patent application
  misc_feature: The sequence is a functional homolog of SEQ ID NO 570 in the 10/412,699US patent application
  misc_feature: The sequence is a functional homolog of SEQ ID NO 64 in the 10/412,699US patent application
  misc_feature: The sequence is a functional homolog of SEQ ID NO 938 in the 10/412,699US patent application
  misc_feature: Useful for biocontainment applications
  misc_feature: Useful for making plants with altered Lignin content
  misc_feature: Useful for making plants with altered alkaloid content
  misc_feature: Useful for making plants with altered sterol content
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated heat sensitivity
  misc_feature: Functional homolog of the protein sequence given in SEQ ID NO 12958
  misc_feature: Functional homolog of the protein sequence given in SEQ ID NO 13210
  misc_feature: Functional homolog of the protein sequence given in SEQ ID NO 13434
  misc_feature: Functional homolog of the protein sequence given in SEQ ID NO 13435
  misc_feature: Functional homolog of the protein sequence given in SEQ ID NO 13438
  misc_feature: Functional homolog of the protein sequence given in SEQ ID NO 13528
  misc_feature: The sequence is a functional homolog of SEQ ID NO 1730 in the 20040045049 US patent application
  misc_feature: The sequence is a functional homolog of SEQ ID NO 18 in the 20040045049 US patent application
  misc_feature: The sequence is a functional homolog of SEQ ID NO 1814 in the 20040045049 US patent application
  misc_feature: The sequence is a functional homolog of SEQ ID NO 1963 in the 20040045049 US patent application
  misc_feature: The sequence is a functional homolog of SEQ ID NO 1965 in the 20040045049 US patent application
  misc_feature: The sequence is a functional homolog of SEQ ID NO 1967 in the 20040045049 US patent application
  misc_feature: The sequence is a functional homolog of SEQ ID NO 938 in the 20040045049 US patent application
  misc_feature: The sequence is a functional homolog of SEQ ID NO 14 in the 20070033671 US patent application
  misc_feature: The sequence is a functional homolog of SEQ ID NO 14 in the 20070033671 US patent application
  misc_feature: The sequence is a functional homolog of SEQ ID NO 1468 in the 20070033671 US patent application
  misc_feature: The sequence is a functional homolog of SEQ ID NO 32 in the 20070033671 US patent application
  misc_feature: The sequence is a functional homolog of SEQ ID NO 14 in the 10/666,642 US patent application
  misc_feature: Useful for biocontainment applications
  misc_feature: Functional homolog of the protein sequence given in SEQ ID NO 13753
  misc_feature: Useful for making plants with altered alkaloid content
  misc_feature: Useful for making plants with altered lignin content
  misc_feature: Useful for making plants with modulated biomass
  misc_feature: Useful for making plants with modulated flowering time
  misc_feature: Functional homolog of the protein sequence given in SEQ ID NO 13528
  misc_feature: Useful for making plants with altered terpenoid content
  misc_feature: Functional homolog of the protein sequence given in SEQ ID NO 13438
  misc_feature: The sequence is a functional homolog of SEQ ID NO 32 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 2199 in the 10/666,642 US patent application
  misc_feature: The sequence is a functional homolog of SEQ ID NO 2197 in the 10/666,642 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 1701 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1949 in the 10/412,699 US patent application
  misc_feature: The sequence is a functional homolog of SEQ ID NO 1955 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 359 in the 11/188,298 US application
  misc_feature: The sequence is a functional homolog of SEQ ID NO. 273 in the 11/188,298 US application
  misc_feature: The sequence is a functional homolog of SEQ ID NO. 361 in the 11/188,298 US application
  misc_feature: The sequence is a functional homolog of SEQ ID NO. 518 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGKIEIKRIENTTSRQVTFCKRRNGLLKKAYELSILCDAEIALVIFSSRGRLYEYSSNSVRSTIERYKKASASTSGTAPVIDVNSLQFFQQETAKLRQQIQTLQNSNRHLMGESIGNMTAKELKGLENRLERGIGRIRSKKNELLLAEIEYMQKREADLHNENMFLRAKVAEVERALQQEAAAEDQTMAMGPAAVGGATTELKALPASFDPRGYGYYQQQQQQHVLAAASAASSSQYSEQPQGQGQQEYEYHHQTALHLGYHVKIHSAAGGKGFL

SEQ ID NO: 1623 - DNA, 882 bp, Sorghum bicolor
  misc_feature: Ceres ANNOT ID no. 6016518
  misc_feature: Encodes the peptide sequence at SEQ ID NO 1624
atggacgaaaggattccgccgccgtccctcttgcaatactcgcagtcccctgttcattcttcccctcaccccctcaattctatgaggtattcttcctctgaaagagaaagatatctggctgagttgcttgcagagaggcagaaattggccccatttgtgcaagttcttcctttctgtaccaggctgttgaaccaagagattttgcgcgcatcttctatggcgcctaaccataactttgttgatcctgagagaattgagcatggtagcccattaaggttacctggccacccagtgaatggtcagccaatggatctggagggctggacagggattcaaacagaggcttctcagcatatgggggttctacaagcatcatcaatgggctggaatggtgctcctgtactcgctgccactcctgttgtcaagaaagtcatgaggctggatgttccggtggacaagtatcctaattacaactttgttggtcgtttattggggccgcgaggtaactccctgaaaagagttgaagcttcaacccaatgtagagtttacattcgaggacgtggttcggtgaaagactctgttaaggaagacaagctgagggataaacctgggtatgaacaccttaatgaacaactgcatgtacttgtggaagcagagtttccagtagatatggttgatgcgcgcctaaatcaagctgtctccatcctagaggatctcctcaaaccaattgacgagtccatggacttctacaagaagcagcagctgagggagctggcaattctaaatggcacgctgagagaggaaagtccaagccctcacctcagccctagtgtgtcccccttcaactccaccgggatgaagcgcgcaaaaacagggcggtaa

SEQ ID NO: 1624 - protein, 293 aa, Sorghum bicolor
  misc_feature: Ceres ANNOT ID no. 6016518
  misc_feature (4)..(293): NCBI GI: 92893883 NCBI Desc: kh [medicago truncatula]
  misc_feature (1)..(291): NCBI GI: 19310523 NCBI Desc: at1g09660/f21m12_5 [arabidopsis thaliana]
  misc_feature (31)..(290): NCBI GI: 24060154 NCBI Desc: kh domain-like protein [oryza sativa (japonica cultivar-group)]
  misc_feature (37)..(290): NCBI GI: 115464523 NCBI Desc: os05g0481500 [oryza sativa (japonica cultivar-group)]
  misc_feature (196)..(291): NCBI GI: 115448377 NCBI Desc: os02g0722700 [oryza sativa (japonica cultivar-group)]
MDERIPPPSLLQYSQSPVHSSPHPLNSMRYSSSERERYLAELLAERQKLAPFVQVLPFCTRLLNQEILRASSMAPNHNFVDPERIEHGSPLRLPGHPVNGQPMDLEGWTGIQTEASQHMGVLQASSMGWNGAPVLAATPVVKKVMRLDVPVDKYPNYNFVGRLLGPRGNSLKRVEASTQCRVYIRGRGSVKDSVKEDKLRDKPGYEHLNEQLHVLVEAEFPVDMVDARLNQAVSILEDLLKPIDESMDFYKKQQLRELAILNGTLREESPSPHLSPSVSPFNSTGMKRAKTGR

SEQ ID NO: 1625 - DNA, 405 bp, Sorghum bicolor
  misc_feature: Ceres ANNOT ID no. 6016519
  misc_feature: Encodes the peptide sequence at SEQ ID NO 1626
atgtcgggcggcaggaggagggggcttgtgtggagcctccccgtggcgaggtcggatgtgctcggcaagctgggccctgccttcggcatcggcgccggctgcggcgtgggcgtcggcttcggcctcatcggaggtgcaggaattggagctggattccccggtttacaattgggattcggagctggagctggatgtggaataggaataggttttggttatggctttggaaaaggcgttgcatatgatgaaagcggaaggtatttgaacatcaggagaccatttcgtaactccagaagcattgcttacgatgaacagtttgatatcatgtttgatgaactgatggagagcaccaggaagctgatcaaagcaacatcaaaggagatcgacaagtggaggcggatgtag

SEQ ID NO: 1626 - protein, 134 aa, Sorghum bicolor
  misc_feature: Ceres ANNOT ID no. 6016519
  misc_feature (1)..(78): NCBI GI: 86277800 NCBI Desc: keratin 1 [hippoglossus hippoglossus]
  misc_feature (25)..(87): NCBI GI: 18700012 NCBI Desc: keratin associated protein 16-7 [mus musculus]
  misc_feature (22)..(86): NCBI GI: 50509489 NCBI Desc: glycine-rich cell wall protein precursor-like protein [oryza sativa (japonica cultivar-group)]
  misc_feature (3)..(79): NCBI GI: 4995987 NCBI Desc: lj1 [human herpesvirus 6b]
  misc_feature (22)..(87): NCBI GI: 51895965 NCBI Desc: loc446967 protein [xenopus laevis]
MSGGRRRGLVWSLPVARSDVLGKLGPAFGIGAGCGVGVGFGLIGGAGIGAGFPGLQLGFGAGAGCGIGIGFGYGFGKGVAYDESGRYLNIRRPFRNSRSIAYDEQFDIMFDELMESTRKLIKATSKEIDKWRRM

SEQ ID NO: 1627 - DNA, 1500 bp, Sorghum bicolor
  misc_feature: Ceres ANNOT ID no. 6016520
  misc_feature: Encodes the peptide sequence at SEQ ID NO 1628
atgttatcggagcgcccgcccgacgagttccccccgttgccgcaatcgcccccgatgcagatgccgcactatcagtcgcggcggaagccgcggaggagacagagggaggaaggaggaggaggaggaggaggaggcggtggaggtcacggtaacggcggggactcgtcctcgggaggggagggcactagcgcttcgcctaagagggagtggtggggtggagccagcctcggcgatgagctgcccacccctcgggagatgtgccggaggcttgatgagttcgtcatcggccaggccaaggcaaaaaaggtgctatctgtagctgtgtacaaccattacaagagaatatataatgcaaatgtacagaaagaatctgctgctaattctgggcttcctgatgctggacatgatgatcaaaatattgtagaaatagataaaagcaatgtactcctaatgggcccaactggctcaggaaaaacattgcttgcaaaaacattagcacgcattgtaaatgtaccattcgttatagctgatgcgacatcattaacgcaggctggatatgtaggggaggatgtagagtcgatactgcaaaaattacttgtggctgctgagtataatgttcaggctgcacaacaagggatagtatacatagatgaaatagataaaataacaaagaaggcagagagtgcaaatgttagtagagatgtatctggagaaggtgttcaacaagcattgttgaaaatcctagaaggaactgttgtcagtattcctgagaaaggatcgcgcaagaattctcgcaatgatagtatacagatagacacgacagatattctttttatatgtggtggtgcttttgtggacttggaaaagactatttctgaaaggcgccaagattcatctataggatttggggcacctgtccgtacgaacatgagaagttctggagctagctgtccaatggttacctcaactttgttagaatctgttgagagtggtgatcttgttagatatggtctaattccagagttcattggtcgtttgcccattctagtaagtttggcagctctgaatgaaggtcagctcgttcaggttctgacagaaccgaagaattcactttccaaacaatacaggaaaatgtttaacctgaacaaagttaggctgcactttactgacggtgcacttagattggtagctaagaaggcaatagctaaaagcactggtgctcgtggtttaagagccatcttggaaactgttctattggaggccatgtatgagattccagacgaaaaaacaggaaatgagcgagtagacgctgttgtggtggatgaggaggcgattggttctgttgataggccaggttgtggggctaaaattctccgaggggatggtgcgttggaccagtacataacaagaaccaatgtgatgaatttacgggaaactaacgatggtttggccggggagctcgaggaagcatacatgctgtctagaattgttagcttgtaa

SEQ ID NO: 1628 - protein, 499 aa, Sorghum bicolor
  misc_feature: Ceres ANNOT ID no. 6016520
  misc_feature (143)..(349): Pfam Id: AAA_2 Pfam Desc: ATPase family associated with various cellular activities(AAA)
  misc_feature (147)..(348): Pfam Id: AAA Pfam Desc: ATPase family associated with various cellular activities(AAA)
  misc_feature (42)..(473): NCBI GI: 115446761 NCBI Desc: os02g0564400 [oryza sativa (japonica cultivar-group)]
  misc_feature (41)..(499): NCBI GI: 2674203 NCBI Desc: clp protease regulatory subunit clpx [arabidopsis thaliana]
  misc_feature (58)..(489): NCBI GI: 140039862 NCBI Desc: clpx, atpase regulatory subunit [medicago truncatula]
  misc_feature (41)..(498): NCBI GI: 140049786 NCBI Desc: clpx, atpase regulatory subunit [medicago truncatula]
  misc_feature (79)..(468): NCBI GI: 8978260 NCBI Desc: clp protease regulatory subunit clpx-like [arabidopsis thaliana]
  misc_feature: The sequence is a functional homolog of SEQ ID NO. 462 in the 11/188,298 US application
  misc_feature: The sequence is a functional homolog of SEQ ID NO. 471 in the 11/188,298 US application
MLSERPPDEFPPLPQSPPMQMPHYQSRRKPRRRQREEGGGGGGGGGGGHGNGGDSSSGGEGTSASPKREWWGGASLGDELPTPREMCRRLDEFVIGQAKAKKVLSVAVYNHYKRIYNANVQKESAANSGLPDAGHDDQNIVEIDKSNVLLMGPTGSGKTLLAKTLARIVNVPFVIADATSLTQAGYVGEDVESILQKLLVAAEYNVQAAQQGIVYIDEIDKITKKAESANVSRDVSGEGVQQALLKILEGTVVSIPEKGSRKNSRNDSIQIDTTDILFICGGAFVDLEKTISERRQDSSIGFGAPVRTNMRSSGASCPMVTSTLLESVESGDLVRYGLIPEFIGRLPILVSLAALNEGQLVQVLTEPKNSLSKQYRKMFNLNKVRLHFTDGALRLVAKKAIAKSTGARGLRAILETVLLEAMYEIPDEKTGNERVDAVVVDEEAIGSVDRPGCGAKILRGDGALDQYITRTNVMNLRETNDGLAGELEEAYMLSRIVSL

SEQ ID NO: 1629 - DNA, 888 bp, Sorghum bicolor
  misc_feature: Ceres ANNOT ID no. 6016524
  misc_feature: Encodes the peptide sequence at SEQ ID NO 1630
atggagctccgcctctgcctccgtctccacgcacgcctccctccttccgcgacgccaccgcctttcccggcgcccgcggtgctcccagcctcccgccgccttcggacgggaggaagctatggggttgctcttaggcggcacacgaggcgttcgagtccggtaatccgtgcttcaatagccgacggcgagcagggtgtgtctgtgaaggagaggagcgtctcggtgatcctcttgtccggaggccagggaaagagaatgggggcaaatatgccaaagcagtatctacctctactcggactaccaattgcattgcacagtttaaaaacattctgccagctgaaggaagtcaaagaagtcgtggtggtgtgcgattcagactacagcgatgtatttgaaggttctattgagaacttgcaaatacctcttaaatttgcacgcccaggaaaagagagacaggactccgtttttaatggacttcaggaaattgatggggattcggaattagtttgtgttcatgattctgcgaggcccttagtttcttctgaagatgtaaaaaaggtcttagaagatgctgcagtacatggagcagctgttcttggtgtgcctgtgaaagctacaataaaggaggccaatagtgattcttttgttgtaaaaactcttgatcggaaaactctctgggaaatgcaaactccacaggtaatgaagcccaagttactcaaagatggttttgagcttgttaaacgggatggccatgaagtcactgatgatgtatccattgtagaatatctaaaacaccctgtctatatcactgaagggtcttatacaaacattaaggtgactactcctgatgacttgctactggctgagcgcctgatgaatgagaagtag

SEQ ID NO: 1630 - protein, 295 aa, Sorghum bicolor
  misc_feature: Ceres ANNOT ID no. 6016524
  misc_feature (73)..(294): Pfam Id: IspD Pfam Desc: Uncharacterized protein family UPF0007
  misc_feature (90)..(295): NCBI GI: 139006319 NCBI Desc: 4-(cytidine 5'-diphospho)-2-c-methyl-d-erythritol synthase [oryza sativa (japonica cultivar-group)]
  misc_feature (53)..(294): NCBI GI: 73672049 NCBI Desc: 2-c-methyl-d-erythritol 4-phosphate cytidylyltransferase [ginkgo biloba]
  misc_feature (44)..(293): NCBI GI: 87201352 NCBI Desc: 4-diphosphocytidyl-2-c-methyl-d-erythritol synthase [stevia rebaudiana]
  misc_feature (44)..(236): NCBI GI: 115441507 NCBI Desc: os01g0887100 [oryza sativa (japonica cultivar-group)]
  misc_feature (70)..(294): NCBI GI: 90108461 NCBI Desc: chain a, 2c-methyl-d-erythritol 4-phosphate cytidylyltransferase (ispd) from arabidopsis thaliana
  misc_feature (55)..(294): SWISSPROT Homolog: EC 2.7.7.60 2-C-methyl-D-erythritol 4-phosphate cytidylyltransferase, chloroplastprecursor
MELRLCLRLHARLPPSATPPPFPAPAVLPASRRLRTGGSYGVALRRHTRRSSPVIRASIADGEQGVSVKERSVSVILLSGGQGKRMGANMPKQYLPLLGLPIALHSLKTFCQLKEVKEVVVVCDSDYSDVFEGSIENLQIPLKFARPGKERQDSVFNGLQEIDGDSELVCVHDSARPLVSSEDVKKVLEDAAVHGAAVLGVPVKATIKEANSDSFVVKTLDRKTLWEMQTPQVMKPKLLKDGFELVKRDGHEVTDDVSIVEYLKHPVYITEGSYTNIKVTTPDDLLLAERLMNEK

SEQ ID NO: 1631 - DNA, 780 bp, Sorghum bicolor
  misc_feature: Ceres ANNOT ID no. 6016525
  misc_feature: Encodes the peptide sequence at SEQ ID NO 1632
atggctcgagcgctgctcctgctacgagtagcccgctaccctcctctcccgacctcacccgcgctcctccagccgcgtctcctgcctcagccgctgctccgccgccacgcgccctcccagtcccagtctcagttccgcttcctctcctccctctccccctcgtccgtgtccaccagctcagatgctcctagcgacggcgggggcggccgcgacggagaagaggatggagcgaagagcggcggcggcggccacgtcgactacttggggatgagcgacgaggagctcatggagcagtgcgacatgggcacgttcaaggcgtccggccccggcggccagcaccgcaacaagcgcgagtccgccgttcgtctgaaacacctccccaccggcatcatcgcccaggctgtggaggatcggtcacaacataagaatcgagcgtctgctttatctcggcttcgaaccctgattgctcttaaagttaggaggccaataaacctggatgactacactccacctgttgagcttcttcagatattacccctgaagtccaccgttcgagggaaagatgttggcccccaaattggtccaaataactcaaaattttctccaggaatgcaagctttattagatctgctgtttgctgttgaaggttccatatcagatgcagcaaagattttaggcctaagcactggtgctttgtcaagactgattctgtcagatgattctctccgaacggccgcgaatgaactgcgagcttcgaagggactgaagcctctgaggtga

SEQ ID NO: 1632 - protein, 259 aa, Sorghum bicolor
  misc_feature: Ceres ANNOT ID no. 6016525
  misc_feature (94)..(190): Pfam Id: RF-1 Pfam Desc: Peptidyl-tRNA hydrolase domain
  misc_feature (84)..(256): NCBI GI: 140066338 NCBI Desc: class i peptide chain release factor; helix-turn-helix, fis-type [medicago truncatula]
  misc_feature (156)..(259): NCBI GI: 20161254 NCBI Desc: p0408g07.27 [oryza sativa (japonica cultivar-group)]
  misc_feature (1)..(158): NCBI GI: 115441511 NCBI Desc: os01g0887400 [oryza sativa (japonica cultivar-group)]
  misc_feature (88)..(162): NCBI GI: 86159828 NCBI Desc: class i peptide chain release factor [anaeromyxobacter dehalogenans 2cp-c]
  misc_feature (88)..(162): NCBI GI: 121539192 NCBI Desc: class i peptide chain release factor [anaeromyxobacter sp. fw109-5]
MARALLLLRVARYPPLPTSPALLQPRLLPQPLLRRHAPSQSQSQFRFLSSLSPSSVSTSSDAPSDGGGGRDGEEDGAKSGGGGHVDYLGMSDEELMEQCDMGTFKASGPGGQHRNKRESAVRLKHLPTGIIAQAVEDRSQHKNRASALSRLRTLIALKVRRPINLDDYTPPVELLQILPLKSTVRGKDVGPQIGPNNSKFSPGMQALLDLLFAVEGSISDAAKILGLSTGALSRLILSDDSLRTAANELRASKGLKPLR

SEQ ID NO: 1633 - DNA, 771 bp, Sorghum bicolor
  misc_feature: Ceres ANNOT ID no. 6016526
  misc_feature: Encodes the peptide sequence at SEQ ID NO 1634
atggacggcgggggctccgggccggcgcccaacgccgcgcgcaccgcggacgaggtcttccgcgactacaaagcccgccgcgccggcatgatcaaggcgctcaccaccgatgtggagaggttcttcaagctctgtgaccccgaaaaggagaacttgtgcctttatggctatcccaatgagacgtgggaggtgaccttgccagctgaggaagtgcccccagagatccctgaaccagcattaggaatcaactttgctagggatggcatgaatgagaaggactggctggcgctagttgcagtccacagcgattcctggttactctctgttgcattctactttggtgcacggtttggatttgacagagaagctaggaggcgactctttagcatgataaacaacatgcccacaatatttgaggtagtgacaggagcagtcaagaagcaggcaaaggagaagacacctaacagtagcagcaagagcaacaagcctagttcaaaagtgcagtcaagagcagagtctcgttcaaaggctaaggttcccaaagatgaagaagagagcggcgatgacgatggggatgaggaggcggaggagcacgacaacaccctgtgtggaacctgcggaaccaatgatggcaaggaccagttctggatctgctgcgataactgcgagaagtggtaccatgggaagtgcgtcaagatcacacctgcccgagctgagcacatcaagcagtacaagtgcccagactgcaccaacaagagggccagggcatga

SEQ ID NO: 1634 - protein, 256 aa, Sorghum bicolor
  misc_feature: Ceres ANNOT ID no. 6016526
  misc_feature (202)..(252): Pfam Id: PHD Pfam Desc: PHD-finger
  misc_feature (3)..(256): NCBI GI: 4091080 NCBI Desc: nucleic acid binding protein [oryza sativa]
  misc_feature (3)..(256): NCBI GI: 4884860 NCBI Desc: nucleic acid binding protein [oryza sativa]
  misc_feature (1)..(255): NCBI GI: 115394650 NCBI Desc: phd2 [glycine max]
  misc_feature (14)..(255): NCBI GI: 115394660 NCBI Desc: phd1 [glycine max]
  misc_feature (1)..(256): NCBI GI: 110740836 NCBI Desc: nucleic acid binding protein - like [arabidopsis thaliana]
  misc_feature: The sequence is a functional homolog of SEQ ID NO 10 in the 10/225,066US patent application
  misc_feature: The sequence is a functional homolog of SEQ ID NO 1052 in the 10/225,066US patent application
  misc_feature: The sequence is a functional homolog of SEQ ID NO 136 in the 11/375,241US patent application
  misc_feature: The sequence is a functional homolog of SEQ ID NO 1645 in the 11/479,226US patent application
  misc_feature: The sequence is a functional homolog of SEQ ID NO 1873 in the 11/479,226US patent application
  misc_feature: The sequence is a functional homolog of SEQ ID NO 1981 in the 11/479,226US patent application
  misc_feature: The sequence is a functional homolog of SEQ ID NO 2552 in the 10/374,780US patent application
  misc_feature: The sequence is a functional homolog of SEQ ID NO 304 in the 10/374,780US patent application
  misc_feature: The sequence is a functional homolog of SEQ ID NO 782 in the 10/412,699US patent application
  misc_feature: The sequence is a functional homolog of SEQ ID NO 816 in the 10/412,699US patent application
  misc_feature: The sequence is a functional homolog of SEQ ID NO 838 in the 10/225,066US patent application
  misc_feature: Useful for making plants with modulated growth and phenotype characteristics
  misc_feature: The sequence is a functional homolog of SEQ ID NO 782 in the 20040045049 US patent application
  misc_feature: The sequence is a functional homolog of SEQ ID NO 10 in the 20050160493 US patent application
  misc_feature: The sequence is a functional homolog of SEQ ID NO 1052 in the 20050160493 US patent application
  misc_feature: The sequence is a functional homolog of SEQ ID NO 1981 in the 20070022495 US patent application
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: The sequence is a functional homolog of SEQ ID NO 1981 in the 11/479,226 US patent application
  misc_feature: Useful for making plants with altered alkaloid content
  misc_feature: Functional homolog of the protein sequence given in SEQ ID NO 13176
  misc_feature: Useful for making plants with altered lignin content
  misc_feature: Useful for making plants with modulated flowering time
  misc_feature: Functional homolog of the protein sequence given in SEQ ID NO 13473
  misc_feature: The sequence is a functional homolog of SEQ ID NO. 482 in the 11/188,298 US application
MDGGGSGPAPNAARTADEVFRDYKARRAGMIKALTTDVERFFKLCDPEKENLCLYGYPNETWEVTLPAEEVPPEIPEPALGINFARDGMNEKDWLALVAVHSDSWLLSVAFYFGARFGFDREARRRLFSMINNMPTIFEVVTGAVKKQAKEKTPNSSSKSNKPSSKVQSRAESRSKAKVPKDEEESGDDDGDEEAEEHDNTLCGTCGTNDGKDQFWICCDNCEKWYHGKCVKITPARAEHIKQYKCPDCTNKRARA

SEQ ID NO: 1635 - DNA, 1521 bp, Sorghum bicolor
  misc_feature: Ceres ANNOT ID no. 6016533
  misc_feature: Encodes the peptide sequence at SEQ ID NO 1636
atggcggatggcggcgtggattcggagtcgacggcgctggagttcacgccgacgtggatcgtggcggcggtctgctccctcatcgtggtcatctccctcgccgccgagaggtgcctgcatcacctcggcaagacgttcaaggcgaagaaccagaaggcgctctttgaggctctcctcaaggtcaaagaagagctgatgcttctggggttcatctccctgctgctgacggtgttccaaggaatgatgcagaggacgtgcattcctcgggaatggaccatctacatgctcccatgccgtaacgccaaggagcagaccgagctgagcaccacggaggcgcatggccttgctgccggaatcttaggcctcacccgccggcgtctgcttgccgagagcggacccatggcccagcattgccaaaagaagggagaagttcctttgttgtcagttgaagcactacatcagttgcatatcttcattttcattctggccattgcacacgtgattttctgtgttttgactatgcttttaggaagcgcaaggattcgtcaatggaaacactgggaggatgaaattcagaagggtactacagaaaatgggcctaggaaggtgacctatgtgcatcaatctgaatttatcagggaacatttcaagggtattggcagagattccacaatgttgagctggctgcattcttttgttaagcagttttatgggtcggttactaaatcagactacactacaatgcgacttggcttcatcacgacacattgtagggcaaacccaaaatttgatttccacagatacatgatgcgagctttggaggctgactttaagaaggtggttggcataagctggtacttgtggatattcgtggtggtattcatgttgctgaacgtcaatggttggcatacatacttttggatctctttcattccccttcttcttctgttggccgttggcaccaagctagagcatgtcataactcagttggctcaagaggtcgctgagaagcactccgcaatagagggcgacctggtcgtcaatccgtcagatgaccacttctggtttggacggccaaaaatcgtcttgtacctgatccacttcatcctcttccagaacgcatttgagattactacctacggtttcaactcctgcatcatggaccacgtccccttcattgtgccgaggcttgttgtcggggccatcatccagctgctctgcagctacagcaccctgcctctgtacgccattgtcacgcagatggggaccttcttcaagaaggagatcttcgacgagcacgtgcagcagagcctcgtgggctgggcgcagaaggccaagaagaggaaagcgctcaagaacaatggcaatggcagcattggcgctgccaggtcggcatcggcacatccatctgcgaggctcgaactgatgagacgagctgtcgctcttgaagaaggcagtgccggtggcaacgggagtgaagccagtgccgccgagctgcaggacagggtcccgaagctctga

SEQ ID NO: 1636 - protein, 506 aa, Sorghum bicolor
  misc_feature: Ceres ANNOT ID no. 6016533
  misc_feature (8)..(483): Pfam Id: Mlo Pfam Desc: Mlo family
  misc_feature (7)..(488): NCBI GI: 13784989 NCBI Desc: seven transmembrane protein mlo8 [zea mays]
  misc_feature (1)..(499): NCBI GI: 14091600 NCBI Desc: membrane protein mlo15 [arabidopsis thaliana]
  misc_feature (1)..(499): NCBI GI: 42571225 NCBI Desc: seven transmembrane mlo family protein / mlo-like protein 15 (mlo15) [arabidopsis thaliana]
  misc_feature (1)..(447): NCBI GI: 46405143 NCBI Desc: mlo3 [hordeum vulgare subsp. vulgare]
  misc_feature (7)..(448): NCBI GI: 14091596 NCBI Desc: membrane protein mlo13 [arabidopsis thaliana]
  misc_feature: Useful for making plants with modulated biotic stress sensitivity
  misc_feature: Functional homolog of the protein sequence given in SEQ ID NO 13615
MADGGVDSESTALEFTPTWIVAAVCSLIVVISLAAERCLHHLGKTFKAKNQKALFEALLKVKEELMLLGFISLLLTVFQGMMQRTCIPREWTIYMLPCRNAKEQTELSTTEAHGLAAGILGLTRRRLLAESGPMAQHCQKKGEVPLLSVEALHQLHIFIFILAIAHVIFCVLTMLLGSARIRQWKHWEDEIQKGTTENGPRKVTYVHQSEFIREHFKGIGRDSTMLSWLHSFVKQFYGSVTKSDYTTMRLGFITTHCRANPKFDFHRYMMRALEADFKKVVGISWYLWIFVVVFMLLNVNGWHTYFWISFIPLLLLLAVGTKLEHVITQLAQEVAEKHSAIEGDLVVNPSDDHFWFGRPKIVLYLIHFILFQNAFEITTYGFNSCIMDHVPFIVPRLVVGAIIQLLCSYSTLPLYAIVTQMGTFFKKEIFDEHVQQSLVGWAQKAKKRKALKNNGNGSIGAARSASAHPSARLELMRRAVALEEGSAGGNGSEASAAELQDRVPKL

SEQ ID NO: 1637 - DNA, 2004 bp, Sorghum bicolor
  misc_feature: Ceres ANNOT ID no. 6016539
  misc_feature: Encodes the peptide sequence at SEQ ID NO 1638
atgccgcccaaatcgaaggcggccgccgccgccgcggagccggtagccgtcgaggacctcttcacctcgattcaccgccacatcgaggccggtgctttcgaacaggccgccaaggtcgccgaccaagttctcaaggcggctccaggggatgaggacgcggtgcgatgcaaggtggtggcatacatcaaggccgacgagatcgacaaggcgttcgccgcgatccgcgccgccgagcgcctcccgatcgacctcagctactacaaggcctactgctgctacaggcaaaacaaactgcaagaagctctggagcttttaagaggtcaagaagaaacttcagctgttctccagctggaatcccagatcttttaccggctaggaagaatgaatgattgcatgagtagctatgagaagcttcagaaatttaaaattgactcaatggatctgaagataaatatcattgctgctctggttgctgctggaagggcttctgaggtgcaggcagctatgaaggcacataaggttgatcttaccacaagagcactcagggatactcgtagctttgagctcgcatacaattctgcttgctccttgatagaaaacaagaagtactctgaagccaaggagcagttggacttggcgaaaagaattgggaaagaagagcttatggtggaagactatggcgatgtggagattgaatatgaattagctcctgtgtctgctcagcttgcttatgtgcagcagctacaaggacaatctcaagaagctctgcaaacctatcttaatatgataaatgggcagtcagctgatccatcatcacttgctgtggcaacaacaaaccttatttcactaaaaggtacaaaagatactgcagatagcttgaagaagcttgatcggcttattggaacaactacagctccaaaccagttacatcttgttgaaaaccttgacttcaagttatcccctaggcagaaagaagctctttattctgcacgtgttcttctactgctccatgcaaataaaactgatcaggcacatgagttggtcagtggactgcttggtatgtttccagatagtgtattccctgttttacttcaagccgctgttcatgtgaaagaaaagaaggttcagaaagctgaagatgttcttagccagtatgctgagaagaatcctgagaattctaaagggcttctccttgcacttgctcagattgctgctaatgccaaccattttcagcttgctgctgactcactatgcagaatacctgacatccagcacatgcctgcaacagttgctacattagtggctcttaaagagcgcctaggtgactccaatgctgcagcttctgtacttgattctgctatccactggtggaagaattccatgaccgaggataacaaattagatatgttaacacgggaggctgcttcatttaagctcagtcatggacatgatgaagaggcttgtttgttgtacgaggaactcgtgaagagccatggaagtattgaagctttggctgggctagtgatgacttcagcacgcacaaacctggagaaggctgaacaatatgagaagaagctgaagccattgccaggcctcaaaggagttaatgttgagagcttggagaagacatctggtgcaaggcatgttgaagggccccaagatatgaaggttgatgttcctgaggaagtgaagaagcaaaaggcaaagaagaggaagcggaagcctagatacccgaaaggctttgatccagcaaacccagggccgccaccagatccagagagatggctaccaaggagagagcgatccagttaccgtccaaagaggaaggataagagggctcaggtcagaggtgctcaaggagctgtgtctagggagacagcagcaaccaatgccggtggttcctcaaaaggaagccaaaccaccagttcatccaagacaccagcggcaaatactgatcagccaaaaactagcaacaaatccaggaagaagaagtccaggtcttag

SEQ ID NO: 1638 - protein, 667 aa, Sorghum bicolor
  misc_feature: Ceres ANNOT ID no. 6016539
  misc_feature (518)..(606): Pfam Id: SRP72 Pfam Desc: SRP72 RNA-binding domain
  misc_feature (12)..(667): NCBI GI: 108881114 NCBI Desc: signal recognition particle [aedes aegypti]
  misc_feature (17)..(663): NCBI GI: 116116019 NCBI Desc: ensangp00000018437 [anopheles gambiae str. pest]
  misc_feature (313)..(658): NCBI GI: 119625903 NCBI Desc: signal recognition particle 72kda, isoform cra_c [homo sapiens]
  misc_feature (8)..(658): NCBI GI: 50979066 NCBI Desc: signal recognition particle,72 kda subunit [canis familiaris]
  misc_feature (8)..(658): NCBI GI: 119625901 NCBI Desc: signal recognition particle 72kda, isoform cra_b [homo sapiens]
MPPKSKAAAAAAEPVAVEDLFTSIHRHIEAGAFEQAAKVADQVLKAAPGDEDAVRCKVVAYIKADEIDKAFAAIRAAERLPIDLSYYKAYCCYRQNKLQEALELLRGQEETSAVLQLESQIFYRLGRMNDCMSSYEKLQKFKIDSMDLKINIIAALVAAGRASEVQAAMKAHKVDLTTRALRDTRSFELAYNSACSLIENKKYSEAKEQLDLAKRIGKEELMVEDYGDVEIEYELAPVSAQLAYVQQLQGQSQEALQTYLNMINGQSADPSSLAVATTNLISLKGTKDTADSLKKLDRLIGTTTAPNQLHLVENLDFKLSPRQKEALYSARVLLLLHANKTDQAHELVSGLLGMFPDSVFPVLLQAAVHVKEKKVQKAEDVLSQYAEKNPENSKGLLLALAQIAANANHFQLAADSLCRIPDIQHMPATVATLVALKERLGDSNAAASVLDSAIHWWKNSMTEDNKLDMLTREAASFKLSHGHDEEACLLYEELVKSHGSIEALAGLVMTSARTNLEKAEQYEKKLKPLPGLKGVNVESLEKTSGARHVEGPQDMKVDVPEEVKKQKAKKRKRKPRYPKGFDPANPGPPPDPERWLPRRERSSYRPKRKDKRAQVRGAQGAVSRETAATNAGGSSKGSQTTSSSKTPAANTDQPKTSNKSRKKKSRS

SEQ ID NO: 1639 - DNA, 780 bp, Sorghum bicolor
  misc_feature: Ceres ANNOT ID no. 6016548
  misc_feature: Encodes the peptide sequence at SEQ ID NO 1640
atggcttcgtcggtgccggcgccatcggggtcggtgatcaccgtggcatcgtcttcttcctcagcagccgcggccgcggtgtgtggcacgggctcgccatgcgctgcgtgcaagttcctgcgccgcaagtgccagccggactgcgtgttcgcaccctacttcccaccggacaacccgcagaagttcgtgcacgtgcaccgtgtcttcggcgccagcaacgtgaccaagctgctgaacgagctccaccctttccagcgcgaggacgccgtgaactcgctcgcctacgaggccgacatgcgcctccgcgaccccgtctacggctgcgttggcgtcatctccatcctccagcacaacctacgccagctccagcaggacctcgcccgcgccaagtacgagctctccaagtaccaggcggcagcggcagcttctgcgtccacggcggcgcccaacgggccgcaggcgatggcagagttcatcggcaacgcgatgccgaacggcgcgcacaacttcatcaacattggacactcggcggcgctcggctccctcggaggctccgccaccgtgttcggccaggagcagttcgccaacgcgcagatgctgtccaggagctacgacggcgagcccatcgcgaggctggggatcaacggcggctacgagttcgggtactcgaccgcgatgggcgggtctggcgctgtctctggcctcgggacgctcggcatcagccctttcttgaagtccggtaccgccggcggcgacgagaagcccagcggcggtcagtag

SEQ ID NO: 1640 - protein, 259 aa, Sorghum bicolor
  misc_feature: Ceres ANNOT ID no. 6016548
  misc_feature (1)..(259): NCBI GI: 62997483 NCBI Desc: asymmetric leaves2 [zea mays]
  misc_feature (1)..(258): NCBI GI: 120431393 NCBI Desc: ial1 [zea mays]
  misc_feature (2)..(259): NCBI GI: 20804970 NCBI Desc: b1099d03.24 [oryza sativa (japonica cultivar-group)]
  misc_feature (2)..(259): NCBI GI: 60476771 NCBI Desc: as2 [triticum aestivum]
  misc_feature (26)..(145): NCBI GI: 17227156 NCBI Desc: lob domain 6 [arabidopsis thaliana]
  misc_feature: Abnormal phyllotaxy, leaf number higher than wild-type
  misc_feature: The plant is abnormally small.
  misc_feature: Useful for making plants with modulated biomass
  misc_feature: Functional homolog of the protein sequence given in SEQ ID NO 12922
  misc_feature: Useful for making plants with modulated biomass
  misc_feature: Functional homolog of the protein sequence given in SEQ ID NO 12922
MASSVPAPSGSVITVASSSSSAAAAAVCGTGSPCAACKFLRRKCQPDCVFAPYFPPDNPQKFVHVHRVFGASNVTKLLNELHPFQREDAVNSLAYEADMRLRDPVYGCVGVISILQHNLRQLQQDLARAKYELSKYQAAAAASASTAAPNGPQAMAEFIGNAMPNGAHNFINIGHSAALGSLGGSATVFGQEQFANAQMLSRSYDGEPIARLGINGGYEFGYSTAMGGSGAVSGLGTLGISPFLKSGTAGGDEKPSGGQ

SEQ ID NO: 1641 - DNA, 1056 bp, Sorghum bicolor
  misc_feature: Ceres ANNOT ID no. 6016556
  misc_feature: Encodes the peptide sequence at SEQ ID NO 1642
atggagcaagagccgaaggcggtggcgaggaacaggaaggtggtgctgcgcgggtacatcgaccgcgcgccaagggaggacgacatggagctcgtcgacggcggcgccctggagctgcgcgtccccgagtgcgccggcggcggccccgcggtgctggtgaagaacctctacctctcctgtgacccctacatgcgcggcaggatgcgggacttccagggctcctatattccgcccttcaagcctggatcacctattgaagggtttggtgtggggagggtggtcgactccacttatccaggacttagtgctggtgacattgtttccgggatgactggctgggaggactacagtctgatcaccaagcctgaacaactcacgaagattcagcaaagcgacataccactctcttatcatctgggccttcttggcatgcctggttttacagcttacgttggattctatgagatttgttcaccaaagaaaggggagtttgtttttgtttctgctgcatctggagcagttgggcaaattgttggtcaacttgcaaagctccatggctgctatgttgtgggaagcgctggaacaaatcagaaggttgagctcctaaaggaaaaattcggatttgatgcagctttcaactacaaggaagagcctgacttgactgctgccttaaaaaggtacttccctgaaggcatagacatctactttgagaacgtaggtgggccgatgcttgatgctgtactactcaacatgcgagtacatggccgcattgcagtgtgtggtatggtttcccagcatggggtaactgctcctgctgggatccacaacctgttctccttcataagcaagaggatagagatgaagggattcatccagagtgattacgtacacctgttcccacagttcgtggatgacatcaccaagcattacagagatgggaagattgtgtatgtggaagatgtgagtattgggctggagagcggaccagctgcctttgttggtctgttcagtggtaaaaatgttggcaagcaggttgtgcgtgtgtctcaagattga

SEQ ID NO: 1642 - protein, 351 aa, Sorghum bicolor
  misc_feature: Ceres ANNOT ID no. 6016556
  misc_feature (161)..(308): Pfam Id: ADH_zinc_N Pfam Desc: Zinc-binding dehydrogenase
  misc_feature (85)..(351): NCBI GI: 2190553 NCBI Desc: strong similarity to arabidopsis zeta-crystallin-like protein (gbz49268). [arabidopsis thaliana]
  misc_feature (11)..(351): NCBI GI: 6692816 NCBI Desc: allyl alcohol dehydrogenase [nicotiana tabacum]
  misc_feature (9)..(351): NCBI GI: 116310695 NCBI Desc: h0306b06.9 [oryza sativa (indica cultivar-group)]
  misc_feature (11)..(351): NCBI GI: 62461976 NCBI Desc: alcohol dehydrogenase-like protein [ocimum basilicum]
  misc_feature (11)..(351): NCBI GI: 21554121 NCBI Desc: quinone oxidoreductase-like protein [arabidopsis thaliana]
MEQEPKAVARNRKVVLRGYIDRAPREDDMELVDGGALELRVPECAGGGPAVLVKNLYLSCDPYMRGRMRDFQGSYIPPFKPGSPIEGFGVGRVVDSTYPGLSAGDIVSGMTGWEDYSLITKPEQLTKIQQSDIPLSYHLGLLGMPGFTAYVGFYEICSPKKGEFVFVSAASGAVGQIVGQLAKLHGCYVVGSAGTNQKVELLKEKFGFDAAFNYKEEPDLTAALKRYFPEGIDIYFENVGGPMLDAVLLNMRVHGRIAVCGMVSQHGVTAPAGIHNLFSFISKRIEMKGFIQSDYVHLFPQFVDDITKHYRDGKIVYVEDVSIGLESGPAAFVGLFSGKNVGKQVVRVSQD

SEQ ID NO: 1643 - DNA, 1194 bp, Sorghum bicolor
  misc_feature: Ceres ANNOT ID no. 6016562
  misc_feature: Encodes the peptide sequence at SEQ ID NO 1644
atggcgaccgagctgctgtcgccgctcctcccgcagcgtcaaggggccctcgctgtcgtcgtggccgcgcccctactcgcgctcctcctggccgttgtcttcttctcccgctctccggtggcggcacccgtgtccgagagctcgccggagctcgtcgacctgatactcctcgccggcgctcaggagaagggagcggtgtgcttggatggtagcccgcctggttaccacctgcggagaggatttggttccggagctcacagctggctcgtctttcttgagcgcaaaatgaccaacttcggttcatctaaatatatgacagcagtaaacctcaatgggatactcagcaatgaccacatagaaaaccctgatttctacaactggaatatagctgttataaggtactgcgacggaggatcatttgctggggatgcagagggtgaagatctggatggaaccaaacttttcttcagaggattgcgcatctgggaagcagttgtggatgaactcatggccttgcttacaggctgttctgctggttctctagctgcgctactgcactgtgataattttcgtggacagtttcctcatgaagtttcagttaaatgcctttctgatgctggattttttattgacgagaaggatttatctggtgaaaggtccatgcggtcgctcatcagtggagtagttcaccttcagaatgttagagaagttctacccaacaactgcctccaaaagaaggatccagcagagtgtttctttcctgctgaactgattaagagcatcatcacccccacatttattctgaactccgattacgattcttggcagattcgaaacattctcgcaccaaatggatcctatcctggtcaggcatggtctagttgcaaagcagatatccggaactgcagctgcacacaaattgatgtactacatggattcaagaagaaattagtcagtgaactgaaggttgcggaagataacaatgactgggggctgttcattgattcatgctttacccactgtcaaacaccattcaatatcacatggcactcaccgatctcaccaagacttggtgacaagtctattgcagaggctgttggggattggtactttggtagaaggcaagacgtgaaactgatcgactgcgagtacccatgcaaccctacatgcagcagtcttctgcctactgcttga

SEQ ID NO: 1644 - protein, 397 aa, Sorghum bicolor
  misc_feature: Ceres ANNOT ID no. 6016562
  misc_feature (27)..(380): Pfam Id: PAE Pfam Desc: Pectinacetylesterase
  misc_feature (171)..(396): NCBI GI: 115441561 NCBI Desc: os01g0892400 [oryza sativa (japonica cultivar-group)]
  misc_feature (94)..(394): NCBI GI: 87241323 NCBI Desc: pectinacetylesterase [medicago truncatula]
  misc_feature (94)..(394): NCBI GI: 109509142 NCBI Desc: pectin acetylesterase [eucalyptus globulus subsp. globulus]
  misc_feature (94)..(393): NCBI GI: 109509148 NCBI Desc: pectin acetylesterase [eucalyptus globulus subsp. globulus]
  misc_feature (94)..(394): NCBI GI: 79366428 NCBI Desc: carboxylic ester hydrolase [arabidopsis thaliana]
  misc_feature: Useful for making plants with altered cell wall content and/or composition
  misc_feature: Functional homolog of the protein sequence encoded by LOCUS at3g09420
MATELLSPLLPQRQGALAVVVAAPLLALLLAVVFFSRSPVAAPVSESSPELVDLILLAGAQEKGAVCLDGSPPGYHLRRGFGSGAHSWLVFLERKMTNFGSSKYMTAVNLNGILSNDHIENPDFYNWNIAVIRYCDGGSFAGDAEGEDLDGTKLFFRGLRIWEAVVDELMALLTGCSAGSLAALLHCDNFRGQFPHEVSVKCLSDAGFFIDEKDLSGERSMRSLISGVVHLQNVREVLPNNCLQKKDPAECFFPAELIKSIITPTFILNSDYDSWQIRNILAPNGSYPGQAWSSCKADIRNCSCTQIDVLHGFKKKLVSELKVAEDNNDWGLFIDSCFTHCQTPFNITWHSPISPRLGDKSIAEAVGDWYFGRRQDVKLIDCEYPCNPTCSSLLPTA

SEQ ID NO: 1645 - DNA, 1041 bp, Sorghum bicolor
  misc_feature: Ceres ANNOT ID no. 6016563
  misc_feature: Encodes the peptide sequence at SEQ ID NO 1646
atggcggccgcgccccggctcatcacgatgacgctcctggccgtgtcagccttattgtcccgaccggcggcggcggagctcgtcgagctcaccctcctcgcaaacgctcgggagaagggcgcggtctgcttggatggcagcccgccggcttaccagctccggagaggcttcggctctggatcacgcagctggctcgtcaatcttgagggaggagcatggtgcaacaccgcagaagattgctccagccgcagcctgaccgaccttggttcgtctaagttcatgaaaccaatagagtttgaagggatcctcagcaacaattgctcggaaaatccctatttctacaactggaatatagttgacataaggtactgcgatgggggatcatttgctggggatgcagagggcgaagatcggtggcgttcatgtagaacggaaccaaacttttctacagaggattgcgcatctgggaagcagtcgttgacgaactcatgggaaaaggaatggacactgctaaacagaaaggatttatcaggccaaaggtttatgcggtccatcttcagtggagttgttcaccttcagaatgtgagaaaagttttgcccaaggactgtcttgcaaagaaggacccaacagaggtggttaaccgctcattctcttgggaaattcagtttaccttggtaggaaatgttgtggcgccaggcggatctgatccgggacaatcatgggctatctgcaaagctgatattcgaaactgtacttccacacaaattgaggcactgaatggattccgggagaaaatggttgaggatttgaaggttgctcaagagaagaagggctgggggttgttcatcgattcgtgcttcaaccactgccaaacgccattcagaatcacatggcagtccccgatctccctgagacttggtaacaagacgatcgctgaagctgttgcgaattggtatgtcagtaaataccatggagtgaaggagattgactgcgggtatccatgcatcaaccccacctgtagcagtcagctcgacctgtaa

SEQ ID NO: 1646 - protein, 346 aa, Sorghum bicolor
  misc_feature: Ceres ANNOT ID no. 6016563
  misc_feature (12)..(329): Pfam Id: PAE Pfam Desc: Pectinacetylesterase
  misc_feature (174)..(344): NCBI GI: 115441561 NCBI Desc: os01g0892400 [oryza sativa (japonica cultivar-group)]
  misc_feature (27)..(137): NCBI GI: 87241323 NCBI Desc: pectinacetylesterase [medicago truncatula]
  misc_feature (27)..(136): NCBI GI: 79366428 NCBI Desc: carboxylic ester hydrolase [arabidopsis thaliana]
  misc_feature (27)..(136): NCBI GI: 21703105 NCBI Desc: at1g57590/t8l23_6 [arabidopsis thaliana]
  misc_feature (16)..(136): NCBI GI: 140049891 NCBI Desc: pectinacetylesterase [medicago truncatula]
  misc_feature: Useful for making plants with altered cell wall content and/or composition
  misc_feature: Functional homolog of the protein sequence encoded by LOCUS at3g09420
MAAAPRLITMTLLAVSALLSRPAAAELVELTLLANAREKGAVCLDGSPPAYQLRRGFGSGSRSWLVNLEGGAWCNTAEDCSSRSLTDLGSSKFMKPIEFEGILSNNCSENPYFYNWNIVDIRYCDGGSFAGDAEGEDRWRSCRTEPNFSTEDCASGKQSLTNSWEKEWTLLNRKDLSGQRFMRSIFSGVVHLQNVRKVLPKDCLAKKDPTEVVNRSFSWEIQFTLVGNVVAPGGSDPGQSWAICKADIRNCTSTQIEALNGFREKMVEDLKVAQEKKGWGLFIDSCFNHCQTPFRITWQSPISLRLGNKTIAEAVANWYVSKYHGVKEIDCGYPCINPTCSSQLDL

SEQ ID NO: 1647 - DNA, 1278 bp, Sorghum bicolor
  misc_feature: Ceres ANNOT ID no. 6016567
  misc_feature: Encodes the peptide sequence at SEQ ID NO 1648
atggaatgccttgagtttgattgttctgatttattcctggatggcgatgcgatcgacttcccattggaaatccatcttgagtccaacagttcagcaggcgccaaagctgcgccggatcataggcggcatgctcagcttcatcgcagcaaggcccctgatccgccaccgttgcctggaacctcttatgacgcgtggagaatttctaggaaggcaaaggcttgtcgccgcgtccctgaaggcgtcgtcgattcctgggacaggttgttcttgcagggataccaatctgatctccgtgtttggacagacgatgacactgaaattctttcacattcctgtgttcttggtgtcaaatctcctgttctgagagctatgttggaggaagccaaattgaaagatggttttcggtgtattcgtatttctggcgcgccttcagaagcagtctgtgttttcatcagatttctttactcttcacgttttgagcaggaacagatgaagaagcacgttctgcatttgcttgtactctcccatgttttctcggtgccatctctgaagacggtctgcatcgaccaactcgagaggaatttccttgctcctgacaacgtggtagacatgctgcaacttgccagattgtgtgacgcgcctcggctctcgctcgtctgcacccggatgatcatcggggatttcaagaccatctctctgacggatgggtggaaagtaatgagacgggtcaatcctactatggaacaggagttgctcgagtctcttgtcgaaaccgatacaaaaaggcaggaaagagctaaaaggatggaagaaaagaaggtctatctgcaattgcacgaagcaatggaggcccttgtccacatatgccgagacggatgcaggacgatcgggcctcgagatcaagcgctcaagggcagtctagcagctgcctgcaagtttccggcctgcaagggcatcgagctgctcgtgcgccacttctcgacctgcagagttcgggtgcctggtggctgtgccaactgcaagcgaatgtggcagctcctcgagctgcattcccgcatgtgtttcatcccggacacctgcaaggttcctctctgcaggcattttaaggagaaaatgcggaatctggggaggaaggaagagaccaaatggaaccttttggtgtgcaaggtactggagagcagaggaaccatggcttttatgccagaaaggagaaaaaaattatcaatcctaacaccagctgggagttgccacgtggctcctcttgtaggacctatttga

SEQ ID NO: 1648 - protein, 425 aa, Sorghum bicolor
  misc_feature: Ceres ANNOT ID no. 6016567
  misc_feature (85)..(195): Pfam Id: BTB Pfam Desc: BTB/POZ domain
  misc_feature (21)..(332): NCBI GI: 21952829 NCBI Desc: p0696g06.1 [oryza sativa (japonica cultivar-group)]
  misc_feature (52)..(407): NCBI GI: 42561724 NCBI Desc: taz zinc finger family protein / btb/poz domain-containing protein [arabidopsis thaliana]
  misc_feature (52)..(395): NCBI GI: 92866951 NCBI Desc: zinc finger, taz-type; btb/poz [medicago truncatula]
  misc_feature (40)..(401): NCBI GI: 42573822 NCBI Desc: taz zinc finger family protein / btb/poz domain-containing protein [arabidopsis thaliana]
  misc_feature (51)..(394): NCBI GI: 36955924 NCBI Desc: btb and taz domain protein 5 [arabidopsis thaliana]
MECLEFDCSDLFLDGDAIDFPLEIHLESNSSAGAKAAPDHRRHAQLHRSKAPDPPPLPGTSYDAWRISRKAKACRRVPEGVVDSWDRLFLQGYQSDLRVWTDDDTEILSHSCVLGVKSPVLRAMLEEAKLKDGFRCIRISGAPSEAVCVFIRFLYSSRFEQEQMKKHVLHLLVLSHVFSVPSLKTVCIDQLERNFLAPDNVVDMLQLARLCDAPRLSLVCTRMIIGDFKTISLTDGWKVMRRVNPTMEQELLESLVETDTKRQERAKRMEEKKVYLQLHEAMEALVHICRDGCRTIGPRDQALKGSLAAACKFPACKGIELLVRHFSTCRVRVPGGCANCKRMWQLLELHSRMCFIPDTCKVPLCRHFKEKMRNLGRKEETKWNLLVCKVLESRGTMAFMPERRKKLSILTPAGSCHVAPLVGPI

SEQ ID NO: 1649 - DNA, 2205 bp, Sorghum bicolor
  misc_feature: Ceres ANNOT ID no. 6016570
  misc_feature: Encodes the peptide sequence at SEQ ID NO 1650
  misc_feature: Up-regulated in shoot tissues in response to salicylic acid treatment
atggagacgcgcggcaagcggctcctcccctttctactggtcctcatcgccgcggcggtggctccgtccgccatgtcccgtgacgagagagaggtggtgaaggtgtccggtgcgccggacggggttgtgtgggcggcccagctctcggatctccacttcagcgtgcaccacccggagcgcgcctacgacttccggcggtatgtcggcccggcgctggccatggtcaaccccgacctcgtcctgatcacaggagaccttactgatgggaaaagcaaagatttgttaacaatgaaacagaacgaggcagaatgggtggaatatgaaagtacaatgaaggaaatcattgaaagtagcaagcttccaagaaggattttctatgatctgagaggaaatcatgatagctttggtgtaccagcatctggtgacgactatgacttttataataagtatagcatcaatgccaagttaagacggcaggggcgtgtccaaagcattactttggagaatagtggtcggaagcatctgtttgttggctttgatagcacaatggagattggtcttagaggtccaaccaatctatttggacatccaactgacaagcaggtgattgaattggatcaagcgctatcacagtgggatactgactttgacaaggctccagtgacaaaaattgcatttgggcacttccctttgtctttctcagcattaacagagtcaggaaaaagtatcaaggatgtttttctaaaacaatcattggcagcatacttgtgtgggcatcttcatacaaggttcgggaaaaacttgaaacgatactaccatcggcaagtccaggaaccatcattatcagagcattactaccaacttaacatgcaccaaggagatgcaatccatagtaataaggaaaactgttctgaagaagcagctcatattgaagagttctgggaatgggagatgggtgattggagaaagagcagaagtatgagggtactagcaattgatgatggatatgtctcctatactgatatagatttcagattaggctcaaagagcataatcatactacctacctttccacttgattcaagattcatgcagagagcctctggttttcgtgatttcaaatgtcatgtcccgggggcatcgtcttttgataccgtgagagctcttgttttctctaaacatgagatagtatctgtttctataaaaatatatgactcaaggccaggaactcttgaagtagtctttgactctgaaatgaaaagggtggattccaatgaaactcgaggaaatatgtatttgataccatggaactggagggcatttgaagattcctctcccagccgatattggctccaaattgaagtgatggatataacaggtgacacaagtgtcagccagttgaggccattctctgttaacggcttgtctgcaagagtgaactggacatggaaagagttttttgtgatgggtatccagtgggcttcaatatatcatcctgcactgtggtgtgccttttctctaattttttcgttgcttcttgttccacaagttttagcagtggtattcaaagatcagttcacatataaatgtctatgcacatatggtaggcagaggacactgttgaaatctctagttggtggtttcatctgttcttttgttgaactcgccagggtgattcttgtatggttattgctcctgctatatgctgtctatttagtttttataccttggttatttggtcaccctgttactgaagatggtagcctgacattcatgacatataaaggttggattctaaaaggacccaatagtagcaacaaagtagtccatgctgggattccagatgtcatggtcattgttctacctcacctttgttttgtgttactacccactattgtgattttagctgccatggctgctgagagagctgcatatcgagagcattatctttctcgatcaggaaagaagaaagatgattactaccaaaagagcaggagacagatagaacatgaaaacttttggaatggtcgctggattagaaaatttctgtgtgttctttgcgtggtggttctatggaaacattggaagctttgcagagcgcttgtgaaggcttatgctatgaactctttgctccatgcgccagtacttttcttcttcattcctttactcatggtgtttgccatctacaagacatggtccatttag

SEQ ID NO: 1650 - protein, 734 aa, Sorghum bicolor
  misc_feature: Ceres ANNOT ID no. 6016570
  misc_feature (43)..(263): Pfam Id: Metallophos Pfam Desc: Calcineurin-like phosphoesterase
  misc_feature (1)..(734): NCBI GI: 57899805 NCBI Desc: calcineurin-related phosphoesterase-like [oryza sativa (japonica cultivar-group)]
  misc_feature (1)..(734): NCBI GI: 21952835 NCBI Desc: p0696g06.7 [oryza sativa (japonica cultivar-group)]
  misc_feature (9)..(734): NCBI GI: 34395043 NCBI Desc: calcineurin-related phosphoesterase-like protein [oryza sativa (japonica cultivar-group)]
  misc_feature (32)..(731): NCBI GI: 144924121 NCBI Desc: metallophosphoesterase [medicago truncatula]
  misc_feature (44)..(265): NCBI GI: 116487833 NCBI Desc: mgc154928 protein [xenopus laevis]
  misc_feature: Up-regulated in shoot tissues in response to salicylic acid treatment
METRGKRLLPFLLVLIAAAVAPSAMSRDEREVVKVSGAPDGVVWAAQLSDLHFSVHHPERAYDFRRYVGPALAMVNPDLVLITGDLTDGKSKDLLTMKQNEAEWVEYESTMKEIIESSKLPRRIFYDLRGNHDSFGVPASGDDYDFYNKYSINAKLRRQGRVQSITLENSGRKHLFVGFDSTMEIGLRGPTNLFGHPTDKQVIELDQALSQWDTDFDKAPVTKIAFGHFPLSFSALTESGKSIKDVFLKQSLAAYLCGHLHTRFGKNLKRYYHRQVQEPSLSEHYYQLNMHQGDAIHSNKENCSEEAAHIEEFWEWEMGDWRKSRSMRVLAIDDGYVSYTDIDFRLGSKSIIILPTFPLDSRFMQRASGFRDFKCHVPGASSFDTVRALVFSKHEIVSVSIKIYDSRPGTLEVVFDSEMKRVDSNETRGNMYLIPWNWRAFEDSSPSRYWLQIEVMDITGDTSVSQLRPFSVNGLSARVNWTWKEFFVMGIQWASIYHPALWCAFSLIFSLLLVPQVLAVVFKDQFTYKCLCTYGRQRTLLKSLVGGFICSFVELARVILVWLLLLLYAVYLVFIPWLFGHPVTEDGSLTFMTYKGWILKGPNSSNKVVHAGIPDVMVIVLPHLCFVLLPTIVILAAMAAERAAYREHYLSRSGKKKDDYYQKSRRQIEHENFWNGRWIRKFLCVLCVVVLWKHWKLCRALVKAYAMNSLLHAPVLFFFIPLLMVFAIYKTWSI

SEQ ID NO: 1651 - DNA, 2607 bp, Sorghum bicolor
  misc_feature: Ceres ANNOT ID no. 6016572
  misc_feature: Encodes the peptide sequence at SEQ ID NO 1652
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in shoot tissues in response to aminocyclopropane carboxylic treatment
atgatcggaaagataatcggagacatcacgggcagcaacaagcatgcgcagctcaagggcaacgtggtgctcgtgcgcaagaccgtgctcggcttggacgtcaccagcatcgccggctccctcctcgacggcgttggcgagttcctcggacgcggcgtcacctgccagcttatcagctccaccgtcgtcgaccccaacaatggcaaccgcgggaaggtgggcgcggaggcgagcctggagaagtggctgctgaacccgccgccgcttctgtccggcgagaacaagttccacgtcaccttcgactgggaggtggagaagcagggcattccaggcgccatcatcgtcaagaacaaccacgcctccgagttcttcctcaagaccatcaccctcgacgacgtccccggccacggcaccgtcgtcttcgtcgccaactcatggatctacccgcagtccaagtaccgctacaaccgcgtcttcttctccaacgacacgtacctgcccagccagatgccggcggcgctcaagccttaccgcgacgacgagctccggaacctgaggggcgacgaccagcaaggcccgtacaaggagcatgaccgcgtctaccgctacgacgtctacaacgacctcggcctgcctgacagcggcaacccgcggcccgtcctcggcggcaacaaggagctcccctacccgcgccgctgccgcaccgggcggaaacccaccagaaccgaccccaacagcgagagaaggctgacggtggtcgagggcgacgtctacgtgccgcgcgacgagcgtttcggccacatcaagaagtcggacttctacggctacgcgatcaaggcgctcgtgaacgccgtcatcccggcgatccgcacctacgtcgacctgtcgcccggcgagttcaactccttcaaggacatcatcaagctctacgagggcggcatccagctgcccaaaataccagtccttgaagacctgcggaagcagttcccgctcgagctcgtcaaggacgtcctccccgtcggcggcgactacctcctcaagctccccatgccgcaaatcatcaaagaggacaagacaggttggatgaccgatgaggagtttggacgggagattctcgccggcgtcaaccccatgatcgtcaggcgtctcacggagttccctcccagaagcacccttgaccccagcaagtacggtgaccacacgagcaccatcacggaggcgcacctcgagaacaagctggagggcctcaccgtgcagcaggcgctggaaggcaaccggctctacatcctggaccaccacgacaacttcatgccgttcctgatcaggatcaacaacctggagggcaacttcatctacgccaccaggaccgtgctgttcctgcgcggcgacggcacgctggtgccggtggccatcgagctgagcctgccggagctccgggacggcctgaccaccgccaagagcaccgtgtacacgcccacgtcgaccaccggcgcggaggcctgggtgtggcacctcgccaaggccttcgctaacgtcaccgactactgctggcaccagctggtcagccactggctcaacacgcacgccgtcatggagccgttcatcatcgcgaccaaccggcagctcagcgtgacgcaccccgtccacaagctcctgctgccgcactaccgcgacaccatgaacatcaactccaacgcacgccagatgctcgtcaacgccggcggcctcttcgagacaaccgtcttcccgcgccagtacgcgttcgagatgtccgccgtcatctacaagaactggaacttcaccgagcaggctctccctgacgacctaatcaagaggggcatggcggttgccgatgcatcgagcccgtacaaggtgaagctgctggtggaggactacccatacgcgtcggacgggctggcaatctggcacgcgatcgagcagtgggtgacggagtacctgggcatctactaccccaacgacggcgtgctgcaggcggacgtggagctgcaggcatggtggaaggaggtgcgcgaggtcgggcacgccgacctcaaggacgagccatggtggcccaagatggagacggtggcggagctcgtcaaggcctgcaccaccatcatctggatcgcgtcggcgctccacgccgccgtcaacttcgggcagtacccgtacgccgggtacattcccaaccgtccgtcggtcagccggaagccgatgccggcgccgggcagcgaggagtacgcggagctggggaagaacccggagaaggtgttcgtgcgcaccatcacgagccagttccagacactcgtcggcatctcgctgctggagatcctgtccagccactcctccgacgaggtgtacctcggccagcgcgacacgccggagtggacgtcggacgccaaggcgcaggaggcgttccggcggttcggggcgcggctgaccgagatcgagagccgcgtgatgaccatgaacgccgacccaagtctcaagaaccgcaacgggccggccaagttcccctacacgctgctctaccccaacacctccgacaagaatggcgatgccgccggcatcaccgccaagggcattccaaacagcatctccatctga

SEQ ID NO: 1652 - protein, 868 aa, Sorghum bicolor
  misc_feature: Ceres ANNOT ID no. 6016572
  misc_feature (171)..(846): Pfam Id: Lipoxygenase Pfam Desc: Lipoxygenase
  misc_feature (53)..(159): Pfam Id: PLAT Pfam Desc: PLAT/LH2 domain
  misc_feature (2)..(868): NCBI GI: 8515851 NCBI Desc: lipoxygenase [zea mays]
  misc_feature (2)..(868): NCBI GI: 84626283 NCBI Desc: lipoxygenase [zea mays]
  misc_feature (1)..(868): NCBI GI: 73920226 NCBI Desc: lipoxygenase 2 (lipoxygenase l-2)
  misc_feature (1)..(868): NCBI GI: 18481649 NCBI Desc: lipoxygenase [zea mays]
  misc_feature (1)..(868): NCBI GI: 12620877 NCBI Desc: lipoxygenase [zea mays]
  misc_feature (1)..(868): SWISSPROT Homolog: EC 1.13.11.12 Lipoxygenase 2
  misc_feature: Useful for making plants with altered Lignin content
  misc_feature: GREAT-hit functional homolog of the protein sequence given in SEQ ID NO 13126
  misc_feature: Useful for making plants with altered lignin content
  misc_feature: Functional homolog of the protein sequence given in SEQ ID NO 13126
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in shoot tissues in response to aminocyclopropane carboxylic treatment
MIGKIIGDITGSNKHAQLKGNVVLVRKTVLGLDVTSIAGSLLDGVGEFLGRGVTCQLISSTVVDPNNGNRGKVGAEASLEKWLLNPPPLLSGENKFHVTFDWEVEKQGIPGAIIVKNNHASEFFLKTITLDDVPGHGTVVFVANSWIYPQSKYRYNRVFFSNDTYLPSQMPAALKPYRDDELRNLRGDDQQGPYKEHDRVYRYDVYNDLGLPDSGNPRPVLGGNKELPYPRRCRTGRKPTRTDPNSERRLTVVEGDVYVPRDERFGHIKKSDFYGYAIKALVNAVIPAIRTYVDLSPGEFNSFKDIIKLYEGGIQLPKIPVLEDLRKQFPLELVKDVLPVGGDYLLKLPMPQIIKEDKTGWMTDEEFGREILAGVNPMIVRRLTEFPPRSTLDPSKYGDHTSTITEAHLENKLEGLTVQQALEGNRLYILDHHDNFMPFLIRINNLEGNFIYATRTVLFLRGDGTLVPVAIELSLPELRDGLTTAKSTVYTPTSTTGAEAWVWHLAKAFANVTDYCWHQLVSHWLNTHAVMEPFIIATNRQLSVTHPVHKLLLPHYRDTMNINSNARQMLVNAGGLFETTVFPRQYAFEMSAVIYKNWNFTEQALPDDLIKRGMAVADASSPYKVKLLVEDYPYASDGLAIWHAIEQWVTEYLGIYYPNDGVLQADVELQAWWKEVREVGHADLKDEPWWPKMETVAELVKACTTIIWIASALHAAVNFGQYPYAGYIPNRPSVSRKPMPAPGSEEYAELGKNPEKVFVRTITSQFQTLVGISLLEILSSHSSDEVYLGQRDTPEWTSDAKAQEAFRRFGARLTEIESRVMTMNADPSLKNRNGPAKFPYTLLYPNTSDKNGDAAGITAKGIPNSISI

SEQ ID NO: 1653 - DNA, 2622 bp, Sorghum bicolor
  misc_feature: Ceres ANNOT ID no. 6016579
  misc_feature: Encodes the peptide sequence at SEQ ID NO 1654
atgttcgggaacattggaaagatcccggtgatcagcgacatcacgggcagcaacaagaatgcgcaccttaagggcaacgtggtgctcatgcgcaaaaccgtcctcggcttcgacgtcaccagcatggccggcgccgtcatcgacggcgtcggcgagttcctcggccgcggcgtcacctgccagctcatcagctccactgtcgtcgacccctacaacgggaaccgcgggaaggttggcgcggaggcgagcctggagcagtggctgctgcaaccgccgccgctgctgtccggcgagaacaagttcggcgtcaccttcgactgggaggtggagaagcacggcgtgccaggcgccatcatcgtcaagaacaaccacgcctccgagttcttcctcaagaccatcaccctcgacgacgtccccggccacggcaccgtcgtcttcgtcgccaactcatggatctacccgcagtccaagtaccgctacaaccgcgtcttcttctccaacgacacgtacctgcccagccagatgccggcggcgctgaagccctaccgcgacgacgagctccggaacctgaggggcgacgaccagcaggggccataccaggagcacgaccgcgtctaccgctacgacgtctacaacgacctcggcaaccccgacggcgggaacccgcgcccggtcctcggcggctccaaggaccacccctaccctcgccgcggccgcacgggccggaagccgacgctgacagaccccagcagcgagagcaggctgacgctggtcgacggcgacgtctacgtgccgcgcgacgagcggttcggccacatcaagaactccgacttctacggctacaccatcaaggcgttcgccgacggcctggtgcccatcctccaaggctacttcctcggcctcgagttcaactccttcaaggacatcctgcagctgtacgagggcgggatcaagctgcccgacatccccgcgctcgaggagttccgcaagcagttcccccttcagatggtcaaggacctcatgcccgccggcggcgactacgtcctcaaactccccatgccccaaatcatcaaagaggacaagaaagcttggatgagtgacgaggagttcgcaagggagacactcgccggcgtgaaccccctgatcatcaggcgtctgacggagtttcctccgaaaagcacccttgatccgagcaagtacggcgaccagacgagcaccatcaccgaggcgcacatcgcggggagcctggagggcctcaccgtgcaggaggcgctggacagcaaccggctctacatcctggaccaccacgaccactacatgccgttcctgatcgaggtcaacagcctggacgacaacttcatctacgccacccggacactcctgttcctgcgcggcaacggcacgctcgcgccggtggccatcgagatgagcctccccgagctcgtccgggacgtcaccgccgcgaagagcacggtgtacacgccggcgccgccgacggccgccggcgcggaggcgtgggtgtggcgcctggccaaggcctacgtcaacgtgaacgactactgctggcaccagggcgtcagccactggctcaacacgcacgccgtcatggagcccttcgtgatcgccaccaaccggcagctcagcgtgacgcaccccgtccacaggctgctgctgccgcactaccgcgacaccatgaacatcaacgcactcgctcgacagaagctcatcaacgccggcggcatcttcgagatgaccgtcttcccgcgcaagtacgccatcgagatcacctccaaagtctacgccacctggaacttcgccgaccaagccctccccgacgacctcatcaaacgaggcatggccgttccagatccgtcgagcccgtacaaggtgcggctgctgatcgaggactacccgtacgcgtctgacgggctggccgtctggcacgcgatcgagcagtgggtgacggagtacctgggcatctactaccccaacgacggcgtgctgcaggcggacgtggagctgcaggcatggtggaaggaggcgcgcgaggtcgggcacgccgacctcaaggacgagccatggtggcccaagatggagacggtggcggagctcgtcaaggcctgcaccaccatcatctggatcgcgtcggcgctccacgccgccgtcaacttcgggcagtacccgtactgcgggtaccacccgaaccggccgtcggtgagccggcggccgatgccggtgccaggcaccgacgagtacgcggagctggaggagaacccggagaagttcttcttgcgctccatcaccacgcagttccaggccgtcgtcggcatctcgctgctcgagatcctgtccagccactcctccgacgaggtgtacctcggccagcgcgacaccaaggagtggacgtcggacgccaaggcgcaggaggcgttcaggcggttcggggcgcggctggtcgagatcgagaaacgcgtggaggccatgaacaaggacccacgctacaagaaccgctacagcgaggcccagttcccctacacgctgctcttccccaacacctccgacaagaagggcgacaacgccggcgtcaccgccaagggcatacccaacagcatctccatctga

SEQ ID NO: 1654 - protein, 873 aa, Sorghum bicolor
  misc_feature: Ceres ANNOT ID no. 6016579
  misc_feature (176)..(851): Pfam Id: Lipoxygenase Pfam Desc: Lipoxygenase
  misc_feature (58)..(164): Pfam Id: PLAT Pfam Desc: PLAT/LH2 domain
  misc_feature (1)..(873): NCBI GI: 84626283 NCBI Desc: lipoxygenase [zea mays]
  misc_feature (1)..(873): NCBI GI: 8515851 NCBI Desc: lipoxygenase [zea mays]
  misc_feature (10)..(873): NCBI GI: 73920226 NCBI Desc: lipoxygenase 2 (lipoxygenase l-2)
  misc_feature (10)..(873): NCBI GI: 20267 NCBI Desc: lipoxygenase; lipoxygenase l-2 [oryza sativa (japonica cultivar-group)]
  misc_feature (10)..(873): NCBI GI: 18481649 NCBI Desc: lipoxygenase [zea mays]
  misc_feature (10)..(873): SWISSPROT Homolog: EC 1.13.11.12 Lipoxygenase 2
  misc_feature: Useful for making plants with altered Lignin content
  misc_feature: GREAT-hit functional homolog of the protein sequence given in SEQ ID NO 13126
  misc_feature: Useful for making plants with altered lignin content
  misc_feature: Functional homolog of the protein sequence given in SEQ ID NO 13126
MFGNIGKIPVISDITGSNKNAHLKGNVVLMRKTVLGFDVTSMAGAVIDGVGEFLGRGVTCQLISSTVVDPYNGNRGKVGAEASLEQWLLQPPPLLSGENKFGVTFDWEVEKHGVPGAIIVKNNHASEFFLKTITLDDVPGHGTVVFVANSWIYPQSKYRYNRVFFSNDTYLPSQMPAALKPYRDDELRNLRGDDQQGPYQEHDRVYRYDVYNDLGNPDGGNPRPVLGGSKDHPYPRRGRTGRKPTLTDPSSESRLTLVDGDVYVPRDERFGHIKNSDFYGYTIKAFADGLVPILQGYFLGLEFNSFKDILQLYEGGIKLPDIPALEEFRKQFPLQMVKDLMPAGGDYVLKLPMPQIIKEDKKAWMSDEEFARETLAGVNPLIIRRLTEFPPKSTLDPSKYGDQTSTITEAHIAGSLEGLTVQEALDSNRLYILDHHDHYMPFLIEVNSLDDNFIYATRTLLFLRGNGTLAPVAIEMSLPELVRDVTAAKSTVYTPAPPTAAGAEAWVWRLAKAYVNVNDYCWHQGVSHWLNTHAVMEPFVIATNRQLSVTHPVHRLLLPHYRDTMNINALARQKLINAGGIFEMTVFPRKYAIEITSKVYATWNFADQALPDDLIKRGMAVPDPSSPYKVRLLIEDYPYASDGLAVWHAIEQWVTEYLGIYYPNDGVLQADVELQAWWKEAREVGHADLKDEPWWPKMETVAELVKACTTIIWIASALHAAVNFGQYPYCGYHPNRPSVSRRPMPVPGTDEYAELEENPEKFFLRSITTQFQAVVGISLLEILSSHSSDEVYLGQRDTKEWTSDAKAQEAFRRFGARLVEIEKRVEAMNKDPRYKNRYSEAQFPYTLLFPNTSDKKGDNAGVTAKGIPNSISI

SEQ ID NO: 1655 - DNA, 489 bp, Sorghum bicolor
  misc_feature: Ceres ANNOT ID no. 6016582
  misc_feature: Encodes the peptide sequence at SEQ ID NO 1656
atgggtcggtctctccccgtggcggtagcggtcgtcgccgtggtcctcgtgtgctgctccgctctctgccgcgccgagcggctcggggccagggagtgcgaggacctggggttcaccggcctcgctctatgctccgattgcaacgcgctctccgagttcgtcaaggaccaagagctggtggaggattgccgtaaatgttgcaccgaggattcagatgattctatcagcaagctcacattttctggtgcaattattgaggtgtgcatgagaaaactggtattttatccagaagttgttggcttcctcgaagaagataaagatgacttcccttatgtggaagcccgttattcctatggttctccgccaaagctcataatgcttgacaacaagggtgaacagaaggagaccataaggatcgataactggaagcgagagcacattcggcagtttctcaaggagaaagtgaagccagtgaaattagacagctga

SEQ ID NO: 1656 - protein, 162 aa, Sorghum bicolor
  misc_feature: Ceres ANNOT ID no. 6016582
  misc_feature (81)..(157): Pfam Id: Sep15_SelM Pfam Desc: Sep15/SelM redox domain
  misc_feature (9)..(159): NCBI GI: 140070026 NCBI Desc: 15 kda selenoprotein precursor, related [medicago truncatula]
  misc_feature (11)..(158): NCBI GI: 144953871 NCBI Desc: 15 kda selenoprotein [bos taurus]
  misc_feature (11)..(158): NCBI GI: 12314088 NCBI Desc: dj604k5.1 (15 kda selenoprotein) [homo sapiens]
  misc_feature (11)..(158): NCBI GI: 42741648 NCBI Desc: 15 kda selenoprotein isoform 1 precursor [homo sapiens]
  misc_feature (11)..(158): NCBI GI: 6094261 NCBI Desc: 15 kda selenoprotein precursor
MGRSLPVAVAVVAVVLVCCSALCRAERLGARECEDLGFTGLALCSDCNALSEFVKDQELVEDCRKCCTEDSDDSISKLTFSGAIIEVCMRKLVFYPEVVGFLEEDKDDFPYVEARYSYGSPPKLIMLDNKGEQKETIRIDNWKREHIRQFLKEKVKPVKLDS

SEQ ID NO: 1657 - DNA, 699 bp, Sorghum bicolor
  misc_feature: Ceres ANNOT ID no. 6016583
  misc_feature: Encodes the peptide sequence at SEQ ID NO 1658
atggcgcgcaccgagaaactcgccggcgatggctgctccggcggcgaaggccaagtggaggtggaggtcggcatgggggtggatgggaagggggtcatagagtgccgtatatgccaggaggagggggaggaggccgctatggactcgccctgcgcctgcactggcacactcaagtttgcccacaggaaatgcatacagagatggtgcaacaagaaaggcaacattacatgtgaaatctgcaaccaggtttactccccgaattatgtcatccctccacctaaatgctgttcagatgaaatggacatggatcttaggccaaactgggttggacgaatcgatcctcacgattcccattttctagcaattgccattgcagagcagcagttgctgcaagctgaatttgatgattgtgtatctgcaaattctagtggtgtcacatgctgccggaccattgctttaattttgatgttccttttgcttgtacgccatgtaattgtcattgtgagggatgttagcatgctacaagatgcaacggtgctgttcagtgcaactcttcagtttgcgggattctttctaccttgttatgtaatagctcgttcttgctatgctttgcagcatcggagacgaagacagagtagtacagggcggctgctgctgctgctgctggacaagtgcgtacagagggaggtttctgaatag

SEQ ID NO: 1658 - protein, 232 aa, Sorghum bicolor
  misc_feature: Ceres ANNOT ID no. 6016583
  misc_feature (35)..(80): Pfam Id: zf-C3HC4 Pfam Desc: Zinc finger, C3HC4 type (RING finger)
  misc_feature (82)..(211): NCBI GI: 21952840 NCBI Desc: p0696g06.12 [oryza sativa (japonica cultivar-group)]
  misc_feature (55)..(211): NCBI GI: 57899809 NCBI Desc: zinc finger protein-like [oryza sativa (japonica cultivar-group)]
  misc_feature (34)..(213): NCBI GI: 15223693 NCBI Desc: zinc finger (c3hc4-type ring finger) family protein [arabidopsis thaliana]
  misc_feature (33)..(211): NCBI GI: 30692888 NCBI Desc: zinc finger (c3hc4-type ring finger) family protein [arabidopsis thaliana]
  misc_feature (34)..(213): NCBI GI: 7262667 NCBI Desc: contains similarity to pit1 from arabidopsis thaliana gbaf130849
MARTEKLAGDGCSGGEGQVEVEVGMGVDGKGVIECRICQEEGEEAAMDSPCACTGTLKFAHRKCIQRWCNKKGNITCEICNQVYSPNYVIPPPKCCSDEMDMDLRPNWVGRIDPHDSHFLAIAIAEQQLLQAEFDDCVSANSSGVTCCRTIALILMFLLLVRHVIVIVRDVSMLQDATVLFSATLQFAGFFLPCYVIARSCYALQHRRRRQSSTGRLLLLLLDKCVQREVSE

SEQ ID NO: 1659 - DNA, 1227 bp, Sorghum bicolor
  misc_feature: Ceres ANNOT ID no. 6016588
  misc_feature: Encodes the peptide sequence at SEQ ID NO 1660
atgggaactcgccgcggcagcggcgtgctccaccgcctcctcgccctctcgtcgctgctgctcctcgcttccggtgagatcgtcttcgaggagcgcttcgaagatggttgggagagtcggtgggtagaatccgattggaaaaggagtgaagggaaagctggaaggttcaaacacacagcggggagatactctgcagatcctgatgacaaaggaatacaaacaacaatggatgctagacattttgctatctcagccaagttcccacaattcagtaacaagaaccggacacttgtggtccagtactccattaagtttgagcaggatattgaatgtggtggtggctatattaagcttatgtctggttatgtcaaccaaaaaaaatttagtggggacactccatacagcttgatgtttgggccagatatatgtggtactcaaacaaagaagctccatcttatagtctcttaccaggggcagaactatcccatcaagaaagatctagaatgtgagacggacaagttaacacatttctacactttcattcttaggcctgatgcgtcttatagcctacttgttgacaaccgcgaaagagaaactgggagcatgtacaccgattgggatatcctccctcctcgtaaaattaaggatcttcacgccaaaaggcctaaggactgggatgacagagaatatattgaagatcctgatgaagtaaagccagagggctatgattctatcccaaaacagattcctgatccgaaggccaaaaagcctgacacgtgggatgaggacgaggatggaatatggaagcccaggatggtatcgaatccagcatacaagggaccatggaaacgcaagagaattaaaaatcctaactacaagggtaaatggaagaccccatggatcgataatccagagtttgaggatgatccagatctttatgtgctgaagcctttgaagtatattggaattgaagtttggcaggtaaaagctggttcagttttcgacaacattttgatttgtgatgaccctgagtatgcaagaaatgttgttgaggaaacttggggtgctaatagggaggctgaaaaggaggcttttgaagaagctgaaaaggagaggaaagctagggaggatagggaaggtcaaaaggcaaaggatgatggtgggcgccgaaggcctcgtaaaaaacactacagagatcactgggatgactaccatgatgagctatga

SEQ ID NO: 1660 - protein, 408 aa, Sorghum bicolor
  misc_feature: Ceres ANNOT ID no. 6016588
  misc_feature (27)..(339): Pfam Id: Calreticulin Pfam Desc: Calreticulin family
  misc_feature (12)..(408): NCBI GI: 92867898 NCBI Desc: concanavalin a-like lectin/glucanase [medicago truncatula]
  misc_feature (13)..(408): NCBI GI: 2052383 NCBI Desc: calreticulin
  misc_feature (59)..(408): NCBI GI: 115464783 NCBI Desc: os05g0507300 [oryza sativa (japonica cultivar-group)]
  misc_feature (13)..(377): NCBI GI: 33517365 NCBI Desc: calreticulin 3 [brassica rapa subsp. pekinensis]
  misc_feature (12)..(379): NCBI GI: 117165712 NCBI Desc: calreticulin-1 [glycine max]
MGTRRGSGVLHRLLALSSLLLLASGEIVFEERFEDGWESRWVESDWKRSEGKAGRFKHTAGRYSADPDDKGIQTTMDARHFAISAKFPQFSNKNRTLVVQYSIKFEQDIECGGGYIKLMSGYVNQKKFSGDTPYSLMFGPDICGTQTKKLHLIVSYQGQNYPIKKDLECETDKLTHFYTFILRPDASYSLLVDNRERETGSMYTDWDILPPRKIKDLHAKRPKDWDDREYIEDPDEVKPEGYDSIPKQIPDPKAKKPDTWDEDEDGIWKPRMVSNPAYKGPWKRKRIKNPNYKGKWKTPWIDNPEFEDDPDLYVLKPLKYIGIEVWQVKAGSVFDNILICDDPEYARNVVEETWGANREAEKEAFEEAEKERKAREDREGQKAKDDGGRRRPRKKHYRDHWDDYHDEL

SEQ ID NO: 1661 - DNA, 822 bp, Sorghum bicolor
  misc_feature: Ceres ANNOT ID no. 6016589
  misc_feature: Encodes the peptide sequence at SEQ ID NO 1662
atggggaaaccgctgatctacgagattctggagaagccggcgagcagcagcgtcatcggcatctgctccctgatctggtggctcatccagaagcggggcatcgggtacgcggacgtcgggctgagctacgaggccgccgtggacggcgggcagtactggcggatcatcacctccgccttctcgcacatcagcgtggtccacctggtgttcaacatgagcgcgctgtggagcctcggcgtcgtcgagcagctggggcagatcgggctcggcgtcgagtactacctgcactacacgctcgttctcgtcgtgctgtccggattgctggtcctcgggttctaccacatgatgattcagaggttcaaggtggagtacttcaggagggtcactgcggttggctactcatgcgttgtgtttggctggatgacaatcctggctgccaagcaaccgtcgtcaaagctgaatatttttggggttctttcactgcccatcagctttgcgccattcgagtcgctgatattcacatcaatcatggtgccacaggctagtttcatcggccacttgtcggggataattgttgggtactcaattgcctggggtctgattcatgggatgaacaactactgggcaatcacaatgcttggctggattgcacttgtatttgtcttgagcttgaagcgtacaggatctatggagttgagtttcattgagatcgagccagtgacagatccctcgctgccttctgttggtgtggttgctcccagaaatggtagaactctacaaatggatgtcttgcctggaagaagagttgcagacattgtataa

SEQ ID NO: 1662 - protein, 273 aa, Sorghum bicolor
  misc_feature: Ceres ANNOT ID no. 6016589
  misc_feature (46)..(205): Pfam Id: Rhomboid Pfam Desc: Rhomboid family
  misc_feature (19)..(273): NCBI GI: 21952847 NCBI Desc: p0696g06.19 [oryza sativa (japonica cultivar-group)]
  misc_feature (51)..(201): NCBI GI: 121917995 NCBI Desc: clan s-, family s54, rhomboid-like serine peptidase [trichomonas vaginalis g3]
  misc_feature (9)..(194): NCBI GI: 3738201 NCBI Desc: spcc790.03 [schizosaccharomyces pombe]
  misc_feature (50)..(193): NCBI GI: 51258484 NCBI Desc: mgc84665 protein [xenopus laevis]
  misc_feature (48)..(193): NCBI GI: 62858293 NCBI Desc: loc549203 [xenopus tropicalis]
MGKPLIYEILEKPASSSVIGICSLIWWLIQKRGIGYADVGLSYEAAVDGGQYWRIITSAFSHISVVHLVFNMSALWSLGVVEQLGQIGLGVEYYLHYTLVLVVLSGLLVLGFYHMMIQRFKVEYFRRVTAVGYSCVVFGWMTILAAKQPSSKLNIFGVLSLPISFAPFESLIFTSIMVPQASFIGHLSGIIVGYSIAWGLIHGMNNYWAITMLGWIALVFVLSLKRTGSMELSFIEIEPVTDPSLPSVGVVAPRNGRTLQMDVLPGRRVADIV

SEQ ID NO: 1663 - DNA, 1314 bp, Sorghum bicolor
  misc_feature: Ceres ANNOT ID no. 6016592
  misc_feature: Encodes the peptide sequence at SEQ ID NO 1664
atggctagaaccatgagagcacgagcacccaaacacttggtccggcaatgcacgccacgccctctcttctcggtcttcctcatcgcgctctgcttcgccgcttcgaacctgccctccgcgagctcagcggactcgtgcagcaacggcctcagcctcggcagcctcgtccccttcaacaccaccggcctcacctgcttccaagcatggccgtcgcaggacttcgtcctaaggttcggcaaggcggcggcgccggggagcaacgcgtggagcttcgtgctgtcggcgccggacaacggcgggtacgtctccatcggcttctcgcccacggggcggatggtggggagcagcgccgtggccgggtgggtgacggccgccggcgcgggctccgcgaggcagtactacctcggcgggacgacctccaggtcgtgcccgccggaccagggcaagctgacgctcgcgagcgcgaccgtcgtgtccaaggggtcccggctctacctcgcgttccagctcgacgggcagccgctcaccaacgtcgtctacgccgtcggccctagcgccaccttgcccgggtcgaacgggctgctgccgcagcaccaggacatggcggccggcaccatcagcctgtccggcggcaccagtggcggcggcagccctgctaccggcggcggtgacgacgacgacgacgatggcagagagggcggcgaaggaaagggcaagggaaacggtgacggtggcgacgaagatggtgaccaggggaagggcgagaggcgcacgtccccagcctcagcatccagcagctcgggcgccagcggcggcggcggcgccttcctgagcgcagcgcggcggcacggcttgctcgcgctcatcagctggggcgtgctggtcccggcgggcgtggcgctggcgcgcttcttcaagcggttcgacccgttctggttctacgcgcacgtcgtcgcgcaaggcctcgggttcctgctcggcgcgctggccgtcgtcgccggtttcaggctcgacgacgacgagcgcgcccccgtcgccacccacaagggcatcggcgtcgccgtcgtcgtctgcgcctgcctgcaggtgatggcggtgctggcgaggccggccaaggagaccaaggcgaggaggtactggaactggtaccaccacagcgtgggcagggcggccgtcgtgctcggcgtcgccaacgtcttctacggcctctcgttggccaacgaacggcaggagtggagctacgtgtatggcgttttcatcggggtcttcgcggtggtttgtcttgtgctcgaggaatggagacgtaggcattga

SEQ ID NO: 1664 - protein, 437 aa, Sorghum bicolor
  misc_feature: Ceres ANNOT ID no. 6016592
  misc_feature (24)..(437): NCBI GI: 115441589 NCBI Desc: os01g0895200 [oryza sativa (japonica cultivar-group)]
  misc_feature (35)..(437): NCBI GI: 21952844 NCBI Desc: p0696g06.16 [oryza sativa (japonica cultivar-group)]
  misc_feature (2)..(238): NCBI GI: 21952847 NCBI Desc: p0696g06.19 [oryza sativa (japonica cultivar-group)]
  misc_feature (27)..(271): NCBI GI: 57899802 NCBI Desc: membrane protein-like [oryza sativa (japonica cultivar-group)]
  misc_feature (27)..(271): NCBI GI: 115441571 NCBI Desc: os01g0893700 [oryza sativa (japonica cultivar-group)]
MARTMRARAPKHLVRQCTPRPLFSVFLIALCFAASNLPSASSADSCSNGLSLGSLVPFNTTGLTCFQAWPSQDFVLRFGKAAAPGSNAWSFVLSAPDNGGYVSIGFSPTGRMVGSSAVAGWVTAAGAGSARQYYLGGTTSRSCPPDQGKLTLASATVVSKGSRLYLAFQLDGQPLTNVVYAVGPSATLPGSNGLLPQHQDMAAGTISLSGGTSGGGSPATGGGDDDDDDGREGGEGKGKGNGDGGDEDGDQGKGERRTSPASASSSSGASGGGGAFLSAARRHGLLALISWGVLVPAGVALARFFKRFDPFWFYAHVVAQGLGFLLGALAVVAGFRLDDDERAPVATHKGIGVAVVVCACLQVMAVLARPAKETKARRYWNWYHHSVGRAAVVLGVANVFYGLSLANERQEWSYVYGVFIGVFAVVCLVLEEWRRRH

SEQ ID NO: 1665 - DNA, 951 bp, Sorghum bicolor
  misc_feature: Ceres ANNOT ID no. 6016593
  misc_feature: Encodes the peptide sequence at SEQ ID NO 1666
atggagattagggctcagccaacgagcctgaggctcgcgccgccgcccgcctccgccagcttccgccggacccctctgaggacctccttccttaagggaaacgtgtcacttaaagttgtgcaagtacgacaatcaaatgtcaacagatttaagtgcaatagcatacgaagtaacctctttgaaagactaacaagggttgtcaggtcctacgcaaattcagttctaagttcgtttgaagatcctgagaagattctagagcaggcagttctggagatgaatgatgacttgacaaagatgaggcaggccactgcacaggtcttggcgtctcaaaagcggcttgagaataaatacaaagctgcagaacaagcttctgctgattggtatcggagggctcagcttgctcttcaaaagggtgacgaggatcttgctcgcgaagccctcaagcggcgtaaatcatatgctgataatgcgagctccttaaggtcccagcttgatcaacagaagggtgtagttgaaaatctgatttcgaataccaaggttcttgagagcaagatagcagaggccaagcagaaaaaggataccctaaaagctcgtgctcaatcagcgaagactgccacaaaagtgagtgaaatgttgggcaacgtgaatacaagtagtgccctttctgcgtttgagaaaatggaggaaaaagttatggcgatggaatcccaagcagaggcacttggccagttagcaactgatgatctagaaggaaagtttgcactgctcgagacttcatctgttgatgatgatctttcacaactgaaaaaggaattgtctggaagctctttgaaaggagagcttccaccaggaagagcagcagtcagcaactcaggtgctgggcgccctttccccgacctagagatcgagagcgagctaaacgagctgcggaggaaggccaaagaatattag

SEQ ID NO: 1666 - protein, 316 aa, Sorghum bicolor
  misc_feature: Ceres ANNOT ID no. 6016593
  misc_feature (58)..(274): Pfam Id: PspA_IM30 Pfam Desc: PspA/IM30 family
  misc_feature (1)..(316): NCBI GI: 44888076 NCBI Desc: probable membrane-associated 30 kda protein, chloroplast precursor
  misc_feature (6)..(315): NCBI GI: 729842 NCBI Desc: membrane-associated 30 kda protein, chloroplast precursor (m30)
  misc_feature (1)..(316): NCBI GI: 140049664 NCBI Desc: pspa/im30; prefoldin [medicago truncatula]
  misc_feature (19)..(314): NCBI GI: 51558001 NCBI Desc: chloroplast vesicle-inducing protein in plastids 1 [chlamydomonas reinhardtii]
  misc_feature (59)..(309): NCBI GI: 81299605 NCBI Desc: membrane-associated 30 kd protein-like [synechococcus elongatus pcc 7942]
  misc_feature: The sequence is a functional homolog of SEQ ID NO. 459 in the 11/188,298 US application
MEIRAQPTSLRLAPPPASASFRRTPLRTSFLKGNVSLKVVQVRQSNVNRFKCNSIRSNLFERLTRVVRSYANSVLSSFEDPEKILEQAVLEMNDDLTKMRQATAQVLASQKRLENKYKAAEQASADWYRRAQLALQKGDEDLAREALKRRKSYADNASSLRSQLDQQKGVVENLISNTKVLESKIAEAKQKKDTLKARAQSAKTATKVSEMLGNVNTSSALSAFEKMEEKVMAMESQAEALGQLATDDLEGKFALLETSSVDDDLSQLKKELSGSSLKGELPPGRAAVSNSGAGRPFPDLEIESELNELRRKAKEY

SEQ ID NO: 1667 - DNA, 870 bp, Sorghum bicolor
  misc_feature: Ceres ANNOT ID no. 6016603
  misc_feature: Encodes the peptide sequence at SEQ ID NO 1668
atgggtggttttgtgaagacccagaagaccaatgcgtacttcaagcgtttccaagtgaagttcaagagaaggcgcgctggtaagacagactacagggccaggataaggctcatcaaccaggacaaaaacaagtacaacacacccaaatacagatttgttgtgcgattcaccaacaaggacatcactgcacaaatcatctctgctagtatagcgggtgatatggttcttgcttctgcctactcacatgagttgccacgatatggtcttgaagttggtctgaccaactatgcagctgcctactgcactggtcttctgttggctcgccgtgtgctcaagatccgtggtttggatcaggagtatgagggcaatgttgaggccactggtgaggacttctctgttgagccagctgatgagaggaggcctttccgtgctctgttggatgttggccttatcaggactacaacagggaaccgtgtctttggtgccctcaagggagctttggatggtggcctggatattcctcacagtgagaagaggtttgctgggtttaagaaggatgacaagcagctggatgctgatattcaccgcaagtacatctatggtggccacgttgctgactacatgaagaaccttgctgaggaggagccagagaagtaccagtctcacttcagtgattacattaagaagggaattgaggctgaggacatggaaggtctgtacaagaaggtccatgcggccatccggctgatccatctgtggtacaacccaaagaagctcacatatgagcagaggaaggctagcctcgtccaaaggctcaaccaactcaactcctctggtggtgccgatgatgatgatgaggatgacgagtaa

SEQ ID NO: 1668 - protein, 289 aa, Sorghum bicolor
  misc_feature: Ceres ANNOT ID no. 6016603
  misc_feature (27)..(173): Pfam Id: Ribosomal_L18p Pfam Desc: Ribosomal L18p/L5e family
  misc_feature (1)..(289): NCBI GI: 71153169 NCBI Desc: 60s ribosomal protein l5-1
  misc_feature (2)..(289): NCBI GI: 55976534 NCBI Desc: 60s ribosomal protein l5-2
  misc_feature (4)..(289): NCBI GI: 34484312 NCBI Desc: 60s ribosomal protein l5 [cucumis sativus]
  misc_feature (4)..(289): NCBI GI: 30984512 NCBI Desc: at5g39740 [arabidopsis thaliana]
  misc_feature (4)..(281): NCBI GI: 61654618 NCBI Desc: l5 [suberites domuncula]
MGGFVKTQKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADIHRKYIYGGHVADYMKNLAEEEPEKYQSHFSDYIKKGIEAEDMEGLYKKVHAAIRLIHLWYNPKKLTYEQRKASLVQRLNQLNSSGGADDDDEDDE

SEQ ID NO: 1669 - DNA, 879 bp, Sorghum bicolor
  misc_feature: Ceres ANNOT ID no. 6016607
  misc_feature: Encodes the peptide sequence at SEQ ID NO 1670
atggagacgcggcggccccggcgcggcgggaagaagcgcttcctcctcccgctcgcgctcctctgcctcgccgtgctgctccccggcgcgctgctcccgccgtccgcctcggcgtcatcctcgtcgccggccgtgggaggtggcagcaggaagcggcggtgggtggggtttgactactatgtactggcgctgcaatggccgggcaccatctgccgcgagaccagcaactgctgcgacaccaatggctgctgccgatcgaagcctctcaagtggttcacgattcatggtctctggccacagtacaattatgggggctggccatcatgctgcagaccaaccaaattcaacataaataagatattaatgctgatgccaatacttgagaagtactggccatccttgtactgcggttcttcttcaacctgctttggtggaaggggtccattttgggtgcatgaggatgaatatgactacttctccacagcactgtatctctacagcaaatacaatgttacgaaagctctgagaaaagcgcatattcggcctgcaagcggcagaaaatacgccgttggccatattgttgctgtcattgaatacgcgtttggggcaatgccgtcacttgtctgtaagaacggctcagttcaagaactcaggctctgcttccacaaggattatcagcctcgtgattgcacgcttgagactggcactgcaccgaacagcagaagctactgccctcgctacgtcacgttcccgtcgtataaaccgtctgtgatggccaatactacggaggggatcagtaaccaagcgtcgaagccaatggtgagctacacgagtacgtctgcctctgagcagcgtctaggactccaggttctgaaatga

SEQ ID NO: 1670 - protein, 292 aa, Sorghum bicolor
  misc_feature: Ceres ANNOT ID no. 6016607
  misc_feature (57)..(235): Pfam Id: Ribonuclease_T2 Pfam Desc: Ribonuclease T2 family
  misc_feature (118)..(276): NCBI GI: 115441615 NCBI Desc: os01g0897300 [oryza sativa (japonica cultivar-group)]
  misc_feature (13)..(269): NCBI GI: 15149819 NCBI Desc: s-like rnase 28 [antirrhinum mollissimum]
  misc_feature (13)..(269): NCBI GI: 21615405 NCBI Desc: s-like rnase [antirrhinum majus x antirrhinum hispanicum]
  misc_feature (57)..(255): NCBI GI: 2642160 NCBI Desc: s-like ribonuclease rns2 [arabidopsis thaliana]
  misc_feature (14)..(262): NCBI GI: 31621000 NCBI Desc: ribonuclease ngr2 [nicotiana glutinosa]
METRRPRRGGKKRFLLPLALLCLAVLLPGALLPPSASASSSSPAVGGGSRKRRWVGFDYYVLALQWPGTICRETSNCCDTNGCCRSKPLKWFTIHGLWPQYNYGGWPSCCRPTKFNINKILMLMPILEKYWPSLYCGSSSTCFGGRGPFWVHEDEYDYFSTALYLYSKYNVTKALRKAHIRPASGRKYAVGHIVAVIEYAFGAMPSLVCKNGSVQELRLCFHKDYQPRDCTLETGTAPNSRSYCPRYVTFPSYKPSVMANTTEGISNQASKPMVSYTSTSASEQRLGLQVLK

SEQ ID NO: 1671 - DNA, 1242 bp, Sorghum bicolor
  misc_feature: Ceres ANNOT ID no. 6016625
  misc_feature: Encodes the peptide sequence at SEQ ID NO 1672
atggaaaataatcatgcatgtccaccaccgagcaagggaaacctgatcacaatattgagtatcgatggtggtggggttaagggtatcatccctggtaccttccttgcattccttgagtctaaacttcaggagcttgatgggagcaacgcacgcatagctaactactttgatgtcatcgctggcacaagcacaggtggtcttattactgctatgctagcagcaccatcactgaacaatgctaagcaaccatgctatgaggccaaggatattgtgccattctacctcaaacatagtcctcgcatctttccatgcagaactggaattttgggctggttcttcaagatcctgcaaataattaagatgataattgggccaaaatatgatggaaagtacctgcacaaaatgaccaatgatttgctgggcgatacgagattgaaagaaacattgacaaatgttgttgttcctacttttgatgttaagtgcgtaaagccaacaatattcagcacattcaaggcgagatctgataccttgatgaatgctcgtcttggtgatgtgtgtattggcacatctgcagcaccaacagttctccccgcacactattttgaaactgtggattatcacactggttcatcacgtagcttcaacattattgatgggggtctcgctgcaaacaatccgactttggtggcaatgggtgagataacagaacagatcagacagaagagcaaggaattccctgagaccaagcccttggactatcatagatatctggtagtatcgttaggcacaggtcttccagagcaagacatcaaatttgatgcgtgtcgtgttgccaagtggggcatttttggatggtttggccgggagaataccatgcctttgctgcaaatgttcttacatgctagctcagacatgactgatagttatgttgcggaccttttcaaagcaattgggtgctcagaccaactgctgcgtattcaggaccgcaacataccaataggggctgtgccagccgacctctcaacggagaagaatcttcaagggctggttaagattggagaaaaccttctgcataagccactaagcaaggatgattataagatcaactacatcgagacagtgccgaaagatagccgtgctctaacctatgctggtatgctcacacagtttgcaaagctcctttctgatgagaggaagcttaggcttcagaacatggaactggatgacggtagcaaatcctga

SEQ ID NO: 1672 - protein, 413 aa, Sorghum bicolor
  misc_feature: Ceres ANNOT ID no. 6016625
  misc_feature (19)..(231): Pfam Id: Patatin Pfam Desc: Patatin-like phospholipase
  misc_feature (9)..(401): NCBI GI: 62766606 NCBI Desc: patatin-like protein [gossypium hirsutum]
  misc_feature (9)..(401): NCBI GI: 9794868 NCBI Desc: patatin-like protein 1 [nicotiana tabacum]
  misc_feature (8)..(405): NCBI GI: 4539677 NCBI Desc: patatin-like protein [sorghum bicolor]
  misc_feature (6)..(401): NCBI GI: 4006871 NCBI Desc: patatin-like protein [arabidopsis thaliana]
  misc_feature (8)..(405): NCBI GI: 4539676 NCBI Desc: patatin-like protein [sorghum bicolor]
  misc_feature: Useful for making plants with modulated heat sensitivity
  misc_feature: Functional homolog of the protein sequence given in SEQ ID NO 13256
MENNHACPPPSKGNLITILSIDGGGVKGIIPGTFLAFLESKLQELDGSNARIANYFDVIAGTSTGGLITAMLAAPSLNNAKQPCYEAKDIVPFYLKHSPRIFPCRTGILGWFFKILQIIKMIIGPKYDGKYLHKMTNDLLGDTRLKETLTNVVVPTFDVKCVKPTIFSTFKARSDTLMNARLGDVCIGTSAAPTVLPAHYFETVDYHTGSSRSFNIIDGGLAANNPTLVAMGEITEQIRQKSKEFPETKPLDYHRYLVVSLGTGLPEQDIKFDACRVAKWGIFGWFGRENTMPLLQMFLHASSDMTDSYVADLFKAIGCSDQLLRIQDRNIPIGAVPADLSTEKNLQGLVKIGENLLHKPLSKDDYKINYIETVPKDSRALTYAGMLTQFAKLLSDERKLRLQNMELDDGSKS

SEQ ID NO: 1673 - DNA, 1407 bp, Sorghum bicolor
  misc_feature: Ceres ANNOT ID no. 6016643
  misc_feature: Encodes the peptide sequence at SEQ ID NO 1674
atggcttcctctgctctgatccacccgcgctgcactctgcacaagatcaggagccccggacgccgtcccgaaccgtcccgcgcaagcttcgcggctgccgccacagctaacgaggccgccgtatcgccgtccatctccgcgagggcggggtctggggcgagggcgagcgcgagcgcgtcggttgcctcggcagcgaggacgacgacgagcgcgcggaggagcaggacggcatcggtcgcaaccatgtggaggcaggtccaggggtcccacgactgggacggcctgctccagccgctgcaccccgtggtgcgcgacgaggtggcgcgctacggcgagctcgtcggcgcctgctacaaggtgctcgacgtcgacccgtcgtcggcgcggtacatgtgctgcaaccacgccaaggagcgcgtgctcgaggaggccggcgtggccggggcagggtacgaggtgacgcgctacatctacgcaacgccggacgtggccgtggccggcggtccgtccactagcggccgcggccgcggccgcgccagctgggtcgggtacgtcgccgtgtccaccgacgagatgacccggcggctcggcaggcgcgacgtcctcgtctcgctgcgcggaacggtgacgcaggcagagtgggctgccaacctcatgagcgcgctcgagccggcgcgcctcgacgcgcgacaggacgtcaaggtcgaggccggctttctcaacctctacacctcctcgcccggcggcggcggcggcggcatggggagctgccgagaccagctcctccgcgaggtgtcccgcgtcatcaagtctttctccaaggacaggccccgtgaggacatgagcgtcacactggccgggcacagcatggggagcgccctggcgatgctgctcggttacgacctctgccagctcggcctcaaccgcgacgcgtcagggcgccgcgtccccgtcaccgtcttctccttcggcgggccgagggtggggaacgcggccttcaaggaccgctgcgacgagctcggcgtgaaggtgctgcgcgtcgcgaacgtccgcgatccggtgaccatgctcccgggcgccatcttcaacgagggcacgagagggctcctcgcctcctgggccgccggtgaccgctacacgcacgtcggcgtggagctcgccctcgacttcctcagcctccgagacctggggagcgttcatgacctcggcgcgtacgtatcgtcgatcaaggccgaagccggtggcaaggtgcccaagtctgacaatgcggcgacggaaagcagaggagccgccgttctcgcgaagaaggcgatggagttcgtcgggagtcagcgcgccgccgcgtttgcatggccagaggctgtcctcggcattggcggcgtcgtgcagtctctcggcttgatctga

SEQ ID NO: 1674 - protein, 468 aa, Sorghum bicolor
  misc_feature: Ceres ANNOT ID no. 6016643
  misc_feature (202)..(362): Pfam Id: Lipase_3 Pfam Desc: Lipase (class 3)
  misc_feature (25)..(468): NCBI GI: 115441651 NCBI Desc: os01g0900400 [oryza sativa (japonica cultivar-group)]
  misc_feature (35)..(449): NCBI GI: 6850308 NCBI Desc: contains similarity to a lipase-like protein from ipomoea nil gbu55867 and contains a lipase pf01764 domain. [arabidopsis thaliana]
  misc_feature (67)..(441): NCBI GI: 124360696 NCBI Desc: peptidase s26a, signal peptidase i; esterase/lipase/thioesterase; lipase, class 3 [medicago truncatula]
  misc_feature (25)..(404): NCBI GI: 27363430 NCBI Desc: at1g06800/f4h5_10 [arabidopsis thaliana]
  misc_feature (45)..(404): NCBI GI: 30684625 NCBI Desc: lipase class 3 family protein [arabidopsis thaliana]
MASSALIHPRCTLHKIRSPGRRPEPSRASFAAAATANEAAVSPSISARAGSGARASASASVASAARTTTSARRSRTASVATMWRQVQGSHDWDGLLQPLHPVVRDEVARYGELVGACYKVLDVDPSSARYMCCNHAKERVLEEAGVAGAGYEVTRYIYATPDVAVAGGPSTSGRGRGRASWVGYVAVSTDEMTRRLGRRDVLVSLRGTVTQAEWAANLMSALEPARLDARQDVKVEAGFLNLYTSSPGGGGGGMGSCRDQLLREVSRVIKSFSKDRPREDMSVTLAGHSMGSALAMLLGYDLCQLGLNRDASGRRVPVTVFSFGGPRVGNAAFKDRCDELGVKVLRVANVRDPVTMLPGAIFNEGTRGLLASWAAGDRYTHVGVELALDFLSLRDLGSVHDLGAYVSSIKAEAGGKVPKSDNAATESRGAAVLAKKAMEFVGSQRAAAFAWPEAVLGIGGVVQSLGLI

SEQ ID NO: 1675 - DNA, 1365 bp, Sorghum bicolor
  misc_feature: Ceres ANNOT ID no. 6016645
  misc_feature: Encodes the peptide sequence at SEQ ID NO 1676
atgacttcctctgccatgatccaaccgcgctgcaccctgcaccaggccaggagcacccggcgccctgaaccgtcccgcgcaagcttcgccgctgccgccacagttaacgaggccgcctcatcgccgtccatctccgcgagggcgagtgcgcgggttacctcagcagcgaggaggacgagcacgacggcatcatctgtcgcaaccatgtggaggcaggtccaggggtcccacgactgggacggcctgctccagccgctgcaccccgtggttcgcgacgaggtggcgcgctacggcgagctcgtcggcgcctgctacaaggtgatggacgtcgacccgtcgtcggcgcggtacatgtgctgcaaccacgccaaggagcgcgtcctcgaggaggccggcgtggctgaggcagggtacgaggtgacgcgctacatctacgcaacgccggacgtggccgtggccggcggtccgtccactagcggccgcggccgcggccgcgccagctgggtcgggtacgtcgctgtgtccaccgacgagatgacccggcggctcggcaggcgcgacgtcctcgtctcgctgcgcggaacggtgacgcaggcagagtgggcggccaacctcatgagcgcgctcgagccggcgcgcctcgacgcgcgacaggacgtcaaggtcgaggccggcttcctcaacctgtacacctcctcgcccggcggcggcggcggcggcatggggagctgccgagaccagctcctccgcgaggtgtcccgcgtcatcaagtctttctccaaggacaggccccgtgaggacatgagcgtcaccctggctgggcacagcatgggaagcgccctggcgatgctgctcggctacgacctctcccagctcggcctcaaccgcgacgcgtcagggcgccgcgtccccgtcaccgtcttctccttcggcgggccgagagtagggaacgcggccttcaaggaccgctgcgacgagctcggcgtgaaggtgctgcgcgccgcgaacgtccgcgatccggtgaccatgctcccgggcgccctcttcaacgagggcacgagagggttcctcgcttcctgggccgccggcgacagctacacgcacgtcggcgtggagctcgccctcgacttccttagcctccgcgacctggggagcgttcatgacctcggcgcgtacgtatcgtcgatcaaggccggagcctgtggcaaggtgtccaagtccgacaatgcggtggcggacagcagaggcgccgccgtcctcgcgaaggcgatggagttcgtcgggattcagcgcgccgccgcgttcgcattgccagacgccgctctcggcattggcggcgtggtgcaatctctcggtttgatctga

SEQ ID NO: 1676 - protein, 454 aa, Sorghum bicolor
  misc_feature: Ceres ANNOT ID no. 6016645
  misc_feature (189)..(349): Pfam Id: Lipase_3 Pfam Desc: Lipase (class 3)
  misc_feature (38)..(454): NCBI GI: 115441651 NCBI Desc: os01g0900400 [oryza sativa (japonica cultivar-group)]
  misc_feature (25)..(409): NCBI GI: 6850308 NCBI Desc: contains similarity to a lipase-like protein from ipomoea nil gbu55867 and contains a lipase pf01764 domain. [arabidopsis thaliana]
  misc_feature (41)..(427): NCBI GI: 124360696 NCBI Desc: peptidase s26a, signal peptidase i; esterase/lipase/thioesterase; lipase, class 3 [medicago truncatula]
  misc_feature (14)..(391): NCBI GI: 27363430 NCBI Desc: at1g06800/f4h5_10 [arabidopsis thaliana]
  misc_feature (70)..(391): NCBI GI: 30684625 NCBI Desc: lipase class 3 family protein [arabidopsis thaliana]
MTSSAMIQPRCTLHQARSTRRPEPSRASFAAAATVNEAASSPSISARASARVTSAARRTSTTASSVATMWRQVQGSHDWDGLLQPLHPVVRDEVARYGELVGACYKVMDVDPSSARYMCCNHAKERVLEEAGVAEAGYEVTRYIYATPDVAVAGGPSTSGRGRGRASWVGYVAVSTDEMTRRLGRRDVLVSLRGTVTQAEWAANLMSALEPARLDARQDVKVEAGFLNLYTSSPGGGGGGMGSCRDQLLREVSRVIKSFSKDRPREDMSVTLAGHSMGSALAMLLGYDLSQLGLNRDASGRRVPVTVFSFGGPRVGNAAFKDRCDELGVKVLRAANVRDPVTMLPGALFNEGTRGFLASWAAGDSYTHVGVELALDFLSLRDLGSVHDLGAYVSSIKAGACGKVSKSDNAVADSRGAAVLAKAMEFVGIQRAAAFALPDAALGIGGVVQSLGLI

SEQ ID NO: 1677 - DNA, 2409 bp, Sorghum bicolor
  misc_feature: Ceres ANNOT ID no. 6016648
  misc_feature: Encodes the peptide sequence at SEQ ID NO 1678
atggaagcaatggaggctgaagaaggtccttttctggctaatgatgccaagttgcacgcaggaatctgtagagcatttcatccttctgtatctaagctttccgccattttcccctttatcgaagcatcaagacccagaagcaagtctggtatacaggcattgtgttcactacatgtagctcttgataaagccaaagggcttctacaacattgtgcagactgcagcaggctctatttggccatcacttcggaaactgtgcttttaaagtttgagaagtctagaagccagcttcaggagagtctaaggcggactggaagcatagtaacggaagatatcggctgtaagattgtggagattgttggtgagctggaggaaattgtttttacattggatagatcagagaaggaagctggtgacgagcttatcaatttgctccagagaaacaataaaacaaatggttccagtgatagtggcgagcttgaggtcttccatatgtctgctcttaaattgggaattacatcttctagggcagcactcacggagagaagagcccttaagaagctaattgagaaggctcgttctgatgaagacaagcggaaggagcttgttgtgtcatacttgtacaatctcatgaggaagtactcaaagttcttcagaagtgagactggtgatgatacagattctcagggatcgtctccatgctcaccaacagtattaggtatggatgatatgtatgggccgtacagcaatggtcgggcattcagtagacagctttcgagcattcagtcgttcaattcgaggtttggatctttcaattctaggcttggatcattcaattgcagacgtggtggtggtccaaggtctgagaatatgtcaatccctcctgaagagcttaggtgccctatttccttacaactgatgtatgatccagtcatcatttcatctgggcagacttatgagcgtatttgcattgagaaatggttcaatgatggtcacagcacatgtcctaaaacacagcagcaacttgcccacctgtcattgactccaaactactgtgttaaggccttgattgccagctggtgtgagcagaacgaatttccagttcctgatggtccaccaggaactttcgatgtaaattggaggcttgctttctctgacactgaggctacaggttgtgtgtctgttgaaagttttgattgtaccaatgcaaagagtgtcaagattgtcccaatggagaatgttagaaaggaggagccagcaaacagtgaatcgggaacgctggatgacagctcttgtaacgatttcgagttgaacgagggctatgggaacttgctgctcttgcttcatgaaagaagtaacatgaacaagcagtgcaggttggtggagcagataaggtatcttttgaaagatgacgaggaagcaaggatccagctgggctcgaatggttttgccgaggcactggttgagttcttgaggaatgctgtgaatgatggaaatgagaaggcacaagaagttggtgcaatggctcttttcaatcttgcagtcaacaataacagaaacaagggactcctgttatctgctggagtcgccaatctacttgagcagatgatatcaaatccacgcctatctggtcctgctacagcactctaccttaatctttcctgccttcctgatgcaaaggccatcatcggttcgagccaggccgtgccattcctagtcgaccgtctgtatagccaagatgccagcgacacaaaaggcagctcctgcaagcatgacgccctgtacacactgtacaacctctcaaaccaccaggccagcgtcccggcgcttctagctgcaggcattgtggatgctctccattgcctcgtcacggaatctccagagtcggaggggcttggttggacagagaaggctctcgcagtgctcatcagcctcgcggccacccaagctggcaggaaggagatcatgtccacccctggtttggtcagcacgctagcgacgctgctagacacaggtgagccgacagagcaggagcaggcagtgtcgtgcctcctggtgatgtgcagcgccgacgacaagtgcatcccgccagtgctccaggaaggggtggtcccatcgctggtctccatctcggcggccgggacagggaggggcagggagaaggcccagaagctcctgaagttgttcagggaacagaggcagcgggacgcgccgctgccccagcagccccagcaccagcagcagcagctgctgcagagccagctggtggagggcgggaacggcggtggcggtggcgctatcgtgtgccaccgggaatcgaagccgctgtgcaagtccaagtccaggaagctgggcaggacgctgagctcgctgtggaagaacaggggcttctcgctgtaccagtgctag

SEQ ID NO: 1678 - protein, 802 aa, Sorghum bicolor
  misc_feature: Ceres ANNOT ID no. 6016648
  misc_feature (295)..(367): Pfam Id: U-box Pfam Desc: U-box domain
  misc_feature (1)..(761): NCBI GI: 20161603 NCBI Desc: b1065g12.5 [oryza sativa (japonica cultivar-group)]
  misc_feature (229)..(793): NCBI GI: 42562301 NCBI Desc: armadillo/beta-catenin repeat family protein / u-box domain-containing family protein [arabidopsis thaliana]
  misc_feature (1)..(796): NCBI GI: 38347439 NCBI Desc: osjnba0076n16.3 [oryza sativa (japonica cultivar-group)]
  misc_feature (294)..(731): NCBI GI: 14149112 NCBI Desc: bg55 [bruguiera gymnorrhiza]
  misc_feature (1)..(238): NCBI GI: 41053097 NCBI Desc: armadillo repeat containing protein-like [oryza sativa (japonica cultivar-group)]
  misc_feature: The sequence is a functional homolog of SEQ ID NO. 309 in the 11/188,298 US application
  misc_feature: The sequence is a functional homolog of SEQ ID NO. 528 in the 11/188,298 US application
  misc_feature: The sequence is a functional homolog of SEQ ID NO. 308 in the 11/188,298 US application
MEAMEAEEGPFLANDAKLHAGICRAFHPSVSKLSAIFPFIEASRPRSKSGIQALCSLHVALDKAKGLLQHCADCSRLYLAITSETVLLKFEKSRSQLQESLRRTGSIVTEDIGCKIVEIVGELEEIVFTLDRSEKEAGDELINLLQRNNKTNGSSDSGELEVFHMSALKLGITSSRAALTERRALKKLIEKARSDEDKRKELVVSYLYNLMRKYSKFFRSETGDDTDSQGSSPCSPTVLGMDDMYGPYSNGRAFSRQLSSIQSFNSRFGSFNSRLGSFNCRRGGGPRSENMSIPPEELRCPISLQLMYDPVIISSGQTYERICIEKWFNDGHSTCPKTQQQLAHLSLTPNYCVKALIASWCEQNEFPVPDGPPGTFDVNWRLAFSDTEATGCVSVESFDCTNAKSVKIVPMENVRKEEPANSESGTLDDSSCNDFELNEGYGNLLLLLHERSNMNKQCRLVEQIRYLLKDDEEARIQLGSNGFAEALVEFLRNAVNDGNEKAQEVGAMALFNLAVNNNRNKGLLLSAGVANLLEQMISNPRLSGPATALYLNLSCLPDAKAIIGSSQAVPFLVDRLYSQDASDTKGSSCKHDALYTLYNLSNHQASVPALLAAGIVDALHCLVTESPESEGLGWTEKALAVLISLAATQAGRKEIMSTPGLVSTLATLLDTGEPTEQEQAVSCLLVMCSADDKCIPPVLQEGVVPSLVSISAAGTGRGREKAQKLLKLFREQRQRDAPLPQQPQHQQQQLLQSQLVEGGNGGGGGAIVCHRESKPLCKSKSRKLGRTLSSLWKNRGFSLYQC

SEQ ID NO: 1679 - DNA, 1605 bp, Sorghum bicolor
  misc_feature: Ceres ANNOT ID no. 6016657
  misc_feature: Encodes the peptide sequence at SEQ ID NO 1680
atggccgagccgtgcccgcccggtgggatcgacccgcgcagcggcttctgcgccgcgacgcggaccttccacagcctgcgcccgtccaccgagctcccgccggactcgctcccggccaccgcggccgcctacgccttctccagcctctcgtccccgctccccgaccgccccgccctcgtcgacgccgccaccggcattgccgtctcctacccctccttcctcgccgccgtccgctccctcgcggggggcctctggtccgtcctcggccttcgccccggggacgtcgccctcgtcgtctccccttcccgcatcgacgtccccgtcatagacttcgcgctcatgtccatcggcgctgtcgtctcgcctgccaacccggcgtccaccgccgacgagtacgcgcacatggtcgcgctctccagaccggtcgtcgcgctcgcggcccccgaggtggccgctaagctgccgaggaacctcaggtgtgtcgtcatcggctcggatgagtacaagggcctctcctccgccggcggcgcggcgcctcccccgccggtggcggtgaagcagtccgacacggcggccgtgctgtactcgtcgggcactacgggccgggtcaaggccgccgcggtctcgcaccgcaacctcatcgccctgctctgcgcgcacagggacatccgggctatggtggacaaggaggctgccgaggccggcgaggagccgcccccgcctacggtgacgctgttccctctcccgctcttccacgtgttcggcttcatgatgatgctgaggtccgtggccatgggggagaccgccgtcctcatggaccgcttcgacttcgtcgccgcgctgcgcgccatcgagcggtaccgagtcaccctgctgcccgcggcgcccccggtgctggtggccatgatcaagtccgaggaggcgcgccgccgcgacctctcctccctcatcgtcatcgggatcggcggcgcgccactcggccgcgaggtcgccgagcgcttcgccgccatcttccccaacatcgaactcgtccagggctacggtctgacggagtcatctggctccgtggcttcgacggtcgggccagatgagtgcaaagcgtacggttcggtcgggaagctggcatcgcacttggaggcgaagatcgtcgatccctccaccggttatgtgggtgacgacgaggctactgcagcaacagttgattcagaaggctggttgaaaactggtgacctatgctacttcaatgaggatgggtttctctacattgttgatcggttgaaagagttgataaaatacaagggatatcaggtacctccagccgaactggagcatatcctgaattctcatcctgatatcatggatgcagcagttattccgtacccagacgaagatgtcgggcaactaccaatggcttttatagtgaggaaaccaggctcaaaccttaccaagcaacaagtcatggatttcgtggctaaacaggtcgcaccgtacaagaaagtccgtcgagtggcctttgtttctgcaattcccaaatcgcctgctgggaagatcttgcggcgggagcttgtagagcaggccgtgtccatggttacctccaagctttga

SEQ ID NO: 1680 - protein, 534 aa, Sorghum bicolor
  misc_feature: Ceres ANNOT ID no. 6016657
  misc_feature (69)..(457): Pfam Id: AMP-binding Pfam Desc: AMP-binding enzyme
  misc_feature (10)..(388): NCBI GI: 29888154 NCBI Desc: 4-coumarate-coa ligase-like protein [arabidopsis thaliana]
  misc_feature (10)..(388): NCBI GI: 36312839 NCBI Desc: 4-coumarate coa ligase isoform 4 [arabidopsis thaliana]
  misc_feature (1)..(525): NCBI GI: 140056579 NCBI Desc: amp-dependent synthetase and ligase [medicago truncatula]
  misc_feature (10)..(417): NCBI GI: 29893225 NCBI Desc: 4-coumarate-coa ligase-like protein [arabidopsis thaliana]
  misc_feature (10)..(390): NCBI GI: 15217956 NCBI Desc: 4-coumarate--coa ligase family protein / 4-coumaroyl-coa synthase family protein [arabidopsis thaliana]
  misc_feature: Useful for making plants with altered cell wall content and/or composition
  misc_feature: GREAT-hit functional homolog of the protein sequence encoded by LOCUS at5g63380
MAEPCPPGGIDPRSGFCAATRTFHSLRPSTELPPDSLPATAAAYAFSSLSSPLPDRPALVDAATGIAVSYPSFLAAVRSLAGGLWSVLGLRPGDVALVVSPSRIDVPVIDFALMSIGAVVSPANPASTADEYAHMVALSRPVVALAAPEVAAKLPRNLRCVVIGSDEYKGLSSAGGAAPPPPVAVKQSDTAAVLYSSGTTGRVKAAAVSHRNLIALLCAHRDIRAMVDKEAAEAGEEPPPPTVTLFPLPLFHVFGFMMMLRSVAMGETAVLMDRFDFVAALRAIERYRVTLLPAAPPVLVAMIKSEEARRRDLSSLIVIGIGGAPLGREVAERFAAIFPNIELVQGYGLTESSGSVASTVGPDECKAYGSVGKLASHLEAKIVDPSTGYVGDDEATAATVDSEGWLKTGDLCYFNEDGFLYIVDRLKELIKYKGYQVPPAELEHILNSHPDIMDAAVIPYPDEDVGQLPMAFIVRKPGSNLTKQQVMDFVAKQVAPYKKVRRVAFVSAIPKSPAGKILRRELVEQAVSMVTSKL

SEQ ID NO: 1681 - DNA, 1740 bp, Sorghum bicolor
  misc_feature: Ceres ANNOT ID no. 6016683
  misc_feature: Encodes the peptide sequence at SEQ ID NO 1682
atggccctgaccgacgccaccgcgttcccctacggcctgcgcgtcctcgtcgtcgacgacgacccaacttggctcaagatcctcgagaagatgctccgcaagtgttcctacgaagtcaccacatgcggtttagcaagcgttgctctccaaattctccgagagaggagaaacaagtttgacattgtaatcagtgacgtcaacatgcctgacatggatggtttcaagcttctcgaactcattggacttgagatggatctacccgtcataatgatgtccatagacggagagacgagtagagtgatgaaaggtgtccagcatggtgcttgtgactatctcctcaagcctgttcggatgaaggaacttcgaaacatttggcaacatgtgtataggaagaaaatgcatgaggtgaaagagattgaaggtaatgacagctgtgatgatctccaaatatttagaaatggtgtggagggatttgacgagaggggcctatttatgagagctgactctgataccatgaggaagagaaaagacatggataaggaccatgcagatcaggactcaagtgatggagctactgttaagaaggctagagttgtctggtctgttgaccttcaccagaagtttgtaaatgctgtcaaccaaattggatttgacaaagttgggccgaagaaaatactggaccttatgagtgttcctggcctgacaagagagaatgtggctagccatcttcagaaatatcgcctctacttgagtaggttgcaaaagcagaacgaggaaaggataatgggtgctgctaggcaagatttcagtcacaagggaccatcagataatcttaacctccgaagttccttcgaagagcaaccaggcaacctttccaatggatttcagcatagttctcagaagatccaagctcagaccaacattcccgatcctcatctggacgacacgaagacttctgtgcccttgaaggtgccagataaaaatggaacttcagtaagtgatgctgttgatcctcagaatatcaccagtgcttcacctttaagtggggtattctcttttgaaagaatgccagtgaatcaggacaggaagttatcagagaccatgattttggaatgtcagtcctggagtggaagtgtgccaccaaagcagttcatgcagtatccaaagcataaccatgagcgctgcgacctgctaggagactattcttgcttgcccaaaccggacttagagcacccaattgcccctggtcatctgtatgccccagcaccagtaatatcgatggtggagggagatgccagaaacttctcagatgtaaaaccagatcttattgcctgtatgaagtccttatcaccagcactgacttgtacagttgagtcagtttctgctcaacttagtgacagtgctgtgacctcaactaacagtgaccagaagttttccagtgtggaggggttgtccagcattaaagattgtgactttgatcaggaaaggaaccaagccactttgcttacttcagaagaggcaagtataatatgcggcactgatttgacttggctacatgatgacctgtccggctatcaaggtgtctccttcagcaatataggactgaatagcatcgatttatttcaatgcaatgatacaatgggggcactacctggactacagaataactggtatgatgatatagagttgagcagtgaaactatggagatccaattgctagacggaggcctgtttgcataa

SEQ ID NO: 1682 - protein, 579 aa, Sorghum bicolor
  misc_feature: Ceres ANNOT ID no. 6016683
  misc_feature (13)..(126): Pfam Id: Response_reg Pfam Desc: Response regulator receiver domain
  misc_feature (197)..(247): Pfam Id: Myb_DNA-binding Pfam Desc: Myb-like DNA-binding domain
  misc_feature (5)..(579): NCBI GI: 118790785 NCBI Desc: tpa: response regulator [oryza sativa (japonica cultivar-group)]
  misc_feature (229)..(579): NCBI GI: 115441691 NCBI Desc: os01g0904700 [oryza sativa (japonica cultivar-group)]
  misc_feature (9)..(578): NCBI GI: 92877542 NCBI Desc: response regulator, rega/prra/actr type [medicago truncatula]
  misc_feature (10)..(373): NCBI GI: 31711702 NCBI Desc: at1g67710 [arabidopsis thaliana]
  misc_feature (10)..(373): NCBI GI: 7576358 NCBI Desc: response regulator 11 [arabidopsis thaliana]
  misc_feature: The sequence is a functional homolog of SEQ ID NO 1232 in the 10/666,642US patent application
  misc_feature: The sequence is a functional homolog of SEQ ID NO 1233 in the 10/666,642US patent application
  misc_feature: The sequence is a functional homolog of SEQ ID NO 1452 in the 11/479,226US patent application
  misc_feature: The sequence is a functional homolog of SEQ ID NO 148 in the 10/225,066US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 2512 in the 10/374,780US patent application
  misc_feature: The sequence is a functional homolog of SEQ ID NO 688 in the 10/412,699US patent application
  misc_feature: The sequence is a functional homolog of SEQ ID NO 932 in the 10/666,642US patent application
  misc_feature: The sequence is a functional homolog of SEQ ID NO 933 in the 10/666,642US patent application
  misc_feature: The sequence is a functional homolog of SEQ ID NO 934 in the 10/666,642US patent application
  misc_feature: The sequence is a functional homolog of SEQ ID NO 935 in the 10/666,642US patent application
  misc_feature: The sequence is a functional homolog of SEQ ID NO 936 in the 10/666,642US patent application
  misc_feature: The sequence is a functional homolog of SEQ ID NO 937 in the 10/666,642US patent application
  misc_feature: Useful for making plants with modulated growth and phenotype characteristics
  misc_feature: The sequence is a functional homolog of SEQ ID NO 688 in the 20040045049 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1232 in the 20070033671 US patent application
  misc_feature: The sequence is a functional homolog of SEQ ID NO 1233 in the 20070033671 US patent application
  misc_feature: The sequence is a functional homolog of SEQ ID NO 932 in the 20070033671 US patent application
  misc_feature: The sequence is a functional homolog of SEQ ID NO 933 in the 20070033671 US patent application
  misc_feature: The sequence is a functional homolog of SEQ ID NO 934 in the 20070033671 US patent application
  misc_feature: The sequence is a functional homolog of SEQ ID NO 935 in the 20070033671 US patent application
  misc_feature: The sequence is a functional homolog of SEQ ID NO 936 in the 20070033671 US patent application
  misc_feature: The sequence is a functional homolog of SEQ ID NO 937 in the 20070033671 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature: Useful for making plants with altered lignin content
  misc_feature: Functional homolog of the protein sequence given in SEQ ID NO 13182
  misc_feature: The sequence is a functional homolog of SEQ ID NO 936 in the 10/666,642 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: The sequence is a functional homolog of SEQ ID NO. 378 in the 11/188,298 US application
MALTDATAFPYGLRVLVVDDDPTWLKILEKMLRKCSYEVTTCGLASVALQILRERRNKFDIVISDVNMPDMDGFKLLELIGLEMDLPVIMMSIDGETSRVMKGVQHGACDYLLKPVRMKELRNIWQHVYRKKMHEVKEIEGNDSCDDLQIFRNGVEGFDERGLFMRADSDTMRKRKDMDKDHADQDSSDGATVKKARVVWSVDLHQKFVNAVNQIGFDKVGPKKILDLMSVPGLTRENVASHLQKYRLYLSRLQKQNEERIMGAARQDFSHKGPSDNLNLRSSFEEQPGNLSNGFQHSSQKIQAQTNIPDPHLDDTKTSVPLKVPDKNGTSVSDAVDPQNITSASPLSGVFSFERMPVNQDRKLSETMILECQSWSGSVPPKQFMQYPKHNHERCDLLGDYSCLPKPDLEHPIAPGHLYAPAPVISMVEGDARNFSDVKPDLIACMKSLSPALTCTVESVSAQLSDSAVTSTNSDQKFSSVEGLSSIKDCDFDQERNQATLLTSEEASIICGTDLTWLHDDLSGYQGVSFSNIGLNSIDLFQCNDTMGALPGLQNNWYDDIELSSETMEIQLLDGGLFA

SEQ ID NO: 1683 - DNA, 1554 bp, Sorghum bicolor
  misc_feature: Ceres ANNOT ID no. 6016693
  misc_feature: Encodes the peptide sequence at SEQ ID NO 1684
atggcggcgatggaagccgccgccgacgctatgctcgccgccgcaagccgcgccttcacgagcaccttcgccatcgccattcagatccaggggtgctgtatctgtttagttcttgctcttgggtgggcggctgcttcaatcgtcagaaaaagggttataaagaacatgaggcggaacattgtagatggaaatagttttgcttttctttgtgacaacatagatgagcttgagcactctgttcaggagaatttacctagagtctctgtaattatgcctttgaagggctttggcgaacataatttgcaaaattggcgaactcagattacatcactttatggggggccactagaattcctgtttatcgtagagagcaaagacgatccagcttatcatgctgtttcccgtttgatcgcagagtacaaggaccatctagaggcgaaggtggttgtggctgggttgtcaacaacctgtagccagaaaattcacaatcaattgattggtgttaaaaagatgcacaaggataccaagtatgtcttgtttcttgacgatgatgtgaggctgcatcctgggactatcagagctctcacaaaagaaatggagaagaatcctgagatatttatacaaactggatatccccttgacttaccttctggcagtttgggcagctattgcatatatgaataccacatgccttgctcgatgggatttgcaactggtgggaagactttcttcttgtggggtggctgtatgatgatgcatgctgatgattttaggcaagaccgatatggtgttgtcagtggattaagagatggtggttactcagatgatatgacactcgctgcaatagcaggacagcacaaaaggctcatatcttcacctcctgttgctgtgtttccacaccctcttgccagtgatcttagcttctccagatactggaattacctcaggaaacaaacttttgttcttgagtcatatgtatcgaatgtcaactggatgatgaaccgtgcattatttacaagtcattgttatctgtcatgggggtttgtctggccatatattatggctttggtccatgttttagctgctcttcgagcaccgtacagcgaagttgtaaaggaagcgtccgattcatcttggggattgttcctagtgagcctcttgttcatatgcactctcaccgagcttgtttcaatgtggaatttgaccaaggtggaaattcaactgtgcaatatgctgtctcctgaaggaccgaaagtatctcttgattcatacaattgggggcttgtgttcattgctgtgttggtagacaatttcctctatccagtatctgcattcagatcacatttctcccaatcaatcaattggtctggtatccgatactacttgagagatgggaaaataagcaagatcgaaagagagaacagttcaaagtacactgatcttggagggaagcatctatatggcaagaggacatacccttctaataaatcattgcttggttacctgtcaagaactctagtgcaatggcatcagccaaagaaatatgacgtatag

SEQ ID NO: 1684 - protein, 517 aa, Sorghum bicolor
  misc_feature: Ceres ANNOT ID no. 6016693
  misc_feature (1)..(517): NCBI GI: 14718995 NCBI Desc: ceramide glucosyltransferase [gossypium arboreum]
  misc_feature (1)..(517): NCBI GI: 15983422 NCBI Desc: at2g19880/f6f22.9 [arabidopsis thaliana]
  misc_feature (435)..(517): NCBI GI: 115441703 NCBI Desc: os01g0906000 [oryza sativa (japonica cultivar-group)]
  misc_feature (80)..(331): NCBI GI: 116223683 NCBI Desc: glycosyl transferase, family 2 [solibacter usitatus ellin6076]
  misc_feature (82)..(306): NCBI GI: 119513459 NCBI Desc: glycosyl transferase, family 2 [nodularia spumigena ccy9414]
MAAMEAAADAMLAAASRAFTSTFAIAIQIQGCCICLVLALGWAAASIVRKRVIKNMRRNIVDGNSFAFLCDNIDELEHSVQENLPRVSVIMPLKGFGEHNLQNWRTQITSLYGGPLEFLFIVESKDDPAYHAVSRLIAEYKDHLEAKVVVAGLSTTCSQKIHNQLIGVKKMHKDTKYVLFLDDDVRLHPGTIRALTKEMEKNPEIFIQTGYPLDLPSGSLGSYCIYEYHMPCSMGFATGGKTFFLWGGCMMMHADDFRQDRYGVVSGLRDGGYSDDMTLAAIAGQHKRLISSPPVAVFPHPLASDLSFSRYWNYLRKQTFVLESYVSNVNWMMNRALFTSHCYLSWGFVWPYIMALVHVLAALRAPYSEVVKEASDSSWGLFLVSLLFICTLTELVSMWNLTKVEIQLCNMLSPEGPKVSLDSYNWGLVFIAVLVDNFLYPVSAFRSHFSQSINWSGIRYYLRDGKISKIERENSSKYTDLGGKHLYGKRTYPSNKSLLGYLSRTLVQWHQPKKYDV

SEQ ID NO: 1685 - DNA, 1854 bp, Sorghum bicolor
  misc_feature: Ceres ANNOT ID no. 6016694
  misc_feature: Encodes the peptide sequence at SEQ ID NO 1686
atgctcgccgacctcaacttcgaaccggcggagagcgatggcgaggaccgcccaccgacccccacacccaaccccgccgccaccgccgccgtggccgttgccgcggctccggcggtcaccactgactccttcacgaggagtggcaatgaggagggtggtttgatgaaaaatgtgattgctacaaaggacaccgatactgttgaatgtgaagatgctgatcaacattgtcaaggtgcttctgctccacgtgaggaaaaagttagcaacctgaaagctgctttggttcatgtggcccgaaaaatgcctaagaatgctcatgcacattttatgttgggtttaatgtatcaaaggcttggtcaggcacagaaggcaatagcatcatatgagaagtcaactgaaatactgctacaagatgaagaagaagtgcggaggcctgatttactctcatcagtgaggatacaccacgcacagtgcattttgcaagcaagcatgggggatagttttgacgaagagcttgaaactggtgaggtagatgacattcttgccaagttgaagagttcagttgagtcagatcacaggcaagcagctgtttggaatatcctaggtttagttcttcttcggggtggtcaaatacaggtatgccgtgtctgcgaagaactacttgctgattttttgcaccctatccagagtgctatctcagttctatcttctctcacggctgttgctccagactacttggactcccttgcgaatcttggtgtcgcatacattcaaagtggggatctagagatgtctgcaaagtgcttccaagaacttcttctaaaagatcaaaaccacccagctgctctggtgaactatgcagttcttcttctctgtagatatgggtctttgtctgcaggggcagggggcaatgtcagcacaggtccttacctgcatcagaaagaagccttagttgttgcaaaagagtgcttacttgcagcagtgaaggctgatcctagagccgcatcagtttgggttaatcttgcaaatgcatattatatggatggtgagcataggaactcaaagaggtgcttggagcaggcagcaaaattggaacccaatcatatgcctgctcggtatgctattgcagttcaccgtatcagagatgctgtaaggtcacaatgttctgatgatcaacttctttgggctgcaaatgagatggcaacagttctaaaagaaggagacccttctgcagttgatgccccaattgcatgggctgggttggcaatggctcacagggcacaacatgaaattgcagcagcctacgataacgaaaacatcaatcttaatgatgcagaagagcgagctcaatatacactaaaacaggcaatccaagaggacccagatgatgccgttcagtggcatcaacttggcctgtacaatatttgcatgaccaggttcagcaggtctgtaaattttcttaaagcagctttagcccgttccccagattgcagttatgcttggtcgaatcttggtatcgcattgcaactatcagatgatccatcctctgaaactgtatataagcgggcactgctaaaatcatcaactcagcagctgcacgcaatcttctcgaatcttggaattctttatcggcagcataggaactatgaatttgcaaggaagatgttattaaggtcgttggaattgtgtcctggatatgcaccagccagcaataacctgggccttgtatttgtcgctgagggccgttgggaggatgctagaagctgttttgagaaagctctgcaatctgatcccctacttgatgcggccaaatcgaacttgtcaaaagtccttgcattgtctaagaaacagtag

SEQ ID NO: 1686 - protein, 617 aa, Sorghum bicolor
  misc_feature: Ceres ANNOT ID no. 6016694
  misc_feature (105)..(138): Pfam Id: TPR_2 Pfam Desc: Tetratricopeptide repeat
  misc_feature (246)..(279): Pfam Id: TPR_2 Pfam Desc: Tetratricopeptide repeat
  misc_feature (335)..(368): Pfam Id: TPR_2 Pfam Desc: Tetratricopeptide repeat
  misc_feature (567)..(600): Pfam Id: TPR_2 Pfam Desc: Tetratricopeptide repeat
  misc_feature (105)..(138): Pfam Id: TPR_1 Pfam Desc: Tetratricopeptide repeat
  misc_feature (335)..(368): Pfam Id: TPR_1 Pfam Desc: Tetratricopeptide repeat
  misc_feature (567)..(600): Pfam Id: TPR_1 Pfam Desc: Tetratricopeptide repeat
  misc_feature (1)..(617): NCBI GI: 20804879 NCBI Desc: p0497a05.3 [oryza sativa (japonica cultivar-group)]
  misc_feature (94)..(615): NCBI GI: 27764942 NCBI Desc: at5g63200/mdc12_17 [arabidopsis thaliana]
  misc_feature (225)..(617): NCBI GI: 89297032 NCBI Desc: tpr domain containing protein [tetrahymena thermophila sb210]
  misc_feature (327)..(614): NCBI GI: 72397241 NCBI Desc: tpr repeat [methanosarcina barkeri str. fusaro]
  misc_feature (319)..(613): NCBI GI: 113474349 NCBI Desc: tpr repeat [trichodesmium erythraeum ims101]
MLADLNFEPAESDGEDRPPTPTPNPAATAAVAVAAAPAVTTDSFTRSGNEEGGLMKNVIATKDTDTVECEDADQHCQGASAPREEKVSNLKAALVHVARKMPKNAHAHFMLGLMYQRLGQAQKAIASYEKSTEILLQDEEEVRRPDLLSSVRIHHAQCILQASMGDSFDEELETGEVDDILAKLKSSVESDHRQAAVWNILGLVLLRGGQIQVCRVCEELLADFLHPIQSAISVLSSLTAVAPDYLDSLANLGVAYIQSGDLEMSAKCFQELLLKDQNHPAALVNYAVLLLCRYGSLSAGAGGNVSTGPYLHQKEALVVAKECLLAAVKADPRAASVWVNLANAYYMDGEHRNSKRCLEQAAKLEPNHMPARYAIAVHRIRDAVRSQCSDDQLLWAANEMATVLKEGDPSAVDAPIAWAGLAMAHRAQHEIAAAYDNENINLNDAEERAQYTLKQAIQEDPDDAVQWHQLGLYNICMTRFSRSVNFLKAALARSPDCSYAWSNLGIALQLSDDPSSETVYKRALLKSSTQQLHAIFSNLGILYRQHRNYEFARKMLLRSLELCPGYAPASNNLGLVFVAEGRWEDARSCFEKALQSDPLLDAAKSNLSKVLALSKKQ

SEQ ID NO: 1687 - DNA, 930 bp, Sorghum bicolor
  misc_feature: Ceres ANNOT ID no. 6016697
  misc_feature: Encodes the peptide sequence at SEQ ID NO 1688
atgtcgtcagcggcggggcataaggagcggagccgggtgctggttataggcggcacgggctacatcggccggttcatcgtcgccgccagcgcccgcgagggccatcccacgtacgtcctcgtccgcgaccccgcgcccgccgaccctgccaaggccgccgtcctccaggggttccgggacgccggcgtcaccctcgtcaagggggatctgtacaaccatgagagcttggtggtggcaatggaatcggcagatgttgtgatctcggcggtgggttatgcacagctgccagatcaaacccgcattatctcagccataaaagatgctggaaacataaagagattctttccatcagagtttgggaatgatgtagatcatgtgcatgcggttgaacctgcaaaatcggtgtttgctgccaaagctagtataaggcgtgccgtagaggccgaggggatcccctacacgtatatatcctccaacttctttgctggtcgtttcttgccagctattggacagattggggttacaggccttccaatagataaggttctcatattaggtgatggaaatgtgaaagaagaggatgttggcacctacacaataaaagctgtagatgatccaagaaccctgaataagatcctatatctgaggccaccaagcaacatcttatctcacaatgagcttatctcactctgggagaagaaagttgggaagacatttgaaagggtgtacattccagaagacgatgtcttgaagaagattcaagagtctccaattccattgaacagagcgctgtcaatcagccattctgcgtgggtgaagggggaccacaccaactttgagattgaccctttctttggagttgaagccactgacctttaccctgatgtcaagtacactaccgtggatgaatacctgaacaagttcctttga

SEQ ID NO: 1688 - protein, 309 aa, Sorghum bicolor
  misc_feature: Ceres ANNOT ID no. 6016697
  misc_feature (13)..(300): Pfam Id: NmrA Pfam Desc: NmrA-like family
  misc_feature (13)..(207): Pfam Id: Epimerase Pfam Desc: NAD dependent epimerase/dehydratase family
  misc_feature (9)..(309): NCBI GI: 76559894 NCBI Desc: tpa: isoflavone reductase-like protein 5 [vitis vinifera]
  misc_feature (10)..(309): NCBI GI: 3243234 NCBI Desc: isoflavone reductase related protein [pyrus communis]
  misc_feature (9)..(309): NCBI GI: 76559896 NCBI Desc: tpa: isoflavone reductase-like protein 6 [vitis vinifera]
  misc_feature (10)..(309): NCBI GI: 10764491 NCBI Desc: allergenic isoflavone reductase-like protein bet v 6.0102 [betula pendula]
  misc_feature (10)..(309): NCBI GI: 6573171 NCBI Desc: isoflavone reductase homolog 2 [glycine max]
  misc_feature (10)..(309): SWISSPROT Homolog: EC 1.3.1.45 Isoflavone reductase
MSSAAGHKERSRVLVIGGTGYIGRFIVAASAREGHPTYVLVRDPAPADPAKAAVLQGFRDAGVTLVKGDLYNHESLVVAMESADVVISAVGYAQLPDQTRIISAIKDAGNIKRFFPSEFGNDVDHVHAVEPAKSVFAAKASIRRAVEAEGIPYTYISSNFFAGRFLPAIGQIGVTGLPIDKVLILGDGNVKEEDVGTYTIKAVDDPRTLNKILYLRPPSNILSHNELISLWEKKVGKTFERVYIPEDDVLKKIQESPIPLNRALSISHSAWVKGDHTNFEIDPFFGVEATDLYPDVKYTTVDEYLNKFL

SEQ ID NO: 1689 - DNA, 1083 bp, Sorghum bicolor
  misc_feature: Ceres ANNOT ID no. 6016703
  misc_feature: Encodes the peptide sequence at SEQ ID NO 1690
atggcgagctcgccgcgatctcctccgccggcgcctacgccggaattcgagatctctcggcagtcccgtctctttgcggcgttgtccaagaaggtgatagatctcgatgaactgaggatgctggcggctcagggagtcccagacgccgcgggcgtccgggcaactgtgtggaagctgctactgggctatctgcccaatgaccgctcgctgtgggagcaggagctggcaaagaagagagcacagtacgctgctttcaaagatgagttccttagaaaccctgtagaaatatcgcgacaggtgcaaacagaaggccaccacaacgtaaatgaagagcatgttgacaatgggttcctgcacaggtcagaggtaacaagagaggagcaccctttaagccttgggaagaccagtgcttggaatcagttttttgagattgaccgtgatgtaaagcgcacccaccctgacatgcatttcttctgtggcgattcatcttttgcaaagtccaatcaggaatctttgaaaaatgtactgttaatctttgccaagctgaatgctggaataagatatgtacaagggatgaatgaaattttggcaccgctcttctttgtatttcggagtgatccggatgataaaaatgctaaatttgcggaagcggattcattcttttgcttcgttgagctgcttagtgggtttagagacaacttctgccagaaactagacaacagtgctgttggcattcgaggtacactagccaagttatcacagcttgtagcaacgtatgatggagaactccaacatcatttggaagtaactacagaagttaatccccagttctatgcattcagatggataacgttactgctgacccaggaattcaactttgccgacatcattcacatttgggacacactattaagtgatcccgatggcccccaggaaaccttgctcagaatatgctgtgcgatgctgatccttgtccggaagcgcctcttggccggcgatttcacctccaacctcaagctcctgcagaattacccgccaacgaacatcagccacctcctctacgtcgccaacaagttgcagtga

SEQ ID NO: 1690 - protein, 360 aa, Sorghum bicolor
  misc_feature: Ceres ANNOT ID no. 6016703
  misc_feature (96)..(332): Pfam Id: TBC Pfam Desc: TBC domain
  misc_feature (1)..(359): NCBI GI: 56785363 NCBI Desc: rabgap/tbc domain-containing protein-like [oryza sativa (japonica cultivar-group)]
  misc_feature (2)..(360): NCBI GI: 140059084 NCBI Desc: rabgap/tbc [medicago truncatula]
  misc_feature (12)..(360): NCBI GI: 92892994 NCBI Desc: rabgap/tbc [medicago truncatula]
  misc_feature (2)..(360): NCBI GI: 116634829 NCBI Desc: osigba0135c09.4 [oryza sativa (indica cultivar-group)]
  misc_feature (143)..(311): NCBI GI: 20804889 NCBI Desc: p0497a05.14 [oryza sativa (japonica cultivar-group)]
MASSPRSPPPAPTPEFEISRQSRLFAALSKKVIDLDELRMLAAQGVPDAAGVRATVWKLLLGYLPNDRSLWEQELAKKRAQYAAFKDEFLRNPVEISRQVQTEGHHNVNEEHVDNGFLHRSEVTREEHPLSLGKTSAWNQFFEIDRDVKRTHPDMHFFCGDSSFAKSNQESLKNVLLIFAKLNAGIRYVQGMNEILAPLFFVFRSDPDDKNAKFAEADSFFCFVELLSGFRDNFCQKLDNSAVGIRGTLAKLSQLVATYDGELQHHLEVTTEVNPQFYAFRWITLLLTQEFNFADIIHIWDTLLSDPDGPQETLLRICCAMLILVRKRLLAGDFTSNLKLLQNYPPTNISHLLYVANKLQ

SEQ ID NO: 1691 - DNA, 1041 bp, Sorghum bicolor
  misc_feature: Ceres ANNOT ID no. 6016705
  misc_feature: Encodes the peptide sequence at SEQ ID NO 1692
atgtgcgaggcaccgcgactcggctaccgcgccgccggcgccggcgacgcggacgccgctgacgtcgacgtcgtcaccaccggcggacgccggaggatccccgcgcattcctctgttctggcctcggcgtcgccggtgctcgggagcatcctggagcggcgcctccagaaggacagggagagcggcaagcccggcaggtccgtcgtccggatccgcggcgtcaccgacgacgccgcggccgccttcgtccgcctcctctacgccggcaggtgcggcgacggcggcgaggaggaggaggaggatgacgccatggagaagcacgcggtgcaggtgctggtgctggcgcacgcgtaccaggtgccgtggctgaagcgtgcgtgcgagggcgccatcggcgcgcgcctcaccgcggactcggtggtggacgtgctgcagctggccgacctctgcgacgcgccgcgcctgcacctccgctgcaccaggctgctggccaaggagttcgccgccgtcgagcgcaccgaggcctggcgcttcctgcaggagaacgacccctggcaggagctccacgtcctgcagcgcctgcacgaggccgacatgcggcggcgcaagtggcggcggaagcgcgcggagcagcgcgtgtacgtggagctgagcgaggccatggactgccttgaccacatctgcacggagggctgcacggaggtcggcccggcgaggcgggcgccggcgccggcgccgtgcgcgcgctacgccacgtgccggggcctgcagctgctcatccgccacttctcccagtgccaccgcaagagctgcgcgcggtgccagcgcatgtggcagctgctccgcctccactccgcgctctgcgaccgccccgaccgctgcaacaccccgaggtttaagcagaaggagcaggagaaggtggctgccaaggccggcgatgacgacgacaaatgggggcttctggtgaagaaggtgaaggctgccagggtcttctcttctctagccaacaggaagcagacgagcacctccacccagtgctga

SEQ ID NO: 1692 - protein, 346 aa, Sorghum bicolor
  misc_feature: Ceres ANNOT ID no. 6016705
  misc_feature (14)..(135): Pfam Id: BTB Pfam Desc: BTB/POZ domain
  misc_feature (17)..(335): NCBI GI: 90265067 NCBI Desc: h0510a06.17 [oryza sativa (indica cultivar-group)]
  misc_feature (17)..(335): NCBI GI: 38345257 NCBI Desc: osjnbb0011n17.18 [oryza sativa (japonica cultivar-group)]
  misc_feature (17)..(335): NCBI GI: 115459034 NCBI Desc: os04g0482300 [oryza sativa (japonica cultivar-group)]
  misc_feature (17)..(335): NCBI GI: 116309937 NCBI Desc: h0525d09.9 [oryza sativa (indica cultivar-group)]
  misc_feature (20)..(329): NCBI GI: 92866951 NCBI Desc: zinc finger, taz-type; btb/poz [medicago truncatula]
MCEAPRLGYRAAGAGDADAADVDVVTTGGRRRIPAHSSVLASASPVLGSILERRLQKDRESGKPGRSVVRIRGVTDDAAAAFVRLLYAGRCGDGGEEEEEDDAMEKHAVQVLVLAHAYQVPWLKRACEGAIGARLTADSVVDVLQLADLCDAPRLHLRCTRLLAKEFAAVERTEAWRFLQENDPWQELHVLQRLHEADMRRRKWRRKRAEQRVYVELSEAMDCLDHICTEGCTEVGPARRAPAPAPCARYATCRGLQLLIRHFSQCHRKSCARCQRMWQLLRLHSALCDRPDRCNTPRFKQKEQEKVAAKAGDDDDKWGLLVKKVKAARVFSSLANRKQTSTSTQC

SEQ ID NO: 1693 - DNA, 1332 bp, Sorghum bicolor
  misc_feature: Ceres ANNOT ID no. 6016707
  misc_feature: Encodes the peptide sequence at SEQ ID NO 1694
atgaggccgcacggggcggggacgggcggcggtggcgtggggaggcggaaggttggggccgccgctgctgcggcgagccgggagtggatggtggtgccggcgtcgggcccggcgcgggtggaggaagccgggaagcacgcggtgatggcgcgtacggggctccccgcgcgcgatctcagggtgctcgacccgttgctctcgtacccgtccacgatcctgggccgcgagcgcgccatcgtcgtcaacctggagcgcgtcaaagccctgatcacagccacggaggtgctgcttccaaacaccaaggatcctgccttcgcgcgcttcgtccgcgatctccagacccgcgtcctcgcatcttcgtcggaccaggcagctgagctcactgacatggaaggtgaatcatctatggttgcttcaccatttcctgtaccaagttcatccaaaggacatgaagtggaaatgactaagaagactactgctattgtgcctgaaatgactagcagcagcagtatgcccaatttagctgttgcaaaagatggaaataccaaggttttgcctttcgaatttcgagctcttgaagtgtgccttgagtcagcctgcagatctttggaagaggaaacttctactctggagcaagaggcatatccagcgttagatgagctgacatcaaagatcagcacattaaaccttgaacgagttaggcaaatcaagagtcgtctggttgcgatatctggtcgggtacagaaggtgagggatgagcttgagcatttactggatgatgaaatggatatggctgaaatgtacttgacagagaagcttactcaacaagaaatcagtgaggcttcatctagagctgaggttgaggatccatctcatacagaagaggatagggatgaagattatagaagtgaaccagatggaagcaatggtagctttattggttataagcctaatattgaagaactagagatgcttctagaggcttactttgtgcaaattgatggcacacttaacaagctatcacatctgagggagtacgttgatgacacagaagattatatcaatataatgttggatgacaagcagaatcagctgctgcagatgggagtcatgctctcgactgctactgttgtcattactgctggagtggctgtagttggtctttttggtatgaatattggcatatcactttacacagacccaacaactgaggaggaaactcgagcagcaaacagaaaattttgggaaactactttcgggactgttgctggctgcgtgattttgtacatcatagccatgggttggggaaagagaagtggattactgcaatga

SEQ ID NO: 1694 - protein, 443 aa, Sorghum bicolor
  misc_feature: Ceres ANNOT ID no. 6016707
  misc_feature (24)..(442): Pfam Id: CorA Pfam Desc: CorA-like Mg2+ transporter protein
  misc_feature (15)..(443): NCBI GI: 32488076 NCBI Desc: osjnba0084a10.4 [oryza sativa (japonica cultivar-group)]
  misc_feature (15)..(443): NCBI GI: 116309978 NCBI Desc: osigba0160i14.4 [oryza sativa (indica cultivar-group)]
  misc_feature (19)..(438): NCBI GI: 92883626 NCBI Desc: mg2+ transporter protein, cora-like [medicago truncatula]
  misc_feature (186)..(442): NCBI GI: 25360941 NCBI Desc: mrs2-7 [arabidopsis thaliana]
  misc_feature (186)..(442): NCBI GI: 30682808 NCBI Desc: magnesium transporter cora-like family protein (mrs2-7) [arabidopsis thaliana]
MRPHGAGTGGGGVGRRKVGAAAAAASREWMVVPASGPARVEEAGKHAVMARTGLPARDLRVLDPLLSYPSTILGRERAIVVNLERVKALITATEVLLPNTKDPAFARFVRDLQTRVLASSSDQAAELTDMEGESSMVASPFPVPSSSKGHEVEMTKKTTAIVPEMTSSSSMPNLAVAKDGNTKVLPFEFRALEVCLESACRSLEEETSTLEQEAYPALDELTSKISTLNLERVRQIKSRLVAISGRVQKVRDELEHLLDDEMDMAEMYLTEKLTQQEISEASSRAEVEDPSHTEEDRDEDYRSEPDGSNGSFIGYKPNIEELEMLLEAYFVQIDGTLNKLSHLREYVDDTEDYINIMLDDKQNQLLQMGVMLSTATVVITAGVAVVGLFGMNIGISLYTDPTTEEETRAANRKFWETTFGTVAGCVILYIIAMGWGKRSGLLQ

SEQ ID NO: 1695 - DNA, 1308 bp, Sorghum bicolor
  misc_feature: Ceres ANNOT ID no. 6016710
  misc_feature: Encodes the peptide sequence at SEQ ID NO 1696
atggctggttcgtcttcaatggacactgaagctgcaggccaacagctcaagcatggcagcggctacagcatcccggctactgctcatgcggtggacacagactcgtggcagcaggtgggcctgctgatggtgatcggcttcaactgcgcctacgtgctcagcttctccaacctcatgatggtgcccctgggctgggcatggggcgtcgcctgcctgctgctcgtcggcgccgccgcatggtacgccaactggctcctcgccggcctccatttcgtcgacggacagaggttcattcgctacagggacctcatgggcttcgtattcgggaggaacatgtactacatcacttggttcctgcagttcaccactctacttctgtgcaacatgggcttcattctactaggagcaagagcactcaaggcaatcaacagcgagtttacccacacccctgccaggctgcagtggttcgtcaccgcgacgggattcatctacttcgccttcgcctacttcgtgcccacgatttctgccatgaggaactggctcgccacgtcggccgcgctgacattagcttacgacgtcgctctgctggctatcctcatcagagatgggaaatcgaacaagcagaaggactacaacgtccatgggacccaagccgagaaggtgttcaacgcgttgggcgccgtcgccgccatcgtcgtctgcaacacgtccgggctgctcccggagatacagtcgacggtgcgggagccggcggtgcgcggcatgcggcgggcgctgcttctgcagtacaccgccggcgccgcggggtactacggcatcagcgtggcggggtactgggcgtacgggtcggcggtgtcggagtacctccccaacgagctcggcgggccaaggtgggccgccgtgctcatcaacgccaccgccttcctgcagagcatcgtctcccaacacgtacctgttcacggtgccgatccacgaggcgatggacacgcggctgcagcggctggacgagggcatgttctcccggtacaacctcacgcgacgcctctgcgcgcgggggctcgtcttcggcttcaacgtcttcgtcaccgcgctgttcccgttcatgggggacttcgtcaacctcgtcggctccttcgcgctcgtcccgctcaccttcacatcaaagggaagagcggcgggagatgtaacagactttggcattgggggatcatcgttttctcctcggttctctgcgtcgctaccaccgccgccgccgttcgtctgatcttcaacaatgctaggatctaccacttcttcgctgacatgtag

SEQ ID NO: 1696 - protein, 435 aa, Sorghum bicolor
  misc_feature: Ceres ANNOT ID no. 6016710
  misc_feature (32)..(420): Pfam Id: Aa_trans Pfam Desc: Transmembrane amino acid transporter protein
  misc_feature (9)..(435): NCBI GI: 2088642 NCBI Desc: proline transporter 1 [arabidopsis thaliana]
  misc_feature (9)..(435): NCBI GI: 21593453 NCBI Desc: proline transporter 1 [arabidopsis thaliana]
  misc_feature (26)..(435): NCBI GI: 16215723 NCBI Desc: proline transporter [hordeum vulgare subsp. vulgare]
  misc_feature (7)..(435): NCBI GI: 31376371 NCBI Desc: at3g55740 [arabidopsis thaliana]
  misc_feature (3)..(435): NCBI GI: 8571474 NCBI Desc: proline/glycine betaine transporter [atriplex hortensis]
  misc_feature: Useful for making plants with altered carbon content
  misc_feature: Useful for making plants with altered nitrogen content
  misc_feature: Useful for making plants with modulated endosperm cell number
  misc_feature: Useful for making plants with modulated endosperm cell size
  misc_feature: Useful for making plants with modulated nitrogen use efficiency
  misc_feature: Useful for making plants with modulated oxidative stress sensitivity
  misc_feature: GREAT-hit functional homolog of the protein sequence given in SEQ ID NO 13523
  misc_feature: GREAT-hit functional homolog of the protein sequence given in SEQ ID NO 13529
  misc_feature: GREAT-hit functional homolog of the protein sequence encoded by LOCUS at2g36590
MAGSSSMDTEAAGQQLKHGSGYSIPATAHAVDTDSWQQVGLLMVIGFNCAYVLSFSNLMMVPLGWAWGVACLLLVGAAAWYANWLLAGLHFVDGQRFIRYRDLMGFVFGRNMYYITWFLQFTTLLLCNMGFILLGARALKAINSEFTHTPARLQWFVTATGFIYFAFAYFVPTISAMRNWLATSAALTLAYDVALLAILIRDGKSNKQKDYNVHGTQAEKVFNALGAVAAIVVCNTSGLLPEIQSTVREPAVRGMRRALLLQYTAGAAGYYGISVAGYWAYGSAVSEYLPNELGGPRWAAVLINATAFLQSIVSQHVPVHGADPRGDGHAAAAAGRGHVLPVQPHATPLRAGARLRLQRLRHRAVPVHGGLRQPRRLLRARPAHLHIKGKSGGRCNRLWHWGIIVFSSVLCVATTAAAVRLIFNNARIYHFFADM

SEQ ID NO: 1697 - DNA, 1380 bp, Sorghum bicolor
  misc_feature: Ceres ANNOT ID no. 6016712
  misc_feature: Encodes the peptide sequence at SEQ ID NO 1698
atgggaaaccacagctcgcgagacgggagcaaacacgggcggcgccagccctccttccagcagcagtcgtcggcgcagtggggcgccgggggagggtactacgcccaggacccgcgcgccgactactacggcgcgccggggtcacaacagggaggagggtacgccgcgccgtacccggccccggcgtaccagcccaccgctgccgctgctccggcgccgcaggccgcgaagccgcggcagctggaccggcggtactcgcggattgccgacgactaccactcagtggaccaggttactgatgctctagctcaagcaggacttgaatcatcaaatcttattgtcggcattgatttcacaaagagcaatgaatggacaggcaaattctctttccatgggcgtagtctacatcacattagtaacacaccaaatccgtatgaacaagccatctcgattattgggcgaacactatcgaaatttgatgaagataatttgattccatgtttcggatttggagatgcatcaacacatgatcaagacgtcttctgtttctctcctgacgagagaccttgcaatggattcgaagaagctcttgatcgttatagggaacttgtaccacatttgcgcctagctggaccaacgtcctttgcaccaatcattgagatggctatgaccattgtggagcaaagtggcgggcaataccacgtcctattgataattgcagatgggcaggttacaaggagtgtagatactgcatctggacagctgagttcgcaagagcaaaagactgttgatgccattgtgaaggctagtgaactgcctttgtcaattgtgttagtaggagttggtgatggcccctgggacatgatgaaggaatttgatgacaacattcctgctcgagcttttgacaatttccaatttgtaaatttttcagagataatgtccaagaacatggcacaatcaaggaaagaggctacatttgctctttcagcattgatggagataccacaacagtataaagcaaccgtggaattaggaattttaggtcgccgctctttcaagtctcctgatagagttcctctgcctccccctactggaagctatgatgcttattcctattcatctaaaagctttagtaaaccaaccacctacccgcagagctcttcatccgcatcaccctatcctcactatgaaactccacatacagccaccccagtcgcgccctcgtccacttatgacaaccaggtctgtcctatctgccttgtgaaccccaaagacatggcgtttggctgtggacaccagacttgctgtgactgcggacagagtctcgagtcgtgcccaatctgtcgcactcccatcactacaaggataaagctatactag

SEQ ID NO: 1698 - protein, 459 aa, Sorghum bicolor
  misc_feature: Ceres ANNOT ID no. 6016712
  misc_feature (134)..(282): Pfam Id: Copine Pfam Desc: Copine
  misc_feature (3)..(459): NCBI GI: 109627815 NCBI Desc: copine-like protein [oryza sativa (japonica cultivar-group)]
  misc_feature (3)..(459): NCBI GI: 56785364 NCBI Desc: copine iii-like [oryza sativa (japonica cultivar-group)]
  misc_feature (23)..(459): NCBI GI: 30697566 NCBI Desc: copine-related [arabidopsis thaliana]
  misc_feature (1)..(450): NCBI GI: 60459371 NCBI Desc: ring-finger protein [capsicum annuum]
  misc_feature (52)..(459): NCBI GI: 42408845 NCBI Desc: copine i-like [oryza sativa (japonica cultivar-group)]
MGNHSSRDGSKHGRRQPSFQQQSSAQWGAGGGYYAQDPRADYYGAPGSQQGGGYAAPYPAPAYQPTAAAAPAPQAAKPRQLDRRYSRIADDYHSVDQVTDALAQAGLESSNLIVGIDFTKSNEWTGKFSFHGRSLHHISNTPNPYEQAISIIGRTLSKFDEDNLIPCFGFGDASTHDQDVFCFSPDERPCNGFEEALDRYRELVPHLRLAGPTSFAPIIEMAMTIVEQSGGQYHVLLIIADGQVTRSVDTASGQLSSQEQKTVDAIVKASELPLSIVLVGVGDGPWDMMKEFDDNIPARAFDNFQFVNFSEIMSKNMAQSRKEATFALSALMEIPQQYKATVELGILGRRSFKSPDRVPLPPPTGSYDAYSYSSKSFSKPTTYPQSSSSASPYPHYETPHTATPVAPSSTYDNQVCPICLVNPKDMAFGCGHQTCCDCGQSLESCPICRTPITTRIKLY

SEQ ID NO: 1699 - DNA, 834 bp, Sorghum bicolor
  misc_feature: Ceres ANNOT ID no. 6016718
  misc_feature: Encodes the peptide sequence at SEQ ID NO 1700
atggcaaaagaactatggctcacaattggtagtttaaagtatataggtaaagaagtaaagccaggagccacggtttcttgcgaagttggtaatgatttggttatccacctttcacaggctgcactgggggaaccaaagaaagcgagtgagaatgtcattgtgtctgtcaaaatcgacgataagaaattagtgcttggaaccttatcggttgagaagcatcctcagatttcatgtgatcttgtctttgataaagattttgagctatcccacaattcaaaaacagctagtgttttcttctgtggctacaagtctcctgttcctcagtttgattcggatgaagagctagaaactgaccaccaaattccaagaaatgaaatttctgcggcaaaggttccagtgaagggtggtataaaagttgaatcatcttccagtgatgatgatgatgatgatttcactgatagtgaaatgtctgatgaagatgactccagtgatgaagatgatgtgtcaactggtgatgattctagtgatgattctggttcggaagaacagactcctaccccaaagaagactgatgtagtagttggcaagaagagagccattcaagctgaggcaccttctggtaagaaggcaaagtctgaacaatctgctcagaaaacaggtgacaagaaggtctcaactcattctgcaaagcagtctagcaagactccagacaaatctacaaagacccccacagctgacaagaagtcccccaaatctggtagccatgcctgcaagtcatgcaacaatgcgacaggacttgagtctcatcagaaggcgaagaagcatgaagcctag

SEQ ID NO: 1700 - protein, 277 aa, Sorghum bicolor
  misc_feature: Ceres ANNOT ID no. 6016718
  misc_feature (16)..(258): NCBI GI: 14550106 NCBI Desc: hd2 type histone deacetylase hda106 [zea mays]
  misc_feature (12)..(277): NCBI GI: 33667906 NCBI Desc: histone deacetylase [solanum chacoense]
  misc_feature (12)..(255): NCBI GI: 115465847 NCBI Desc: os05g0597100 [oryza sativa (japonica cultivar-group)]
  misc_feature (12)..(274): NCBI GI: 7716950 NCBI Desc: histone deacetylase 2 isoform c [zea mays]
  misc_feature (12)..(274): NCBI GI: 73919937 NCBI Desc: histone deacetylase 2a (hd2a) (zm-hd2a) (nucleolar histone deacetylase hd2-p39)
  misc_feature: Useful for making plants with altered Lignin content
  misc_feature: Useful for making plants with modulated drought sensitivity
  misc_feature: Functional homolog of the protein sequence given in SEQ ID NO 12957
MAKELWLTIGSLKYIGKEVKPGATVSCEVGNDLVIHLSQAALGEPKKASENVIVSVKIDDKKLVLGTLSVEKHPQISCDLVFDKDFELSHNSKTASVFFCGYKSPVPQFDSDEELETDHQIPRNEISAAKVPVKGGIKVESSSSDDDDDDFTDSEMSDEDDSSDEDDVSTGDDSSDDSGSEEQTPTPKKTDVVVGKKRAIQAEAPSGKKAKSEQSAQKTGDKKVSTHSAKQSSKTPDKSTKTPTADKKSPKSGSHACKSCNNATGLESHQKAKKHEA

SEQ ID NO: 1701 - DNA, 4914 bp, Sorghum bicolor
  misc_feature: Ceres ANNOT ID no. 6016719
  misc_feature: Encodes the peptide sequence at SEQ ID NO 1702
atgaatcttttgaagaggccatccaactcatcgcctccagaagacgaaacagacaagcataaacggcagaagagggaatgccaggatttcacccccagaaggtaccagcttgatgtctatgaggttgctatgaggcagaacacaattgcgatgcttgacacgggagctgggaagacaatgattgctgtcatgctcatcaagcattttgggaagatcagcaaagcaaataatgatcgaaagctcatcatattccttgcaccaacagttcaactcgtcacacagcaatgcgaggttattaagagctacactgattttgaggtggagcattatcatggtgcaaagggtgttgatcaatggaaggctcatagctggcaacaacaattcttaaaatatcaggttatggtcatgacaccacaggtgttgctagatgctttacgccaagctttcttgatcctggacatggttagtctcatgatatttgatgaatgccatcacgcaactggtaaccacccatatactaggataatgaaggagttctatcacggatcagagcataaaccaaatgtgttcggggtctcatctgatttggattgcgaaaatcagctatctgagctggaaaatattttagattccaagatacacgctgtggtggatagagaagagatagaactttgtgttccttccgcaaaagaagtgaacagatactatgagccgagaactgtttcttttgaagatttaagtgaagaactggaaattttgtgttccaagtatgatgggctgatcgtacaattgcataacagatcgaccaatcagtacaaagatgctgatgaaataacaaaagaatcacggagacgtctctcaaaatctttagcaaagatttgctattgccttgaagatgccggtcttctttgtgctagtgaggccactaaaatctgcattgaaagagggcagagaaaaggttggctgaaggggggcagtgacaccactgatcagcaaagtgatccaaatggaccaatcctatttgcagaaatttcaatgcttcatatgaagttctttcaggaagtgttggatataattgacaaacgcctccaacagcaacaaggaattgatgcccttctgaactcagagagtggatgtgtggaagcagcaaagatgggctatatttcaccaaagctctatgagctcatgcgagtatttctttctttcagtgactctgataacgtccgatgccttatttttgtggaccgaaagattagtgctagagtcattgagcggacaatgaagaaaataggccgactctcctgtttcagagtctcttttctaactggagggagttcttcagtggatgcactcacccctaaaatgcaaaaggatacgctggattcattccgctctggaaaggtcaacttactgtttactacagatgttgcagaagagggtatacatattccagactgctcgtgtgtaataagatttgatttgccaaggactacccgcagctatgtgcaatcacgtggacgagcacgacagcgggactctcagtacatactaatgattgaaaaggggaatgtgaaacaaagtgatttaatatctaggattatgagaagtaagacctcgatgactgagattgcttcaaaccgagagcctgaggattcacaccgcaatttcttccccattgaagaaataaatgaataccatatagcacacacaggagccaaaataactactgattctagcatcagtgttctcaaccagtactgtgacaagctcccgaaggacaagtactacaccccaagacccacgtttcagttcacccattatggtgatggttatgagtgtactgtaacactaccatccagtgccatgtttcaacttttggtaggtccaaaagcaagaaatatgcagaaagcaaagcagcttgtttgccttgatgcatgtaagaggctgcatcagctcggagcacttgatgaccatctttctccatcagttgaagagacgcctctggaaatttcaagcaagtctagtatctcaacatctggtgcaggtttaggtacaaccaaacggaaagagctacatggtacaaccaaagttctttctatgtctggctcttggggttcagataaaagtgtgactaaacttcaaggctacaagttaaattttgtttgtgatcaagttgatcaaaaatactgtgactttgtccttctaattgatacaagtatagcaaaagaagctgctactttaaatattgatttatatttgcatgacaagatggtaaaagcttcggtttctccttgtggacctcttgagttggatgctcgacagatggaaaaaacaaaattgtttcaagcacttctatttaacggtttgtttggaaaactgtttattggatcaaaagcatcaaaaaccccaagggagttcattctcaagaaagatgatgcatttctttggaataaagaaaatatgtatttgctattacctgtggattctactcaggattctcataaaagtgtttgcatcaactggagtatagttgatatagcggctacaactgttggactcatgagaagcatttattcagatggcaaacataacctaaaggataaacttaatcatgaaaaaaatgacgaaaattttattcgtttggccaacaagtcatgcaaagctgatgatcttaaaaatatggtggttttagcaattcatactggaaagatatatactgttcttaaggtatctgatttatgtgctaatagtaaatttgatggtacatctgacaagaaagaagcaaaattccagacatttgcagaatattttgagaagaagtataatatatttctttgtcatcctttacaaccattgctagtgttgaaacccacccataatcctcacaatcttctttcctcaaagaatagagatgaaggcaatgttgtggaaaataaaaatagggcaaatagccttgttcacatgcctccagagttgctgattccccttgatttacctgttgatgttttgagagtattctatttgtttccatctctgatgcatcgtcttgaatcactaatgctagccagccaactaagaagtgaaattgcatacacagattctgatatatcgagcttcgtgattttggaagctattacaacacttagatgctgcgaggacttctcaatggagcgtttagagttattgggggactctgttcttaagtatgcagtgagtgcccatcttttcatgacatttcttaataagcatgaggggcagttatcgtccagaaggcaagaaactatatgtaatgccacactttatagacttggtactgaacgcagaatacagggttatatacgtgatgctgcatttgatcctcgtcgatggcttgctcctggacagctgtccagccgtccctgtccttgtgaatgcccagtaaaatctgaggttataactgaggatattcacagaattgatgacaaatctataattataggcaaggcgtgtgacaagggacacagatggatatgttctaaaaccatctctgattgtgttgaggctataattggggcctattatgtggaagggggattaaaagcagcttttgctgttctcaaatggttgcagattgagacacttgaggaagagcaaattatggaagccctatcaagtgcttcagtgcgaaattatcttccaaaagttgatgtagttgaatttcttgaagcaaaactaggctacacctttcaagtgaaaggtttgctaatagaggctctcacccacccatcacagcaagaatctggagcaacatactgctaccagcgcttggaattccttggtgatgcagtcttagatattttaataactcgccatttattccttagtcataaagacacagatgagggggagctgacagatttacggtctgcatcagtaaataatgagaattttgcacaagttgcggtaaagcacaatctccatcagtttctacaacattcttctgggttcctacaagaccaaattactgaatatgtgaatagtctggaaggttcatccatggacagaaccagccttttatccagtgggccatctagggggccaaaagttctaggtgatattgtagaaagtattgcaggtgctattcttattgacagcaaacttgatctggatttagtctggcgggttttcaaacctcttctttccccaattgtcacacctgagaatttggagttacccccattcagagaacttaatgagtggtgtgacaagaatgggtactttattggaattaaatgtgaaaatcgaggagacaaaacaacggctattcttagcttacaactcaaggacttgcttctggtgaggcaaggttgtgggaagaacaaaatagatgcaaaagcacatgcagcttccttattgctcagggatctagaggaaaaaggacttataattccaaagaatgcaagcagagtggaacaatttgaaaagaattctggtactagaaaccattgcaacaacttggttgatgttatggacacacaaaatgtagcaccacctaggcaaaaggaactaccggtgtcaagtaccgctcctggctctgttcttgataaaccattggttgtgaaggttaagttgagtaaaggaggacctcgtgtatcgttgtatgagtcgtgtaaaaagcttcagtggccaatgcctatgtttgaatttgtgaaagtcgagccaagtgtgtgctcctcttccggtgattcttcacaaaaggttgcaccccaaggatatgcatttgcttcaacaataacattgcatataccgaacggcgatatcatcagcctcacaggagacggacgtgcggataagaagagctcacaggattctgctgcgctgctcatgctctatgagctgcagcggcgaggtagattccaagtccaagaagtatga

SEQ ID NO: 1702 - protein, 1637 aa, Sorghum bicolor
  misc_feature: Ceres ANNOT ID no. 6016719
  misc_feature (1057)..(1191): Pfam Id: Ribonuclease_3 Pfam Desc: RNase3 domain
  misc_feature (1267)..(1379): Pfam Id: Ribonuclease_3 Pfam Desc: RNase3 domain
  misc_feature (431)..(511): Pfam Id: Helicase_C Pfam Desc: Helicase conserved C-terminal domain
  misc_feature (33)..(204): Pfam Id: DEAD Pfam Desc: DEAD/DEAH box helicase
  misc_feature (863)..(1020): Pfam Id: PAZ Pfam Desc: PAZ domain
  misc_feature (29)..(179): Pfam Id: ResIII Pfam Desc: Type III restriction enzyme, res subunit
  misc_feature (872)..(1635): NCBI GI: 144923433 NCBI Desc: helicase, c-terminal; argonaute and dicer protein, paz; ribonuclease iii, bacterial [medicago truncatula]
  misc_feature (212)..(968): NCBI GI: 115482610 NCBI Desc: os10g0485600 [oryza sativa (japonica cultivar-group)]
  misc_feature (518)..(1627): NCBI GI: 78099743 NCBI Desc: dicer-like protein [oryza sativa (indica cultivar-group)]
  misc_feature (879)..(1495): NCBI GI: 34922211 NCBI Desc: endoribonuclease dicer homolog (carpel factory protein) (short integuments 1 protein) (suspensor1 protein)
  misc_feature (879)..(1495): NCBI GI: 6102610 NCBI Desc: caf protein [arabidopsis thaliana]
MNLLKRPSNSSPPEDETDKHKRQKRECQDFTPRRYQLDVYEVAMRQNTIAMLDTGAGKTMIAVMLIKHFGKISKANNDRKLIIFLAPTVQLVTQQCEVIKSYTDFEVEHYHGAKGVDQWKAHSWQQQFLKYQVMVMTPQVLLDALRQAFLILDMVSLMIFDECHHATGNHPYTRIMKEFYHGSEHKPNVFGVSSDLDCENQLSELENILDSKIHAVVDREEIELCVPSAKEVNRYYEPRTVSFEDLSEELEILCSKYDGLIVQLHNRSTNQYKDADEITKESRRRLSKSLAKICYCLEDAGLLCASEATKICIERGQRKGWLKGGSDTTDQQSDPNGPILFAEISMLHMKFFQEVLDIIDKRLQQQQGIDALLNSESGCVEAAKMGYISPKLYELMRVFLSFSDSDNVRCLIFVDRKISARVIERTMKKIGRLSCFRVSFLTGGSSSVDALTPKMQKDTLDSFRSGKVNLLFTTDVAEEGIHIPDCSCVIRFDLPRTTRSYVQSRGRARQRDSQYILMIEKGNVKQSDLISRIMRSKTSMTEIASNREPEDSHRNFFPIEEINEYHIAHTGAKITTDSSISVLNQYCDKLPKDKYYTPRPTFQFTHYGDGYECTVTLPSSAMFQLLVGPKARNMQKAKQLVCLDACKRLHQLGALDDHLSPSVEETPLEISSKSSISTSGAGLGTTKRKELHGTTKVLSMSGSWGSDKSVTKLQGYKLNFVCDQVDQKYCDFVLLIDTSIAKEAATLNIDLYLHDKMVKASVSPCGPLELDARQMEKTKLFQALLFNGLFGKLFIGSKASKTPREFILKKDDAFLWNKENMYLLLPVDSTQDSHKSVCINWSIVDIAATTVGLMRSIYSDGKHNLKDKLNHEKNDENFIRLANKSCKADDLKNMVVLAIHTGKIYTVLKVSDLCANSKFDGTSDKKEAKFQTFAEYFEKKYNIFLCHPLQPLLVLKPTHNPHNLLSSKNRDEGNVVENKNRANSLVHMPPELLIPLDLPVDVLRVFYLFPSLMHRLESLMLASQLRSEIAYTDSDISSFVILEAITTLRCCEDFSMERLELLGDSVLKYAVSAHLFMTFLNKHEGQLSSRRQETICNATLYRLGTERRIQGYIRDAAFDPRRWLAPGQLSSRPCPCECPVKSEVITEDIHRIDDKSIIIGKACDKGHRWICSKTISDCVEAIIGAYYVEGGLKAAFAVLKWLQIETLEEEQIMEALSSASVRNYLPKVDVVEFLEAKLGYTFQVKGLLIEALTHPSQQESGATYCYQRLEFLGDAVLDILITRHLFLSHKDTDEGELTDLRSASVNNENFAQVAVKHNLHQFLQHSSGFLQDQITEYVNSLEGSSMDRTSLLSSGPSRGPKVLGDIVESIAGAILIDSKLDLDLVWRVFKPLLSPIVTPENLELPPFRELNEWCDKNGYFIGIKCENRGDKTTAILSLQLKDLLLVRQGCGKNKIDAKAHAASLLLRDLEEKGLIIPKNASRVEQFEKNSGTRNHCNNLVDVMDTQNVAPPRQKELPVSSTAPGSVLDKPLVVKVKLSKGGPRVSLYESCKKLQWPMPMFEFVKVEPSVCSSSGDSSQKVAPQGYAFASTITLHIPNGDIISLTGDGRADKKSSQDSAALLMLYELQRRGRFQVQEV

SEQ ID NO: 1703 - DNA, 1206 bp, Sorghum bicolor
  misc_feature: Ceres ANNOT ID no. 6016725
  misc_feature: Encodes the peptide sequence at SEQ ID NO 1704
atggcaaagcctggaattttaggccgcagcagcgcacagaaatcaaatgagggcatgcgaatcatattctcagcagttgttggtgttatgctagggtacttgtttggcatttccttccccacagttaatataacaaagcttcacttcccttctagcattatctcctatattgaggacagaaactctggcatcacaacccaaacattattgaatcatgcatggacatctgcagctactcataagaagaacaattcagcttctaactctgatgaaattcctaagatttatgttccaacaaaccctaaaggtgctgaaaggcttccaccaggcattgtagtgtctgaaactgacctttatctccggagattgtggggtgaacctagtgaggatcttactagcaaaccaagataccttgttacatttacagttggatacgctcaaaaggcaaacattgatgcagcagtgagaaagttttcagagaacttcacaattatgttgttccattatgatgatcggataactgagtgggatgaatttgagtggtcaaaaagggccatccatgtgagtgtcagaaagcagactaaatggtggtacgccaagcgatttctacatcctgacattgttgcccgttatgactacatatttatctgggatgaagatctcggtgttgaacattttaatgcagaggcgtacattggacttgttaggaagcatgggcttgagatctctcagcctggtttggagcctgataaaggtctgacatggcaaatgactaaacgaataggtgatcaggaagtccacaaagtaactgaggagaggcctggctggtgtagcgacccccatcttccaccatgtgcagcatttgttgaaattatggcaactgtgttctcaagggatgcatggcgctgtgtatggcatatgattcagaacgacttggtccatggatggggtcttgattttgctcttaggaaatgtgtggagccagcccatgagaaaattggagtcgttgattcccagtggattgttcatcaagtcgtcccatcgcttggtaaccagggcaaggcggagaatggaaaagcgccatgggaaggggttagagcacgctgtcgtaaagaatgggggatatttcaaacaaggttgacagatgctgagaaagcatattacttggcgcaagggatcacaccaccaaaatcgacagtaacttag

SEQ ID NO: 1704 - protein, 401 aa, Sorghum bicolor
  misc_feature: Ceres ANNOT ID no. 6016725
  misc_feature (94)..(387): NCBI GI: 8778842 NCBI Desc: t6d22.12 [arabidopsis thaliana]
  misc_feature (1)..(287): NCBI GI: 115441749 NCBI Desc: os01g0910400 [oryza sativa (japonica cultivar-group)]
  misc_feature (92)..(289): NCBI GI: 4850384 NCBI Desc: f3f19.3 [arabidopsis thaliana]
  misc_feature (10)..(387): NCBI GI: 23309021 NCBI Desc: at3g26440/f20c19_16 [arabidopsis thaliana]
  misc_feature (92)..(401): NCBI GI: 9743342 NCBI Desc: f21j9.23 [arabidopsis thaliana]
MAKPGILGRSSAQKSNEGMRIIFSAVVGVMLGYLFGISFPTVNITKLHFPSSIISYIEDRNSGITTQTLLNHAWTSAATHKKNNSASNSDEIPKIYVPTNPKGAERLPPGIVVSETDLYLRRLWGEPSEDLTSKPRYLVTFTVGYAQKANIDAAVRKFSENFTIMLFHYDDRITEWDEFEWSKRAIHVSVRKQTKWWYAKRFLHPDIVARYDYIFIWDEDLGVEHFNAEAYIGLVRKHGLEISQPGLEPDKGLTWQMTKRIGDQEVHKVTEERPGWCSDPHLPPCAAFVEIMATVFSRDAWRCVWHMIQNDLVHGWGLDFALRKCVEPAHEKIGVVDSQWIVHQVVPSLGNQGKAENGKAPWEGVRARCRKEWGIFQTRLTDAEKAYYLAQGITPPKSTVT

SEQ ID NO: 1705 - DNA, 1002 bp, Sorghum bicolor
  misc_feature: Ceres ANNOT ID no. 6016732
  misc_feature: Encodes the peptide sequence at SEQ ID NO 1706
atggcggcagcatccgccgccgcagccgccgaagccaacggcgagagcaaagacgaattcctcatacgcgacgacgcgccggggctgctcgccgctctcaaggagatgaaggacggattggacctcgtcaggggcaaggtcgaggccatcacccggaaggtcaaggagaaccagttgccgacggccaacgggatcgggtacctagatgcgaagaaccagctgctccttggctactgccaggacatcgtctactacctgctccgcaaggccaaggggctctcggtggatggacaccccgttgtacggagccttgtcgagattaggctgtttctagagaagattcgtccaattgacaagaaggcagagtaccaaattcagaagctcaccaacgctgctgacaatgcaattgcacgagagaagacaggaaatgcagaggcgaaggggaagggcgagcattcagatgaggatgaccccctgaagtataggccaaacccagatatgatggacacaaaggctggtcctgatgggcaggatactgatggtgtttaccgtcctccgaaatttatgcctactagcgtggatgatgaagagaagcgtcgtaaaaaagattcaaggagagataaagcattagcccgagtggcaatagaaaatccttatattaaagaaataattgacgatgctgcggacagacctgaagagtggaaggaaacagtgggcgatgaaagcagggaatttgggaggtacatgcgacagagagaggagcaagagaagcaggaagaggagttgttcactcgggctcctgtaaccaaacgtgataagcagatcgagaagcgcataaggagacaacttcatgggctaggaggcttaacggatggtttcgaccttggaatgaacatgctaattggcggagacaaggaagatgatggcggttcaagcaaatcgcatggcaagagtggacatcgaaagaagcacctgaagagcagtaagaggaagaggcattag

SEQ ID NO: 1706 - protein, 333 aa, Sorghum bicolor
  misc_feature: Ceres ANNOT ID no. 6016732
  misc_feature (32)..(113): Pfam Id: Sas10_Utp3 Pfam Desc: Sas10/Utp3 family
  misc_feature (21)..(333): NCBI GI: 40675680 NCBI Desc: loc395016 protein [xenopus tropicalis]
  misc_feature (21)..(333): NCBI GI: 82524661 NCBI Desc: loc395016 [xenopus tropicalis]
  misc_feature (23)..(329): NCBI GI: 54645558 NCBI Desc: ga10717-pa [drosophila pseudoobscura]
  misc_feature (21)..(332): NCBI GI: 119586553 NCBI Desc: hcg41742, isoform cra_d [homo sapiens]
  misc_feature (21)..(331): NCBI GI: 23272205 NCBI Desc: 1500001l15rik protein [mus musculus]
MAAASAAAAAEANGESKDEFLIRDDAPGLLAALKEMKDGLDLVRGKVEAITRKVKENQLPTANGIGYLDAKNQLLLGYCQDIVYYLLRKAKGLSVDGHPVVRSLVEIRLFLEKIRPIDKKAEYQIQKLTNAADNAIAREKTGNAEAKGKGEHSDEDDPLKYRPNPDMMDTKAGPDGQDTDGVYRPPKFMPTSVDDEEKRRKKDSRRDKALARVAIENPYIKEIIDDAADRPEEWKETVGDESREFGRYMRQREEQEKQEEELFTRAPVTKRDKQIEKRIRRQLHGLGGLTDGFDLGMNMLIGGDKEDDGGSSKSHGKSGHRKKHLKSSKRKRH

SEQ ID NO: 1707 - DNA, 2082 bp, Sorghum bicolor
  misc_feature: Ceres ANNOT ID no. 6016734
  misc_feature: Encodes the peptide sequence at SEQ ID NO 1708
atggccgggaggcgcccggcaccggcggccctcctcctcctcctcctagccgcatccttcgcccccatctcctccgccgtccgcccagtctccgacgcgcacagatccgctgccgcggagctcttcgccccctccgccgatggatccttcggcgatttggagagtacgtatgaggcggtgaggactttccagatactcgggttggagaactataagagtttgtctgggaaggcgtgcaagtttgctgcggagaacttggcttcccccggttccaccgcgaaagatctgttccacgcagtccggatcagtggcgcgctcgggtgcggtgttgatgccggcgtgtacgatggtgttgtggcaacgctcaaggcagtgattaaggataccaattccctgttggaattctactattctgtgggaggtttgcttagcatcaaggaacaaggccataatgttgttctgtctgatgcagaaagtacatttcatgccattaaggcacttagccaaagcgacggaagatggcgttatgacactaacagtgctgaatctagcacatttgctgctggtatcgcactagaagcattggcgggcattgtttcactggcagatgcagagattgattcatccatgatggcagtggttaaaaacgacatcatgaagctttttgacaccatcaagagctatgatgatgggaccttctactttgatgaaaagcatgttgatgctactgaatacaagggtcctataatgacttccgcttcagtggtacggggtgtcacctcatttgcagctgttgtttctggaaaattgaatatccctggtgagaaaatacttggcctggcaaagttcttccttggtattgggctcccaggtagtgcaaaggactgctttaatcagattgagtctctgtcgttcctggagaacaatagggtctttgttcctttgatactgtcacttccttccaaagtattttcattgacttcgaaagatcagcttaaggttgaagttacaacagtttttggatctgcttcaccttcactcaaagtgaatcttgtgcaagtgttgggatctgactctaaagtcatcaccaatgagaacaaggaacttcaatatgaccttgacaacaatgtccattacttggacattgctccactgaaaatagatgttgggaaatactcaatagtttttgagatttcacttcaggaaccagagcatgagacagtttatgttactggagggagaaacaccgaaagtgtcattgtcacaggactgatcaaagtcaacaaggcagaaataggaatctctgacaatgatgctgggaccgtggagtctgtccaaaagttagatcttctgaaagatacaaaagtgtctctttctgcaaaccacctgcagaagctgcgtttatcctttcaactaaccacaccgctcgggcacacatttaaacctcaccaggtgttcttgaagttgaagcatgagagtaaggttgaacacttatttgtggtacctggctctgcaaggcagttcaaaattgttcttgatttcctaggtttggtggaaaaattttactacctttctggaagatatgatcttgagcttgccgttggtgatgctgcaatggaaaattcatttctacgatcccttggccatttggacttggacctaccagaagctccagaaaaagccccacgtcctcctgcacaagctgttgacccattctcaaaatttgggccaaaggcagagatagcacatatattccgcgcaccagagaagaggccacccaaggaactctcgcttgctttcacgggtctcacgcttctaccttttatcggattcttgatagggctcatgcgtcttggagtgaacttgaagaacttcccatccttgccaggaccggctgcatttgcctcacttttccatgctggagtaggagcagtcctgctgctctacgttctcttctggctcaagttggaccttttcacaactctgaagtaccttggcttcctcgtcatcttccttgtttttgtgggccataggaccctatcctacctttcctccgtgtcgacaaaacagaagacggcataa

SEQ ID NO: 1708 - protein, 693 aa, Sorghum bicolor
  misc_feature: Ceres ANNOT ID no. 6016734
  misc_feature (6)..(687): Pfam Id: Ribophorin_II Pfam Desc: Ribophorin II (RPN2)
  misc_feature (12)..(693): NCBI GI: 18958022 NCBI Desc: at4g21150/f7j7_90 [arabidopsis thaliana]
  misc_feature (520)..(668): NCBI GI: 94959375 NCBI Desc: at4g21150 [turritis glabra]
  misc_feature (554)..(668): NCBI GI: 94959377 NCBI Desc: at4g21150-1 [arabidopsis lyrata subsp. petraea]
  misc_feature (236)..(680): NCBI GI: 116132034 NCBI Desc: ensangp00000020783 [anopheles gambiae str. pest]
  misc_feature (554)..(668): NCBI GI: 94959379 NCBI Desc: at4g21150-2 [arabidopsis lyrata subsp. petraea]
MAGRRPAPAALLLLLLAASFAPISSAVRPVSDAHRSAAAELFAPSADGSFGDLESTYEAVRTFQILGLENYKSLSGKACKFAAENLASPGSTAKDLFHAVRISGALGCGVDAGVYDGVVATLKAVIKDTNSLLEFYYSVGGLLSIKEQGHNVVLSDAESTFHAIKALSQSDGRWRYDTNSAESSTFAAGIALEALAGIVSLADAEIDSSMMAVVKNDIMKLFDTIKSYDDGTFYFDEKHVDATEYKGPIMTSASVVRGVTSFAAVVSGKLNIPGEKILGLAKFFLGIGLPGSAKDCFNQIESLSFLENNRVFVPLILSLPSKVFSLTSKDQLKVEVTTVFGSASPSLKVNLVQVLGSDSKVITNENKELQYDLDNNVHYLDIAPLKIDVGKYSIVFEISLQEPEHETVYVTGGRNTESVIVTGLIKVNKAEIGISDNDAGTVESVQKLDLLKDTKVSLSANHLQKLRLSFQLTTPLGHTFKPHQVFLKLKHESKVEHLFVVPGSARQFKIVLDFLGLVEKFYYLSGRYDLELAVGDAAMENSFLRSLGHLDLDLPEAPEKAPRPPAQAVDPFSKFGPKAEIAHIFRAPEKRPPKELSLAFTGLTLLPFIGFLIGLMRLGVNLKNFPSLPGPAAFASLFHAGVGAVLLLYVLFWLKLDLFTTLKYLGFLVIFLVFVGHRTLSYLSSVSTKQKTA

SEQ ID NO: 1709 - DNA, 2106 bp, Sorghum bicolor
  misc_feature: Ceres ANNOT ID no. 6016739
  misc_feature: Encodes the peptide sequence at SEQ ID NO 1710
atggacgcctccggcggttcgtcgccaccgcactcccaagagaacccgccggagcacggtggcgacatgggggaggccccggcggaggagatcggaggggaggcggcggatgacttcatgttcgccgaagacacgttcccctccctcccggacttcccttgcctctcgtcgccgtccagctccaccttctcgtcgtcctcctcgtccaactcctccagcgcctacaccaacacgacggcaggaggagctggcggcggcggcgccgccgccgccggcgagccctccgagcctgcatcggccggggaagggtttgatgcgcttgatgacatcgaccagatcctcgacttcgcgtcgctctccatgccgtgggactccgagccgttcccggaggttagcttgatgctagaggacgccatgtccgcgccgccgaatccggtgtgcgacgtcagacgtgaagagaaacccgttctggaagggacgggcagagaggaagcctgcatggatgcgtcatcggtggcggcgggggaggagctgccgcggttcttcatggagtggctcacgagcaaccgtgaaaacatctcggcggaggatctccgcgggatccgcctccgccgctccaccatcgaggccgccgccgctcggctcggcggcgggcgccaaggcaacatgcagctgctcaagctcatcctcacctgggtgcagaaccatcacctccagaagaagcgcccgcgcgacgtgatggaggaggcggcgggcctgcacggccagctccccagcccgggcgccaaccaaggatacgagttccccgccggcggacaggatatggccgcaggcggcggcacatcctggatgccctaccagcagcagccgttcacgccacctgcgtacggcggcgacgcggtgtacccaaacgcggcaggccaacaataccctttccaccagagctccagcacgagcagcgtggtcgtgaacagccagccgttctccccgccgacggtgggcgacatgcacggcgccggcggcgcaaacatggcctggccacagcagtacgtgccgttcccaacacctggggcgtccacgggctcttaccctatgccgcagccgttctccgccggattcggcgggcagtacgccgccgccggcgctgccggcggccaccccaccatggccccccagcgcatggcaggcgtggaggcctcggcgaccaaggaggcccgcaagaagcgcatggcgagacagcggcgcctgtcctgcctgcagcagcagcgcaaccagcagctaaacctgggccagatccagggctccgtccacccgcaggagccgtcccctcggtcggcccactccacgccggtcacgccctcagccggtggctggggattctggtcgccgagcagccagcagcaggtccagaacccgctctccatcaagtccaattcctcaggggaaccggtgcctctctccctggaagcggtgaccgcgccaccggcgaagccggcgcctggtgctcggctggacgacagtccccagcgccttgcggcggcttcagataagcggcagggtgccaaggcggacaagaacctgcggttcctgctgcagaaggtgctgaagcagagcgacgtcgggagcctcgggcgcatcgtgctccccaaaaaggaagcggaggttcacctgccagagctcaagacgagggatggcatctccatccccatggaggacattgggacatcgcgcgtatggaacatgcggtacaggttttggcccaacaacaagagtagaatgtatctgctggagaacacaggagaatttgttcgttccaatgagcttcaggagggggatttcatagtgatatactccgatgtcaagtcgggcaaatttctgatacggggcgtgaaggtaaggccgccggcgcaagagcaaggcaacggttccagtgccgcaggcaagcacaagctgatgtctccagcaggtccagagaaagccagcgttcctggagatgccgacgtcgatggggtcagtggtgcatgcaaagggaggtctccgcaaggcgttcgacgggatcggcagcagggagccgccgccatgaaccagatggccgtgagcatctga

SEQ ID NO: 1710 - protein, 701 aa, Sorghum bicolor
  misc_feature: Ceres ANNOT ID no. 6016739
  misc_feature (530)..(635): Pfam Id: B3 Pfam Desc: B3 DNA binding domain
  misc_feature (1)..(701): NCBI GI: 138603 NCBI Desc: regulatory protein viviparous-1
  misc_feature (1)..(673): NCBI GI: 629807 NCBI Desc: transcription activator vp1 - rice
  misc_feature (1)..(673): NCBI GI: 109940047 NCBI Desc: protein viviparous homolog
  misc_feature (1)..(673): NCBI GI: 56784394 NCBI Desc: vp1 protein, osvp1 [oryza sativa (japonica cultivar-group)]
  misc_feature (1)..(673): NCBI GI: 391885 NCBI Desc: vp1 protein (osvp1) [oryza sativa (japonica cultivar-group)]
  misc_feature: The sequence is a functional homolog of SEQ ID NO 44 in the 10/838,616US patent application
  misc_feature: The sequence is a functional homolog of SEQ ID NO 46 in the 10/838,616US patent application
  misc_feature: Useful for making plants with modulated drought sensitivity
  misc_feature: Useful for making plants with modulated growth and phenotype characteristics
  misc_feature: GREAT-hit functional homolog of the protein sequence given in SEQ ID NO 13375
  misc_feature: The sequence is a functional homolog of SEQ ID NO 44 in the 20060008874 US patent application
  misc_feature: The sequence is a functional homolog of SEQ ID NO 46 in the 20060008874 US patent application
MDASGGSSPPHSQENPPEHGGDMGEAPAEEIGGEAADDFMFAEDTFPSLPDFPCLSSPSSSTFSSSSSSNSSSAYTNTTAGGAGGGGAAAAGEPSEPASAGEGFDALDDIDQILDFASLSMPWDSEPFPEVSLMLEDAMSAPPNPVCDVRREEKPVLEGTGREEACMDASSVAAGEELPRFFMEWLTSNRENISAEDLRGIRLRRSTIEAAAARLGGGRQGNMQLLKLILTWVQNHHLQKKRPRDVMEEAAGLHGQLPSPGANQGYEFPAGGQDMAAGGGTSWMPYQQQPFTPPAYGGDAVYPNAAGQQYPFHQSSSTSSVVVNSQPFSPPTVGDMHGAGGANMAWPQQYVPFPTPGASTGSYPMPQPFSAGFGGQYAAAGAAGGHPTMAPQRMAGVEASATKEARKKRMARQRRLSCLQQQRNQQLNLGQIQGSVHPQEPSPRSAHSTPVTPSAGGWGFWSPSSQQQVQNPLSIKSNSSGEPVPLSLEAVTAPPAKPAPGARLDDSPQRLAAASDKRQGAKADKNLRFLLQKVLKQSDVGSLGRIVLPKKEAEVHLPELKTRDGISIPMEDIGTSRVWNMRYRFWPNNKSRMYLLENTGEFVRSNELQEGDFIVIYSDVKSGKFLIRGVKVRPPAQEQGNGSSAAGKHKLMSPAGPEKASVPGDADVDGVSGACKGRSPQGVRRDRQQGAAAMNQMAVSI

SEQ ID NO: 1711 - DNA, 1593 bp, Sorghum bicolor
  misc_feature: Ceres ANNOT ID no. 6016747
  misc_feature: Encodes the peptide sequence at SEQ ID NO 1712
atggcggcccagcccatccgcaaggcgcacttcgaccgcatcacccgcgccctcgcctccgaccacccgccaccgtcccccgccgcgctgcacgcgcacctcctccgctcgcacgccgcggccaccgcgccgaacctcgtccgctcgctcgtcaacggcgccatcagccgcctctccaagccgcgcccgcgcgccgcgctcgccttgctcctcctcatgccgcgcctgcccgtcctccccgaccacttcacgctacccttcgcgctcaacgccgccgcgtcgctccgcctcctcccgctcggcgcctccctgcacgccgtcgcgttccgccttgggcttctaccgctccgcctccccgtcgcaaacgcgcttgtcgacctctacgccaagtgcgaggagttctccgccgcgcacgccgcgctggccgacatccccgcccccgacgcggtctccttcaattccctcctgtgcgcgcacgctcggaacgcctccgtgcgtcccgccgagtccctcttcgccgccatgcgcagcaggacccaggtctcctggaacgccatggtggtcctctacgtcagcgctggtgacctcgtgtccgctcgtcgcgtgtttgacgaaatgccgacgagggacacggcctcgtggtcggtgctcattgctgggtattgcaagggtgggctggtgcagaacgcgcgcgagctgtttgacaaaatgccgtcaaagaatctcgtggcccggacagcgatgattaatggttatgcacagactgggcagccaaaggcggcacttgctctctttagggatctggaagcggctgggattgagcctgatggagccacaatggttggggttatctctgcagtttcacagataggcagcacagagttggctgggtgggttggagcttatgttgacaggaagaagatcgaaaggaatgtgaaggttcttacagcactggtagatatgcatgcaaagtgtggcaacattgagcaggccctgagtgctttcagggagatcccacagcctgatgcctatccgtacacagcactgattagcggcctggcaactcatgggcatgaaaagctggcactttcagtgttcgaaaggatgcaggtccaagccgtcaagcctgaccctatcactttcgttggtgtgcttactgcttgcagccatacagggcttgttgataagggactggagtattgggaggcaatggtgcgggattatggaattgtgcggcgtgcggatcactatgcctgtgtcattgacatgcttggccgtgcagggaggattgaggaggctttcgagatggttcaaacgatgccaatggggccgcatccgggggcccttggtgcactcctgagtgcttgcaagacatatgagaatgttgagattgcagaaattgttgcaaacaagctatttgagttggaaccttggaacactggcaactatatactcttgtcaaacatatatgctgggaaagaactgtgggaggaggcagaaagggttagatcactgatgagaacaaaattgccatttaaaaatcctggatctacttggtttgaggatcgacagagggagcatgctaagatgtag

SEQ ID NO: 1712 - protein, 530 aa, Sorghum bicolor
  misc_feature: Ceres ANNOT ID no. 6016747
  misc_feature (243)..(277): Pfam Id: PPR Pfam Desc: PPR repeat
  misc_feature (344)..(378): Pfam Id: PPR Pfam Desc: PPR repeat
  misc_feature (13)..(518): NCBI GI: 116309337 NCBI Desc: h0622f05.4 [oryza sativa (indica cultivar-group)]
  misc_feature (63)..(527): NCBI GI: 115489262 NCBI Desc: os12g0578000 [oryza sativa (japonica cultivar-group)]
  misc_feature (1)..(521): NCBI GI: 20804987 NCBI Desc: selenium-binding protein-like [oryza sativa (japonica cultivar-group)]
  misc_feature (80)..(521): NCBI GI: 91806359 NCBI Desc: pentatricopeptide repeat-containing protein [arabidopsis thaliana]
  misc_feature (184)..(521): NCBI GI: 140070676 NCBI Desc: tetratricopeptide-like helical [medicago truncatula]
MAAQPIRKAHFDRITRALASDHPPPSPAALHAHLLRSHAAATAPNLVRSLVNGAISRLSKPRPRAALALLLLMPRLPVLPDHFTLPFALNAAASLRLLPLGASLHAVAFRLGLLPLRLPVANALVDLYAKCEEFSAAHAALADIPAPDAVSFNSLLCAHARNASVRPAESLFAAMRSRTQVSWNAMVVLYVSAGDLVSARRVFDEMPTRDTASWSVLIAGYCKGGLVQNARELFDKMPSKNLVARTAMINGYAQTGQPKAALALFRDLEAAGIEPDGATMVGVISAVSQIGSTELAGWVGAYVDRKKIERNVKVLTALVDMHAKCGNIEQALSAFREIPQPDAYPYTALISGLATHGHEKLALSVFERMQVQAVKPDPITFVGVLTACSHTGLVDKGLEYWEAMVRDYGIVRRADHYACVIDMLGRAGRIEEAFEMVQTMPMGPHPGALGALLSACKTYENVEIAEIVANKLFELEPWNTGNYILLSNIYAGKELWEEAERVRSLMRTKLPFKNPGSTWFEDRQREHAKM

SEQ ID NO: 1713 - DNA, 1557 bp, Sorghum bicolor
  misc_feature: Ceres ANNOT ID no. 6016761
  misc_feature: Encodes the peptide sequence at SEQ ID NO 1714
atggcgctcccgaccatccctccccgcgccctcctcctcctcctcctcctctccgtcctcctcctcgcgcaccccgccgccggcgccggcaccggctcggagttcgacgacggcacctcgcccaagttccccggctgcgacaacacgctccagaaggtgaaagtgacgtactgggtggacggcgacgagcggagcagcctgacggggatcagcgcgaggttcggcgtggtcctgccggacgcggcgtccgacgaccagaagcagcgggccgtcgtgcccagccccaagaacggctgcgccaagtcgtccacgcagctcaccggctccgtcgccgtggcggtgcgcggggagtgcacgttcatcgagaaggccaaggcggccgaggccgctggcgccgtcgcgattctcctcgtcaacgacgaggacgacctgcagaggatggtctgctccgacaaggacccgcctcccaacatcggcatccccgtcgtcatggtctccaagtccgccggcgacaaggtccagtcggccatcgggaacggggccaaggtcgacatcctcatgtacgcgccgctgaagccgtccttcgatggcgccatacctttcctctggatgatggccgtcggcacggtggcctgcgcctcggtgtggaccgtcgccgtcgtcggagaagagcctaccaagccgggcgatgtttccctgggtggggaggagaacccggacgccgaggtggtggagctgcaaacccagacggcgctcgtgttcatcgtcacgtcctcgcttgtcctgctcttcctcttcttcttcaactccgtctggtccgcctggctcctggtttccctcttctgcctcggggctgtccatggaatggaattcgtggcatcatctctcattgtaagactctgccagcggtgtcgcgaggcgaaagcgaagcttcctgctatagggaacgtgaaggtggtcacgctagtcatgttgccgctagccttcatcttcgccttggcctgggttacgcaccagaactcaccgcttgcttgggttggtcagaacctcatgggcatctgcatgatgattctagtattgcaagtggtgcatatgccaaacataaaagttgcgacggcgctccttgtggcggcttttttctacgacatattctgggtcttcatatcacccctttttttcaagaaaagcgtcatgatcacagttgctcgtggcactgatgatgggccgagccttccaatggtgttgaagatgccaaaggaattcgattcgtggaatgggtatgacatgattggattcggggacattctcttcccaggactgcttgttgctttcagtttcagatttgacagaacacacggcaaagacttgacagacggctatttcctctgcctaatgatcggttatgcctttggcttgtcatgcacatatgttggcttgtacctaatgaaaagtggccagccagctctgctctaccttgttccttcaacactaggagttatcgttttgcttggagcgaagaggggggagctcggtcagctgtggaacgccaaggcgtaa

SEQ ID NO: 1714 - protein, 518 aa, Sorghum bicolor
  misc_feature: Ceres ANNOT ID no. 6016761
  misc_feature (238)..(518): Pfam Id: Peptidase_A22B Pfam Desc: Signal peptide peptidase
  misc_feature (67)..(177): Pfam Id: PA Pfam Desc: PA domain
  misc_feature (5)..(515): NCBI GI: 6850311 NCBI Desc: contains similarity to a vacuolar sorting receptor homolog from arabidopsis thaliana gbu79959
  misc_feature (13)..(514): NCBI GI: 16118854 NCBI Desc: growth-on protein gro11 [euphorbia esula]
  misc_feature (12)..(514): NCBI GI: 21554548 NCBI Desc: growth-on protein gro10 [arabidopsis thaliana]
  misc_feature (12)..(514): NCBI GI: 42571983 NCBI Desc: protease-associated (pa) domain-containing protein [arabidopsis thaliana]
  misc_feature (12)..(514): NCBI GI: 16118856 NCBI Desc: growth-on protein gro10 [euphorbia esula]
MALPTIPPRALLLLLLLSVLLLAHPAAGAGTGSEFDDGTSPKFPGCDNTLQKVKVTYWVDGDERSSLTGISARFGVVLPDAASDDQKQRAVVPSPKNGCAKSSTQLTGSVAVAVRGECTFIEKAKAAEAAGAVAILLVNDEDDLQRMVCSDKDPPPNIGIPVVMVSKSAGDKVQSAIGNGAKVDILMYAPLKPSFDGAIPFLWMMAVGTVACASVWTVAVVGEEPTKPGDVSLGGEENPDAEVVELQTQTALVFIVTSSLVLLFLFFFNSVWSAWLLVSLFCLGAVHGMEFVASSLIVRLCQRCREAKAKLPAIGNVKVVTLVMLPLAFIFALAWVTHQNSPLAWVGQNLMGICMMILVLQVVHMPNIKVATALLVAAFFYDIFWVFISPLFFKKSVMITVARGTDDGPSLPMVLKMPKEFDSWNGYDMIGFGDILFPGLLVAFSFRFDRTHGKDLTDGYFLCLMIGYAFGLSCTYVGLYLMKSGQPALLYLVPSTLGVIVLLGAKRGELGQLWNAKA

SEQ ID NO: 1715 - DNA, 468 bp, Sorghum bicolor
  misc_feature: Ceres ANNOT ID no. 6016765
  misc_feature: Encodes the peptide sequence at SEQ ID NO 1716
atggatcctcgtgcgctcggcgctggcatgctgctcgccgtcctgctcatggccgccaccgcggcggcgtccgcgcgccccgacgacgacgacgtagcgggcagcggggccggagccggcggcatacggcaaccggcgagcgacgggtaccgcgggaggaaggtgggggccaggacggaggtgcgggacgtggagagcgacggcgaggtgcaggagctcggccgcttctccgtcgccgagtacaaccgccagcttagaggcgacggcggcggcaggctcgagttcggcagggtggtggcggcgcagcggcaggtggtgtcggggctcaagtactacctccgcgtcgcggcggtggaggaaggtgcgcagaacgccggcggcgagcgcgcgttcgacgccgtcgtcgttgtcaagccctggctcgagtcgcgcaccctgctcacgttcgcgccggcggccgccaagtaa

SEQ ID NO: 1716 - protein, 155 aa, Sorghum bicolor
  misc_feature: Ceres ANNOT ID no. 6016765
  misc_feature (56)..(153): Pfam Id: Cystatin Pfam Desc: Cystatin domain
  misc_feature (3)..(153): NCBI GI: 75251118 NCBI Desc: cysteine proteinase inhibitor 4 precursor (oryzacystatin-4) (oryzacystatin iv) (oc-iv)
  misc_feature (5)..(154): NCBI GI: 109238645 NCBI Desc: cystatin hv-cpi5 [hordeum vulgare subsp. vulgare]
  misc_feature (10)..(153): NCBI GI: 115441813 NCBI Desc: os01g0915300 [oryza sativa (japonica cultivar-group)]
  misc_feature (10)..(153): NCBI GI: 125991832 NCBI Desc: cysteine proteinase inhibitor 5 precursor (oryzacystatin-5) (oryzacystatin v) (oc-v)
  misc_feature (46)..(155): NCBI GI: 27728729 NCBI Desc: cystatin [malus x domestica]
  misc_feature: The sequence is a functional homolog of SEQ ID NO. 303 in the 11/188,298 US application
MDPRALGAGMLLAVLLMAATAAASARPDDDDVAGSGAGAGGIRQPASDGYRGRKVGARTEVRDVESDGEVQELGRFSVAEYNRQLRGDGGGRLEFGRVVAAQRQVVSGLKYYLRVAAVEEGAQNAGGERAFDAVVVVKPWLESRTLLTFAPAAAK

SEQ ID NO: 1717 - DNA, 1440 bp, Sorghum bicolor
  misc_feature: Ceres ANNOT ID no. 6016768
  misc_feature: Encodes the peptide sequence at SEQ ID NO 1718
  misc_feature: Down-regulated in shoot tissues in response to salicylic acid treatment
atgaactgtgggccgcccgaccagctgccgccggcgtcggcgccggcgtgcttcctcaacctcaactgggaccagtccatggccgccgccacggccggcgaccacctcgacccggcgctcagctcgatggtctcctccccggcgtccaactcgacggccgccgcggcgactgacggcctcgctctccacgggatctcgccacagccgcagtacggaggcacccctctcagctcgccccccaagctcaacctctccatgatgggccagttccaccactacccgccgccgcaggtcggtggcgctgcgcccagcggcctgccaatcctcgagaacttgatgccgatggctcatctagaccagttcctcgccgacccaggcttcgccgagcgcgcggcgaggctctccggctttgacggccgccccggtggaagtggctatggcggcgccgtcccgggacagtttggcctcccggacgctgaccccatcgacgcattgaaggagctggagctcgggaacggccgggacgagtcatcggtgtccgatccggcgtccgccagcgcggagatggcgctcaaggggccttccgatggcaatgcaaagaaacgcaaggctagcggaaaggggaaaggcaaggacggccccgggtccaccgccgccaaggatctcgcgaaggaggaatccggtgggaagcggtgcaaatcggcggacgagagcaatggcgcggaggacaactccaccaagggcaaggccgcgcagagcaatagcgagaatggtggaaagaagcaggggaaggacagcacatcgaagcctcccgagccgcccaaggactacatccatgtccgggcgaggcgcggtgaggcgacagacagccacagcctcgcggagagggtgagaagggaaaagatcagccagcggatgaagctgctgcaggatcttgttccgggttgcaataaggtggttggcaaggcagtcatgctcgatgaaatcataaactacgtgcagtccttgcaacggcaagtcgagtttctgtccatgaaattggccactgtgaatccccagctggacttcaacaacctgcctaacctccttcctaaagatatacaccagtcctgtggcccgctgcagaactcgcatttcccgctggagacctcaggtgcaccgctgccataccttaaccagcctcaccaggggaaccctctaggttgcagcctaaccggcatggacagccagagttctatgcacccacttgacccggcattttgccggccaatgaattcgcaacatcctttcctcaacggtgttagtgatgctgcatctcaggtcgggactttctggcaagacgaccttcaaagcgtagttcacatggatatcgggcaaagtcaggagatcgctcccacctcttcgaatagctacaacgtccacatgaaaatggagctttga

SEQ ID NO: 1718 - protein, 479 aa, Sorghum bicolor
  misc_feature: Ceres ANNOT ID no. 6016768
  misc_feature (287)..(337): Pfam Id: HLH Pfam Desc: Helix-loop-helix DNA-binding domain
  misc_feature (206)..(409): NCBI GI: 46367684 NCBI Desc: ta1 protein [oryza sativa (japonica cultivar-group)]
  misc_feature (118)..(478): NCBI GI: 29647487 NCBI Desc: bhlh transcription factor(gbof-1)-like [oryza sativa (japonica cultivar-group)]
  misc_feature (21)..(440): NCBI GI: 115485347 NCBI Desc: os11g0442500 [oryza sativa (japonica cultivar-group)]
  misc_feature (118)..(436): NCBI GI: 50726625 NCBI Desc: ta1 protein-like [oryza sativa (japonica cultivar-group)]
  misc_feature (212)..(443): NCBI GI: 57834129 NCBI Desc: osjnba0038p21.14 [oryza sativa (japonica cultivar-group)]
  misc_feature: The sequence is a functional homolog of SEQ ID NO 1929 in the 10/374,780US patent application
  misc_feature: The sequence is a functional homolog of SEQ ID NO 1930 in the 10/374,780US patent application
  misc_feature: The sequence is a functional homolog of SEQ ID NO 198 in the 10/714,887US patent application
  misc_feature: The sequence is a functional homolog of SEQ ID NO 198 in the 11/435,388US patent application
  misc_feature: Useful for making plants with altered Lignin content
  misc_feature: Useful for making plants with modulated growth and phenotype characteristics
  misc_feature: Functional homolog of the protein sequence given in SEQ ID NO 13280
  misc_feature: The sequence is a functional homolog of SEQ ID NO 198 in the 20060015972 US patent application
  misc_feature: The sequence is a functional homolog of SEQ ID NO 1929 in the 20060162006 US patent application
  misc_feature: The sequence is a functional homolog of SEQ ID NO 1930 in the 20060162006 US patent application
  misc_feature: Useful for making plants with altered lignin content
  misc_feature: Functional homolog of the protein sequence given in SEQ ID NO 13755
  misc_feature: The sequence is a functional homolog of SEQ ID NO 1929 in the 10/374,780 US patent application
  misc_feature: The sequence is a functional homolog of SEQ ID NO 1930 in the 10/374,780 US patent application
  misc_feature: Useful for making plants with modulated biomass
  misc_feature: Functional homolog of the protein sequence given in SEQ ID NO 13025
  misc_feature: Down-regulated in shoot tissues in response to salicylic acid treatment
  misc_feature: The sequence is a functional homolog of SEQ ID NO. 414 in the 11/188,298 US application
MNCGPPDQLPPASAPACFLNLNWDQSMAAATAGDHLDPALSSMVSSPASNSTAAAATDGLALHGISPQPQYGGTPLSSPPKLNLSMMGQFHHYPPPQVGGAAPSGLPILENLMPMAHLDQFLADPGFAERAARLSGFDGRPGGSGYGGAVPGQFGLPDADPIDALKELELGNGRDESSVSDPASASAEMALKGPSDGNAKKRKASGKGKGKDGPGSTAAKDLAKEESGGKRCKSADESNGAEDNSTKGKAAQSNSENGGKKQGKDSTSKPPEPPKDYIHVRARRGEATDSHSLAERVRREKISQRMKLLQDLVPGCNKVVGKAVMLDEIINYVQSLQRQVEFLSMKLATVNPQLDFNNLPNLLPKDIHQSCGPLQNSHFPLETSGAPLPYLNQPHQGNPLGCSLTGMDSQSSMHPLDPAFCRPMNSQHPFLNGVSDAASQVGTFWQDDLQSVVHMDIGQSQEIAPTSSNSYNVHMKMEL

SEQ ID NO: 1719 - DNA, 468 bp, Sorghum bicolor
  misc_feature: Ceres ANNOT ID no. 6016771
  misc_feature: Encodes the peptide sequence at SEQ ID NO 1720
atggggaagaagcggcagctgatctgcctcgcggccgctgtcgccgccgcggccatcctcctgacagcgtcggccaagaagtccggcgatgtcaccgagcttcagatcggcgtcaagtacaagcctgagtcatgtaccctgcaagcacacaaaggagacaaaattaaagttcattatcgtggggcactcactgatggatcggtttttgattctagctacgacagaggtgacccgtttgaatttactcttggaaatggccaagtgataaaaggttgggaccaaggattgctaggtatgtgcgtcggtgaaaagcggaagctaaagatacctgcaaagatgggttatggtgagcgaggctccccaccgaagattccaggtggagcaactctgatcttcgacactgagcttatcgccgtcaacggaaagacatctggcggtgcaaagacagaaagtgatagcgagctctaa

SEQ ID NO: 1720 - protein, 155 aa, Sorghum bicolor
  misc_feature: Ceres ANNOT ID no. 6016771
  misc_feature (43)..(137): Pfam Id: FKBP_C Pfam Desc: FKBP-type peptidyl-prolyl cis-trans isomerase
  misc_feature (19)..(152): NCBI GI: 2129622 NCBI Desc: probable peptidylprolyl isomerase (ec 5.2.1.8) fkbp15-1 - arabidopsis thaliana
  misc_feature (19)..(152): NCBI GI: 22136164 NCBI Desc: immunophilin [arabidopsis thaliana]
  misc_feature (19)..(152): NCBI GI: 21593622 NCBI Desc: immunophilin (fkbp15-1) [arabidopsis thaliana]
  misc_feature (19)..(154): NCBI GI: 1272408 NCBI Desc: immunophilin
  misc_feature (14)..(155): NCBI GI: 23396588 NCBI Desc: fk506-binding protein 2 precursor (peptidyl-prolyl cis-trans isomerase) (ppiase) (rotamase) (15 kda fkbp) (fkbp-15)
  misc_feature (19)..(152): SWISSPROT Homolog: EC 5.2.1.8 FK506-binding protein 2-1 precursor
MGKKRQLICLAAAVAAAAILLTASAKKSGDVTELQIGVKYKPESCTLQAHKGDKIKVHYRGALTDGSVFDSSYDRGDPFEFTLGNGQVIKGWDQGLLGMCVGEKRKLKIPAKMGYGERGSPPKIPGGATLIFDTELIAVNGKTSGGAKTESDSEL

SEQ ID NO: 1721 - DNA, 699 bp, Sorghum bicolor
  misc_feature: Ceres ANNOT ID no. 6016772
  misc_feature: Encodes the peptide sequence at SEQ ID NO 1722
atgtctgctgtgggtaccagggatcgacgatgtggaacagcagatcgaacttcgccggcgggcaggacaacggcagcgaccggcggcgggaagaaacgcgggtcctcgaggctgaagaagagcagcggcagcaagaaagacgccgacgctgccgccgaggacgactaccccaggtacggcaccaacaacaccagcggcggtggtggcaaagacgaggccggcggcgacaaccgctacaaccacatgaacagcaacggcgtcggtaccgacgacgactacaacggcggtggcaaccaccaccactacagcggcggcggcgtagtgggctccccctactacggcggcggcggcgcaggcggatacggcaacagctctccctactacggcggtggcggatacggcaacagctctccctacggcggcggatacggcaacagcgctccccacggcaccggcggcgacgcaccgccgtacaacaacgctccgcccgccttctgggctccccaggacggtgcgaggtcgccgttgtacatcaacaccagggcggtgcacgtgtacggcgctcctggtggtgggtacgacaacgatagcaacaacgacgaccaccagaggaggagaggcggcgggttcttcggcccggcgttccaagccgtcggccacttcttcgaccgcaagttcggtttcaacgacagggactga

SEQ ID NO: 1722 - protein, 232 aa, Sorghum bicolor
  misc_feature: Ceres ANNOT ID no. 6016772
  misc_feature (3)..(229): NCBI GI: 19386747 NCBI Desc: p0413c03.3 [oryza sativa (japonica cultivar-group)]
  misc_feature (17)..(187): NCBI GI: 115441823 NCBI Desc: os01g0916100 [oryza sativa (japonica cultivar-group)]
  misc_feature (56)..(214): NCBI GI: 3893085 NCBI Desc: glycine-rich protein 2 [cicer arietinum]
  misc_feature (85)..(220): NCBI GI: 295808 NCBI Desc: glycine-rich protein [hordeum vulgare subsp. vulgare]
  misc_feature (85)..(220): NCBI GI: 121644 NCBI Desc: glycine-rich cell wall structural protein precursor
MSAVGTRDRRCGTADRTSPAGRTTAATGGGKKRGSSRLKKSSGSKKDADAAAEDDYPRYGTNNTSGGGGKDEAGGDNRYNHMNSNGVGTDDDYNGGGNHHHYSGGGVVGSPYYGGGGAGGYGNSSPYYGGGGYGNSSPYGGGYGNSAPHGTGGDAPPYNNAPPAFWAPQDGARSPLYINTRAVHVYGAPGGGYDNDSNNDDHQRRRGGGFFGPAFQAVGHFFDRKFGFNDRD

SEQ ID NO: 1723 - DNA, 2910 bp, Sorghum bicolor
  misc_feature: Ceres ANNOT ID no. 6016774
  misc_feature: Encodes the peptide sequence at SEQ ID NO 1724
atggagcagctgcggacgatcgggcgggagctggcgatggggtcacagggcgggtgggggcagtccaaggagttcctcgacctcgtcaagtccattggcgaggcgcgctccaaggcggaggaggaccgcatcatcgcgcgcgagctcgagcacctcaagcgccgccttgcggaccccgacgtgccacgccgcaagatgaaggagctcctcctccgcctcgtctacgccgagatgctcggccacgatgcctccttcggccacatccatgccgtcaagatgacccacgacgaatcgctcccgctcaaacgaaccggctacctcgccgtcgcgcttttcctcgatgagcgccacgaccttgtcatcctcgtggtcaacaccatccagaaggacctcaggtcggacaactacctcgtcgtctgcgcagcgctcaccgccgcgtgccgcctcatcggtgaggaggccatccctgccgtgctgccccaggtcgtagagctgctcgcgcaccccaaggaggctgtgaggaagaaggccgtcatggcactacaccggttctaccagcgatcaccctcctccgtctcccaccttgtctccaacttccggaagaggctctgtgataatgatcccggggtgatgggtgcaactctatgccccctctatgacctgattttggaggaaccaaattcgtacaaggatttagttgttagttttgttaacatcctaaaacaagttgcggagaggaggcttccgacttcctatgattatcaccaaatgcccgcaccgtttattcagataaaactattgaagatacttgctgtgcttggtagtggtgataaacaagcaagtgggcatatgtacaccgtattgggtgacatattcaggaagggtgacactgcgagcaacattggcaatgctatactgtatgaatgcatatgctgtatttcatccattttcccaaaccctaagatgctagaggctgcagcagaaacaacatcaaagtttctgaagagtgatagtcataatcttaagtacatgggcattgatgctcttggccggctaataaaaataaatccagatattgcagaagagcaccagctggctgtcattgattgcttagaggacccagatgatactttgaagcgcaagacctttgagcttctttataagatgacaaagtcaacaaatgttgaagtgattgttgataggatgattgagtacatgatcaatataactgatcatcattacaagacagaaattgcatcacgttgtgttgaacttgcagagcaatttgcgcctagcaatcagtggttcatccagaccatgaacaaagtctttgagcatgctggagatcttgtcaacatcagagtggcacacaatttgatgcggctaattgctgaaggctttggagaggaggatgaaggtgctgacagtcagctaagatcatcggctgtagattcctatctccgcattgtcggagagccaaagcttccttcttcgttcctgcagataatatgctgggttttgggggaatatggaacagcagatggaaaatattctgcatcttatattatcgggaagttgtgtgatgtggcagaggcccacctcactgatgacactgtcaaggcgtatgcgatctcagcaattctgaagatatttgcgtttgaaatcgcacttggaaggaagattgatttgctgcctgagtgtcaaacactggtagatgaattgtcagcttcacattcaacagacttgcagcaacgtgcatatgagctacaggctttactaggcttggacaaaaatgctgttgaaagtgttatgcctgcagatgcaagttgtgaagatattgaggtcgacagaaacctctcatttctaaacagttatgtgcagcaagccttggaaaatggtgcgtccccttacattccagagagtgaacgctctggtgttataagtgttggcagctacagaagccaagaacaacaggaaacatctgcccatactcttagatttgaggcctatgagatgcctaaaccttcgttgccactagcaacttcacaaacaagcatttccacaccaactactgacctggttccagttccagagacaggctactataaggaagaccatcaaacatcaaggtctcaaccaccaggtgatgcagtttctggtgagtttggtgtcaaacttcgccttgatggggttcaaaagaaatggggaaggccaacatattcctcttctacaccctcaagctcgacgtctagtcaacaaactaccaatgggacctctcattccgatgggggagggtcaagttcgcagccacgggagtcctcgtatggttctaagagacagcagggcacagaagtttcagcagaaaagcaacggctggctgcttcactttttggttcggcagcagctaaagctgataggaaagcacaagcttctagaaagacagcaaaggacagtccctcaactgagaaagtagctaccactaatgtgactgcccagcctgttaaggagcaagtaatccctgctgcaccaccgcctgatctgctggatctgggtgatgagccagtttcatcaaatcctccattggctgatcctttctcacagttagaggggcttcttggaccagcatcggctgctccggtgctttctggaactccggctaccggcgcttccaaagcaccagatctgatgtcaatcttctcagatgatgtaccaactggagtggctagtggatccaccgatcccactctaggtgatgttaattcgacgagctcccacaaaggagcaactgcagtggcttcaaagaagggtccaagccttcaagatgccttgcaaaaggatgctactgcacggcaagtaggcgtgacaccaacagggaacaatcccaatctcttcaaggacttgctaggctaa

SEQ ID NO: 1724 - protein, 969 aa, Sorghum bicolor
  misc_feature: Ceres ANNOT ID no. 6016774
  misc_feature (41)..(597): Pfam Id: Adaptin_N Pfam Desc: Adaptin N terminal region
  misc_feature (152)..(188): Pfam Id: HEAT Pfam Desc: HEAT repeat
  misc_feature (1)..(969): NCBI GI: 144925047 NCBI Desc: adaptin, n-terminal [medicago truncatula]
  misc_feature (13)..(465): NCBI GI: 82914855 NCBI Desc: epsilon-adaptin [plasmodium yoelii yoelii str. 17xnl]
  misc_feature (28)..(643): NCBI GI: 5689377 NCBI Desc: epsilon-adaptin [homo sapiens]
  misc_feature (28)..(643): NCBI GI: 37675283 NCBI Desc: adaptor-related protein complex 4, epsilon 1 subunit [homo sapiens]
  misc_feature (28)..(643): NCBI GI: 6960319 NCBI Desc: adaptor-related protein complex ap-4 epsilon subunit [homo sapiens]
MEQLRTIGRELAMGSQGGWGQSKEFLDLVKSIGEARSKAEEDRIIARELEHLKRRLADPDVPRRKMKELLLRLVYAEMLGHDASFGHIHAVKMTHDESLPLKRTGYLAVALFLDERHDLVILVVNTIQKDLRSDNYLVVCAALTAACRLIGEEAIPAVLPQVVELLAHPKEAVRKKAVMALHRFYQRSPSSVSHLVSNFRKRLCDNDPGVMGATLCPLYDLILEEPNSYKDLVVSFVNILKQVAERRLPTSYDYHQMPAPFIQIKLLKILAVLGSGDKQASGHMYTVLGDIFRKGDTASNIGNAILYECICCISSIFPNPKMLEAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLCDVAEAHLTDDTVKAYAISAILKIFAFEIALGRKIDLLPECQTLVDELSASHSTDLQQRAYELQALLGLDKNAVESVMPADASCEDIEVDRNLSFLNSYVQQALENGASPYIPESERSGVISVGSYRSQEQQETSAHTLRFEAYEMPKPSLPLATSQTSISTPTTDLVPVPETGYYKEDHQTSRSQPPGDAVSGEFGVKLRLDGVQKKWGRPTYSSSTPSSSTSSQQTTNGTSHSDGGGSSSQPRESSYGSKRQQGTEVSAEKQRLAASLFGSAAAKADRKAQASRKTAKDSPSTEKVATTNVTAQPVKEQVIPAAPPPDLLDLGDEPVSSNPPLADPFSQLEGLLGPASAAPVLSGTPATGASKAPDLMSIFSDDVPTGVASGSTDPTLGDVNSTSSHKGATAVASKKGPSLQDALQKDATARQVGVTPTGNNPNLFKDLLG

SEQ ID NO: 1725 - DNA, 1473 bp, Sorghum bicolor
  misc_feature: Ceres ANNOT ID no. 6016775
  misc_feature: Encodes the peptide sequence at SEQ ID NO 1726
atggacaacactcagaatcaaccactaccacctggtgttggtacatggccgcaggctcctcccagtcacccaccacaatgcgatgctgatccgcagtcttatcatccacaatttgacactagacctgacaatgctagtgccaatagtagtggtagtgcagcaaacattgagtcagctgtccaggaggctgttcttcacgcacaggacattgagacccagcaagtcatacagaatcaaagacatgcaaacacaacaagtgaacctacaacatatggagaagacttactatcgaaccgccgtgaccctagtgcgttgaaggagcacttactaaagatgacagctgatcatcgtgcagagatggcaagcaaaagggggaagccacttcatccaaacaatggcaattatgaaattggcaatggctatggtgtaccaggaggtggtgcttattatgctgcaaacttgccaagtgctcaaatgaataaacctagagatgaaactgataaagcaaaatgtgcaaacgatctccctgattttttgaagcagaggttaagggcaaggggaattctcaaagatgagacagcaaataagaacaacatgagtacacagaccgtggattctcaacaaagccagaacaaatctgcgcaagagttgcctcatggttgggttgaagcaaaggacctgacaactggtgcaccttacttctacaatcaaagcaccggagttagtcaatgggatcgccctggcagtgttgtgaataccatgcaacatcaagtttctccatccttgccagagaactgggaggaggcaattgacaaatcaacaggccacaaatactattataatacgaagacacagaccacacagtgggaacctccttctgtgagcaccagtgttacacctccagcttccaccaacactgcaattgagccagtcgctcaaactgcagatatttggaactctcaaatgcagagatgtctgggctgtggcggatgggggattggtcttgtccagccttggggatactgcaatcactgcacaagggttcaaaatcttccttttcaacagtatccatcttacacaagtaatacgatgcacgccagtggtaacaatgctcccaaaactcaggggaatgtttcagctaaggacagatcaagctcaaaaccgcccttagggaaaccaaacagaaaagatcaccgcaaaaggaaccgccccgaggacgatgagcttgacccaatggacccaagttcttactcagacgctccacgcggtggctgggttgttggtttgaagggtgttcaaccacgagcagcagatactaccgcagctggacctttgttccagcaaagaccatatccctcaccaggtgctgtgttgagaaaaaatgcagaggtagcaacccatggcaagaaacgtggtatggctccgataacaaaaagaggagatggcagcgatggacttggggaggcagattag

SEQ ID NO: 1726 - protein, 490 aa, Sorghum bicolor
  misc_feature: Ceres ANNOT ID no. 6016775
  misc_feature (217)..(247): Pfam Id: WW Pfam Desc: WW domain
  misc_feature (262)..(292): Pfam Id: WW Pfam Desc: WW domain
  misc_feature (1)..(490): NCBI GI: 115441827 NCBI Desc: os01g0916300 [oryza sativa (japonica cultivar-group)]
  misc_feature (55)..(372): NCBI GI: 42571161 NCBI Desc: ww domain-containing protein [arabidopsis thaliana]
  misc_feature (369)..(465): NCBI GI: 119571121 NCBI Desc: polyglutamine binding protein 1, isoform cra_b [homo sapiens]
  misc_feature (369)..(465): NCBI GI: 67508863 NCBI Desc: polyglutamine binding protein variant 2 [homo sapiens]
  misc_feature (369)..(465): NCBI GI: 15214469 NCBI Desc: pqbp1 protein [homo sapiens]
MDNTQNQPLPPGVGTWPQAPPSHPPQCDADPQSYHPQFDTRPDNASANSSGSAANIESAVQEAVLHAQDIETQQVIQNQRHANTTSEPTTYGEDLLSNRRDPSALKEHLLKMTADHRAEMASKRGKPLHPNNGNYEIGNGYGVPGGGAYYAANLPSAQMNKPRDETDKAKCANDLPDFLKQRLRARGILKDETANKNNMSTQTVDSQQSQNKSAQELPHGWVEAKDLTTGAPYFYNQSTGVSQWDRPGSVVNTMQHQVSPSLPENWEEAIDKSTGHKYYYNTKTQTTQWEPPSVSTSVTPPASTNTAIEPVAQTADIWNSQMQRCLGCGGWGIGLVQPWGYCNHCTRVQNLPFQQYPSYTSNTMHASGNNAPKTQGNVSAKDRSSSKPPLGKPNRKDHRKRNRPEDDELDPMDPSSYSDAPRGGWVVGLKGVQPRAADTTAAGPLFQQRPYPSPGAVLRKNAEVATHGKKRGMAPITKRGDGSDGLGEAD

SEQ ID NO: 1727 - DNA, 1461 bp, Sorghum bicolor
  misc_feature: Ceres ANNOT ID no. 6016776
  misc_feature: Encodes the peptide sequence at SEQ ID NO 1728
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
atggctggagcagcggtggcggcggccaacggaggggcgtgctgccacgctgccaaggggcccgggtacgccacgccgctggaggccatggagaagggacccagggagaagctcgtctacgtcacctgcgtctacaacggtactggaattaacaagccggattaccttgcgacggtggatttggatcccgactcccccacatactcccaggtgatccacaggctcccggtcacccacatcggcgatgagctgcatcactctggatggaactcctgcagctcctgccacggcgatccatcagccaagcgccgcttcctgatcctaccttcgctgttgtcaggtcgtgtgtatgttgttgacacagcgacagacccgagggcgccatccttgcataaggtggttgagtctgaggacattgctgagaagactgggcttgggtttcctcacacgtcccattgccttgcatctggcgacattatgatttcttgccttggggacaaggaggggaacgcagctggcaatggcttcctgctgttagattcagagtttaatgttaaagggcgttgggaaaagccaggtcacagtcccttgtttggatatgacttctggtaccagcctcgccacaagacgatgatcagttcgtcatggggagcccctgcagcattcaggacaggtttcaaccttcaacatgtccaggatggcctgtacggaaggcatctgcacgtatacgactggcctggtggtgagctcaagcagacacttgatctaggtgacactggacttcttccccttgaggtgaggtttttacatgatccatcaaaggacactggctatgttggctgtgctttgacaagcaacatggtgagatttttcaagaccgcggatggatcatggagccatgaggttgctatctctgtgaaaccattgaaggtccggaactggattctgccagaaatgccaggattgataactgatttcgttctctctcttgacgaccgttatctgtacttggtaaattggcttcatggcgatatcaggcagtacaacattgaggatcctgcaaaacctttcttggctggacaagtatgggttggtggtcttcttcaaaagggcagtgatgtcgtctatgtcactgatgatggtcaagaagaacagtataatgtgcctcaagtcaagggtcatcgacttagaggtggaccgcagatgattcaactgagcttggatggcaagaggatatacgtgaccaactcacttttcagccgttgggatgagcagttctttggggatgattttgtcaagaagggctcccacatgttgcagatcgatgtcgacaccgagaaaggagggctggctatcaaccccaacttcttcgtagattttggcaccgagcctgatggtcctgccctggcccatgagatgagatatcctggtggggactgcacctctgatatatggatctga

SEQ ID NO: 1728 - protein, 486 aa, Sorghum bicolor
  misc_feature: Ceres ANNOT ID no. 6016776
  misc_feature (17)..(486): Pfam Id: SBP56 Pfam Desc: 56kDa selenium binding protein (SBP56)
  misc_feature (10)..(486): NCBI GI: 15485720 NCBI Desc: selenium binding protein [medicago sativa]
  misc_feature (8)..(486): NCBI GI: 15485718 NCBI Desc: selenium binding protein [lotus corniculatus var. japonicus]
  misc_feature (5)..(486): NCBI GI: 22137196 NCBI Desc: at4g14040/dl3061c [arabidopsis thaliana]
  misc_feature (5)..(486): NCBI GI: 23198396 NCBI Desc: selenium-binding protein-like protein [arabidopsis thaliana]
  misc_feature (20)..(486): NCBI GI: 15485722 NCBI Desc: selenium binding protein [glycine max]
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
MAGAAVAAANGGACCHAAKGPGYATPLEAMEKGPREKLVYVTCVYNGTGINKPDYLATVDLDPDSPTYSQVIHRLPVTHIGDELHHSGWNSCSSCHGDPSAKRRFLILPSLLSGRVYVVDTATDPRAPSLHKVVESEDIAEKTGLGFPHTSHCLASGDIMISCLGDKEGNAAGNGFLLLDSEFNVKGRWEKPGHSPLFGYDFWYQPRHKTMISSSWGAPAAFRTGFNLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVLSLDDRYLYLVNWLHGDIRQYNIEDPAKPFLAGQVWVGGLLQKGSDVVYVTDDGQEEQYNVPQVKGHRLRGGPQMIQLSLDGKRIYVTNSLFSRWDEQFFGDDFVKKGSHMLQIDVDTEKGGLAINPNFFVDFGTEPDGPALAHEMRYPGGDCTSDIWI

SEQ ID NO: 1729 - DNA, 1791 bp, Sorghum bicolor
  misc_feature: Ceres ANNOT ID no. 6016795
  misc_feature: Encodes the peptide sequence at SEQ ID NO 1730
atgtccatgccgcaatccgtcctcctcctcccctcctttttacccccagctcccctcgttcgcgtcgcctcgcggccgccgtcgtcgccatccctcaccgccctcagattccaccgcgtcgacgccaagctttccccaccactcctcgcggcatgccacggtcctcccggcggcttccgtggttatggtgactccggcggcagcgatggaggtgatggaggaagcggaggtggtggcgggagaggaatggattctcctgaacccggagacgggtggtggcggcggtggttccaggcccttcacccggagttccttctcctgttcctgctcctccagtccggcgccgcgtccgcactcgctgaggcactcggcaactccggagatgacgcggggggcgtgtgggaggtgaggggcggcacgcgcactcgccttgtgccggactcaacctggacctcctatctcatcgctggggacgacggatcgaagcgggaggacgaggatggaaaggtgggagacggccctgagggcctagccgccctgcggaggcagctggggcggtcgtggcggcggtgcgccgatgttgctgtccagctgctgctccccgacggataccctcatagcgtcagcagcgactacatgaactactcgctctggcgcggcgttcagggcgtggcgagccaaatcagcggggtactttccacgcaggctctgctctatgcggttgggttagggagaggagcgatacccactgctgctgcggtgaattgggtcctgaaagatggcctcgggtaccttagcaagatcatgttgtccaaatttggacgccattttgatgttaaccccaaagggtggcggctatttgctgattttctggagaatatggcttatgggctggagattctgactccagtgttccctcacctgtttgttccaattggggcggctgctggtgctagtcgctcagcagcttctttgatacaggctgccacgagaagttgcttttatgctggatttgcagtacaaagaaactttgctgaggttattgcaaagggtgaagcgcaaggaatggttagcaaatttgttggcatagggcttggcattgcgttggctaatcagattggctcatctgtaccattagctcttatttcgtttgctggaattactgcagttcacatgtattgcaatctcaagtcgtatcaatcaattcagctcagaacactgaatccttaccgtgcaagcttggtgtttagtgaatatctgttaagtggacaagttccatcagtcaaagaagttaatgatgaggaacctcttttcttcaatctgtcgcttggcgcttcatgtcaacaaagcaagattttgtcagcggaagcaaaagatgctgcggatagaatatgccggcggttacaaatgggttctaagcttagtgaaataattgagagtaaagaagatgcttgtgcattgtttgatctttacaaaaatgagcaatatctgcttatggattacaagggaaaattttgtattgtacttaaagagggatcttctccagaagacatgctcaaatctttgttccatgttaactatctgtattggctggaaaggtatatgggtttcaaaccaagtaatgttgcctcagagtgtagacctggtggaaggcttgaagtatccctggattatgctcagagagaattcagccatgtcaaacatgatggttctgatggtggctgggttatggatggtctgattgcaaggcccttgcccgttagaatacgaataggagatggtgctccttag

SEQ ID NO: 1730 - protein, 596 aa, Sorghum bicolor
  misc_feature: Ceres ANNOT ID no. 6016795
  misc_feature (1)..(596): NCBI GI: 38344695 NCBI Desc: osjnbb0096e05.17 [oryza sativa (japonica cultivar-group)]
  misc_feature (199)..(438): NCBI GI: 115463943 NCBI Desc: os05g0419200 [oryza sativa (japonica cultivar-group)]
  misc_feature (203)..(524): NCBI GI: 8920582 NCBI Desc: contains similarity to cg10338 gene product from drosophila melanogaster gbae003660. [arabidopsis thaliana]
  misc_feature (193)..(439): NCBI GI: 115459438 NCBI Desc: os04g0517300 [oryza sativa (japonica cultivar-group)]
  misc_feature (193)..(439): NCBI GI: 116310213 NCBI Desc: osigba0145m07.5 [oryza sativa (indica cultivar-group)]
  misc_feature: Useful for making plants with altered terpenoid content
  misc_feature: GREAT-hit functional homolog of the protein sequence given in SEQ ID NO 13311
MSMPQSVLLLPSFLPPAPLVRVASRPPSSPSLTALRFHRVDAKLSPPLLAACHGPPGGFRGYGDSGGSDGGDGGSGGGGGRGMDSPEPGDGWWRRWFQALHPEFLLLFLLLQSGAASALAEALGNSGDDAGGVWEVRGGTRTRLVPDSTWTSYLIAGDDGSKREDEDGKVGDGPEGLAALRRQLGRSWRRCADVAVQLLLPDGYPHSVSSDYMNYSLWRGVQGVASQISGVLSTQALLYAVGLGRGAIPTAAAVNWVLKDGLGYLSKIMLSKFGRHFDVNPKGWRLFADFLENMAYGLEILTPVFPHLFVPIGAAAGASRSAASLIQAATRSCFYAGFAVQRNFAEVIAKGEAQGMVSKFVGIGLGIALANQIGSSVPLALISFAGITAVHMYCNLKSYQSIQLRTLNPYRASLVFSEYLLSGQVPSVKEVNDEEPLFFNLSLGASCQQSKILSAEAKDAADRICRRLQMGSKLSEIIESKEDACALFDLYKNEQYLLMDYKGKFCIVLKEGSSPEDMLKSLFHVNYLYWLERYMGFKPSNVASECRPGGRLEVSLDYAQREFSHVKHDGSDGGWVMDGLIARPLPVRIRIGDGAP

SEQ ID NO: 1731 - DNA, 1728 bp, Sorghum bicolor
  misc_feature: Ceres ANNOT ID no. 6016797
  misc_feature: Encodes the peptide sequence at SEQ ID NO 1732
atggcggtggcagtggcagtggacgtcgctgctccagcagcgctacagaatagtactgcggctcctgctgagaacggggacgtcgctgctgcgggcgcggcagagaatggtactgcggcttccgctgcgaacggggacggcggcggctcggagctgctcggcggtccacgctggacggggctgcaccttttcgtgatgaacatccggagcgtgttcaagctggacgagctcggcgcggaggtgctgggcatcgcggtgccggcgtcgctggcgctgacggccgacccgctcgcctcgctgatcgacacggccttcatcggccggctggggtccgtggagatcgcggccgtgggcgtcgccatcgcggtgttcaaccaggtcatgaaggtgtgcatctacccgctcgtcagcgtcaccacgtcgttcgtcgcggaggaggacgccgtgctcagcaaaggcggcgccaaggtcatcgacaacggagaagaagaagaagaattagaagcgggacaagttggcccggagaagcacactgccgctgccggcgcggacccggagaagcagcagcagccagctgatgaagaagccgccaagaacggcggcgagggatgcgcccctgccgtcgtcgccggccggagtagcggcaagaaatcagggaacaggaggttcgtgccgtccgtgacgtcggcactgatcgtgggcgcgctcctggggctgttccagaccgtcttcctcgtcgccgccgggaagccgctgctgcgcctcatgggcgtcaagccgggttcgcccatggtgatgcccgcgctgcgctacctgacgctgcgcgcgcttggcgccccggccgtgctgctgtctctcgccatgcaaggagtcttccgtgggttcaaggacgccaagacgcccttatacgccatcgtggccggcgacgcggcgaacattgtgctggatccgatcctgatatttggctgccgcctgggcgtgatcggcgcagccattgcccatgttctttcccagtacctgataacgctgataatgctgagcaagctggtgaggaaggtcgatgtcgtcccgcccagcctgaaatgcctcaaattccggcgcttcctcggatgcggattccttctgctggcacgggtggtggccgtgacgttctgcgtgacgctggcggcgtcgctggctgctcgccacgggccgaccgccatggccgccttccagatctgcacccaggtctggctggccacgtccctcctcgccgacgggctcgccgtcgccggccaggccatgatcgcgagcgccttcgccaaggaggaccgctacaaggtggccgccaccgccgcgcgcgtcctgcagctcggcgtcgtcctgggcgccgccctcacggcgctcctcggactcgggctgcagttcggagccggcgtcttcaccagcgacgccgccgtcatcaagaccatccggaagggcgttccgttcgtcgccggcacgcagacgctcaacacgctagccttcgtcttcgacggcatcaacttcggcgcgtcggactacgccttctctgcctactccatgatcggcgtggcggctgtcagcatcccgtcgctcatcttcctctcgtcgcacggcggcttcgtcggcatctgggtagccctcaccatctacatgggcgtcagggcccttgccagcacctggaggatggcagcagcccaggggccatggaagtttcttcggcagtga

SEQ ID NO: 1732 - protein, 575 aa, Sorghum bicolor
  misc_feature: Ceres ANNOT ID no. 6016797
  misc_feature (87)..(318): Pfam Id: MatE Pfam Desc: MatE
  misc_feature (375)..(534): Pfam Id: MatE Pfam Desc: MatE
  misc_feature (28)..(575): NCBI GI: 57899840 NCBI Desc: mate efflux family protein-like [oryza sativa (japonica cultivar-group)]
  misc_feature (56)..(574): NCBI GI: 42571819 NCBI Desc: mate efflux family protein [arabidopsis thaliana]
  misc_feature (221)..(574): NCBI GI: 140057542 NCBI Desc: ribosomal protein s2; multi antimicrobial extrusion protein mate [medicago truncatula]
  misc_feature (61)..(574): NCBI GI: 42562670 NCBI Desc: mate efflux family protein [arabidopsis thaliana]
  misc_feature (4)..(575): NCBI GI: 115451571 NCBI Desc: os03g0216700 [oryza sativa (japonica cultivar-group)]
MAVAVAVDVAAPAALQNSTAAPAENGDVAAAGAAENGTAASAANGDGGGSELLGGPRWTGLHLFVMNIRSVFKLDELGAEVLGIAVPASLALTADPLASLIDTAFIGRLGSVEIAAVGVAIAVFNQVMKVCIYPLVSVTTSFVAEEDAVLSKGGAKVIDNGEEEEELEAGQVGPEKHTAAAGADPEKQQQPADEEAAKNGGEGCAPAVVAGRSSGKKSGNRRFVPSVTSALIVGALLGLFQTVFLVAAGKPLLRLMGVKPGSPMVMPALRYLTLRALGAPAVLLSLAMQGVFRGFKDAKTPLYAIVAGDAANIVLDPILIFGCRLGVIGAAIAHVLSQYLITLIMLSKLVRKVDVVPPSLKCLKFRRFLGCGFLLLARVVAVTFCVTLAASLAARHGPTAMAAFQICTQVWLATSLLADGLAVAGQAMIASAFAKEDRYKVAATAARVLQLGVVLGAALTALLGLGLQFGAGVFTSDAAVIKTIRKGVPFVAGTQTLNTLAFVFDGINFGASDYAFSAYSMIGVAAVSIPSLIFLSSHGGFVGIWVALTIYMGVRALASTWRMAAAQGPWKFLRQ

SEQ ID NO: 1733 - DNA, 1221 bp, Sorghum bicolor
  misc_feature: Ceres ANNOT ID no. 6016803
  misc_feature: Encodes the peptide sequence at SEQ ID NO 1734
atgggtctcatctccaacgatgcgtggcacaaacggttcttcagcgttgcgccgcccgcggcgctggtcttcttcttcgtgctgatattcgtcgccggtgcaattgtcacgctcgatcataaggagagtctgtccatattgcagttgcaaccgaaaggagtgattgcagcagtggagatgaggcctccagccactagcgagctgaggtcttcagcgacgaccgagccgcgtgctgagccagcagaggaacccgacatctgtgagaataaatgtagacctccaggcagcgagcccttgccgaggggcatcgtgcaggacaagtccaacttcgagatggagtcgctgggtggcaatcctgaacggaaggagaacggcaacggcaggcagccaaaaagcctcctcgccatccccgtcggcatcaagcagaaggcgatcgtcgacaagctcgtctccaagtttccggaggccaagttcaccgtgatgctgttccactacgacggcgaggtggacgggtggcgagacctcgagtggtcgcgccgcgcgatccacgtcgccgtgcgcgaccagaccaagtggtggttcgccaagaggttcctgcacccggacctggtggcggagtacgactacgtcttcctctgggacgaggacatcgaggtggacagcttcgacccgctcaggtacctgcggatcgtgaggaaagaagggctggagatctcgcagccggcgctggaccggcggtcgcagatccaccaccggctcacggcgcgcgcccggagcggcgacgtccaccggcggtactacaagacgaacgggcacgacaggtgctacggcaacagcacgggaccgccgtgcacggggtgggtggagatgatggtgcccgtgttctcgcgcgcggcgtggcggtgcgcgtggcacatgatccagaacgacctcgtctacgcctggggcatggactacaagctcggctactgcgcgcagggcgaccggagccgcaacgtcggcgtcgtcgacagcgagtacgtgttccaccggggcatccccacgctcggcgacgacggcaaggcgacggtgtcggcgtcgtcgttggggagagaccggttagcggtgagacagcggtcctacaccgagctgcaggtgttcaacaggaggtggaagaaggccgtggcggaggacgggtgctggaccgacccttacccgaaatcggcggcgaccaccgcctga

SEQ ID NO: 1734 - protein, 406 aa, Sorghum bicolor
  misc_feature: Ceres ANNOT ID no. 6016803
  misc_feature (6)..(399): NCBI GI: 57899847 NCBI Desc: lysine ketoglutarate reductase trans-splicing related 1-like [oryza sativa (japonica cultivar-group)]
  misc_feature (96)..(403): NCBI GI: 115471717 NCBI Desc: os07g0414700 [oryza sativa (japonica cultivar-group)]
  misc_feature (99)..(396): NCBI GI: 24636978 NCBI Desc: lysine ketoglutarate reductase trans-splicing related 1 [arabidopsis thaliana]
  misc_feature (93)..(387): NCBI GI: 9743342 NCBI Desc: f21j9.23 [arabidopsis thaliana]
  misc_feature (51)..(387): NCBI GI: 23309021 NCBI Desc: at3g26440/f20c19_16 [arabidopsis thaliana]
  misc_feature: Useful for biocontainment applications
  misc_feature: GREAT-hit functional homolog of the protein sequence given in SEQ ID NO 12967
  misc_feature: Useful for biocontainment applications
  misc_feature: Functional homolog of the protein sequence given in SEQ ID NO 12967
MGLISNDAWHKRFFSVAPPAALVFFFVLIFVAGAIVTLDHKESLSILQLQPKGVIAAVEMRPPATSELRSSATTEPRAEPAEEPDICENKCRPPGSEPLPRGIVQDKSNFEMESLGGNPERKENGNGRQPKSLLAIPVGIKQKAIVDKLVSKFPEAKFTVMLFHYDGEVDGWRDLEWSRRAIHVAVRDQTKWWFAKRFLHPDLVAEYDYVFLWDEDIEVDSFDPLRYLRIVRKEGLEISQPALDRRSQIHHRLTARARSGDVHRRYYKTNGHDRCYGNSTGPPCTGWVEMMVPVFSRAAWRCAWHMIQNDLVYAWGMDYKLGYCAQGDRSRNVGVVDSEYVFHRGIPTLGDDGKATVSASSLGRDRLAVRQRSYTELQVFNRRWKKAVAEDGCWTDPYPKSAATTA

SEQ ID NO: 1735 - DNA, 1149 bp, Sorghum bicolor
  misc_feature: Ceres ANNOT ID no. 6016811
  misc_feature: Encodes the peptide sequence at SEQ ID NO 1736
atggggccgcagctcgccgcagttggccccgccataaccgcgccgcgcttccgcaccacccttccctgctgcacccggccaaggagtaggaggctcacctcttggcgccgcgccgcgctccccaaggatgaggattattacttgatcgacgcggaggagtccattggggatggcttctcgttcagtggagggaagtacggggagggaccaagtaagtcagacgaatggtttgctcaagggaaaatggtaaatgcttaccaaatatacggggacaaagggaaggcaaaagatccattctttggcctgacgatgggatcagaatctcaatcttcagatgacgttttcagatggttctgtgtggaggctgggagctcttctaatcctaaagtgcttttaattcacggcttgccatcgcaggcatactcttaccgcaatgtgatgcctgtactgtcagacaaatatcatgccattgcttttgattggctcgggtttggattttctgataagcctcaaccaaaatatggttttgactatactcttgatgagtatgcctcatccttggaatctctagtcaatgctgttgctcctgataagctctctattgttgttcagggctactttgctccggttgcagtcaaatatgctagtgaacatcaagacaaattgaatcatcttgtactagtgaatccaccgataactgataaacatgtaaaccttccatccaccttggcttcattcagcaacttcttgttgggcgagatattttctcaggatcctctcagagcaagtgataaggtattgactagttgtggtccatacttgatgaaggaagaagatgctatggtgtatagaaggccataccttgtctctggttcctctgggtttgcacttaatgcaataagcaaagctatgaaaaaggaccttaaggcttacattgaatccatgagaaacattttaagaagtaattcgtggaaaacaaagacaacagtatgctggggcatgagagatcgttggctgagctatgatggggttgaagatttttttggaggcctaaaccagaagattgtagagctgcctatggcggggcaccatgtgcaggaggaccgtggtgaagaattaggcaatatgatcaaaagtatactgaggtaa

SEQ ID NO: 1736 - protein, 382 aa, Sorghum bicolor
  misc_feature: Ceres ANNOT ID no. 6016811
  misc_feature (154)..(379): Pfam Id: Abhydrolase_1 Pfam Desc: alpha/beta hydrolase fold
  misc_feature (8)..(381): NCBI GI: 57899848 NCBI Desc: hydrolase-like [oryza sativa (japonica cultivar-group)]
  misc_feature (43)..(381): NCBI GI: 19699240 NCBI Desc: at4g12830/t20k18_180 [arabidopsis thaliana]
  misc_feature (43)..(381): NCBI GI: 21537159 NCBI Desc: hydrolase-like protein [arabidopsis thaliana]
  misc_feature (43)..(257): NCBI GI: 4586259 NCBI Desc: hydrolase-like protein [arabidopsis thaliana]
  misc_feature (80)..(378): NCBI GI: 92874828 NCBI Desc: alpha/beta hydrolase fold [medicago truncatula]
MGPQLAAVGPAITAPRFRTTLPCCTRPRSRRLTSWRRAALPKDEDYYLIDAEESIGDGFSFSGGKYGEGPSKSDEWFAQGKMVNAYQIYGDKGKAKDPFFGLTMGSESQSSDDVFRWFCVEAGSSSNPKVLLIHGLPSQAYSYRNVMPVLSDKYHAIAFDWLGFGFSDKPQPKYGFDYTLDEYASSLESLVNAVAPDKLSIVVQGYFAPVAVKYASEHQDKLNHLVLVNPPITDKHVNLPSTLASFSNFLLGEIFSQDPLRASDKVLTSCGPYLMKEEDAMVYRRPYLVSGSSGFALNAISKAMKKDLKAYIESMRNILRSNSWKTKTTVCWGMRDRWLSYDGVEDFFGGLNQKIVELPMAGHHVQEDRGEELGNMIKSILR

SEQ ID NO: 1737 - DNA, 1194 bp, Sorghum bicolor
  misc_feature: Ceres ANNOT ID no. 6016812
  misc_feature: Encodes the peptide sequence at SEQ ID NO 1738
  misc_feature: Down-regulated in shoot tissues in response to methyl jasmonate treatment
atggcgctccgcctcaacgacgtcgcgctctgcctctccccgccgctcgctgcccgacgccgccgccactgccgcagcggcggcggcagcaggttcgtcgccgtcgcctccatgacgtccgccgtctccaccaagctcgagaataagaagccatttgctcctccaagggaggtacatgtccaggttacacattcaatgccacctcagaagattgaaattttcaagtcgcttgatgattgggctagagataatatcttgacgcatctcaagccagttgagaagtgttggcagccacaggatttcctccctgacccatcatctgaaggatttcatgacgaagttaaggagctcagagaacgtgccaaggaaatccctgatgattattttgtttgtttggtgggagacatgattactgaggaagctcttccaacataccagactatgcttaacacccttgacggtgtcagagatgagacaggtgcaagccccactgcctgggctgtttggacgagggcatggactgctgaggagaacaggcatggtgatctgctcaacaagtatatgtacctcactgggagggtggatatgaggcaaattgagaagacaattcagtatcttattggctctggaatggatcctaggactgagaataatccttatcttggtttcatctacacctccttccaagagcgggcgaccttcatctcacacgggaacaccgctcgtcacgccaaggactttggcgacttaaagcttgcacagatctgtggcatcatcgcgtcagatgagaagcgacatgaaactgcgtacaccaagatcgtggagaaactgtttgagatcgaccctgatggtactgtggttgctctggctgacatgatgaagaagaagatcgcaatgcctgctcacctgatgtttgatgggcaggacgacaagctgtttgagcacttctccatggtcgcgcagaggcttggtgtttacactgccagggactacgccgacatccttgagttccttgtcgacaggtggaaggtggcggacctgactggtctgtctggtgaagggaacaaggcacaggactacctttgcacccttgcttcaaggatcaggaagctggacgagagggcccagagcagagccaagaaagcaggcacgctgcctttcagctgggtatatggtagggaagtccaactgtga

SEQ ID NO: 1738 - protein, 397 aa, Sorghum bicolor
  misc_feature: Ceres ANNOT ID no. 6016812
  misc_feature (67)..(395): Pfam Id: FA_desaturase_2 Pfam Desc: Fatty acid desaturase
  misc_feature (1)..(397): NCBI GI: 115441871 NCBI Desc: os01g0919900 [oryza sativa (japonica cultivar-group)]
  misc_feature (10)..(397): NCBI GI: 1785862 NCBI Desc: stearoyl-acyl-carrier protein desaturase [elaeis guineensis]
  misc_feature (10)..(397): NCBI GI: 3915024 NCBI Desc: acyl-[acyl-carrier-protein] desaturase, chloroplast precursor (stearoyl-acp desaturase)
  misc_feature (25)..(397): NCBI GI: 115457988 NCBI Desc: os04g0379900 [oryza sativa (japonica cultivar-group)]
  misc_feature (1)..(397): NCBI GI: 2290400 NCBI Desc: stearoyl-acp desaturase [helianthus annuus]
  misc_feature (10)..(397): SWISSPROT Homolog: EC 1.14.19.2 Acyl-[acyl-carrier-protein] desaturase, chloroplast precursor
  misc_feature: Down-regulated in shoot tissues in response to methyl jasmonate treatment
  misc_feature: The sequence is a functional homolog of SEQ ID NO. 338 in the 11/188,298 US application
MALRLNDVALCLSPPLAARRRRHCRSGGGSRFVAVASMTSAVSTKLENKKPFAPPREVHVQVTHSMPPQKIEIFKSLDDWARDNILTHLKPVEKCWQPQDFLPDPSSEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMKKKIAMPAHLMFDGQDDKLFEHFSMVAQRLGVYTARDYADILEFLVDRWKVADLTGLSGEGNKAQDYLCTLASRIRKLDERAQSRAKKAGTLPFSWVYGREVQL

SEQ ID NO: 1739 - DNA, 2460 bp, Sorghum bicolor
  misc_feature: Ceres ANNOT ID no. 6016816
  misc_feature: Encodes the peptide sequence at SEQ ID NO 1740
  misc_feature: Down-regulated in shoot tissues in response to salicylic acid treatment
atggccgaagaccacttctcctccgcgccgtccgcgccgtcggcggcggcgacagctgcggccgcggccgccgcggcggtcgggtcctcggtgatcccgatcgtaaacaagctgcaggacatcttcgcgcagctggggagcagctccacgatcgacttgccgcaggtggccgtggtcgggagccagagcagcggcaagtccagcgtcctcgaggcgctcgtcggccgagacttcctcccgcggggctcagacatctgcacgcgccgccccctcgtactccagctcgtgcaccagccgcgccggcccgccgacgccgaggccgatgagtggggcgagttcctccacctctcggggcgtcgcttctacgacttccgcgaaattcgacgcgagatccaggcagaaacagaccgagaggcaggtggtaacaaaggtgtatcggataggcagatacgattgaagattttttctccaaatgttcttaacattactctggttgatttgcctggaatcactaaggtgccagttggtgatcagccaactgatattgaagccagaataaggactatgataatgtcatacatcaggcacaagacatgtatcatcttagctgtttcgccagcaaatgcagatttagcaaactctgatgctcttcaaatggctcgggttgctgatcctgatggttctcgaacaatcggtgttatcacaaagttggacataatggacaggggcactgatgcccggaactttctgctgggaaatgtgatccccttaaaacttggctatgttggtgtcgttaaccgcagccagcaggatatcaactctgacctcagtatcaaggatgctctggctcgtgaagaaaaattctttcgtactcagccagcatatcatggtcttgctcagtattgtgggataccacaattagcaaagaagctaaaccagattctggtccaacatataaaaacagttctgccggggcttaagtcacgcataagcagccaattgactgctgttgctaaggagcttgctgtgtatggtgatcctgttgattcaaaggctggtcaaggtgctaagcttttgaacatactagctaaatactgtgaagctttctcttcaatggtggaaggaaaaaatgaagatatatcgacaattgaactttctggtggagcgaggatccattacattttccagtctatctttgtcaaaagtttagaggaggttgatccttgcgaggatgttacagatgaagatatccgcatggctattcaaaatgcaactggtcctagaagtgctctgtttgtaccagaagttccatttgaagtccttgtacgtaggcagatcagcagattgcttgatccaagtcttcagtgtgcacagttcatatatgatgaacttgtaaagatgagtcatcgctgccttgcaaccgagttgcagcagtttcctatactccgcagaagcatggatgaagtcattgggaagtttttgcgggacggacttaagccagcagaaagtatgatagcacacattattgagatggaggaagattacataaacacatcacacccaaattttattggtggcagcaaggctgttgagcaagcacagcagcaagttaggtctgccaaaatgtcggcagcggtgagaaaggatggagtggatgcacaggcttctgagaaaactcaaaaatcacgcgcaatattgggtagaagtgtaaatggagtagttactgaccacatccagggggtacggcctactgctgaggcagagagaccaggatcttctggtagtggaagcacatctttctggaatcaaatatttacttccactgaggacaaaacacatgctcctgcaagagataacacagcaaacaaatcttatgctgtgcctgcacccaatctggaacattcactctccacgatacagttaagagagccaccagtcgtcctgaagcctttggaacaccagtctgaccaggaggtacttgaaatagcgatcacaaagttactgttgaagtcatattacaatattgtcaggaaaaatgtggaggacttcataccaaaagcaattatgcatttcctggttaatcacacaaaaagggcgctgcataattaccttataacgaaactttatagagatgatcttttggaagacttgctcaaagaacctgatgaggtaaccataaagaggaagcagatacgtgaaaatctgaaggttcttcaacaagcttataaaactttggacgagataccactagacgcagaggcagtagagaggggtggatactcctccctggattctgatgcgattggtctaccaagggcccatgggctttcttcatccctccacggattcaatgatggaagctcaccatattcaaccccgaagcagtcaaggtcaaggaggtcaaatcattctggcgagcagccccctttcaaccctaatatgagtggcaatggtttttga

SEQ ID NO: 1740 - protein, 819 aa, Sorghum bicolor
  misc_feature: Ceres ANNOT ID no. 6016816
  misc_feature (246)..(539): Pfam Id: Dynamin_M Pfam Desc: Dynamin central region
  misc_feature (56)..(237): Pfam Id: Dynamin_N Pfam Desc: Dynamin family
  misc_feature (657)..(748): Pfam Id: GED Pfam Desc: Dynamin GTPase effector domain
  misc_feature (7)..(807): NCBI GI: 60392233 NCBI Desc: dynamin-related protein 3a (dynamin-like protein 2) (dynamin-like protein 2a)
  misc_feature (7)..(807): NCBI GI: 19032337 NCBI Desc: dynamin like protein 2a [arabidopsis thaliana]
  misc_feature (7)..(819): NCBI GI: 2576411 NCBI Desc: similar to dynamin-like protein encoded by genbank accession number x99669 [arabidopsis thaliana]
  misc_feature (19)..(783): NCBI GI: 140071759 NCBI Desc: dynamin central region; dynamin; dynamin gtpase effector [medicago truncatula]
  misc_feature (12)..(802): NCBI GI: 38346632 NCBI Desc: osjnba0072d21.2 [oryza sativa (japonica cultivar-group)]
  misc_feature: Down-regulated in shoot tissues in response to salicylic acid treatment
MAEDHFSSAPSAPSAAATAAAAAAAAVGSSVIPIVNKLQDIFAQLGSSSTIDLPQVAVVGSQSSGKSSVLEALVGRDFLPRGSDICTRRPLVLQLVHQPRRPADAEADEWGEFLHLSGRRFYDFREIRREIQAETDREAGGNKGVSDRQIRLKIFSPNVLNITLVDLPGITKVPVGDQPTDIEARIRTMIMSYIRHKTCIILAVSPANADLANSDALQMARVADPDGSRTIGVITKLDIMDRGTDARNFLLGNVIPLKLGYVGVVNRSQQDINSDLSIKDALAREEKFFRTQPAYHGLAQYCGIPQLAKKLNQILVQHIKTVLPGLKSRISSQLTAVAKELAVYGDPVDSKAGQGAKLLNILAKYCEAFSSMVEGKNEDISTIELSGGARIHYIFQSIFVKSLEEVDPCEDVTDEDIRMAIQNATGPRSALFVPEVPFEVLVRRQISRLLDPSLQCAQFIYDELVKMSHRCLATELQQFPILRRSMDEVIGKFLRDGLKPAESMIAHIIEMEEDYINTSHPNFIGGSKAVEQAQQQVRSAKMSAAVRKDGVDAQASEKTQKSRAILGRSVNGVVTDHIQGVRPTAEAERPGSSGSGSTSFWNQIFTSTEDKTHAPARDNTANKSYAVPAPNLEHSLSTIQLREPPVVLKPLEHQSDQEVLEIAITKLLLKSYYNIVRKNVEDFIPKAIMHFLVNHTKRALHNYLITKLYRDDLLEDLLKEPDEVTIKRKQIRENLKVLQQAYKTLDEIPLDAEAVERGGYSSLDSDAIGLPRAHGLSSSLHGFNDGSSPYSTPKQSRSRRSNHSGEQPPFNPNMSGNGF

SEQ ID NO: 1741 - DNA, 1299 bp, Sorghum bicolor
  misc_feature: Ceres ANNOT ID no. 6016829
  misc_feature: Encodes the peptide sequence at SEQ ID NO 1742
atgggggcgccgagcagccgcgcgctggcgctgggcgcggccttcctgctgctcctcgtcgcgctgccctcggcctttctctacctcaccacctccgcggcgcccgcggcggccacccgcgccacgctcctcaacctcaagcccttctccgccaggtgcgcgcccgccgccgcggcgccgctccgcgtcttcatgtacgacctgcccgcgcgcttccacgtcgccatgatgggggccgacgacggcgcggggttccccgcgtggccgccgtccgcgggcgggatcaggcgccagcacagcgtggagtactggatgatggcgtcgctccaggacggggccgcgggaccggatgggggaagggaggccgtcagggtgcgggatcctgacgccgccgacgccttcttcgtgcccttcttctcctcgctcagcttcaacgtgcacggccgtaacatgaccgaccccgacaccgaggccgaccgtctcctgcaggttgaaattgtggacattctatggaagtctaaatattggcaacggtctgcaggccgtgaccatgttattcctatgcatcaccctaatgctttcagattcctgcgagcaatggtgaatgcatctattctaatagtttcagactttgggagatacacaaaggagctggcttccctgaggaaagatgttgtggcaccatatgtgcatgttgtggattctttccttgatgacgatccacctgatccatttgaggctcgtcatacactgcttttctttcgaggccgtactgtcaggaaagatgaagggaagatccgggcaaaacttgggaaggtattaaaaggtaaggaaggggtgcgctttgaggatagcattgctacaggcgacggcattaaaatatctacagaaggtatgcggtcgtcaaagttttgtctccaccctgctggggacactccttcctcatgccgcctgtttgatgctatagtcagtcattgtgttcctgtgatagtcagcagtcgcattgagctcccttttgaagatgagattgattacagtgagttctcccttttcttctcggttgaagaagctctaagacctgattacttactgaaccagctcagacagatccccaaaaagaagtgggttgatatgtggtcgaagcttaaaaatgtctctcatcattatgaattccagtatccccccaggaagggtgatgcggtgaacatgatatggaggcaggtgaggcacaaaatccctgcagttaaccttgctattcacaggaatagaagactaaaaattccagactggtggggatag

SEQ ID NO: 1742 - protein, 432 aa, Sorghum bicolor
  misc_feature: Ceres ANNOT ID no. 6016829
  misc_feature (63)..(382): Pfam Id: Exostosin Pfam Desc: Exostosin family
  misc_feature (43)..(431): NCBI GI: 22330483 NCBI Desc: exostosin family protein [arabidopsis thaliana]
  misc_feature (43)..(319): NCBI GI: 3176669 NCBI Desc: end is cut off. [arabidopsis thaliana]
  misc_feature (50)..(262): NCBI GI: 115483943 NCBI Desc: os11g0128000 [oryza sativa (japonica cultivar-group)]
  misc_feature (1)..(424): NCBI GI: 42408898 NCBI Desc: exostosin family-like protein [oryza sativa (japonica cultivar-group)]
  misc_feature (61)..(424): NCBI GI: 60657600 NCBI Desc: secondary cell wall-related glycosyltransferase family 47 [populus tremula x populus tremuloides]
  misc_feature: Useful for making plants with altered cell wall content and/or composition
  misc_feature: GREAT-hit functional homolog of the protein sequence encoded by LOCUS at1g67410
  misc_feature: Useful for making plants with altered cell wall content and/or composition
  misc_feature: Functional homolog of the protein sequence given in SEQ ID NO 13754
MGAPSSRALALGAAFLLLLVALPSAFLYLTTSAAPAAATRATLLNLKPFSARCAPAAAAPLRVFMYDLPARFHVAMMGADDGAGFPAWPPSAGGIRRQHSVEYWMMASLQDGAAGPDGGREAVRVRDPDAADAFFVPFFSSLSFNVHGRNMTDPDTEADRLLQVEIVDILWKSKYWQRSAGRDHVIPMHHPNAFRFLRAMVNASILIVSDFGRYTKELASLRKDVVAPYVHVVDSFLDDDPPDPFEARHTLLFFRGRTVRKDEGKIRAKLGKVLKGKEGVRFEDSIATGDGIKISTEGMRSSKFCLHPAGDTPSSCRLFDAIVSHCVPVIVSSRIELPFEDEIDYSEFSLFFSVEEALRPDYLLNQLRQIPKKKWVDMWSKLKNVSHHYEFQYPPRKGDAVNMIWRQVRHKIPAVNLAIHRNRRLKIPDWWG

SEQ ID NO: 1743 - DNA, 1212 bp, Sorghum bicolor
  misc_feature: Ceres ANNOT ID no. 6016846
  misc_feature: Encodes the peptide sequence at SEQ ID NO 1744
atggactgggacgccaagatgcttcctgcctgggacctcggcacggtggtcgggcccagcagcagcggaggcgtaggcgtaggcggtggcggcgcgctggacctgaagctgggcgcgccgacgagctcgagggtggtggccacggccgccgcggccgtcggtgccgcgcccacgctgccgtcagcgaaccatccgcctccgccggcaccggcaccggcaccggcgccgtcgtcgtccgcgccggcgaagcggccgcggccggggcacgcgcagcaggcggtgccggcgtgctccgtgcagggctgcgacgccgacctgtcccgctgccgcgactaccaccgccgccacaaggtctgcgaggcgcactccaagacgcccgtcgtcaccgtcgccggccagcagcagcgcttctgccagcagtgcagcaggtttcatctgctcggggagttcgatgaggtgaagaggagctgcaggaagcgccttgatgggcacaaccgccgccgccggaagccacagccggaccctctcaaccctgccggcttgtttggcaatcaccatggagtgacaaggttcacatcgtacccgcagctcttcaccacatccatggcagagcccaaatggtcggtggttaagacggagaccgacgtgttccaagaccagtactacccggccgtccacctcgatggtgccggcgccggttccctcttccacggcaaggaccggaagcacttcccgttcctgaccaaccacaacaatggcggcggtgacgtggccgccgcggccctgggctgccaacccttcaccatcaccacgacggcttcctcagagagcagcagcaagcagagcaacggcaactgtgctctctctcttctgtcagacaacccgacaccagcacagacggccatgatcccaaccgcgcagcccctcggcccggcgatgcagtacggcaggctccctggcagcggcggcggcagcggcgacgtctccctcaccgggatgtcgtacatgagggtggcagacagcaggcaggcatccatgctgacaacttcgtcacccagtcacactgcagttgcttcccctggtccggctactgcagctgcaacacagcaccagctgcagtaccaccatggctactaccatgtgagcggtggcgagcagggcaacaacccagatggtgctgccattcaggcccttcccttctcatcgtggtag

SEQ ID NO: 1744 - protein, 403 aa, Sorghum bicolor
  misc_feature: Ceres ANNOT ID no. 6016846
  misc_feature (96)..(174): Pfam Id: SBP Pfam Desc: SBP domain
  misc_feature (107)..(403): NCBI GI: 115441907 NCBI Desc: os01g0922600 [oryza sativa (japonica cultivar-group)]
  misc_feature (23)..(270): NCBI GI: 42761373 NCBI Desc: sbp-domain protein-like [oryza sativa (japonica cultivar-group)]
  misc_feature (1)..(278): NCBI GI: 62467440 NCBI Desc: teosinte glume architecture 1 [zea mays]
  misc_feature (1)..(278): NCBI GI: 62467446 NCBI Desc: teosinte glume architecture 1 [zea mays]
  misc_feature (1)..(278): NCBI GI: 62467432 NCBI Desc: teosinte glume architecture 1 [zea mays]
  misc_feature: The plant flowers significantly late compared to wild-type.
  misc_feature: Useful for making plants with modulated flowering time
  misc_feature: GREAT-hit functional homolog of the protein sequence given in SEQ ID NO 13558
  misc_feature: The sequence is a functional homolog of SEQ ID NO. 452 in the 11/188,298 US application
MDWDAKMLPAWDLGTVVGPSSSGGVGVGGGGALDLKLGAPTSSRVVATAAAAVGAAPTLPSANHPPPPAPAPAPAPSSSAPAKRPRPGHAQQAVPACSVQGCDADLSRCRDYHRRHKVCEAHSKTPVVTVAGQQQRFCQQCSRFHLLGEFDEVKRSCRKRLDGHNRRRRKPQPDPLNPAGLFGNHHGVTRFTSYPQLFTTSMAEPKWSVVKTETDVFQDQYYPAVHLDGAGAGSLFHGKDRKHFPFLTNHNNGGGDVAAAALGCQPFTITTTASSESSSKQSNGNCALSLLSDNPTPAQTAMIPTAQPLGPAMQYGRLPGSGGGSGDVSLTGMSYMRVADSRQASMLTTSSPSHTAVASPGPATAAATQHQLQYHHGYYHVSGGEQGNNPDGAAIQALPFSSW

SEQ ID NO: 1745 - DNA, 1644 bp, Sorghum bicolor
  misc_feature: Ceres ANNOT ID no. 6016854
  misc_feature: Encodes the peptide sequence at SEQ ID NO 1746
  misc_feature: Up-regulated in shoot tissues in response to salicylic acid treatment
atggacggcggcgcgggcgcgggccggaggagcgtctcctcgtcctccggatccaggaggaggctcccgcccgccgagaacgggcacggccatgacgccccgccgccctccaggcgcgcctccgtctccctctcccgcggcccctccacgacactgaccagcgagaggaccgtgaaaaggctgaggctgtccaaggcgctgacgataccggatcacacgaccgtgcacgaggcttgtcggaggatggcatcacgcagggtcgacgccgtgttgctgaccgactccaatgctttgctctgtgggatccttaccgacaaggacataaccacaagggtgattgcccgtgagatgaagatggaagagacaccggtctctaaggttatgacaagaaaccctgtatttgttcacgcggacacgcttgcagtcgaggcgttgcaaaagatggtgcaaggtaagtttagacatctgcctgttgtggagcatggtgaagtcattgcaattctggacatagccaagtgcctatatgatgctattgcacggatggaaagggccgcggagaaaggaaaagcaattgctgctgctgctgagggcgttgaaaagcattggggagcagcagtatctggtcctaacaattttattgagactcttcgagaacggatgtttaagccatcactgtctaccattatctctgagaatccaaaagtggtcactgttgcaccatcagacacagttttgacagcatcaaagaagatgctggaattaaaagtgagttcagcagttgtagcaattgaaaacaaacctgggggaattctaacatctagagatatattgatgcgtgttatcgcccaaaatcttcctcctgagtccactacagtcgaaaaggtcatgactcagagtcctgaatgtgccacagtggacatgccaatccttgatgctcttcacacaatgcatgatggaaaatttttacatttgcctgttctggacagggatggaaatgttgtgactgttgttgatgttcttcacatcactcatgctgcaattgctacggttggaaacagcggggcagctggatccgaggcaacatctgccatgatgcagaggttctgggattcagcaatgtccattggacctcttgatgatgatgatgactcgagaagtgaaggatcgacaaaagttgcatctgaggcaacagatataggaagatcagctttctttccagcttctggtttatcaaacacttttgggttcaagattcaggacaagcaagggaggatgcacagatttaactgtgaaacgagcagcttgacagacctgataactagcattcttcagagggtcggtgatgacattgacagaaaacacctgccacaaattttgtatgaagatgaggaccatgataaggtcatcctttcgtcggacagtgaccttatagctgctgtagaccatgcaagacagattggttggaagagcttaaggttgcacttggattatgccggtgttggccgccgaaagagagggggtggttcttcagacttcgagtacgctggcaaggacgcatgggcttctgcttacagtgcagtcgcagcaggggcggctctggttgctgggcttggtgtgatggcctacttgaaacggtcagggtaa

SEQ ID NO: 1746 - protein, 547 aa, Sorghum bicolor
  misc_feature: Ceres ANNOT ID no. 6016854
  misc_feature (60)..(178): Pfam Id: CBS Pfam Desc: CBS domain pair
  misc_feature (229)..(344): Pfam Id: CBS Pfam Desc: CBS domain pair
  misc_feature (413)..(498): Pfam Id: PB1 Pfam Desc: PB1 domain
  misc_feature (234)..(547): NCBI GI: 115441917 NCBI Desc: os01g0923300 [oryza sativa (japonica cultivar-group)]
  misc_feature (15)..(546): NCBI GI: 92881330 NCBI Desc: octicosapeptide/phox/bem1p; cbs [medicago truncatula]
  misc_feature (15)..(546): NCBI GI: 115487552 NCBI Desc: os12g0169400 [oryza sativa (japonica cultivar-group)]
  misc_feature (5)..(546): NCBI GI: 57900300 NCBI Desc: cbs domain-containing protein-like [oryza sativa (japonica cultivar-group)]
  misc_feature (5)..(546): NCBI GI: 115442383 NCBI Desc: os01g0961200 [oryza sativa (japonica cultivar-group)]
  misc_feature: Up-regulated in shoot tissues in response to salicylic acid treatment
MDGGAGAGRRSVSSSSGSRRRLPPAENGHGHDAPPPSRRASVSLSRGPSTTLTSERTVKRLRLSKALTIPDHTTVHEACRRMASRRVDAVLLTDSNALLCGILTDKDITTRVIAREMKMEETPVSKVMTRNPVFVHADTLAVEALQKMVQGKFRHLPVVEHGEVIAILDIAKCLYDAIARMERAAEKGKAIAAAAEGVEKHWGAAVSGPNNFIETLRERMFKPSLSTIISENPKVVTVAPSDTVLTASKKMLELKVSSAVVAIENKPGGILTSRDILMRVIAQNLPPESTTVEKVMTQSPECATVDMPILDALHTMHDGKFLHLPVLDRDGNVVTVVDVLHITHAAIATVGNSGAAGSEATSAMMQRFWDSAMSIGPLDDDDDSRSEGSTKVASEATDIGRSAFFPASGLSNTFGFKIQDKQGRMHRFNCETSSLTDLITSILQRVGDDIDRKHLPQILYEDEDHDKVILSSDSDLIAAVDHARQIGWKSLRLHLDYAGVGRRKRGGGSSDFEYAGKDAWASAYSAVAAGAALVAGLGVMAYLKRSG

SEQ ID NO: 1747 - DNA, 3018 bp, Sorghum bicolor
  misc_feature: Ceres ANNOT ID no. 6016856
  misc_feature: Encodes the peptide sequence at SEQ ID NO 1748
  misc_feature: Up-regulated in shoot tissues in response to salicylic acid treatment
atgaccgttacggcacgcgggaggagcggcggcggggtcgggatggaggagaagtgcgacgcgcccgggttcggcttcctgggcctcgaccggatgcgcgtcctcctgccgccgctccgcctgccggagaagctgtcggccagcaggacgctgcggacgcacctcttcaccaactaccggatgcgcaaggtgcgggacagctccaggtggctcatcccgctctgggtcaccatctgggtcttcatcgcctccctcctctacctccggatgagctaccaggccgtcgacaagcgccgggagtcgctcgccatcatgtgcgacgaccgcgcgcgcatgctccaggaccagttgaacgtcagcatgaaccacctccaggcgctcgccatcctcgtctccaccttccaccactccaagacaccctccgccatcgaccagaaaacgttcgcgtggtacgcggagaggacggcgttcgagcggccgctcacgagcggggtcgcgtatggggtcaaggtcacgcacgccgagcgggagcagttcgagcgccagcagggatggagcatcaagaagatgtactcctccaaaaccaagaagcagtcgcagggacaagggaacggcgaggacgccgaggtgcgggagccggcggaggagtatgctcccgtaatcttcgcgcaggacgcctacaagcacgtcatctccttcgacttgctatccggcgccgatgaccgcgacaacgtgctccgagctagagaatctgggaagggtgttcttactgctcctttcaagttgctcaataatcgcctcggagtgatctccacctacgctgtgtacaagtatgagcttcccccaaatgccacgccacaggatcgcattcaggctgctataggctatttaggtggcatatttgacattgaagcgcttgttgataagtcgcttcaccagctcgcgggcaagcaatccatcatggtgaacgtgtatgatactactaatgagaaaccgatcagtatgtatggttcaaatgatacaggaagtggcatgtgccaggtcagcacactgaactttggtgatccgacgaggaagcatgagatgcactgcaggttcattcagagcccaccttggccttggctggcaataacgacatcaattggaatttttgtgattggtttactggttggatacatagtttatgctactgcaaaacggattgccagagttgaagatgactttcaggagatgagtttgctcaagaagcgcgcagaggatgcagatattgccaagtcacagttcttggctaccgtttctcatgagatcagaactccaatgaatggtgttctagggatgctccaaatgctcatggatactgatttggacacaacacaacaagactatgttagaaccgcacaagccagtggcaaagctttggtatctctcatcaatgaggttcttgatcaggcaaagatcgagtctggtaaacttgagcttgaggcggtaccattcgatcttagaacagtttgtgatgacattttgtctctcttctgtgggaaagctcaggagaaaggactggagttggcagtgtttgtttctgaccaagttccacaaacactaattggcgatccaggcagaataaggcaaatcattacaaatcttgttggaaactctataaaattcacagagaagggtcatatctacttgactgttcatgtcgttgaggagattatgcattgtttggaggttgagaccacaaataccttaagtaggtacccagtggcaaacaggaagcgcagttgggaaaactttcaactttttagtagggaactgaactcctccgagatgccttttgcacccggtgcatcagactcaataagcttgataatatcagttgaagatacgggtgttggaatcccgcccgatgctcagtcccgtgtcttcacccctttcatgcaagtaggtccatccattgctcgcatccatgggggcactggtattggattaagcatcagcaaatgcttggtcggcctcatgaagggagagattggatttgcaagtaaaccccaagtcggttctactttcaccttcactgcagtgcttacgagggcccactccagtggaaatgagaataaatcatcagagtttaaagagatcaatgcattggtggtagatcatagaccggtccgtgccaaggttactaagtaccatttgcagagactgggggttcacaccgaattgacaactgacctagatcagtatatttctaaaattaattgtggatcacagattgcaaagcttgtgctcattgacaaagaaacctggctggaggaatcccactctatgcctcatttggttactaaattgaggaacaaagatcagccagactctacaaagttatttcttttggagaaccctaaaagttctgtcaaaagcagtttgcatatattcagggaatataacttgaatgtaattatgaagccacttcgtgcaagcatgcttcaggtttccctacaaagagcattgggtgggatagataaactgcattgcaggaatggggtagttggcaattcaacacttggcagccttcttcacaagaaacgaatcatagtggttgatgacaacattgtaaatctcaaggttgctgcaggcgctctgaagaaatatggcgcagaagtaacttgtgctgatagtgggaagaaagcaatcacactgctgaaacctcctcacagatttgatgcttgtttcatggacatacagatgcccgaaatggatggatttgaagccacgagaaggattagagtgatggaaagagatctaaatgagcaaatagaacgtggagaagccccactggagtgcgcaggggtccggcagtggcgaactccaatattagccatgacagcagatgttattcaggcgacacatgaacaatgcttaaaatctgaaatggacggttatgtttccaagccattcgagggcgagcaattgtacagagaagtagctcgctttttcctaaatcaagaccaagttcagtag

SEQ ID NO: 1748 - protein, 1005 aa, Sorghum bicolor
  misc_feature: Ceres ANNOT ID no. 6016856
  misc_feature (139)..(363): Pfam Id: CHASE Pfam Desc: CHASE domain
  misc_feature (536)..(696): Pfam Id: HATPase_c Pfam Desc: Histidine kinase-, DNA gyrase B-, and HSP90-like ATPase
  misc_feature (861)..(995): Pfam Id: Response_reg Pfam Desc: Response regulator receiver domain
  misc_feature (424)..(489): Pfam Id: HisKA Pfam Desc: His Kinase A (phosphoacceptor) domain
  misc_feature (1)..(1005): NCBI GI: 38347686 NCBI Desc: histidine kinase 2 [zea mays]
  misc_feature (12)..(1005): NCBI GI: 82466315 NCBI Desc: hybrid type histidine kinase [oryza sativa (indica cultivar-group)]
  misc_feature (12)..(1005): NCBI GI: 118790678 NCBI Desc: tpa: histidine kinase [oryza sativa (japonica cultivar-group)]
  misc_feature (145)..(1005): NCBI GI: 115441923 NCBI Desc: os01g0923700 [oryza sativa (japonica cultivar-group)]
  misc_feature (44)..(998): NCBI GI: 18396292 NCBI Desc: histidine kinase (ahk3) [arabidopsis thaliana]
  misc_feature: The sequence is a functional homolog of SEQ ID NO 5 in US patent 7026530
  misc_feature: Up-regulated in shoot tissues in response to salicylic acid treatment
MTVTARGRSGGGVGMEEKCDAPGFGFLGLDRMRVLLPPLRLPEKLSASRTLRTHLFTNYRMRKVRDSSRWLIPLWVTIWVFIASLLYLRMSYQAVDKRRESLAIMCDDRARMLQDQLNVSMNHLQALAILVSTFHHSKTPSAIDQKTFAWYAERTAFERPLTSGVAYGVKVTHAEREQFERQQGWSIKKMYSSKTKKQSQGQGNGEDAEVREPAEEYAPVIFAQDAYKHVISFDLLSGADDRDNVLRARESGKGVLTAPFKLLNNRLGVISTYAVYKYELPPNATPQDRIQAAIGYLGGIFDIEALVDKSLHQLAGKQSIMVNVYDTTNEKPISMYGSNDTGSGMCQVSTLNFGDPTRKHEMHCRFIQSPPWPWLAITTSIGIFVIGLLVGYIVYATAKRIARVEDDFQEMSLLKKRAEDADIAKSQFLATVSHEIRTPMNGVLGMLQMLMDTDLDTTQQDYVRTAQASGKALVSLINEVLDQAKIESGKLELEAVPFDLRTVCDDILSLFCGKAQEKGLELAVFVSDQVPQTLIGDPGRIRQIITNLVGNSIKFTEKGHIYLTVHVVEEIMHCLEVETTNTLSRYPVANRKRSWENFQLFSRELNSSEMPFAPGASDSISLIISVEDTGVGIPPDAQSRVFTPFMQVGPSIARIHGGTGIGLSISKCLVGLMKGEIGFASKPQVGSTFTFTAVLTRAHSSGNENKSSEFKEINALVVDHRPVRAKVTKYHLQRLGVHTELTTDLDQYISKINCGSQIAKLVLIDKETWLEESHSMPHLVTKLRNKDQPDSTKLFLLENPKSSVKSSLHIFREYNLNVIMKPLRASMLQVSLQRALGGIDKLHCRNGVVGNSTLGSLLHKKRIIVVDDNIVNLKVAAGALKKYGAEVTCADSGKKAITLLKPPHRFDACFMDIQMPEMDGFEATRRIRVMERDLNEQIERGEAPLECAGVRQWRTPILAMTADVIQATHEQCLKSEMDGYVSKPFEGEQLYREVARFFLNQDQVQ

SEQ ID NO: 1749 - DNA, 1329 bp, Sorghum bicolor
  misc_feature: Ceres ANNOT ID no. 6016861
  misc_feature: Encodes the peptide sequence at SEQ ID NO 1750
atgggggaggtggccgcgctgcgccagctcgtcggccaggtccaggagctctgggacctctacggcgccaacgcccaccccatccccaggtggtatttacttgacttcgaacatggttcaatcaaggatgattattgtgggggaaggcctggatacaactcagaattactgaagatcatggaaactaaccaatctccccctcgcaaacgaccgcggagagatcgaaaccgtgaaaaggcaccctcaaacaaaactgaagtaatgcaacaagagatctggagagatttccccgaagatctttttgaaactgtcattgcaaggcttccagttgctgcaatctttcgattccgcaccgtctgccgaaagtggtcttctcttttgggctcagacagtttttctcatcagtactctgaagctccacgtggactgccatggttctatacaatcacccatgagaatgcaaacaacaatgttgcaatgtatgatccttcgctgaagaaatggcaccacccatccgttcctctcactcctacaaagatagttattccagtggcatccgtgggtggtcttgtatgtttattggatctgagccacaggaatttctacatttgcaaccctcttatgcaatcactcaaggagatcccaccaagatcagttcagggatggtcaagagtcgctgtagggatggtgttgaacggaagaagttctagtgatggctacaaagtaatgtggttaggaaatgatgggacttatgaagtctatgactctacaaagaacatgtggtcttgccctggatcttttcctccgggcatcaaacttccacttgctctaaatttcaggtcacagcctgtggcggttggcagcacggtatacttcatgtgcgcagaaccagatggtgttttgtcatatgatgtaagcaccgggatttggaggcaatttgccatcccactgccactgcatctgactgaccacacacttgccgagttccagggaagggttatgctagtgggtctgctgtgcaaaaatgcagcgacctgcgtctgcatatgggagttgcagaagatgactctcctctggaaggaggtggacagaatgccaaatatctggtgcttagagttctacggtaagcacatgaagatgacatgcctgggcaacagtggtttgctcatgctctccttgaaggcgaagcgtatgaaccgccttgttacttacaaccttttcaaaagggagtggcagaaggttcctgattgcatgctaccatgcagccgcaaaaagcaatggatagcatgtggcacagcgtttgatccggtcccctgtgccttggcctga

SEQ ID NO: 1750 - protein, 442 aa, Sorghum bicolor
  misc_feature: Ceres ANNOT ID no. 6016861
  misc_feature (91)..(138): Pfam Id: F-box Pfam Desc: F-box domain
  misc_feature (1)..(442): NCBI GI: 115441927 NCBI Desc: os01g0923900 [oryza sativa (japonica cultivar-group)]
  misc_feature (31)..(442): NCBI GI: 18396298 NCBI Desc: f-box family protein [arabidopsis thaliana]
  misc_feature (150)..(417): NCBI GI: 82734195 NCBI Desc: fimbriata protein [misopates orontium]
  misc_feature (88)..(366): NCBI GI: 124361081 NCBI Desc: cyclin-like f-box; galactose oxidase, central [medicago truncatula]
  misc_feature (147)..(417): NCBI GI: 42795315 NCBI Desc: fimbriata [mimulus lewisii]
  misc_feature: The sequence is a functional homolog of SEQ ID NO. 456 in the 11/188,298 US application
MGEVAALRQLVGQVQELWDLYGANAHPIPRWYLLDFEHGSIKDDYCGGRPGYNSELLKIMETNQSPPRKRPRRDRNREKAPSNKTEVMQQEIWRDFPEDLFETVIARLPVAAIFRFRTVCRKWSSLLGSDSFSHQYSEAPRGLPWFYTITHENANNNVAMYDPSLKKWHHPSVPLTPTKIVIPVASVGGLVCLLDLSHRNFYICNPLMQSLKEIPPRSVQGWSRVAVGMVLNGRSSSDGYKVMWLGNDGTYEVYDSTKNMWSCPGSFPPGIKLPLALNFRSQPVAVGSTVYFMCAEPDGVLSYDVSTGIWRQFAIPLPLHLTDHTLAEFQGRVMLVGLLCKNAATCVCIWELQKMTLLWKEVDRMPNIWCLEFYGKHMKMTCLGNSGLLMLSLKAKRMNRLVTYNLFKREWQKVPDCMLPCSRKKQWIACGTAFDPVPCALA

SEQ ID NO: 1751 - DNA, 1503 bp, Sorghum bicolor
  misc_feature: Ceres ANNOT ID no. 6016869
  misc_feature: Encodes the peptide sequence at SEQ ID NO 1752
atgaagcccccggccggcagcagcggcaagggcggcgcggtggacccttccctgccgcggttcaggtgccaggagtgccgccgcgccctcgtcgtcgtcggggtcgattcctacgccgacaggctgcccgcacatgccgcgcccggtaatcatgcatcttctgttcagggcagtgttatgggtgcaagcaagatggacaactcttacgttgtgttatccaggcagaacaaatctcagggtcctagaattcccccacgcccaccaagtgcagcagcggtgcatactgatcccatccaatcaacaagagcgatagaggggtcatatatagtgcttccacctcctgccgcttccatatacaagacacctgcctctgaaggaggtggtgcgcagctcacagcaccaggtgtaaactccagtagcccctctcagggaaacaattctgggtttcactctagtgttactgtgctgaaaagggcttttgagattgctagctcgcagactcaggttgaacagccactttgtctggaatgtatgagggttctttctgataagatggataaggagattgaagatgttaatgctgatattaaatcttatgaggcttgtcttcaacgtttggagcaggagccctacaacatcctcagtgaaacagatttccaaaaggagaaacaaaagattgaagaagaggaaaataaacttaaagctgctattgaagaagctgaaaaacaatattcagaagttagttctgagatgaaagatcttgaaataaagtctaaacaatttgaggaattggaagagcggtactggcatgaattcaacagttttcagtttcagttggcatctcaccaggaagaaagagacgcagtttttgccaagatagaagtttcccaggttcatctggaactgttgaagcgtactaatgttcttaatgatgcattctatatttcacatgatggagtaattggaacaataaataatttccgcctcggccgcctttctaatgtagaggttgagtgggatgagataaatgctgcttggggtcaggctgcactgctgttgcataccatggctcagtatttcaccccaaaattccaataccggatcaagattcaccctatgggaagctatccaagagtcacagacatccacaataatacatatgaactgtttggtcccgtgaatttgttctggagcacccgatttgacaaagccatgacatggtttctgacttgcctgcaagagttcgctgagtttgccataagtttggataaggagaacaatgttccacctgaaaaatcactgaagcttccctacaagattgatggtgacaaagtagggagccacacgatcgtcctaagtttcaataagaatgaaaactggaccaaggcgctaaagtacatgttgtgcaatctgaagtgggttctctactggtttattggcaatacaagttttgcaccacactcgggatcgctgcacacacaatctctgaagaacaagagttga

SEQ ID NO: 1752 - protein, 500 aa, Sorghum bicolor
  misc_feature: Ceres ANNOT ID no. 6016869
  misc_feature (152)..(481): Pfam Id: APG6 Pfam Desc: Autophagy protein Apg6
  misc_feature (1)..(500): NCBI GI: 73587472 NCBI Desc: beclin 1 protein [zea mays]
  misc_feature (1)..(479): NCBI GI: 73587468 NCBI Desc: beclin 1 protein [saccharum officinarum]
  misc_feature (1)..(500): NCBI GI: 73587466 NCBI Desc: beclin 1 protein [sorghum bicolor]
  misc_feature (1)..(499): NCBI GI: 73587470 NCBI Desc: beclin 1 protein [triticum aestivum]
  misc_feature (1)..(499): NCBI GI: 73587464 NCBI Desc: beclin 1 protein [hordeum vulgare]
MKPPAGSSGKGGAVDPSLPRFRCQECRRALVVVGVDSYADRLPAHAAPGNHASSVQGSVMGASKMDNSYVVLSRQNKSQGPRIPPRPPSAAAVHTDPIQSTRAIEGSYIVLPPPAASIYKTPASEGGGAQLTAPGVNSSSPSQGNNSGFHSSVTVLKRAFEIASSQTQVEQPLCLECMRVLSDKMDKEIEDVNADIKSYEACLQRLEQEPYNILSETDFQKEKQKIEEEENKLKAAIEEAEKQYSEVSSEMKDLEIKSKQFEELEERYWHEFNSFQFQLASHQEERDAVFAKIEVSQVHLELLKRTNVLNDAFYISHDGVIGTINNFRLGRLSNVEVEWDEINAAWGQAALLLHTMAQYFTPKFQYRIKIHPMGSYPRVTDIHNNTYELFGPVNLFWSTRFDKAMTWFLTCLQEFAEFAISLDKENNVPPEKSLKLPYKIDGDKVGSHTIVLSFNKNENWTKALKYMLCNLKWVLYWFIGNTSFAPHSGSLHTQSLKNKS

SEQ ID NO: 1753 - DNA, 4605 bp, Sorghum bicolor
  misc_feature: Ceres ANNOT ID no. 6016870
  misc_feature: Encodes the peptide sequence at SEQ ID NO 1754
  misc_feature: Down-regulated in root tissues in response to salicylic acid treatment
atggcggagaggaagctggatcgaccctcggcgctcggcaaaggtgggctgtcgcttgggatcgaggaggacagggccgccgccgccgccatggggttcgtcgacgataccaaagatcagctgcacctggataacagcattcccctgtctcctcagtggctctacaccaaacctgctgatggaaagatctcactgcctcatgtgtcctccctagagcctgctgagaaggaagtgaggatgctcgaaggaactgttgataggaaagaacgaaggaggaatgtatttgatgctgacactggtcttcgttggcttgaagaggagagggagacgagcctgcttgggaggagggagcgcaagaaggatgtggaccgggatgtcgacaatcgcaagaccgatcgccgatctgacaatgtttctgcaagggacaacactgatccgcgtgcagctcctgcatctgaaaggtggaatgatggttccacccgaagcatggggaatgagggacgccgtgatgcaaaatggtcatcaagatggggacctgatgacaaggacaaggactccaggtcagacaagaaggttgatgcagagaaggatgaaacccatgctgataaacagacattcacaggaaggctgctgtctgagtccgattcccgtgataaatggaggcctcgtcaccggcaggaaagtcattctgtcggaacagcaacgtaccgtgctgctccaggctttggatctgagaaagggcgtgttaaggactcagatattggttttgctgctggaagaggcaggggaaacccgaactcagttgcatccttcaaccggccatcatctgcaggatcaatcggtgctccatctgtgcatgggaagtctgcaaaagctgctgttagtttctgctacccaagagggaagcttcttgatatatacaggcagaaaaatatgatgtcatcctttgatgatgctgacatgaaactggaggaaattccttccatcacactctctactgctgcaaaacccctagcctttgttgcaccggataaagttgaagaggctctcctggaagatattagaaagggtaaagtcattagcagtgaaggaatcaatgggactggaaacaaaaaagagagggcaaaagatctcgaagaaccagcttctggtattgatgatgacaagggcaaagtcagttttgcaattgctgggttgggtcaagaagggtcttcagatttaatctcggagaaggacgccttctacgttgaagggacacttcctactggcatcagtacatctccgccaatgaaaagtctggaggaaaatgccagcagcaatcaatatgggattactgacattagggaaggtttgaaaacggatgaaatcaagtcaagtgctgatcatgatcttggcactaagctacctgatgattcaaacactctgtttgatgtaccatcctttgagcattcttcggaaccccctatgccataccaaagcagtgacatggatataaaagtgagtggccatgctaattatccagaagagttgacattatattatctggatccccaaggaggtgtgcaaggtccatttctcggtgctgacataatttcctggtatgaagatggatactttggtttggagttacccgtacgtttgtctcaggctccagatgatgttcctttccgcccacttgttgaagtcatgccccaccttgggcaaaaactgcaatcgcatatacctcaacccggtgatggaagtgctgaatctctggaatcatctcaaagtaaatttgaatccacagttcctactgcttcctctgggaagagtgaccaagtgtctaattggaattctgaaagcaatgctgttgatcctaaaagaggtgatcatgaagcatcagtaccttctcatagtggttggttatcttcactggaaatgggaaaggatacagcaaatactactaatcgccagcagcacattcctgaatcagttaatcaggatgctgaagaagtgttgtacactgggaggcctaatagcagcatgggtcaatccctacgggaccttgagaatgaccgtgcagatttccagttggcaccacatgatcctcattctgtggttggacaagctaatttgccgcagcatgatatcccaagggagagtgatctgagtcctcttggcttactttggtctgagctggaagggcatccaaaacaacctctctcatcaaacgtacttggtgtaaatgagcggagaaatcccaagcctacagcacccaaggacattccacctgtaaacatgagacacgggccacttagcaggatgaatgaagtttcaagtgtgcgtgatgagtggcctgcaaactttggacggctagacaatatgaatgatgcaaacatttccagcagaatccctcaggttgaagctgagcatcatttgaattttgaggggcaaatgctgcttcaacagatcagacgggagcaacagcaattgcagcaggagcaactgatggcccgcaacaatatggaattttctggtgcatttcctgggcaggtgtttgattctttgcaccaacaccgccagcctatgaatcaaccgctttctgatgtggagcatcttttgagagtccagtttgaaattgagcaacagcagcaacgccgccagctccaacaagagcagcaccaacggcagctacagcagcaacggcaagcccagcttttgcagcaacagcaacagcagcagcagcaacagcaacagatgatcctcgagcaattgttgcagcagcagcttcagggttcaaattttggaccaacaaatatggttgatcaagtcttacttcgtgaacatgtattaaatgaactgcaccagcaacctcaccatttgcaaagacagcatgatgcggctattgaacaactcattcaagcaaaatttggtcatggccttcatagggagcatcataatgatatgttggatgttctctcacgtccaaatcagagacagatgcttcctttagagcagcaaattcttttaggccttcagcatgagcagcaacttcagtctcaacaattggcaaatgctctgcggcagggcagggaggaagaaaggcacttaagtggggtctggccaatggatgatcctgcgcagtttatccgtgcagggaccagtccaaatcagagacatggtcgtttcgatctcctggagaatcttcagagatcgtcatcgtttgatcaccatgaacatcttgaccgcagcttatccttacatgaacgtttgcataggggaggtcaaggtattcactccctagagcggtctggttctttgcctggtggtggtcctggaccaaacccagatgtcataaatgccctagcacgccatcatggacttggtcagttggaaacacatggtgatatataccctttaggccaaatgcctatgcttccttcaggggttcatcctcagcaacataggcttcaggaacagcttcctggttctcacataggaaggcttgaaaggcactggtcggatgccaatggacagttgcaaaacagtctaatggaatcttcacgcatcaaccagttgcagattgaagcggagaagcagagaaggaatgtggaaatgaaccttgctgttgacaacccacatgcatgggcagctcttatgaacaaggagaggaatgcagaacaagatttgagtgatatgattcataagaaacttgtccttcaatcgcagcagtccctgggtttccctgatgttcctgttccagcaccatttgggcgtaaggatcactttgcacaacctgttgcagagaatcctctaagatcagtggacatgttgtcatttgaggagtctcttgcagaaaggtcactttatgcaaagtcagggcagttggcgcaagagggatcagctaatctgggtactttgcccaacaatattgagaacactggaaaatttaaccttagatcaggatctggatcaatgcttgagcagaagcattttcttggaattgatgatgttcaaagggactttccagacaccacaagtggtagaacatcagccaatcaactggttgggagtgtcagtgagttaacaagggttaaaaagcagggttctagtgcgagtttggctggggatgatcctgattttgctgaagaagctgttagtaaatggtctgattctggcatgtcaaaaggaagctctcactccttgctaaagcgctctacaaaccaacatactacatctcagtcagttcccgcagatctgtcttcagcaatcaggctgaagaaagcaggccttgtgtcctctgatgagaataagatggaatcaggagtggcatcagtagcccagggtatggaaagcagtgttcctagcaacaaagagccaggggtgtatagcatgccatcagccaccaacaatccagatgcctctggtcagtccttcagcgaagcgctgaagagctcgaggaagcctccgttgcagtatgatgcctcagaatctgcagacggtggcccaggtggtaagggcgcaaagaagaaggccaagaaaggaaagcagattgacccttctcttcttggcttcaaggtccacagtaaccggatcatgatgggcgagattgttcgagatgattag

SEQ ID NO: 1754 - protein, 1534 aa, Sorghum bicolor
  misc_feature: Ceres ANNOT ID no. 6016870
  misc_feature (510)..(565): Pfam Id: GYF Pfam Desc: GYF domain
  misc_feature (700)..(1534): NCBI GI: 57900204 NCBI Desc: adenylyl cyclase-like [oryza sativa (japonica cultivar-group)]
  misc_feature (1074)..(1534): NCBI GI: 115441937 NCBI Desc: os01g0924600 [oryza sativa (japonica cultivar-group)]
  misc_feature (36)..(1075): NCBI GI: 42562348 NCBI Desc: gyf domain-containing protein [arabidopsis thaliana]
  misc_feature (36)..(1075): NCBI GI: 9802542 NCBI Desc: f17l21.22 [arabidopsis thaliana]
  misc_feature (507)..(921): NCBI GI: 115470515 NCBI Desc: os07g0137900 [oryza sativa (japonica cultivar-group)]
  misc_feature: Down-regulated in root tissues in response to salicylic acid treatment
MAERKLDRPSALGKGGLSLGIEEDRAAAAAMGFVDDTKDQLHLDNSIPLSPQWLYTKPADGKISLPHVSSLEPAEKEVRMLEGTVDRKERRRNVFDADTGLRWLEEERETSLLGRRERKKDVDRDVDNRKTDRRSDNVSARDNTDPRAAPASERWNDGSTRSMGNEGRRDAKWSSRWGPDDKDKDSRSDKKVDAEKDETHADKQTFTGRLLSESDSRDKWRPRHRQESHSVGTATYRAAPGFGSEKGRVKDSDIGFAAGRGRGNPNSVASFNRPSSAGSIGAPSVHGKSAKAAVSFCYPRGKLLDIYRQKNMMSSFDDADMKLEEIPSITLSTAAKPLAFVAPDKVEEALLEDIRKGKVISSEGINGTGNKKERAKDLEEPASGIDDDKGKVSFAIAGLGQEGSSDLISEKDAFYVEGTLPTGISTSPPMKSLEENASSNQYGITDIREGLKTDEIKSSADHDLGTKLPDDSNTLFDVPSFEHSSEPPMPYQSSDMDIKVSGHANYPEELTLYYLDPQGGVQGPFLGADIISWYEDGYFGLELPVRLSQAPDDVPFRPLVEVMPHLGQKLQSHIPQPGDGSAESLESSQSKFESTVPTASSGKSDQVSNWNSESNAVDPKRGDHEASVPSHSGWLSSLEMGKDTANTTNRQQHIPESVNQDAEEVLYTGRPNSSMGQSLRDLENDRADFQLAPHDPHSVVGQANLPQHDIPRESDLSPLGLLWSELEGHPKQPLSSNVLGVNERRNPKPTAPKDIPPVNMRHGPLSRMNEVSSVRDEWPANFGRLDNMNDANISSRIPQVEAEHHLNFEGQMLLQQIRREQQQLQQEQLMARNNMEFSGAFPGQVFDSLHQHRQPMNQPLSDVEHLLRVQFEIEQQQQRRQLQQEQHQRQLQQQRQAQLLQQQQQQQQQQQQMILEQLLQQQLQGSNFGPTNMVDQVLLREHVLNELHQQPHHLQRQHDAAIEQLIQAKFGHGLHREHHNDMLDVLSRPNQRQMLPLEQQILLGLQHEQQLQSQQLANALRQGREEERHLSGVWPMDDPAQFIRAGTSPNQRHGRFDLLENLQRSSSFDHHEHLDRSLSLHERLHRGGQGIHSLERSGSLPGGGPGPNPDVINALARHHGLGQLETHGDIYPLGQMPMLPSGVHPQQHRLQEQLPGSHIGRLERHWSDANGQLQNSLMESSRINQLQIEAEKQRRNVEMNLAVDNPHAWAALMNKERNAEQDLSDMIHKKLVLQSQQSLGFPDVPVPAPFGRKDHFAQPVAENPLRSVDMLSFEESLAERSLYAKSGQLAQEGSANLGTLPNNIENTGKFNLRSGSGSMLEQKHFLGIDDVQRDFPDTTSGRTSANQLVGSVSELTRVKKQGSSASLAGDDPDFAEEAVSKWSDSGMSKGSSHSLLKRSTNQHTTSQSVPADLSSAIRLKKAGLVSSDENKMESGVASVAQGMESSVPSNKEPGVYSMPSATNNPDASGQSFSEALKSSRKPPLQYDASESADGGPGGKGAKKKAKKGKQIDPSLLGFKVHSNRIMMGEIVRDD

SEQ ID NO: 1755 - DNA, 1524 bp, Sorghum bicolor
  misc_feature: Ceres ANNOT ID no. 6016871
  misc_feature: Encodes the peptide sequence at SEQ ID NO 1756
atggcctccgccgacgccgccaagcccgcgtccccgcctgccgcggatccgcccgccgacgaccccatggacgccgaccccgcgccccccgcggtggaggagaaggagaaggaggaggccacgccgcagaagcagccggagaagaagcggggcgggcggaggaagaagggcgaggccgccgcggccgagaagaagacgccgccgtccaagaagtcggccggccccacggtcgagcgcccgtccagggagaggaagaccgtcgagaggtacgcggagctcgcgccgcgcgccacgcccgctaagaagtcccccgctattgtccagggctctggaacgaagctcaaggacatacccaatgtttcattcaaactatcaaagagaaaggttgatgagaatctccagagccttcatactgtattgtatgggagaaaatcaaataaccatttcttgaagagaaacatatctcaattttctgggtttgtttggacagacaatcaagaaaagcagaggaacaaaataaaggaaaagcttgagaaatttaacaaggagaagttgctagatttttgtgaagtactggacattaatgtaaaagtaactacaaagaaggaagaagtttctgccaagctcttagagtttttggagtctccttgtgttaccagggatgttgttctcactgataaaaagaaggggaagaaacgtggaaggaaatctaaggcaacttctgaaggtgcttctgcagagaagaaaaggaaaagagtccagaaacaagcagctgaagatggtaaagagaatgatgatgcggatgatgctgatcctgctggttctgaggatgcatcaacaggagaggaagctgatggggattctgaggcaaatgatcatgctgtgagtgatgatgaacttgatgagcctccagcaaagaagaagtctacagatgctaaacaggttaagaaagaaacaggttctgatgcaaaggaaaaggatacaccaggaaaaaagggttctacgaaacctgcaaaaggtgcatcaaaggcttctcaaaacagtaaaaatgagcctgatgcagaggtaaaaaaggtgggcaagagagcaaagagttcaaaagaaagtgttgtgtcaccagattctaataagtcaaacaagaaggtttctaaatccaaaaaggacgatggaaaagaatcccaaaacaataaagctgccaggtcatccaataagaataaaggaaaaggcaagggtggtgcagctgctgggactgccccaaccactgaacagcttcatgctgttgttagcagcattttgaaggaagttgacttcaacacagcaactttggctgatattctcagacaattagggacccattttgaaatggacctcatggaccgaaaagcagaagtgaagcgcatcatagaagaggtaataaatagtatgtctgatgatgaaggtgaggaagattcagaagatgaagcagaagataatggtaaggtggagaagtcaaagagtgatcccgatggaggtgaagagaagtga

SEQ ID NO: 1756 - protein, 507 aa, Sorghum bicolor
  misc_feature: Ceres ANNOT ID no. 6016871
  misc_feature (420)..(473): Pfam Id: DEK_C Pfam Desc: DEK C terminal domain
  misc_feature (239)..(506): NCBI GI: 42733486 NCBI Desc: bri1-kd interacting protein 112 [oryza sativa (japonica cultivar-group)]
  misc_feature (29)..(444): NCBI GI: 140039548 NCBI Desc: gtp-binding signal recognition particle srp54, g-domain [medicago truncatula]
  misc_feature (14)..(361): NCBI GI: 73620776 NCBI Desc: dek protein
  misc_feature (23)..(361): NCBI GI: 51261610 NCBI Desc: dek-prov protein [xenopus tropicalis]
  misc_feature (14)..(370): NCBI GI: 73620777 NCBI Desc: dek protein
MASADAAKPASPPAADPPADDPMDADPAPPAVEEKEKEEATPQKQPEKKRGGRRKKGEAAAAEKKTPPSKKSAGPTVERPSRERKTVERYAELAPRATPAKKSPAIVQGSGTKLKDIPNVSFKLSKRKVDENLQSLHTVLYGRKSNNHFLKRNISQFSGFVWTDNQEKQRNKIKEKLEKFNKEKLLDFCEVLDINVKVTTKKEEVSAKLLEFLESPCVTRDVVLTDKKKGKKRGRKSKATSEGASAEKKRKRVQKQAAEDGKENDDADDADPAGSEDASTGEEADGDSEANDHAVSDDELDEPPAKKKSTDAKQVKKETGSDAKEKDTPGKKGSTKPAKGASKASQNSKNEPDAEVKKVGKRAKSSKESVVSPDSNKSNKKVSKSKKDDGKESQNNKAARSSNKNKGKGKGGAAAGTAPTTEQLHAVVSSILKEVDFNTATLADILRQLGTHFEMDLMDRKAEVKRIIEEVINSMSDDEGEEDSEDEAEDNGKVEKSKSDPDGGEEK

SEQ ID NO: 1757 - DNA, 2952 bp, Sorghum bicolor
  misc_feature: Ceres ANNOT ID no. 6016885
  misc_feature: Encodes the peptide sequence at SEQ ID NO 1758
  misc_feature: Down-regulated in shoot tissues in response to salicylic acid treatment
atgaggatcatgatcaagggaggcgtgtggaagaacacggaggacgagatcctcaaggcggctgtgatgaagtacggcaagaaccagtgggcgcgcatctcgtcgctgctcgtccgcaagtccgccaagcagtgcaaggcccgctggtacgagtggctcgatccgtccatcaagaagaccgagtggacaagggaagaggatgagaagttacttcatctagctaaactcatgcctactcagtggaggacaattgcacctattgtaggtcgaacaccatctcagtgtcttgaacgttatgaaaaactgcttgatgctgcatgtgcaaaggatgaaaattatgaggctaatgatgatcctaggaagctgcggcctggcgagattgacccaaaccctgagtcaaagcctgcacgtcctgatcctgttgatatggatgaagatgaaaaagaaatgctttctgaggctagggcccgcttagctaacactaggggtaaaaaggccaaacgaaaggcaagggagaaacaacttgaagaggcaagacggcttgcctcactacaaaaaaggagagaattgaaggcggctggtattgatacacgccacagaaaaagaaagagaaaggggattgactacaatgctgagatcccatttgaaaagagaccaccttcaggtttttatgatactgttggtgaagacaggccacttgaacatgtacagtttccaacgaccattgaggagcttgaagggaagagaagagcagatatagaggcacaattaagaaaacaagatatcgccaggaacaagatcctgcagcgacaggatgcccctgctgctataatgcaagcaaataaactaaatgatccagaagctgtcacaaagaggtcaaagctgatgctgccgcctccccaaatttctgaccatgagttagaggagatagcgaagatgggcaatgctggtgatcctgctttagctgatgagcttggtgaaggaagtgctgccacaagaaccttgcttgccagctattctcagactccaaggcttggtatgacaccattgcgaactccacagcgaactccagctgggaagggtgatgcaattatgatggaggcagaaaatcttgcacgtcttagagaatcacagacacctctattaggaggtgacaacccagagcttcatccatcagatttctctggtgttacaccacgtaagaaggagatacagactccaaatccaatggcaacacctttggcaagccctggccctggtattactccaaggattggtatgacaccatccagagaggggcacagctttggtttaacaccaaggggaactcctttccgtgatgaacttcgcataaatgaagaggtggaaatgcaggacagcactaaacttgagcttcgtaggcaagctgaactgaagaaaagcctgcgatctggttttgcttctattccacagccaaagaatgagtaccagatagtcatgccacctattacggaggatgagaaagaagaagctgaagagaaaattgaagaggacatgtcagacagactggcacgagaaagggctgaggaacaggctaggcatgaggtgttgctcagaaagagatccaaagtgttgcagaggagtctgcctaggccaccggctgcttcagtagagattatctggcaatctcttattagaagtggagaaagcagaagcagaagcacctttgtgcctcctacttcgcttgaacaagctgatgaactaataaatgaggagctctttaggcttcttgagcatgataatgcaaaatatcctcttgatgaaaaaactcaaaaagagaaaaagaaaggaagcaagcgtcagcaaaatggaggacctcttgtccctgaaattgaggattttgatgaagatgaacttaaagaggctagttctatggttgaagaggagattcaataccttcgagtggccatgggtcatgaaaatgaatcgtttgaggacttcgtgaaagcacatgatgcatgccaagaggaccttatgttttttcctaccaacaatagctatggtttagctagtgtttctggaaatgctgataaggtttctgctttgcaaaatgagtttgaaactgtgaagaagcgaatggatgatgaagcaaaaaaggcttctcggcttgagcagaagattaagctgctgacacaaggatatcaggtaaggtctggaaaactgtggtcacaggtccaagatacatttaagcagatggacactgctgcaacagaactcggatgcttccaagagctgcagaaacaggaacatcttgccgcttcataccgaatcctaaatttgactgaagaagtgaataagcagaaagcactagaaaggaccctccagagccgctatggtgagcttgtttctggtttccagaggatcgaagaacagcttgaggagcacaagaagcaactcaaggtacaggaggcgatagaagctgaaaaccgtgctcaggaagaggaagttgcggcaccaaaccatgctgctgaggaagaggatgaaaggaagcctcccagctttgaagagaaatcacagcagacaagtagagctactgatgaagaagctgcaggaagcaaaggaaccaccgaggatcagatggatgtgaacagcgggaatggagacggtggagtcgtaggccctatcccaccaacaccaaacactgaaggggatgacgatgaagtatcaattcaggagagcgcttctaacactcagagtagtgactgtacctccactaaggatggggcagacaagatcgatcaagccaagttagaaggtcaggataaatcagatgacagtatggctgttgatgctggccctcgtgaagagagcaaggatgaacttgtacctgttggtgccagcataagtgaagaaaacacaatggtaccttcggatcaagctgtctcaaaggaggatgaaggcatggctccttaa

SEQ ID NO: 1758 - protein, 983 aa, Sorghum bicolor
  misc_feature: Ceres ANNOT ID no. 6016885
  misc_feature (7)..(53): Pfam Id: Myb_DNA-binding Pfam Desc: Myb-like DNA-binding domain
  misc_feature (59)..(103): Pfam Id: Myb_DNA-binding Pfam Desc: Myb-like DNA-binding domain
  misc_feature (1)..(905): NCBI GI: 18092653 NCBI Desc: cdc5 protein [zea mays]
  misc_feature (1)..(983): NCBI GI: 38346500 NCBI Desc: osjnba0020i02.14 [oryza sativa (japonica cultivar-group)]
  misc_feature (1)..(983): NCBI GI: 116309281 NCBI Desc: osigba0130k07.8 [oryza sativa (indica cultivar-group)]
  misc_feature (1)..(731): NCBI GI: 115457842 NCBI Desc: os04g0348300 [oryza sativa (japonica cultivar-group)]
  misc_feature (1)..(840): NCBI GI: 1747310 NCBI Desc: myb-like dna binding protein [arabidopsis thaliana]
  misc_feature: The sequence is a functional homolog of SEQ ID NO 2260 in the 10/374,780US patent application
  misc_feature: The sequence is a functional homolog of SEQ ID NO 313 in the 11/479,226US patent application
  misc_feature: The sequence is a functional homolog of SEQ ID NO 804 in the 10/225,066US patent application
  misc_feature: Useful for making plants with modulated growth and phenotype characteristics
  misc_feature: The sequence is a functional homolog of SEQ ID NO 804 in the 20050160493 US patent application
  misc_feature: The sequence is a functional homolog of SEQ ID NO 2260 in the 10/374,780 US patent application
  misc_feature: The sequence is a functional homolog of SEQ ID NO 313 in the 11/479,226 US patent application
  misc_feature: The sequence is a functional homolog of SEQ ID NO 804 in the 10/225,066 US patent application
  misc_feature: Down-regulated in shoot tissues in response to salicylic acid treatment
  misc_feature: The sequence is a functional homolog of SEQ ID NO. 395 in the 11/188,298 US application
MRIMIKGGVWKNTEDEILKAAVMKYGKNQWARISSLLVRKSAKQCKARWYEWLDPSIKKTEWTREEDEKLLHLAKLMPTQWRTIAPIVGRTPSQCLERYEKLLDAACAKDENYEANDDPRKLRPGEIDPNPESKPARPDPVDMDEDEKEMLSEARARLANTRGKKAKRKAREKQLEEARRLASLQKRRELKAAGIDTRHRKRKRKGIDYNAEIPFEKRPPSGFYDTVGEDRPLEHVQFPTTIEELEGKRRADIEAQLRKQDIARNKILQRQDAPAAIMQANKLNDPEAVTKRSKLMLPPPQISDHELEEIAKMGNAGDPALADELGEGSAATRTLLASYSQTPRLGMTPLRTPQRTPAGKGDAIMMEAENLARLRESQTPLLGGDNPELHPSDFSGVTPRKKEIQTPNPMATPLASPGPGITPRIGMTPSREGHSFGLTPRGTPFRDELRINEEVEMQDSTKLELRRQAELKKSLRSGFASIPQPKNEYQIVMPPITEDEKEEAEEKIEEDMSDRLARERAEEQARHEVLLRKRSKVLQRSLPRPPAASVEIIWQSLIRSGESRSRSTFVPPTSLEQADELINEELFRLLEHDNAKYPLDEKTQKEKKKGSKRQQNGGPLVPEIEDFDEDELKEASSMVEEEIQYLRVAMGHENESFEDFVKAHDACQEDLMFFPTNNSYGLASVSGNADKVSALQNEFETVKKRMDDEAKKASRLEQKIKLLTQGYQVRSGKLWSQVQDTFKQMDTAATELGCFQELQKQEHLAASYRILNLTEEVNKQKALERTLQSRYGELVSGFQRIEEQLEEHKKQLKVQEAIEAENRAQEEEVAAPNHAAEEEDERKPPSFEEKSQQTSRATDEEAAGSKGTTEDQMDVNSGNGDGGVVGPIPPTPNTEGDDDEVSIQESASNTQSSDCTSTKDGADKIDQAKLEGQDKSDDSMAVDAGPREESKDELVPVGASISEENTMVPSDQAVSKEDEGMAP

SEQ ID NO: 1759 - DNA, 690 bp, Sorghum bicolor
  misc_feature: Ceres ANNOT ID no. 6016892
  misc_feature: Encodes the peptide sequence at SEQ ID NO 1760
atgggtgggttctgctgctgcctcagtactgaagattttgaggaatatgtctatccaaacaaccctatctataggcaatgcatatccttgaggcattttttccacagcatttttggcgggtatactgcaacattccagaggcttgagtctagaccaaacaacccagctcaaggggttactccaccgggatccactaatccaagtgtcaacataaatgacaattcgctcgctgaaacttatcaccttgtttctagaccacctccctatgataccgatcctagatatgcccgtgttcaaagagagggattagtctccaggcgtgaaaaatccataaatcttgcacaagaagagtctctagcccttagacgaaatggcagcagctctggtattgagcatttagctgctcagaagaaacggagtagcactgaaaatgagggtgaatatatggtccatcgttctgaatcaactaagagtttgtcggcaaaagcttatagtagcagctatgcagttgtcgcttcagaagatgaggatgtctgccctacttgtcttgaagaatacacgccagacaatccaaaaattataaccaagtgctgtcaccattttcatcttggttgtatttatgaatggatggaaagaagtgatacatgcccaatttgtggaaaggaaatggagttttgcgagagcccgtga

SEQ ID NO: 1760 - protein, 229 aa, Sorghum bicolor
  misc_feature: Ceres ANNOT ID no. 6016892
  misc_feature (179)..(219): Pfam Id: zf-C3HC4 Pfam Desc: Zinc finger, C3HC4 type (RING finger)
  misc_feature (1)..(229): NCBI GI: 57900128 NCBI Desc: zinc finger (c3hc4-type ring finger) protein-like [oryza sativa (japonica cultivar-group)]
  misc_feature (1)..(229): NCBI GI: 92885424 NCBI Desc: zinc finger, ring-type; ringv [medicago truncatula]
  misc_feature (43)..(225): NCBI GI: 23505815 NCBI Desc: at5g41350/myc6_6 [arabidopsis thaliana]
  misc_feature (117)..(225): NCBI GI: 42572783 NCBI Desc: zinc finger (c3hc4-type ring finger) family protein [arabidopsis thaliana]
  misc_feature (177)..(228): NCBI GI: 20334768 NCBI Desc: at4g23450/f16g20_150 [arabidopsis thaliana]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 468 in the 11/188,298 US application
MGGFCCCLSTEDFEEYVYPNNPIYRQCISLRHFFHSIFGGYTATFQRLESRPNNPAQGVTPPGSTNPSVNINDNSLAETYHLVSRPPPYDTDPRYARVQREGLVSRREKSINLAQEESLALRRNGSSSGIEHLAAQKKRSSTENEGEYMVHRSESTKSLSAKAYSSSYAVVASEDEDVCPTCLEEYTPDNPKIITKCCHHFHLGCIYEWMERSDTCPICGKEMEFCESP

SEQ ID NO: 1761 - DNA, 1263 bp, Sorghum bicolor
  misc_feature: Ceres ANNOT ID no. 6016896
  misc_feature: Encodes the peptide sequence at SEQ ID NO 1762
atgaggcggtgggtcttggccatcgccattctttccgctgcttcggcggcggcgctcttccttggggctgaggcccaggcggtccagcagcagggccaccagacagagaggatctcagggagtgctggtgacgtgttagaagataaccctgttgggaggctcaaggtttacgtctatgatctccccagtaaatacaacaagaagctgctgaagaaggatcctaggtgcctgaaccacatgtttgccgcagagatcttcatgcaccggttcctgttgtcaagcgctgtccgaacttttaatcctgaagaagcagattggttctacacgcctgtgtacaccacatgtgacctgactccttcgggtcttccccttcccttcaaatctcctcgcatgatgcgcagcgcaattgagctgattgccacgaactggccttactggaacagatcagagggtgcagatcatttctttgtcacaccacatgactttggtgcttgcttccattatcaggaagagaaagcaatcggacggggaatccttcccttgcttcagcgtgctacactggttcagacctttggacagaagaaccatgtctgcctgaaggacgggtccatcacaatcccaccatttgcacctccccagaaaatgcaggctcaccttatccccgcagacacccctcggtccatcttcgtgtacttccgtggtctgttctatgacaccagcaacgatcctgagggtggttactatgcaagaggtgctcgtgcatcagtctgggagaacttcaagaacaacccgctctttgacatctcaaccgatcacccaccgacttactacgaagacatgcagcgttcagtgttctgcctgtgcccattgggttgggctccatggagtcccaggctggtggaagccgtggttttcggctgcatcccggtgatcattgccgatgacattgtcctgcccttcgcggatgccatcccgtgggaggagatcggtgtgtttgtcgctgaggaggatgtcccaaagctggacagcatcttgacgtcaatcccaacagatgttatactgaggaaacagcgtctcctcgcaaacccatcgatgaagcaggccatgctgttcccccagcctgctcaggcgggtgatgcattccaccagatcctgaatgggctcgcacgcaagctcccgcatggtgacaacgtcttcttgaagcccggggagagggtcctgaactggaccgccgggccgccaggcgacctgaagccttggtag

SEQ ID NO: 1762 - protein, 420 aa, Sorghum bicolor
  misc_feature: Ceres ANNOT ID no. 6016896
  misc_feature (56)..(360): Pfam Id: Exostosin Pfam Desc: Exostosin family
  misc_feature (10)..(420): NCBI GI: 15223522 NCBI Desc: exostosin family protein [arabidopsis thaliana]
  misc_feature (35)..(420): NCBI GI: 17978869 NCBI Desc: at5g61840/mac9_140 [arabidopsis thaliana]
  misc_feature (34)..(420): NCBI GI: 60657598 NCBI Desc: secondary cell wall-related glycosyltransferase family 47 [populus tremula x populus tremuloides]
  misc_feature (80)..(420): NCBI GI: 23821292 NCBI Desc: pectin-glucuronyltransferase [nicotiana plumbaginifolia]
  misc_feature (80)..(394): NCBI GI: 39725600 NCBI Desc: npgut1 homolog [nicotiana tabacum]
  misc_feature: Useful for making plants with altered cell wall content and/or composition
  misc_feature: GREAT-hit functional homolog of the protein sequence encoded by LOCUS at1g27440
  misc_feature: GREAT-hit functional homolog of the protein sequence encoded by LOCUS at5g61840
  misc_feature: Useful for making plants with altered carbohydrate content
  misc_feature: Functional homolog of the protein sequence given in SEQ ID NO 13639
  misc_feature: Useful for making plants with altered cell wall content and/or composition
  misc_feature: Functional homolog of the protein sequence given in SEQ ID NO 13640
MRRWVLAIAILSAASAAALFLGAEAQAVQQQGHQTERISGSAGDVLEDNPVGRLKVYVYDLPSKYNKKLLKKDPRCLNHMFAAEIFMHRFLLSSAVRTFNPEEADWFYTPVYTTCDLTPSGLPLPFKSPRMMRSAIELIATNWPYWNRSEGADHFFVTPHDFGACFHYQEEKAIGRGILPLLQRATLVQTFGQKNHVCLKDGSITIPPFAPPQKMQAHLIPADTPRSIFVYFRGLFYDTSNDPEGGYYARGARASVWENFKNNPLFDISTDHPPTYYEDMQRSVFCLCPLGWAPWSPRLVEAVVFGCIPVIIADDIVLPFADAIPWEEIGVFVAEEDVPKLDSILTSIPTDVILRKQRLLANPSMKQAMLFPQPAQAGDAFHQILNGLARKLPHGDNVFLKPGERVLNWTAGPPGDLKPW

SEQ ID NO: 1763 - DNA, 741 bp, Sorghum bicolor
  misc_feature: Ceres ANNOT ID no. 6016903
  misc_feature: Encodes the peptide sequence at SEQ ID NO 1764
atggcgagcacggcgggaggaggcggagcggcgggggaaggggagtggctcaaggtcgcccagctcagggccacggtgcaagcgcaggacccccaagccaaggaggtggacaacctgacgctgcgtcggttcctgcgcgcgcgcgaccacaacgtggacaaggccggcgccatgttgctcaagttcctcaagtggcggagggaggcggcgcccggcgggtccgtgccggaggaggcagtgcgccgggagctggcgcaggacaaggtgtgcatgggcggcgtcgacagggccggccgccccttcctcgtcgccttccccgccaggcacttctccgcctgccgtgacatggcggagctcaagagttttgttgtctacctcttcgacaagatctgtgccagaatccccagaggccaggagaaattcctctgcatcgttgatctcaagggctggggctactcaaactgggacattcgggcatacattgcggctatagagatcatgcagaactactacccggagcggctgggcaaggcgctgatgatccacgtgccctacatcttcatgaaggcgtggaagatgatctaccccttcatcgacaccaacaccagggacaagttcgtgttcgtggaggacaagagactgcaggagacgctgcggcgggagatcgacgagacccagctcccgaagttcctcggagggaagatggacgtgatcccactcaaggactatatgagtgtatga

SEQ ID NO: 1764 - protein, 246 aa, Sorghum bicolor
  misc_feature: Ceres ANNOT ID no. 6016903
  misc_feature (88)..(247): Pfam Id: CRAL_TRIO Pfam Desc: CRAL/TRIO domain
  misc_feature (5)..(242): NCBI GI: 20805228 NCBI Desc: sec14 like protein [oryza sativa (japonica cultivar-group)]
  misc_feature (5)..(242): NCBI GI: 2286121 NCBI Desc: sec14 like protein [oryza sativa]
  misc_feature (13)..(242): NCBI GI: 92871092 NCBI Desc: cellular retinaldehyde binding/alpha-tocopherol transport; cellular retinaldehyde-binding/triple function, n-terminal [medicago truncatula]
  misc_feature (13)..(242): NCBI GI: 2739046 NCBI Desc: polyphosphoinositide binding protein ssh2p [glycine max]
  misc_feature (10)..(242): NCBI GI: 17226662 NCBI Desc: polyphosphoinositide binding protein [gossypium hirsutum]
MASTAGGGGAAGEGEWLKVAQLRATVQAQDPQAKEVDNLTLRRFLRARDHNVDKAGAMLLKFLKWRREAAPGGSVPEEAVRRELAQDKVCMGGVDRAGRPFLVAFPARHFSACRDMAELKSFVVYLFDKICARIPRGQEKFLCIVDLKGWGYSNWDIRAYIAAIEIMQNYYPERLGKALMIHVPYIFMKAWKMIYPFIDTNTRDKFVFVEDKRLQETLRREIDETQLPKFLGGKMDVIPLKDYMSV

SEQ ID NO: 1765 - DNA, 2082 bp, Sorghum bicolor
  misc_feature: Ceres ANNOT ID no. 6016905
  misc_feature: Encodes the peptide sequence at SEQ ID NO 1766
atggcgaaggtggattcggtggcgccggtgccgagcccgacgttcatggacgccgctcccctgaccttgccgccgccgctggtggtggaggagctcgtgctgcgccgcagtgctcgttgcctcaataggccaacccgtcccagctacgcggaccaggagcctcctaaaaagcccggtggccggggccggggcaagcggaagagggatgaggagaagccggagctggcggcggcgcagcagggtgccaagagcccgggcaggaagtactccaaggtggaggcgggtgagaggaagccgatgcccgtgattgcggcggtgccggtctcttgcgctggcgttgctacggaagacgatgcgatgggaaccgggaagagcgccaagctgagggtgaaagagacattgagggcgttcaacagccactacctccactttgtgcaggaggagcagaagagagcacaggctgcgctacaagagattgaggctaagactaagagtggcctcaaacgtcagaccaaagggggtaaaaagaagagcagtaagcaacaagctgaagctgaggagaaagagaaacgcccgtcaaagcggcctgatctgaaggcaatcaccaagatgcaagaaatgaatgccgtgctttatccagagaagaggattgggcatttaccagggattgatgttggtgatcgattttattctcgtgctgaaatggtagtgttgggcatccacagccattggctcaatggaattgactacatggggatgaaataccaaggaaagaaggagtatgagaagttaacttttccactagccacctgtattgtaatgtcggggatatatgaagatgatctagacaaggccgatgaaattatttatacgggtcaaggaggaaacgatttacttggtaaccatcgccaaattggctctcagcaattgacacgtggcaatttagcattgaagaatagcaggtacaatggtaatcctgtccgagttattcgaggccatttatcaaagaatagctatacaggaaagatctacacctacgatggactttacaaggttgtacatgactgggtgcagactggagtgcaaggccatgttgttttcaaatataaattgaagcggcttgagggtcagccatcattgactacttctgaggtgcgatttactcgtgcagaagctcccacaactatttctgaattacctggactggtttgtgacgacatctctggagggcaagaaaatattccaattcctgctactaacttggttgatgatccgcctgttcctccatctggtttcacatacttgaagtctctaaaaattccaaaggacatcaagattccatctagtattattggctgtgattgtgaaggagattgtgctaccaacaaaaattgttcatgtgctcagcgcaatggttctgatctgccttatgtatcacataagaacattggcaggttggtggagcccaaagcagttgtatttgaatgtggggctaactgcagttgcaaccatgattgtgtaaacagaacatctcaacagggtttgcagtatcggttagaggtatttaagacagcttcaaaaggttggggagttaggacttgggacactatcctccctggggctcccatctgcgagtacacaggggtgttgaggaggactgaagatttggatggttcgcaaaacaactattgttttgacatcgactgtcttcaaaccatgaagggtttggatggaagggagaaaagagctggatctgaaatgcacctgcctaatcttcatcctgaggatgattcagatgcaccacctgcacctgagtactgcatagacgctagttctattggcaattttgccagatttataaatcacagctgccaacctaaccttttcgtccagtgcgtcttgagctcacacaatgatgttaaactggcaaaagtgacgctttttgctgctgacactatacttcctcttcagctatcctatgactatggttatcgcttggacagtgttgttgggcctgatggaaaaattgtgaagctgccttgccactgtggtgctcctgattgccggaagcgcctctactag

SEQ ID NO: 1766 - protein, 693 aa, Sorghum bicolor
  misc_feature: Ceres ANNOT ID no. 6016905
  misc_feature (213)..(377): Pfam Id: YDG_SRA Pfam Desc: YDG/SRA domain
  misc_feature (406)..(509): Pfam Id: Pre-SET Pfam Desc: Pre-SET motif
  misc_feature (511)..(670): Pfam Id: SET Pfam Desc: SET domain
  misc_feature (1)..(693): NCBI GI: 22121716 NCBI Desc: set domain-containing protein set118 [zea mays]
  misc_feature (195)..(693): NCBI GI: 27502110 NCBI Desc: set domain histone methyltransferase suvh4 [arabidopsis thaliana]
  misc_feature (195)..(693): NCBI GI: 13517749 NCBI Desc: suvh4 [arabidopsis thaliana]
  misc_feature (361)..(693): NCBI GI: 92869845 NCBI Desc: 6,7-dimethyl-8-ribityllumazine synthase; set-related region; aws; pre-set; histone h3-k9 methyltransferase [medicago truncatula]
  misc_feature (181)..(693): NCBI GI: 4314371 NCBI Desc: similar to mammalian mhc iii region protein g9a [arabidopsis thaliana]
  misc_feature (195)..(693): SWISSPROT Homolog: EC 2.1.1.43 Histone-lysine N-methyltransferase, H3 lysine-9 specific SUVH4
MAKVDSVAPVPSPTFMDAAPLTLPPPLVVEELVLRRSARCLNRPTRPSYADQEPPKKPGGRGRGKRKRDEEKPELAAAQQGAKSPGRKYSKVEAGERKPMPVIAAVPVSCAGVATEDDAMGTGKSAKLRVKETLRAFNSHYLHFVQEEQKRAQAALQEIEAKTKSGLKRQTKGGKKKSSKQQAEAEEKEKRPSKRPDLKAITKMQEMNAVLYPEKRIGHLPGIDVGDRFYSRAEMVVLGIHSHWLNGIDYMGMKYQGKKEYEKLTFPLATCIVMSGIYEDDLDKADEIIYTGQGGNDLLGNHRQIGSQQLTRGNLALKNSRYNGNPVRVIRGHLSKNSYTGKIYTYDGLYKVVHDWVQTGVQGHVVFKYKLKRLEGQPSLTTSEVRFTRAEAPTTISELPGLVCDDISGGQENIPIPATNLVDDPPVPPSGFTYLKSLKIPKDIKIPSSIIGCDCEGDCATNKNCSCAQRNGSDLPYVSHKNIGRLVEPKAVVFECGANCSCNHDCVNRTSQQGLQYRLEVFKTASKGWGVRTWDTILPGAPICEYTGVLRRTEDLDGSQNNYCFDIDCLQTMKGLDGREKRAGSEMHLPNLHPEDDSDAPPAPEYCIDASSIGNFARFINHSCQPNLFVQCVLSSHNDVKLAKVTLFAADTILPLQLSYDYGYRLDSVVGPDGKIVKLPCHCGAPDCRKRLY

SEQ ID NO: 1767 - DNA, 957 bp, Sorghum bicolor
  misc_feature: Ceres ANNOT ID no. 6016906
  misc_feature: Encodes the peptide sequence at SEQ ID NO 1768
atgtctgccaacgagaactcaccgccggtggaggccgctgcagctgcagctgccgccgccgcgtccacgccacggtcgcggctgccgcggtggacgcggcacgagacgctggtcctgatccaggctcggcgcgccatggagcggggcgggctgcagctgccggcggtgcggccgcggccaaagtgggcggcggtgtcggcctactgccggcgccacggcgtggagcgcgggcccatgcagtgccggaagcggtggggcaacctgtcgtgggacctcaagaagatcgtcgcgtgggaagggaaggccgtcgccggcgccggcgtcggcgctgccggcgacgcgcagcacgagtcgttctgggacatgcgcggcgaccagcggcgcgccaggcagctgccctcgtcgtttgaccgcgaggtgtacgacgcgctcgtctgcggcgcgtccgccggtggcggcgtcgccgcggccgtgatgccgccggacttcggcgacggggacctggaaggggtgtacccgcagccgcccatcatggtcatgccaatatcagtgaagaagtatgagccccctcctgcctcttctgaacacgaatgctctggtccagtgacagagagcgaccagaagaaggcgggcgcggcggcggcggcgtcggacaagaactcgacgtcgtcgcatcacggtggcggcggcggcggcggcttcaaggacagcgacgcgacgttcgtggcggatcaggcagagggcaccgcgacggccacgccgccagcggcggcgacggcgaaggccagcatcgagaagcaggtgatcgaggccctggagaggggcaaccgggcgctggcgcagcagctggaggcgcacaggagcatgtgggacgccgacagggagcagagggcggctcttcttcgcgccatggacagggtcgccgacgccgtgtgcaggatcgccgataagctctga

SEQ ID NO: 1768 - protein, 318 aa, Sorghum bicolor
  misc_feature: Ceres ANNOT ID no. 6016906
  misc_feature (60)..(157): NCBI GI: 51536039 NCBI Desc: gt-2-related-like [oryza sativa (japonica cultivar-group)]
  misc_feature (27)..(172): NCBI GI: 115458134 NCBI Desc: os04g0397500 [oryza sativa (japonica cultivar-group)]
  misc_feature (39)..(318): NCBI GI: 38347161 NCBI Desc: osjnba0039c07.7 [oryza sativa (japonica cultivar-group)]
  misc_feature (19)..(161): NCBI GI: 87247543 NCBI Desc: shattering protein [oryza nivara]
  misc_feature (19)..(311): NCBI GI: 124303202 NCBI Desc: shattering 1 [oryza rufipogon]
  misc_feature: The sequence is a functional homolog of SEQ ID NO 980 in the 11/479,226US patent application
  misc_feature: Useful for making plants with modulated growth and phenotype characteristics
  misc_feature: The sequence is a functional homolog of SEQ ID NO 980 in the 20070022495 US patent application
MSANENSPPVEAAAAAAAAAASTPRSRLPRWTRHETLVLIQARRAMERGGLQLPAVRPRPKWAAVSAYCRRHGVERGPMQCRKRWGNLSWDLKKIVAWEGKAVAGAGVGAAGDAQHESFWDMRGDQRRARQLPSSFDREVYDALVCGASAGGGVAAAVMPPDFGDGDLEGVYPQPPIMVMPISVKKYEPPPASSEHECSGPVTESDQKKAGAAAAASDKNSTSSHHGGGGGGGFKDSDATFVADQAEGTATATPPAAATAKASIEKQVIEALERGNRALAQQLEAHRSMWDADREQRAALLRAMDRVADAVCRIADKL

SEQ ID NO: 1769 - DNA, 450 bp, Sorghum bicolor
  misc_feature: Ceres ANNOT ID no. 6016907
  misc_feature: Encodes the peptide sequence at SEQ ID NO 1770
atggacatggagctggagcacggaggagacgaagacgagagagggagtgattcctcctcctccaagaggagcttcggcgcttcgtcggatgcaaccgtcagcagcacaccaagcaagctgcaagctctgaggtttgcagaggacctctctctcccatcggtgcaggtggtggtgatgagcgccaacatggggtgctcgcactgccggcagcgggtcgccaacgtcgtctccaagatgaacgggctgctggactacatggtggacttcggcaagaaggaggtgacggtgcgcgggaaggtggtgcacaccaagaagaagaagaagaaacacaggaaggcactgctgggtggtgctgcaggttgggacgacgccagatcgacggcgtcgtcttcgcccggcggcggccatgccaggacgctgtcctggtttttgggatgctacggctcatga

SEQ ID NO: 1770 - protein, 149 aa, Sorghum bicolor
  misc_feature: Ceres ANNOT ID no. 6016907
  misc_feature (5)..(149): NCBI GI: 115441975 NCBI Desc: os01g0927300 [oryza sativa (japonica cultivar-group)]
MDMELEHGGDEDERGSDSSSSKRSFGASSDATVSSTPSKLQALRFAEDLSLPSVQVVVMSANMGCSHCRQRVANVVSKMNGLLDYMVDFGKKEVTVRGKVVHTKKKKKKHRKALLGGAAGWDDARSTASSSPGGGHARTLSWFLGCYGS

SEQ ID NO: 1771 - DNA, 2301 bp, Sorghum bicolor
  misc_feature: Ceres ANNOT ID no. 6016908
  misc_feature: Encodes the peptide sequence at SEQ ID NO 1772
atggaggacggggaggcggaggaggcgcagcgggacgcgatcaccgcgaggatgcggggccaggactacgcgggcgccagggcgctgctgctgcggacgctgcagacgaaccccaggctcgagggcgccctggagatgctcccggtgctcgaggtcctctgctgcgcggccgccactggccgtgggggtgtggactggtacagggtcctccaggtgctgcccggggatgacgccgccaggatcgaggagcggtacaagagcatcgtggcccaggtggagccggccatgggggctctgcccggcgccgaattggccctcaagctcgtcgacgaggcgtacgcggtgctgtctgatccggagaagcgagaggggttcgattcgagcaacgttttcactcggttcgttcggtctggtgttgttgatgcgccaccgcctggtggtacagtcgtccgttctgacagggtgagcagtcttcgcacaaaggagattaggggggcagatggtacgagcaatgcagcctcgtatgtcaaccgagctgccgacaggccatgctttgatggaaggtacccctttcttccaaatgtggcaagttcttccgggactaagaggatggatccttgctctcttggtgatgatggtgagttgcagtcacctgacggcactcatgttggcaagaggcaaaagagtgtctctgaaaaggatgtttattgcgtgtcgccctcacaggaagattgggatgcctgctttgatgatccatcacctgccatggaagaagatttggatgcccactttgatgatccatctggtgccaaagaagatgagctctgcactagcaagcagtatgaatatcataactttgaggaagacagggcgatcgagaattttgttgctggccaggtttgggcagcatatgactgggagaggtttcctcgtagatatggactgattgttaaagtactgacggataagatgcagttatatgtctcatggttcaagccctgtccgcaaactcctgaagagaagaaatggtcccatgcaggcttgccattggtttgtggaactttcattgcagaagaacaccatatctcattaatatgcccaactatgttctgtcaccaaattttcaccgataacccgaatcaagatcttgaggtgtatccccaggaaggtgaggtatgggccatttacagtaattgggacattgggtggtacaccgatcctaggatgtggaagagcagtgccttctctattgttgaaattcttaccagttattctagtgaatcaggttgcactgtcgcacacttggtaaaggtagatgggcatggaagtgttttccagaggcgcttcaagagtggaacagagcacttgttacaaatacacagggacaatctcatcacgttttctcacaggatcccttctttcagatttacttcagaggctggaactatgttcgagcttgaacattccacggttccagaaaatattcgccaagaaaatacatcagcgtgtgtttcttatttttctgagctttcaggtttacatgatgacacaaatggcttccctgaaactgctgttgcacaattctcaaatccttcatcaacaagcaaaatggaagctggttccccaatgcaagccatgatgagctacaactacaataccaagtggtcccccaaggattttctagagggtcaaatatgggctgtgtttgattctagggaccggatgcctaggtcttatgtcaggattatccatgtggtttcatatacttcagtttttgttttgaagttggaacctcaccctatgcttaatgaagagatacagtgggttgaagatggtctaccagttgcatctggggtatttcgtgctggtactcaaactagttacaaggatatctgggagttctcacaccctgtagagtgtgactggagtgcaaaaaggtctttttaccggattttcccccaaaaaggggaaatatgggcaatgctaaaaaattggaagatcaccttgaatagcactgacattgacaaatgtgaacctcgcatggttgagatcctctcagattactctgatgaaaatggagtaaatgtgtgcagcttggctcgggtaaaaagttgctttaccttttttcatagggtagtaatggaagatttccatttgacaaggtggatttcaaggtctgaaatgctcagcttttcccatcgtgttcctgcttttgtgattgttgatatcaaagatcatgatataccaaaagggtcatggcatctggaaccaagtgcccttcctacaaggatcatacattaa

SEQ ID NO: 1772 - protein, 766 aa, Sorghum bicolor
  misc_feature: Ceres ANNOT ID no. 6016908
  misc_feature (65)..(126): Pfam Id: DnaJ Pfam Desc: DnaJ domain
  misc_feature (4)..(765): NCBI GI: 20805233 NCBI Desc: osjnba0093f16.20 [oryza sativa (japonica cultivar-group)]
  misc_feature (268)..(764): NCBI GI: 15239554 NCBI Desc: dnaj heat shock n-terminal domain-containing protein [arabidopsis thaliana]
  misc_feature (282)..(497): NCBI GI: 140062656 NCBI Desc: heat shock protein dnaj [medicago truncatula]
  misc_feature (493)..(762): NCBI GI: 102139803 NCBI Desc: heat shock protein dnaj n-terminal domain-containing protein [musa acuminata]
  misc_feature (282)..(493): NCBI GI: 54290766 NCBI Desc: dnaj heat shock n-terminal domain-containing protein-like [oryza sativa (japonica cultivar-group)]
MEDGEAEEAQRDAITARMRGQDYAGARALLLRTLQTNPRLEGALEMLPVLEVLCCAAATGRGGVDWYRVLQVLPGDDAARIEERYKSIVAQVEPAMGALPGAELALKLVDEAYAVLSDPEKREGFDSSNVFTRFVRSGVVDAPPPGGTVVRSDRVSSLRTKEIRGADGTSNAASYVNRAADRPCFDGRYPFLPNVASSSGTKRMDPCSLGDDGELQSPDGTHVGKRQKSVSEKDVYCVSPSQEDWDACFDDPSPAMEEDLDAHFDDPSGAKEDELCTSKQYEYHNFEEDRAIENFVAGQVWAAYDWERFPRRYGLIVKVLTDKMQLYVSWFKPCPQTPEEKKWSHAGLPLVCGTFIAEEHHISLICPTMFCHQIFTDNPNQDLEVYPQEGEVWAIYSNWDIGWYTDPRMWKSSAFSIVEILTSYSSESGCTVAHLVKVDGHGSVFQRRFKSGTEHLLQIHRDNLITFSHRIPSFRFTSEAGTMFELEHSTVPENIRQENTSACVSYFSELSGLHDDTNGFPETAVAQFSNPSSTSKMEAGSPMQAMMSYNYNTKWSPKDFLEGQIWAVFDSRDRMPRSYVRIIHVVSYTSVFVLKLEPHPMLNEEIQWVEDGLPVASGVFRAGTQTSYKDIWEFSHPVECDWSAKRSFYRIFPQKGEIWAMLKNWKITLNSTDIDKCEPRMVEILSDYSDENGVNVCSLARVKSCFTFFHRVVMEDFHLTRWISRSEMLSFSHRVPAFVIVDIKDHDIPKGSWHLEPSALPTRIIH

SEQ ID NO: 1773 - DNA, 2415 bp, Sorghum bicolor
  misc_feature: Ceres ANNOT ID no. 6016911
  misc_feature: Encodes the peptide sequence at SEQ ID NO 1774
  misc_feature: Down-regulated in root tissues in response to aminocyclopropane carboxylic treatment
  misc_feature: Down-regulated in shoot tissues in response to salicylic acid treatment
  misc_feature: Up-regulated in shoot tissues in response to salicylic acid treatment
atggcgctgccgtcccaggccccgtctaactcaggggatccgctgtacccggagctctggcgcgcctgcgccggcccgctcgtcaccgtccctcgcgtcggcgacctcgtcttctactttccccagggacacatcgagcaggtggaggcgtccatgaaccaggtcgccgggaaccagatgcgcctctacgatctgccctccaagctgctctgccgcgtgctcaacgtcgagcttaaggcggagacggacaccgacgaggtctacgcgcagatcatgctcatgccagagcccgagcaaaccgatgtggcggctgagaaggcgagttctgcgtccgctgcgtcgccgaggccagcagtgaggtccttctgcaagacgctcaccgcctccgacaccagcacacacggaggcttctctgtgctgcgccgccacgcagacgagtgcctcccaccactggatatgacgcagtcgcctcccacacaggagctggtggcgaaggatctgcatggcatggagtggcgcttccgccacatctttcgcgggcaacccaggaggcatctccttcagagtggttggagtgtttttgttagttccaaaaggcttgttgctggagacgccttcattttcctcagaggagaaaatggtgaacttcgggttggtgttaggcgggctatgaggcagttgtctaatgtaccttcttcagtcatatctagccaaagcatgcacctcggagtccttgcgactgcatggcacgccatcaacaccaaatccatgttcactgtctactacaagcctaggacgagcccttcagagttcatcataccatatgatcaatatatggagtcagtgaaaaataactattcaattgggatgagattcagaatgaggtttgaaggggaagaggcaccagagcagaggtttactggtacaatcgttggctgtgaaaatcttgacccactatggcctgattccagttggagatacttgaaggtgcgctgggatgagccttctactatcccacgaccagatagggtctctccttggaagatagagcctgcttcatcacctccagttaatccactcccgctttcttctagagtaaaaagacctagacaaaatgctcctccaccttcacctgaagcatctgttctcacaaaagaaagtgcagccaagatcgatattgactctgctcaaacacaacatcaaaattcggtcttgcaaggtcaagagcaaatgaccttgaggaacaacctgactgaaagcaacgactctgattccactgttcaaaagccgatgatgtggtccccatcacccaatgggaaagcccacactaactttcagcagagacctgctatggatagttggatgccaatgggaaggcgtgaaacggacttcaaggactcacgttccgccttcaaggatgcccgcactgcctctcaatcatttagagatacacaggggttcttcatgcaagcttatgatgacaatcatcaccgtctttctttcaacaaccagtttcaggatcagggttcagctcatcgctttgcggatccatacttctatatggcccaacaaccttctctgactgttgaatcaagcacaaggacacaaacagcaaacaacgacttgcgtttctggggcgaccagaattcgatctatggtaatccaggtgatcaacagcagcagggtttcagctttggacaaaacccatcaagttggttgaaccagccatttccccaggttgaacagccacgagtggttaggcctcatgcaacagttgctccatttgatttggaaaagaccagagaaggcagcgggttcaagatctttgggttccaagttgatacaaccagtccatctcctgcccagttgagctctccattatgtgctatccgggagcatgtggtacaaacccgaccatcggcaccagtgaatgaattgcaacctgtgcaaaatgagtgcttgcctgagggatctgtaagcactgctggaactgcaactgagaacgagaaaaacattcagcaagcccagccaagttcaaaagatattcaaagcaagtcccagggtgcttcgacaaggagctgcacaaaggttcataagcaaggggttgcgcttggcagatctgtggacctctcaaaattcactgactacgatgaactcaaagcagaattagacaagatgtttgaattcaatggcgaattagtatctgccaacagaagctggcagatcgtttatactgacaatgagggtgacatgatgcttgtgggggatgacccgtgggaagagttctgtagcatagtgcgcaagatctacatctatacgaaggaggaggtccagaagatgaactcaaaatcatctgcgccaaggaaggaggagcctctaacagtgggtgaaggatgcgccgccacaaatgagtag

SEQ ID NO: 1774 - protein, 804 aa, Sorghum bicolor
  misc_feature: Ceres ANNOT ID no. 6016911
  misc_feature (248)..(329): Pfam Id: Auxin_resp Pfam Desc: Auxin response factor
  misc_feature (121)..(226): Pfam Id: B3 Pfam Desc: B3 DNA binding domain
  misc_feature (12)..(791): NCBI GI: 19352039 NCBI Desc: auxin response factor 2 [oryza sativa]
  misc_feature (15)..(801): NCBI GI: 85069279 NCBI Desc: auxin response factor 2 [lycopersicon esculentum]
  misc_feature (5)..(801): NCBI GI: 62319897 NCBI Desc: arf1-binding protein [arabidopsis thaliana]
  misc_feature (5)..(801): NCBI GI: 62319903 NCBI Desc: arf1-binding protein [arabidopsis thaliana]
  misc_feature (15)..(801): NCBI GI: 30027167 NCBI Desc: auxin response factor-like protein [mangifera indica]
  misc_feature: The plant is abnormally small.
  misc_feature: The sequence is a functional homolog of SEQ ID NO 108 in the 10/225,066US patent application
  misc_feature: The sequence is a functional homolog of SEQ ID NO 296 in the 10/412,699US patent application
  misc_feature: The sequence is a functional homolog of SEQ ID NO 576 in the 10/666,642US patent application
  misc_feature: The sequence is a functional homolog of SEQ ID NO 630 in the 10/412,699US patent application
  misc_feature: The sequence is a functional homolog of SEQ ID NO 692 in the 11/479,226US patent application
  misc_feature: The sequence is a functional homolog of SEQ ID NO 84 in the 10/374,780US patent application
  misc_feature: Useful for making plants with altered tocopherol content
  misc_feature: Useful for making plants with modulated biomass
  misc_feature: Useful for making plants with modulated growth and phenotype characteristics
  misc_feature: Functional homolog of the protein sequence given in SEQ ID NO 13376
  misc_feature: The sequence is a functional homolog of SEQ ID NO 296 in the 20040045049 US patent application
  misc_feature: The sequence is a functional homolog of SEQ ID NO 630 in the 20040045049 US patent application
  misc_feature: The sequence is a functional homolog of SEQ ID NO 576 in the 20070033671 US patent application
  misc_feature: Functional homolog of the protein sequence given in SEQ ID NO 13572
  misc_feature: Useful for making plants with modulated biomass
  misc_feature: Useful for making plants with modulated seed size
  misc_feature: Functional homolog of the protein sequence given in SEQ ID NO 13377
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: The sequence is a functional homolog of SEQ ID NO 298 in the 10/412,699 US patent application
  misc_feature: The sequence is a functional homolog of SEQ ID NO 300 in the 10/412,699 US patent application
  misc_feature: Useful for biocontainment applications
  misc_feature: Useful for making plants with modulated flowering time
  misc_feature: Functional homolog of the protein sequence given in SEQ ID NO 13656
  misc_feature: Down-regulated in root tissues in response to aminocyclopropane carboxylic treatment
  misc_feature: Down-regulated in shoot tissues in response to salicylic acid treatment
  misc_feature: Up-regulated in shoot tissues in response to salicylic acid treatment
MALPSQAPSNSGDPLYPELWRACAGPLVTVPRVGDLVFYFPQGHIEQVEASMNQVAGNQMRLYDLPSKLLCRVLNVELKAETDTDEVYAQIMLMPEPEQTDVAAEKASSASAASPRPAVRSFCKTLTASDTSTHGGFSVLRRHADECLPPLDMTQSPPTQELVAKDLHGMEWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSIGMRFRMRFEGEEAPEQRFTGTIVGCENLDPLWPDSSWRYLKVRWDEPSTIPRPDRVSPWKIEPASSPPVNPLPLSSRVKRPRQNAPPPSPEASVLTKESAAKIDIDSAQTQHQNSVLQGQEQMTLRNNLTESNDSDSTVQKPMMWSPSPNGKAHTNFQQRPAMDSWMPMGRRETDFKDSRSAFKDARTASQSFRDTQGFFMQAYDDNHHRLSFNNQFQDQGSAHRFADPYFYMAQQPSLTVESSTRTQTANNDLRFWGDQNSIYGNPGDQQQQGFSFGQNPSSWLNQPFPQVEQPRVVRPHATVAPFDLEKTREGSGFKIFGFQVDTTSPSPAQLSSPLCAIREHVVQTRPSAPVNELQPVQNECLPEGSVSTAGTATENEKNIQQAQPSSKDIQSKSQGASTRSCTKVHKQGVALGRSVDLSKFTDYDELKAELDKMFEFNGELVSANRSWQIVYTDNEGDMMLVGDDPWEEFCSIVRKIYIYTKEEVQKMNSKSSAPRKEEPLTVGEGCAATNE

SEQ ID NO: 1775 - DNA, 1668 bp, Sorghum bicolor
  misc_feature: Ceres ANNOT ID no. 6016913
  misc_feature: Encodes the peptide sequence at SEQ ID NO 1776
atggcgaccccagtgcgatcggcggccgcaccccgccgcctcgttccgtcgatacctccggcgagctccggacatgttcaacaactggcgtgcttcggtacccgaaccgagccttgcggtgcccgagggttgtcaatggtggtcgccgactccacccgccgtcgggccaagttaggggacggcggggacggcgtcctcggggcgtctgttctcggagggctcgggatggcgggattgggggatcagctgagcgtggtgatgaagttcggagggtcctcagtggcgtccgccgcgaggatggcggaggtggctggcctcatcttgacgttccccgaggagcgccccgtcgtcgtgctctctgccatggggaaaaccaccaacaaccttctccttgctggagagaaggcagtggggtgtggagtgatccacgtttctgaaatcgaagagtggaacatgatcaaagacctacatatcaagacagtggatgaactggggcttccaagatctgtaatacaagacatgctggatgaactggagcaactattgaaaggtatcgctatgatgaaagagctgacgcctaggaccagtgactaccttgtttcatttggagaatgcatgtccaccaggatttttgccgcttatttgaacaaaattggtgtcaaagcacggcagtatgacgcatttgatattggtttcatgacgactgatgaatttggtaatgcggatatcttagaagcaacctatcctgctgttgcaaagagacttcatggggactggatactggatccagcgatacctgttgttactggattccttgggaagggctggaaatcgggtgctgtaactactttaggccgaggtggtagtgacttgactgctacaaccattggtaaagccttgggactgagagaaattcaggtatggaaagatgttgatggtgtactgacttgtgatccaaatatctacccacatgcaaagactgttccatacttaacatttgaagaggctacagaacttgcttattttggtgcccaggttttgcatccacaatcaatgagacctgctagagaaggtgatattccagttagggttaagaattcatacaaccctaaagctccaggcacccttattaccaaacaaagagacatggataaggttgtactaactagcatagtgctcaagtcaaatgtcactatgttggatatcgtgagcactcggatgcttggtcagtatggttttctggcaagggtatttgctatatttgaagatctaggtatatctgtggattgtgttgctaccagtgaagtcagtgtttctgtgtcacttgatccatcaaagatttggagtagggaactgatacaacaggaacttgacaatgtagttgaagagcttgagaaaatagcaatcgttcatctacttcagcagagggcaataatttcgcttatcggaaatgtgcggcaaatgtctcttatactagaaaagaccggacatgtgctgaggaaaagtggggtcaatgttcagatgatctcgcaaggagcgtccaaggttaacatgtcgctgatagtccatgacagcgaggcaaaggcactcgtagaagcccttcatcaagcgttctttcaagacgatgtcctggcgcaagtcgaagtggagaacctactcgtgggctga

SEQ ID NO: 1776 - protein, 555 aa, Sorghum bicolor
  misc_feature: Ceres ANNOT ID no. 6016913
  misc_feature (83)..(366): Pfam Id: AA_kinase Pfam Desc: Amino acid kinase family
  misc_feature (61)..(552): NCBI GI: 115456611 NCBI Desc: os03g0850400 [oryza sativa (japonica cultivar-group)]
  misc_feature (84)..(548): NCBI GI: 126257055 NCBI Desc: monofunctional aspartate kinase 1 [zea mays]
  misc_feature (86)..(550): NCBI GI: 5305740 NCBI Desc: precursor monofunctional aspartokinase [glycine max]
  misc_feature (44)..(550): NCBI GI: 23308185 NCBI Desc: at5g13280/t31b5_100 [arabidopsis thaliana]
  misc_feature (44)..(550): NCBI GI: 4376158 NCBI Desc: aspartate kinase [arabidopsis thaliana]
  misc_feature (44)..(550): SWISSPROT Homolog: EC 2.7.2.4 Aspartokinase 1, chloroplast precursor
  misc_feature: Useful for making plants with altered alkaloid content
  misc_feature: Useful for making plants with modulated nitrogen use efficiency
  misc_feature: Functional homolog of the protein sequence given in SEQ ID NO 13262
  misc_feature: Useful for making plants with altered alkaloid content
  misc_feature: Useful for making plants with modulated nitrogen use efficiency
  misc_feature: Functional homolog of the protein sequence given in SEQ ID NO 13262
MATPVRSAAAPRRLVPSIPPASSGHVQQLACFGTRTEPCGARGLSMVVADSTRRRAKLGDGGDGVLGASVLGGLGMAGLGDQLSVVMKFGGSSVASAARMAEVAGLILTFPEERPVVVLSAMGKTTNNLLLAGEKAVGCGVIHVSEIEEWNMIKDLHIKTVDELGLPRSVIQDMLDELEQLLKGIAMMKELTPRTSDYLVSFGECMSTRIFAAYLNKIGVKARQYDAFDIGFMTTDEFGNADILEATYPAVAKRLHGDWILDPAIPVVTGFLGKGWKSGAVTTLGRGGSDLTATTIGKALGLREIQVWKDVDGVLTCDPNIYPHAKTVPYLTFEEATELAYFGAQVLHPQSMRPAREGDIPVRVKNSYNPKAPGTLITKQRDMDKVVLTSIVLKSNVTMLDIVSTRMLGQYGFLARVFAIFEDLGISVDCVATSEVSVSVSLDPSKIWSRELIQQELDNVVEELEKIAIVHLLQQRAIISLIGNVRQMSLILEKTGHVLRKSGVNVQMISQGASKVNMSLIVHDSEAKALVEALHQAFFQDDVLAQVEVENLLVG

SEQ ID NO: 1777 - DNA, 1224 bp, Sorghum bicolor
  misc_feature: Ceres ANNOT ID no. 6016917
  misc_feature: Encodes the peptide sequence at SEQ ID NO 1778
atggctgcgccgaggaaggggacggcgacgccgctgggcgccgtattctccccggaggagacgaagagagccgtggcgagggtgtccgagtccatcgctggccgccgcgccgagctcgggcgcctccagggcttcgtcgccgacaacgcggccctcgtctcgctcgtcaacaggctccccgacgaactctctcacgaaatcatggttccctttggcggcgccgcatttttcccagggcgtttaatacacacaaatgaactcttggtgctgctgggtgaggggtactatgcagagaggtctgctaagcagacgactgatatattgcataggagggggcaggaattggaagctcaagtcgaagcaatgaaggcaactatcgctgaccttgaagctgaggcgaaattctttgagtccactgccaccgaggcttcagagggtcttgttgaaatcagggaagagtacgatgaggacacagagacgaatgcatcaaaatcagaggcttcaattgctagtggggttatgtccgataaagatagggaacatgctcgaatcattgcaaggctagatgaactcgaaagggaagaaaaggaagctggaagtacttctgaagaagatgacgatgatgatgatgaagatgaagatgaagatgatggagatgctggaacaagtgaggatggtgaggaaaataaggaacctggaaatgctttaagtgatggcaatgagaaccacagttctagttttggcacttcattttctggaagtggtggcaatgataggagtcgtgggattatcaagctgaagagtgcactgaagaagcctggaggagatgaaatgctgagaggcatttctcatacaccatcagcccatacatctcatccagtatttcctggccaaacttctataacaaattctgatgtccaagttcgcactaaagctgtatcttttgaagacgacaaatatgtagttagttcgtcaaagtctcctcccctgctactggattcaatacagtctgctcctgggctcgagaattcttcagaccccactccatctcgtgaccgaaagataatatcaagtgggcgaaaggcctttacaggatctatcattgagcacgacgacaatatttcaaccattcaaccttctgtgggtaattcattggcaaaacctggtacttctgcttcttcaaggcccatgtcaagattcaagatgcagaaaggagggcggtga

SEQ ID NO: 1778 - protein, 407 aa, Sorghum bicolor
  misc_feature: Ceres ANNOT ID no. 6016917
  misc_feature (28)..(146): Pfam Id: Prefoldin Pfam Desc: Prefoldin subunit
  misc_feature (92)..(407): NCBI GI: 115441991 NCBI Desc: os01g0928300 [oryza sativa (japonica cultivar-group)]
  misc_feature (48)..(234): NCBI GI: 45501337 NCBI Desc: rpb5-mediating protein, isoform b [homo sapiens]
  misc_feature (48)..(234): NCBI GI: 19924161 NCBI Desc: rpb5-mediating protein isoform b [homo sapiens]
  misc_feature (48)..(234): NCBI GI: 20139325 NCBI Desc: rna polymerase ii subunit 5-mediating protein (rpb5-mediating protein)
  misc_feature (48)..(234): NCBI GI: 19924159 NCBI Desc: rpb5-mediating protein isoform a [homo sapiens]
MAAPRKGTATPLGAVFSPEETKRAVARVSESIAGRRAELGRLQGFVADNAALVSLVNRLPDELSHEIMVPFGGAAFFPGRLIHTNELLVLLGEGYYAERSAKQTTDILHRRGQELEAQVEAMKATIADLEAEAKFFESTATEASEGLVEIREEYDEDTETNASKSEASIASGVMSDKDREHARIIARLDELEREEKEAGSTSEEDDDDDDEDEDEDDGDAGTSEDGEENKEPGNALSDGNENHSSSFGTSFSGSGGNDRSRGIIKLKSALKKPGGDEMLRGISHTPSAHTSHPVFPGQTSITNSDVQVRTKAVSFEDDKYVVSSSKSPPLLLDSIQSAPGLENSSDPTPSRDRKIISSGRKAFTGSIIEHDDNISTIQPSVGNSLAKPGTSASSRPMSRFKMQKGGR

SEQ ID NO: 1779 - DNA, 1470 bp, Sorghum bicolor
  misc_feature: Ceres ANNOT ID no. 6016920
  misc_feature: Encodes the peptide sequence at SEQ ID NO 1780
atggtgaggctcccgtacgtgaccgcgctcaccacgctcttcagctacggcctcctcttcgccttcggccagctccgggacttcttccgcaggatcctcgacgcccgcaagcccagcaacctcaagggctacgcgccgatctgcttgggtctagaggatttctacacgcgccgcctctatctccgcatccaggactgctttggccggccgattgccagtgcgccagatgcttggttcgatgtggttgagcgctactcaaatgactgcaacaagacactccatcgtaccacagcaacaaccaaatgccttaacttgggttcctataactatcttggtttcgctgcggctgatgagtactgcacccctcgtgttattgagtcactgaagaaatattcggctagcacgtgcagtgttcgagttgacggaggcaacactaagctgcacacagagctcgaagagcttgttgcaagatttgttggtaagcctgcagctattctttttggcatgggctatgtgacaaactctgctatcattcctgctctggttgggaagggaggcttgattattagcgattcactgaaccataattctatagtcaatggagctagaggttcaggggccactgttcgggtttttcaacataacaatcctgctcacttggaagaggtattgagagagcagattgcaggaggccagcctcgtacacacaggccatggaagaagatcattgtgattgttgagggaatttatagcatggagggggagctatgcaaactccctgaggttatttctgtctgcaagaaatacaaggcctacacatatttagacgaagcacacagtattggagctattggaaaaacagggagaggtgtatgtgagctactgggagtggatccagctgatgttgacattatgatgggtacatttacaaaatcatttggatcatgcggaggttacattgcagcatcaaatgagattattcaccatctaaagcttacatgcccagcccatatttatgcaacatccatgtcacctccagcggtccagcaggtcatttcagctataaaggtcatccttggggaagatggaactaacagaggggccaagaagctcgctcaaattcgagagaacagcaatttcttccgctcggagcttcagaaaatgggttttgaggttcttggagataatgactcacccgtcatgcctatcatgctttacaatcctgctaaaattcctgcattctcaagggagtgcctgaggcaaaatgttgctgttgttactgttgcatttcctgccacaccacttctacttgcgagagctaggatatgtatctcagcttcccactccagagaagatctcataaaaggattggaggttatcagcaaagttggtgaccttgtgggtatcaaatacttcccggttgagcaagagaagaccacggctgttgaaaaactgaagaagattcaatga

SEQ ID NO: 1780 - protein, 489 aa, Sorghum bicolor
  misc_feature: Ceres ANNOT ID no. 6016920
  misc_feature (100)..(460): Pfam Id: Aminotran_1_2 Pfam Desc: Aminotransferase class I and II
  misc_feature (1)..(478): NCBI GI: 77551135 NCBI Desc: serine palmitoyltransferase [oryza sativa (japonica cultivar-group)]
  misc_feature (1)..(478): NCBI GI: 27753609 NCBI Desc: serine palmitoyltransferase [lotus corniculatus var. japonicus]
  misc_feature (1)..(489): NCBI GI: 109809703 NCBI Desc: serine palmitpoyltransferase subunit2 [nicotiana tabacum]
  misc_feature (1)..(489): NCBI GI: 4995890 NCBI Desc: serine palmitoyltransferase [solanum tuberosum]
  misc_feature (1)..(478): NCBI GI: 9309380 NCBI Desc: serine palmitoyltransferase [arabidopsis thaliana]
  misc_feature (5)..(471): SWISSPROT Homolog: EC 2.3.1.50 Serine palmitoyltransferase 2
MVRLPYVTALTTLFSYGLLFAFGQLRDFFRRILDARKPSNLKGYAPICLGLEDFYTRRLYLRIQDCFGRPIASAPDAWFDVVERYSNDCNKTLHRTTATTKCLNLGSYNYLGFAAADEYCTPRVIESLKKYSASTCSVRVDGGNTKLHTELEELVARFVGKPAAILFGMGYVTNSAIIPALVGKGGLIISDSLNHNSIVNGARGSGATVRVFQHNNPAHLEEVLREQIAGGQPRTHRPWKKIIVIVEGIYSMEGELCKLPEVISVCKKYKAYTYLDEAHSIGAIGKTGRGVCELLGVDPADVDIMMGTFTKSFGSCGGYIAASNEIIHHLKLTCPAHIYATSMSPPAVQQVISAIKVILGEDGTNRGAKKLAQIRENSNFFRSELQKMGFEVLGDNDSPVMPIMLYNPAKIPAFSRECLRQNVAVVTVAFPATPLLLARARICISASHSREDLIKGLEVISKVGDLVGIKYFPVEQEKTTAVEKLKKIQ

SEQ ID NO: 1781 - DNA, 2328 bp, Sorghum bicolor
  misc_feature: Ceres ANNOT ID no. 6016933
  misc_feature: Encodes the peptide sequence at SEQ ID NO 1782
atggctgaacctcagcgcacaaacaacaacggagctgctaatggtaatgcagactctgaatatgcatcagagaaactgccaccaaagaggctacagagatttgattcactgcatattgaggctggaaagattcctggtggaccaacacatgcagccaaggttggctgggcaaccacactacatttggcattccaaagcataggtgtggtttatggcgacatggggacttctcctctctatgttttctccagcacctttacagatgggatcaacaacacagatgacctccttggagtcatgtctctaattatctacactgttattctccttccgttgataaagtattgtttcattgtactgcgagctaatgacaatggagacggaggaacatttgcactttattcattgatatcacggtatgctaggattagcttgatacctaatcagcaggctgaagatgcaatggtctctcgctacaagttagagtccccaacaaatcgtatcaagagggctcactggatcaagaacaagatggaaaacagtccaaaatttaagatcacacttttcctagtgacagtcctgggaacatccatggtgattggtgatggtgttctaaccccatgtatctcagtgcttagcgcggttggagggatccagcaaaaagcaacaaccctgactcaaggacagattgctggcatctcaatagccattttgattgtcctctttcttgttcagcgcttcggcacagataaagttggttacacatttgctcctataatcctgacatggttcatcttgattgctggcattggagtttacaatttgatcaaacatgatactagcgttctcaaagcattcaatccaaaatatattgtggattatttcaaaagaaatggaaaacagggttggatttctcttggaggggttattttatgcattacaggaactgaggcaatgtttgctgaccttggtcacttcaatatgagagccattcagattggcttctcagtagtactgttcccttcagtactgctagcatacattggacaagctgcatatctccgtatctacccagaaaatgttgcaaatacattctacaaatcaattccaggtccattatattggccaacctttgtggtggcagtagccgctgctataattgcaagccaagctatgatatctggtgcatttgcaattattgcacagtcgcaagttctaggttgctttccacgggttcgtgtgactcacacatcaacaaagtttgaaggacaagtctacatcccggagatcaactatgcattgatgattttatgtgtagctgttacagctattttccaaacaacagaaaagattggaaatgcatatggtattgctgttgtttttgtgatgtttataacaacacttctggtcaccttagtaatgactatgatatggaagacaagtctgctatggattgcactctttccaataatatttggtggagcagagctcatatacttatcttcggcattctataagtttactcaaggtggctacttgccactagtttttgcagcaattttgatgtttataatggccacatggcattatgtccatgttcatcgatacaactatgagctccagaacaaagtatcaagtaactatgtagcagaattggcctctaggcggaacctggccaggttgccaggaataggctttttgtactccgagcttgtgcaaggcatcccacccatacttcctcacttggtagaaaacgtaccttccatccattcagtacttgtgattatatcaataaagtacttaccgatcagcaaaatagaaacaaatgagcggttcctcttcagatatgtggagccaaaagagtacagggtattccgatgtgtggtgcgctatggatacaatgataaagtagaagatccaagagaatttgagggcttgcttattgaacatatgaaagaatttatccatcaagaatcattttacagccaaggtagagatcattcagcagaagaagtagaagatgcaattgagccttctgacagtgttcgaggggcaacattgtccaaaagtttttcagatagaagcattgttgttccaccaaatgggtgcatggatgtgatccaaataatacagagagaaatggaggctggcgttgtccatatgctaggagaaactaatgtggtggcaggaccaaatgcggatttattgaagaagataatagttgactacgcctacagtttcatgaggaagaacttcaggcaaccagagaagataacatgtgtccctcataacagactgttacgggtgggaatgacatatgagatctag

SEQ ID NO: 1782 - protein, 775 aa, Sorghum bicolor
  misc_feature: Ceres ANNOT ID no. 6016933
  misc_feature (61)..(775): Pfam Id: K_trans Pfam Desc: K+ potassium transporter
  misc_feature (30)..(702): NCBI GI: 115458178 NCBI Desc: os04g0401700 [oryza sativa (japonica cultivar-group)]
  misc_feature (31)..(775): NCBI GI: 12862380 NCBI Desc: high-affinity potassium transporter [phragmites australis]
  misc_feature (31)..(775): NCBI GI: 12862382 NCBI Desc: high-affinity potassium transporter [phragmites australis]
  misc_feature (31)..(775): NCBI GI: 12862378 NCBI Desc: high-affinity potassium transporter [phragmites australis]
  misc_feature (31)..(775): NCBI GI: 12862384 NCBI Desc: high-affinity potassium transporter [phragmites australis]
  misc_feature: The sequence is a functional homolog of SEQ ID NO. 279 in the 11/188,298 US application
MAEPQRTNNNGAANGNADSEYASEKLPPKRLQRFDSLHIEAGKIPGGPTHAAKVGWATTLHLAFQSIGVVYGDMGTSPLYVFSSTFTDGINNTDDLLGVMSLIIYTVILLPLIKYCFIVLRANDNGDGGTFALYSLISRYARISLIPNQQAEDAMVSRYKLESPTNRIKRAHWIKNKMENSPKFKITLFLVTVLGTSMVIGDGVLTPCISVLSAVGGIQQKATTLTQGQIAGISIAILIVLFLVQRFGTDKVGYTFAPIILTWFILIAGIGVYNLIKHDTSVLKAFNPKYIVDYFKRNGKQGWISLGGVILCITGTEAMFADLGHFNMRAIQIGFSVVLFPSVLLAYIGQAAYLRIYPENVANTFYKSIPGPLYWPTFVVAVAAAIIASQAMISGAFAIIAQSQVLGCFPRVRVTHTSTKFEGQVYIPEINYALMILCVAVTAIFQTTEKIGNAYGIAVVFVMFITTLLVTLVMTMIWKTSLLWIALFPIIFGGAELIYLSSAFYKFTQGGYLPLVFAAILMFIMATWHYVHVHRYNYELQNKVSSNYVAELASRRNLARLPGIGFLYSELVQGIPPILPHLVENVPSIHSVLVIISIKYLPISKIETNERFLFRYVEPKEYRVFRCVVRYGYNDKVEDPREFEGLLIEHMKEFIHQESFYSQGRDHSAEEVEDAIEPSDSVRGATLSKSFSDRSIVVPPNGCMDVIQIIQREMEAGVVHMLGETNVVAGPNADLLKKIIVDYAYSFMRKNFRQPEKITCVPHNRLLRVGMTYEI

SEQ ID NO: 1783 - DNA, 960 bp, Sorghum bicolor
  misc_feature: Ceres ANNOT ID no. 6016940
  misc_feature: Encodes the peptide sequence at SEQ ID NO 1784
atggccctccgcgcgctcgacaacacgatgcccgccgccgtcgaggagcggcccaagaaggtggctaaggtgggcgtccccgccgccgccgccgccgtcaaggccacctcgcccgggagcggcgacaagaagaaaaagaaggggaacgacgagaactcggcgcccagggccacgaccgcggcggcggagcaggccgtggagtacatcccgtcggaggagctggcggcggcggccagccccaaggccaaggccgcggggctggtcgcggacctggactccaaggactgggtcaagacctgcgaggcgcttaacgacgcgcgccgcctcgcgatccaccaccccgcgctcctcaacccgatcctagagaaggtggtgctggcggtcgtgaagacgatgaagagcccccgcagcgcggtgctcaagacgtccatcatggcctgcgccgacatcttcagctccttcggcaacctcctctcctccgtctccgacgacgccttcgacaagctgctgctccagctcctgctgaaggcgtcccaggacaagcgattcgtgtgcgaggaggccgagaaggcgatgcgcgcgatggcggcgtcgatgccgccgctgccgctgctgaagaagctcaaggcgtacgtccaccacgccaaccttagggtcagggccaaggccgccgtcgccatctcccactgcgccgcccggatggacatcgaggcgatgaaggagttcgggatgtcagctctgctgcaggtggcggcggagctgctgaacgaccgtctaccggaggcgagggaggccgcccgcggcgtggtttcgtcgatgcacgcggcgttcgccaaggatgccgccgccagtggccaggaggacgacgcggccgcgtcctgggagagcctctgctcgctcagcctcccgcccatctccgcggtggccgtcgctaagatcaccgcctcctcctcctcgtag

SEQ ID NO: 1784 - protein, 319 aa, Sorghum bicolor
  misc_feature: Ceres ANNOT ID no. 6016940
  misc_feature (122)..(317): NCBI GI: 115477505 NCBI Desc: os08g0534200 [oryza sativa (japonica cultivar-group)]
  misc_feature (41)..(279): NCBI GI: 115502237 NCBI Desc: protein kiaa0423
  misc_feature (41)..(279): NCBI GI: 50510481 NCBI Desc: mkiaa0423 protein [mus musculus]
  misc_feature (40)..(279): NCBI GI: 40807213 NCBI Desc: kiaa0423 protein [homo sapiens]
  misc_feature (40)..(279): NCBI GI: 119586194 NCBI Desc: kiaa0423, isoform cra_a [homo sapiens]
  misc_feature: Useful for making plants with modulated nitrogen use efficiency
  misc_feature: GREAT-hit functional homolog of the protein sequence given in SEQ ID NO 13164
MALRALDNTMPAAVEERPKKVAKVGVPAAAAAVKATSPGSGDKKKKKGNDENSAPRATTAAAEQAVEYIPSEELAAAASPKAKAAGLVADLDSKDWVKTCEALNDARRLAIHHPALLNPILEKVVLAVVKTMKSPRSAVLKTSIMACADIFSSFGNLLSSVSDDAFDKLLLQLLLKASQDKRFVCEEAEKAMRAMAASMPPLPLLKKLKAYVHHANLRVRAKAAVAISHCAARMDIEAMKEFGMSALLQVAAELLNDRLPEAREAARGVVSSMHAAFAKDAAASGQEDDAAASWESLCSLSLPPISAVAVAKITASSSS

SEQ ID NO: 1785 - DNA, 789 bp, Sorghum bicolor
  misc_feature: Ceres ANNOT ID no. 6016942
  misc_feature: Encodes the peptide sequence at SEQ ID NO 1786
atgccgctcccgacgatgacccactcctccgcgttcctcctcccgtcctcaaccgccccgtccaaccccagcggcggcgccgacacgaccacctacgcgctcgtcgtcctcaaccagcgcctcccccgcttcgcgccgctcctatgggcagcgcgcctgcgcgtgtgcgcggacgggggcgccaaccgcgtcttcgacggcatgccggagctcctcccgggcgaggaccccgccgaggtccgcaccaggtacaagccagatgtaattaaaggggacatggactcaataaggccagaagtgaaggagtattattccaatttgggcacaaacatagttgatgaatcacatgatcaggacacaactgacttgcacaaatgtgtatcatttatcacaagcgatctccctgtcccagagaagtctaatctgtatattcttgttcttggtgcacttggtggaagattcgatcatgagatggggaacatcaatgtattataccgcttttcaaacatcaagatcatcctcctatcagatgactgttcaatctttctgctccccaagacacactctcacgagatccatattgagacatcggttgaaggtcctcactgtggtttgattcccatgggcggcccatcagatatcaccacaaccaccgggctccggtggaatttagataacacaagcatgaggtatggtggattgataagcacatctaacatcgtggatgaagataaagtaacggtgacttcagattctgatctgatctggacaatatcgcttcggaattga

SEQ ID NO: 1786 - protein, 262 aa, Sorghum bicolor
  misc_feature: Ceres ANNOT ID no. 6016942
  misc_feature (38)..(177): Pfam Id: TPK_catalytic Pfam Desc: Thiamin pyrophosphokinase, catalytic domain
  misc_feature (188)..(256): Pfam Id: TPK_B1_binding Pfam Desc: Thiamin pyrophosphokinase, vitamin B1 binding domain
  misc_feature (3)..(262): NCBI GI: 115436492 NCBI Desc: os01g0356500 [oryza sativa (japonica cultivar-group)]
  misc_feature (8)..(262): NCBI GI: 14278355 NCBI Desc: chain b, mouse thiamin pyrophosphokinase complexed with thiamin
  misc_feature (20)..(262): NCBI GI: 46250253 NCBI Desc: thiamin pyrophosphokinase 1 [homo sapiens]
  misc_feature (20)..(262): NCBI GI: 119600497 NCBI Desc: thiamin pyrophosphokinase 1, isoform cra_a [homo sapiens]
  misc_feature (32)..(262): NCBI GI: 39644700 NCBI Desc: tpk1 protein [homo sapiens]
MPLPTMTHSSAFLLPSSTAPSNPSGGADTTTYALVVLNQRLPRFAPLLWAARLRVCADGGANRVFDGMPELLPGEDPAEVRTRYKPDVIKGDMDSIRPEVKEYYSNLGTNIVDESHDQDTTDLHKCVSFITSDLPVPEKSNLYILVLGALGGRFDHEMGNINVLYRFSNIKIILLSDDCSIFLLPKTHSHEIHIETSVEGPHCGLIPMGGPSDITTTTGLRWNLDNTSMRYGGLISTSNIVDEDKVTVTSDSDLIWTISLRN

SEQ ID NO: 1787 - DNA, 2403 bp, Sorghum bicolor
  misc_feature: Ceres ANNOT ID no. 6016948
  misc_feature: Encodes the peptide sequence at SEQ ID NO 1788
atggccgccccgccgcagccgcacccgccggcagcggtggagggggcagcgccggcggctcccctgaccgccgccgcgccgggtccacggccgtacgacgtggcggtcgcggcggcggagctccggccggtggactgcaacctcgcctcgctctgtgaccacgtccaggcggaggggttcggctccggggccttctccgacctcgtcgtggaggccatgggcgccacctaccgtctccatcgcctcatcctctcccgcagcgcctacttcaggaatatgctacatggtccttggagagaggcgggagcacccacagtggttttgcacatagatgatgccaatgttgattcagaggcaattgcaattgcacttgcatatctttacgggcaaccccccaagcttaatgataacaatgcatcccgggtgcttgcagctgcatcatttctggatcttcaggacttatgtacaatatgtacagattttattatttctgagctttggacatcaaactttttacaatatcagttgtttgctgagagtcaagattatggtagccatggagagcgtgtcaggaatgcttgctggggttatctttgtcaaagtgccacgctggaattacgagaggtgctaccaaagctttcttcacaaactttgcatgctctccttacatctgacgaattgtgggtacctaacgaggagaaaaggtttgaactagcattgtttactctacttgcaaaggttgctatgtgtgagatacaagttagtgggaatgaaacaaacttaccaagtgctgatcgatccttgaggaaggggaagacttcaatggatgaatctggggagcaactgctaatggactctgaattgcagaacttgaagctgcataataacttgggcaatgaaattccccataacattattgctatttcagatatgaatggtgaagctcccaagagaatggagaatgattgttctaccggaggaccatcaggagaaagcacttcatatcaatttaatgaaaataactggctttctagtgagcaaactgcaaataattatttctcaagaacttccagtagtggtgttgttcctactgagtggggaaggcccaatgcaccactttggggtggtagggtcgttggacggcggcaaggtacatgcattagaggaatctcttgtctatctactgatgaatataatgcctttatgaatatatttgagaggggttctctgctctactgtaatatgtcctttgatgcactgctaagtgttcgaaagcaactcgaagaatttggattcccttgcaaagctgtcaatgatggtctatggctacagatgcttctgtgtcacagggtgcaagcgatagttgctgatacttgcaggaactgttgccttacgaataattcttgtgcttgcaagcaagcatatgtgagctcgcatacacactacaggcaggagcatgaccggagcagtgcttctggcagcataggtaatgtctaccttgcggatggccagggcgatgggaatggtgtacttgggcctgtccgtgttaacgtaagaggagcagtcgatggacttgctggtattgggagagggaactcaaatgtgcctggtgcagcttgggctcctacacgttatgtcttctcccgtgtcccttatgggctcggttcaagaaatggccagcaatttgccaatgatgaatcagaacctagaattgaccgcaatggagatatttcagcagatggtctgactgcattggttaaccttagccaagaaaacagtgctgctcatctgcaggctgaaagtctatttgagacagggatgcagacaagatatcgcagtgttgcatctgtttccactccaggtggttcttctgtccagatgcaggagtcaaaggagcatgaacttggatcagattgggaaactgcagaggatgcaactatatcgttagacatgaaaacacctcttagccattttcctcctttccgctttggggttgaattcgaggatgtgcacaggcttgctgatggtcaggtgaaacactcgactgaagtgttttatgcaggctctctatggaaggttagtgtccaggcattcaatgatgaggaccctcatgggcgacgcacccttggactttttctccaccgacgcaaggctgagttgttagatcccttgaggaaggctaacttgtacatcgacccccgggaaaaggtcactgctcggtatcagctcatctgtccatcaaagagagaggtcatgatatttggaagcctgaagcaggctgggacgctgctaccaaaagccccgaagggctggggttggcgtactgctatactgtttgatgagcttgcagatcttctccagggtggtgccctgcgaattgctgcagtggtccagctcgtgtaa

SEQ ID NO: 1788 - protein, 800 aa, Sorghum bicolor
  misc_feature: Ceres ANNOT ID no. 6016948
  misc_feature (52)..(166): Pfam Id: BTB Pfam Desc: BTB/POZ domain
  misc_feature (43)..(257): NCBI GI: 82802724 NCBI Desc: gmcl2 [pongo pygmaeus]
  misc_feature (48)..(257): NCBI GI: 58219520 NCBI Desc: germ cell-less protein [rattus norvegicus]
  misc_feature (48)..(257): NCBI GI: 57639631 NCBI Desc: germ cell-less protein [rattus norvegicus]
  misc_feature (48)..(257): NCBI GI: 32451989 NCBI Desc: germ cell-less [mus musculus]
  misc_feature (48)..(277): NCBI GI: 13957745 NCBI Desc: germ cell-less protein [oryzias latipes]
MAAPPQPHPPAAVEGAAPAAPLTAAAPGPRPYDVAVAAAELRPVDCNLASLCDHVQAEGFGSGAFSDLVVEAMGATYRLHRLILSRSAYFRNMLHGPWREAGAPTVVLHIDDANVDSEAIAIALAYLYGQPPKLNDNNASRVLAAASFLDLQDLCTICTDFIISELWTSNFLQYQLFAESQDYGSHGERVRNACWGYLCQSATLELREVLPKLSSQTLHALLTSDELWVPNEEKRFELALFTLLAKVAMCEIQVSGNETNLPSADRSLRKGKTSMDESGEQLLMDSELQNLKLHNNLGNEIPHNIIAISDMNGEAPKRMENDCSTGGPSGESTSYQFNENNWLSSEQTANNYFSRTSSSGVVPTEWGRPNAPLWGGRVVGRRQGTCIRGISCLSTDEYNAFMNIFERGSLLYCNMSFDALLSVRKQLEEFGFPCKAVNDGLWLQMLLCHRVQAIVADTCRNCCLTNNSCACKQAYVSSHTHYRQEHDRSSASGSIGNVYLADGQGDGNGVLGPVRVNVRGAVDGLAGIGRGNSNVPGAAWAPTRYVFSRVPYGLGSRNGQQFANDESEPRIDRNGDISADGLTALVNLSQENSAAHLQAESLFETGMQTRYRSVASVSTPGGSSVQMQESKEHELGSDWETAEDATISLDMKTPLSHFPPFRFGVEFEDVHRLADGQVKHSTEVFYAGSLWKVSVQAFNDEDPHGRRTLGLFLHRRKAELLDPLRKANLYIDPREKVTARYQLICPSKREVMIFGSLKQAGTLLPKAPKGWGWRTAILFDELADLLQGGALRIAAVVQLV

SEQ ID NO: 1789 - DNA, 381 bp, Sorghum bicolor
  misc_feature: Ceres ANNOT ID no. 6016953
  misc_feature: Encodes the peptide sequence at SEQ ID NO 1790
atgctgccgccacggcgccactcggcgctcgcggtgcttgtactggccgccgtgctcctcgcggtcgcaggcaacaacgcgcagcggagcgccgccgccgccgcgttggcaccggtgtaccaccacgacgacgactgggcggcggacgtgggctacggttacggcggcgtggcggcctgcacgggcacggcgacgggggcggagtgcgcggtggcggccaggagggagctgggcgacggcggcagcatcggctacggcgcgctgcgtaaggaccagacgccgtgctcgtaccgcggcgcgtcctactacaactgccgccccggcggcgccgccaacccctacacccggggctgctccgccatcacccagtgcagaggctag

SEQ ID NO: 1790 - protein, 126 aa, Sorghum bicolor
  misc_feature: Ceres ANNOT ID no. 6016953
  misc_feature (61)..(126): Pfam Id: RALF Pfam Desc: Rapid ALkalinization Factor (RALF)
  misc_feature (1)..(126): NCBI GI: 15623891 NCBI Desc: p0506e04.27 [oryza sativa (japonica cultivar-group)]
  misc_feature (8)..(126): NCBI GI: 115447833 NCBI Desc: os02g0670500 [oryza sativa (japonica cultivar-group)]
  misc_feature (45)..(125): NCBI GI: 37695573 NCBI Desc: rapid alkalinization factor 2 [solanum chacoense]
  misc_feature (30)..(125): NCBI GI: 16566316 NCBI Desc: ralf precursor [nicotiana tabacum]
  misc_feature (45)..(125): NCBI GI: 42374767 NCBI Desc: rapid alkalinization factor preproprotein [nicotiana attenuata]
  misc_feature: The plant is abnormally small.
  misc_feature: Useful for making plants with modulated biomass
  misc_feature: Functional homolog of the protein sequence given in SEQ ID NO 13255
MLPPRRHSALAVLVLAAVLLAVAGNNAQRSAAAAALAPVYHHDDDWAADVGYGYGGVAACTGTATGAECAVAARRELGDGGSIGYGALRKDQTPCSYRGASYYNCRPGGAANPYTRGCSAITQCRG

SEQ ID NO: 1791 - DNA, 384 bp, Sorghum bicolor
  misc_feature: Ceres ANNOT ID no. 6016957
  misc_feature: Encodes the peptide sequence at SEQ ID NO 1792
atggcatccaacaagattgtagcagtgcctggtgtcttcatcctcgccttgctccttgttgcctattgtgcggaggcaacaatctgctcaaggcataatacttcttaccaaggcttatgccggagcaataagaactgtgcgaactcgtgtactcaacatgggcttggcactagcggatactgcaagggcaatgtccgtattttcaaaaaatgcttttgtacctttgaatgccctgggggaggtggagggggagggggagggggaggagaaaatccaccagaggagggagggggagacgaagggggaggaggaaatccgccaagagggggaagggggagacgaaatccgccaagggtcaagccgcattccgacgagcaccagtag

SEQ ID NO: 1792 - protein, 127 aa, Sorghum bicolor
  misc_feature: Ceres ANNOT ID no. 6016957
  misc_feature (27)..(77): Pfam Id: Gamma-thionin Pfam Desc: Gamma-thionin family
  misc_feature (25)..(121): NCBI GI: 115442041 NCBI Desc: os01g0932700 [oryza sativa (japonica cultivar-group)]
  misc_feature (8)..(117): NCBI GI: 27818335 NCBI Desc: major pollen allergen art v 1 precursor [artemisia vulgaris]
  misc_feature (4)..(77): NCBI GI: 20067024 NCBI Desc: gamma thionin [capsicum annuum]
  misc_feature (4)..(73): NCBI GI: 1200228 NCBI Desc: defensin [capsicum annuum]
  misc_feature (24)..(117): NCBI GI: 33323477 NCBI Desc: major pollen allergen artv1 [synthetic construct]
MASNKIVAVPGVFILALLLVAYCAEATICSRHNTSYQGLCRSNKNCANSCTQHGLGTSGYCKGNVRIFKKCFCTFECPGGGGGGGGGGGENPPEEGGGDEGGGGNPPRGGRGRRNPPRVKPHSDEHQ

SEQ ID NO: 1793 - DNA, 1371 bp, Sorghum bicolor
  misc_feature: Ceres ANNOT ID no. 6016965
  misc_feature: Encodes the peptide sequence at SEQ ID NO 1794
atggcgacgccagccgccgcgccggccccaccaaaccctaaccctgtccccgacgacccgccgctgcagcagcagcacgaggaggaggaggaagagtcgccggagccagagccggagacggcgccgacgtccctcaccacctcgatcgaccccaccccttccggcggcgaggagagcgagagcgatgactcctcgtccgtctcctcggcgccctcctcagcccccgctcccgcccccgcagcggcggcggccgcggcgccttcgcccgctgccaaggacctcctccacatctccttcaaccaggactacggctgcttcgcggcgggcaccaagtcgggcttccgcatctacaactgcgaccccttccgcgagatcttccgccgggaccttgccgccgtgggcgacggcgctaccggcgccggcgtcggcggcggtgccgggggagggggtatcggcgtcgtcgagatgctgttccgctgcaacatactcgcgctcgtcggcggcggcgataatccccactacccgcctaacaaggtcatgatctgggacgaccaccagagccgctgcatcggggagctctccttccgctcccccgtacgaggcgtccggctccggcgcgaccgcatcatcgtggtactcgagaacaaaatcttcgtctacaacttcgcggaccttaagctcgtgcaccagatcgagacggcgcccaaccccaagggcctctgcgctgtgtcgcagcagcccgggtctatcgtgcttgtttgccccggtgcccagaaggggcagattagggtggaacactatggggcaaggaagaccaagtttattaatgcacacacttcccgtgtcgcgtgcttcgcgttgtcgcaggatgggaggctcattgcaactgctagcaccaagggaacacttgttagaatctacaacgcagctgaaggcaatctcctgcaggaagtaaggagaggtgctgatagagcagaaatatatagcttggctttctcgaataatttgcagtatttgtctgtctcgagcgataaaggaacaatacatgtgttcaatttaaagataaatgtgggatcgactgcaaatgataagcctatgcctgctccagatcctgaagttccccatataagcccccctctttcattcattaagggtgtgttgccgaaatatttccattctgagtggtcagtagctcaattcaggctacatgagggtgagcagtatattgttgcatttggacatgagaagaatactgtggcagttgttggtatggatggaagcttctacagatgccaatttgacccagttaacggaggagaaatgctgcagctggagtgctacaatttcctaaaaccatcggatcaaccgtag

SEQ ID NO: 1794 - protein, 456 aa, Sorghum bicolor
  misc_feature: Ceres ANNOT ID no. 6016965
  misc_feature (34)..(452): NCBI GI: 16323362 NCBI Desc: at3g62770/f26k9_200 [arabidopsis thaliana]
  misc_feature (74)..(454): NCBI GI: 92882249 NCBI Desc: wd40-like [medicago truncatula]
  misc_feature (148)..(448): NCBI GI: 89291191 NCBI Desc: riken cdna 0610008n23-related [tetrahymena thermophila sb210]
  misc_feature (87)..(454): NCBI GI: 82234110 NCBI Desc: wd-repeat domain phosphoinositide-interacting protein 3 (wipi-3) (wd-repeat protein 45-like) (wdr45-like protein)
  misc_feature (88)..(454): NCBI GI: 123285742 NCBI Desc: novel protein [mus musculus]
MATPAAAPAPPNPNPVPDDPPLQQQHEEEEEESPEPEPETAPTSLTTSIDPTPSGGEESESDDSSSVSSAPSSAPAPAPAAAAAAAPSPAAKDLLHISFNQDYGCFAAGTKSGFRIYNCDPFREIFRRDLAAVGDGATGAGVGGGAGGGGIGVVEMLFRCNILALVGGGDNPHYPPNKVMIWDDHQSRCIGELSFRSPVRGVRLRRDRIIVVLENKIFVYNFADLKLVHQIETAPNPKGLCAVSQQPGSIVLVCPGAQKGQIRVEHYGARKTKFINAHTSRVACFALSQDGRLIATASTKGTLVRIYNAAEGNLLQEVRRGADRAEIYSLAFSNNLQYLSVSSDKGTIHVFNLKINVGSTANDKPMPAPDPEVPHISPPLSFIKGVLPKYFHSEWSVAQFRLHEGEQYIVAFGHEKNTVAVVGMDGSFYRCQFDPVNGGEMLQLECYNFLKPSDQP

SEQ ID NO: 1795 - DNA, 3537 bp, Sorghum bicolor
  misc_feature: Ceres ANNOT ID no. 6016970
  misc_feature: Encodes the peptide sequence at SEQ ID NO 1796
atggagctcgtcaccgtcaagcccgcggccggagctctcgtcgaggagggctccgggtccgtggccggcgcgggctcgatcccggcgatggtggcggcgcagcagcagctgctgcacgaacaggtggaccagctccagcgcctcgtcgtcgctcagtgccgtctcaccggcgtcaaccccctcgcccaggagatggctgccggtgcattgtctatcaagataggtaagaggccaagggatctgttgaatccaaaagcagttaagtacatgcagtcactttttgccttgaaggacactcttggcaaaagagaaacccgagaacttagtttgctctgtggggtcactgttacgcaggttagggaattctttacaattcaaaaatcacgagtgagaaagtttgttcgtctgtctcaagaaaaagcgctgagaatagaaacacctaaggagcaggacaatgcatactcaatagactctgagcagataccattggacatagaggcacaagctgaagttatcgaacctttgagcactttagaaccagtggtcctacagagctctttgcaaccaacggatgtccctcaggtctctttgcaatcaatggcgctccaacaaagcgatctgcagcacatggaagtcttccaaaatactttgcataaagcagaggctcaacagaactttgcagctcctatgatgccacctggaacaatggttatgcaaccaactgatgctaagattagctcagactctgttcaaaaggatattaagcaagaggaaactcatcctggtgttgagtcagaagataagaagttcttggaaagtatctttgctctaatgcagaaggaggaaacattctctgggcaggtcaaattaatggaatggattctgcaaataaataatgctacagttcttagtaggtttgtaacgatgggtggtttgaccattatgtcaacatggttgagtcaagcagcaattgaagagcagacatcggttatccatgttattttcaaggtgctgctccaccttccgttacataaggctttaccagtccacatgtcagttgttttgcaaacaattaataggttgcggttttatagaacacaagacatatcgagcagggctaggaacctcttatccagattgagcaaagtgcttgtaaggattcaagcattgaagcaacctcagaaggactcgatatgtaaacaaaggataagtgaaattctccgtgacgagtcttggaaatctgaagttgatattaccgagaagatacttgccttggctgatggtgctaatgagagcagaaagcctgagcccaaaaaaacaccaatgcttctcactgcttctgctgacgagacaaataaaaggagttctgtgcagacaaaatccaaacaaaaaaggaaagttctacttgtggaacatccaaataagaaagttgcagggaagaatgctaattctgtcaggaacacatctacaaacaatagcaggccattatctgcagatgatattcaaaaagcaaagatgcgtgccatgttcatgcaggagaagtatggcaaagttgacacaaataaagcgagtgataaaccacaagcaatggaaacaccgaaaagagctggattagtaaattcaaatgcatcacctatgcccataagtccacgtacatcagctgcacgacctgttgatccaagcccatctacttctaaacaaagcacagattctcagcctgataatagagaaatctcaggtggtttgaagttagacataggttctaaaactaatgttatagagaagttggattccaagagagttctttggcaaataccaccagcggtatggattgacccctcatggagtgtaggagctggtgacaacagcaaggaggtcgaggttcaaacacagagaaaccgacgtgaaaaggaaaccttttatgcaagtcagaaggatatcccaacaaatccaaaggatccatgggatctggaaatggactttgatgacagcctgaccccagaaattccaattgaccagacgccagatgttgacgctatggaaacagatagtgttcgtgcagcacctattgctgtggctcctgttaaggacaagcagattgaatctacatcatcaacatcaggtgcagttgctgatggtgcaggtgctgatactgattatgaattgcttacggtgctactcaagaatccggagcttgtttttgcattaacatctaataacaaaggggagaacatgcctaacgaacagaccattgcccttctggatacactgaagcagactggccttagcctttcagagcttgttaacagtctggggaatggtgctgggtttccgaaagagccagagccagaggcagaacctcttcctgcttcccttccatcaccaactccaccagaccgtacatcaatggctgtctggagaccagaaaacccaatgcaggttatggctccaaacttgcagcagccatgtttgtcaagccgggggaatacacctcctattgcaaatgccatgcagcaaagcttctcaaatgttgtcagttcgttaccctcacaactttatgcttcagtttcggttttgccggcacagattcaagctaacaccccatctctaccacagttggcggtctctgtaaatccgccaattcgacatgtttcccctgtgaataaccatccgaatagagctttagtacatcagcataatcagcaatacgctttgttatctgatcctgttgccacacccttgcatcaacaagcagcggtgagcaaatcaacccatggagtccagagtatcccgaaccctgctgtagcacgttcgtcagtgcctgagcctaatgcatcttacacaacactcccttggcaatctagtgctgctgacatcatccacactggacgaaatgcagcgactgatccatgggcagcccgcacaactaactcctataatactgcatcagcaaacacagtgccgtttgctaaccagaatgcttacggtgatcaaagctcgcacactgcatacaattcttatggttctgcggcagtctcgtcccattctgttctgccagggcacggacatgacagaaatggctacagccgacctacagtgtcagagtaccaatcgttgatggtgcaggacagccaccggagacactcgaggtcacctgatcctggcgtggtccgggactatggcggcacacaaggttataatcagcagtctcgaacgcattggagtgcagggcaagggcaacagagctacaatcctgagccctcaaggcaatggagttcttcccaggcacaccagggctacacacctgccgagtcctcgaggcagtggagtaccgcgcatcagagctacactcctgagccatcgaggcagcggagctctgaacgtcagggctacaatgttgagccctcgaggtcttggagttccggccagcagggccagaatccggaggcatccagacaatggaaccggggaaagcaagatccttactacaatcccagtgatggtcgaagatcatacgatcagcaccggaggagataa

SEQ ID NO: 1796 - protein, 1178 aa, Sorghum bicolor
  misc_feature: Ceres ANNOT ID no. 6016970
  misc_feature (1)..(1178): NCBI GI: 5805319 NCBI Desc: flowering-time protein isoform alpha [zea mays]
  misc_feature (1)..(611): NCBI GI: 5805320 NCBI Desc: flowering-time protein isoform beta [zea mays]
  misc_feature (254)..(559): NCBI GI: 113926883 NCBI Desc: luminidependens [arabidopsis thaliana]
  misc_feature (254)..(559): NCBI GI: 113926853 NCBI Desc: luminidependens [arabidopsis thaliana]
  misc_feature (254)..(559): NCBI GI: 113926881 NCBI Desc: luminidependens [arabidopsis thaliana]
  misc_feature: Useful for making plants with modulated flowering time
  misc_feature: GREAT-hit functional homolog of the protein sequence given in SEQ ID NO 13385
MELVTVKPAAGALVEEGSGSVAGAGSIPAMVAAQQQLLHEQVDQLQRLVVAQCRLTGVNPLAQEMAAGALSIKIGKRPRDLLNPKAVKYMQSLFALKDTLGKRETRELSLLCGVTVTQVREFFTIQKSRVRKFVRLSQEKALRIETPKEQDNAYSIDSEQIPLDIEAQAEVIEPLSTLEPVVLQSSLQPTDVPQVSLQSMALQQSDLQHMEVFQNTLHKAEAQQNFAAPMMPPGTMVMQPTDAKISSDSVQKDIKQEETHPGVESEDKKFLESIFALMQKEETFSGQVKLMEWILQINNATVLSRFVTMGGLTIMSTWLSQAAIEEQTSVIHVIFKVLLHLPLHKALPVHMSVVLQTINRLRFYRTQDISSRARNLLSRLSKVLVRIQALKQPQKDSICKQRISEILRDESWKSEVDITEKILALADGANESRKPEPKKTPMLLTASADETNKRSSVQTKSKQKRKVLLVEHPNKKVAGKNANSVRNTSTNNSRPLSADDIQKAKMRAMFMQEKYGKVDTNKASDKPQAMETPKRAGLVNSNASPMPISPRTSAARPVDPSPSTSKQSTDSQPDNREISGGLKLDIGSKTNVIEKLDSKRVLWQIPPAVWIDPSWSVGAGDNSKEVEVQTQRNRREKETFYASQKDIPTNPKDPWDLEMDFDDSLTPEIPIDQTPDVDAMETDSVRAAPIAVAPVKDKQIESTSSTSGAVADGAGADTDYELLTVLLKNPELVFALTSNNKGENMPNEQTIALLDTLKQTGLSLSELVNSLGNGAGFPKEPEPEAEPLPASLPSPTPPDRTSMAVWRPENPMQVMAPNLQQPCLSSRGNTPPIANAMQQSFSNVVSSLPSQLYASVSVLPAQIQANTPSLPQLAVSVNPPIRHVSPVNNHPNRALVHQHNQQYALLSDPVATPLHQQAAVSKSTHGVQSIPNPAVARSSVPEPNASYTTLPWQSSAADIIHTGRNAATDPWAARTTNSYNTASANTVPFANQNAYGDQSSHTAYNSYGSAAVSSHSVLPGHGHDRNGYSRPTVSEYQSLMVQDSHRRHSRSPDPGVVRDYGGTQGYNQQSRTHWSAGQGQQSYNPEPSRQWSSSQAHQGYTPAESSRQWSTAHQSYTPEPSRQRSSERQGYNVEPSRSWSSGQQGQNPEASRQWNRGKQDPYYNPSDGRRSYDQHRRR

SEQ ID NO: 1797 - DNA, 795 bp, Sorghum bicolor
  misc_feature: Ceres ANNOT ID no. 6016979
  misc_feature: Encodes the peptide sequence at SEQ ID NO 1798
atggagagcggcggcggcaagcacttcatcctggtgcacggcctggcccacggcgcgtggtgctggtacaaggtggtggcgcggctgcgcgccgcgggtcaccgggcgacggcgctcgacatggccgcgtctggggtgcacccggcgcgcctccacgaggtggcgtcgttcgaggactactcgcggccgctgctggacgcggtggccgcggcccccgacggcgacaggctcgtcctggtgggccacagcctcggcgggctcagcgtcgccctcgccatggagaggttcccgggcaaggtcgccgccgccgtgttcctggccgcctccatgccccgcgttggcagccacatgggcgtcaccatcgaagagttcaagagggcgatcaaaccagattttttcatggacagcacaacgacggttctgaacacagagcaggggcctcaaactgcacttctacttggtcccaacttattggcatccaaattgtatgatcaatgccctgccgaggatcttgaactagggaagctgttgataagacccggcttccagttcatggacgacccaacgatgaaggacgagacgctgctcacgcatgccaacttcgggtcggtgaagagggtgtttgtgattgccaaagctgacacaagcaacaccgaggagatgcagcggcagacggtggacctcagccctggtacggacgtcgaggagatcgccggagctgatcacatggccatgctctccaaaccgacggaggtctgtgaagttctggtcaggattgccgacaggtgccactga

SEQ ID NO: 1798 - protein, 264 aa, Sorghum bicolor
  misc_feature: Ceres ANNOT ID no. 6016979
  misc_feature (34)..(258): Pfam Id: Abhydrolase_1 Pfam Desc: alpha/beta hydrolase fold
  misc_feature (1)..(260): NCBI GI: 15408791 NCBI Desc: pir7a protein (pseudomonas inducible protein) [oryza sativa (japonica cultivar-group)]
  misc_feature (1)..(260): NCBI GI: 498744 NCBI Desc: pir7a [oryza sativa]
  misc_feature (1)..(262): NCBI GI: 15408790 NCBI Desc: pir7b protein (pseudomonas inducible protein) [oryza sativa (japonica cultivar-group)]
  misc_feature (1)..(262): NCBI GI: 498745 NCBI Desc: pir7b [oryza sativa]
  misc_feature (7)..(262): NCBI GI: 498747 NCBI Desc: pir7b [oryza sativa]
MESGGGKHFILVHGLAHGAWCWYKVVARLRAAGHRATALDMAASGVHPARLHEVASFEDYSRPLLDAVAAAPDGDRLVLVGHSLGGLSVALAMERFPGKVAAAVFLAASMPRVGSHMGVTIEEFKRAIKPDFFMDSTTTVLNTEQGPQTALLLGPNLLASKLYDQCPAEDLELGKLLIRPGFQFMDDPTMKDETLLTHANFGSVKRVFVIAKADTSNTEEMQRQTVDLSPGTDVEEIAGADHMAMLSKPTEVCEVLVRIADRCH

SEQ ID NO: 1799 - DNA, 441 bp, Sorghum bicolor
  misc_feature: Ceres ANNOT ID no. 6016983
  misc_feature: Encodes the peptide sequence at SEQ ID NO 1800
atggcatcaagttcaaccacacaggatgccaacaatggtgttaggcatgacaacaacctcctgcccattgccaacgttgggcggatcatgaaggatgccctccctccacaggccaagatttcaaagcatgctaaggagaccatccaggagtgtgcaactgagtttgtgggcttcgtcactggcgaggcctccgagcggtgccgccgagagcggcggaagaccatcaacggtgatgacatctgtcatgctatgaggagccttggcctcgaccactacgccgactccatgcacaggtacctgcagaggtatcgcgagactgaggagctagcggcaacactcaacaacggcggcggcggccgtgatggacgggccattcagattgatgtgagggctgagctgtccattttcaagggcagcaaccagcaagatggtagagactaa

SEQ ID NO: 1800 - protein, 146 aa, Sorghum bicolor
  misc_feature: Ceres ANNOT ID no. 6016983
  misc_feature (19)..(84): Pfam Id: CBFD_NFYB_HMF Pfam Desc: Histone-like transcription factor (CBF/NF-Y) and archaealhistone
  misc_feature (15)..(123): NCBI GI: 37542675 NCBI Desc: hap3-like transcriptional-activator [oryza sativa (indica cultivar-group)]
  misc_feature (15)..(123): NCBI GI: 116013394 NCBI Desc: heading date 5 [oryza sativa (indica cultivar-group)]
  misc_feature (15)..(123): NCBI GI: 115475021 NCBI Desc: os08g0174500 [oryza sativa (japonica cultivar-group)]
  misc_feature (17)..(133): NCBI GI: 1922961 NCBI Desc: strong similarity to arabidopsis ccaat-binding factor (gbz97336). [arabidopsis thaliana]
  misc_feature (15)..(118): NCBI GI: 37542669 NCBI Desc: hap3-like transcriptional-activator [oryza sativa (indica cultivar-group)]
  misc_feature: The sequence is a functional homolog of SEQ ID NO 116 in the 10/412,699US patent application
  misc_feature: The sequence is a functional homolog of SEQ ID NO 1168 in the 10/412,699US patent application
  misc_feature: The sequence is a functional homolog of SEQ ID NO 1350 in the 10/666,642US patent application
  misc_feature: The sequence is a functional homolog of SEQ ID NO 202 in the 11/375,241US patent application
  misc_feature: The sequence is a functional homolog of SEQ ID NO 2151 in the 10/666,642US patent application
  misc_feature: The sequence is a functional homolog of SEQ ID NO 280 in the 11/479,226US patent application
  misc_feature: The sequence is a functional homolog of SEQ ID NO 294 in the 11/435,388US patent application
  misc_feature: The sequence is a functional homolog of SEQ ID NO 296 in the 10/714,887US patent application
  misc_feature: The sequence is a functional homolog of SEQ ID NO 30 in the 10/412,699US patent application
  misc_feature: The sequence is a functional homolog of SEQ ID NO 308 in the 10/412,699US patent application
  misc_feature: The sequence is a functional homolog of SEQ ID NO 32 in the 10/675,852US patent application
  misc_feature: The sequence is a functional homolog of SEQ ID NO 364 in the 11/435,388US patent application
  misc_feature: The sequence is a functional homolog of SEQ ID NO 366 in the 10/714,887US patent application
  misc_feature: The sequence is a functional homolog of SEQ ID NO 414 in the 11/435,388US patent application
  misc_feature: The sequence is a functional homolog of SEQ ID NO 416 in the 10/714,887US patent application
  misc_feature: The sequence is a functional homolog of SEQ ID NO 416 in the 11/435,388US patent application
  misc_feature: The sequence is a functional homolog of SEQ ID NO 418 in the 10/714,887US patent application
  misc_feature: The sequence is a functional homolog of SEQ ID NO 418 in the 11/435,388US patent application
  misc_feature: The sequence is a functional homolog of SEQ ID NO 420 in the 10/714,887US patent application
  misc_feature: The sequence is a functional homolog of SEQ ID NO 420 in the 11/435,388US patent application
  misc_feature: The sequence is a functional homolog of SEQ ID NO 468 in the 10/225,066US patent application
  misc_feature: The sequence is a functional homolog of SEQ ID NO 48 in the 10/675,852US patent application
  misc_feature: The sequence is a functional homolog of SEQ ID NO 64 in the 10/675,852US patent application
  misc_feature: The sequence is a functional homolog of SEQ ID NO 66 in the 10/675,852US patent application
  misc_feature: The sequence is a functional homolog of SEQ ID NO 723 in the 11/479,226US patent application
  misc_feature: The sequence is a functional homolog of SEQ ID NO 784 in the 10/374,780US patent application
  misc_feature: The sequence is a functional homolog of SEQ ID NO 787 in the 10/374,780US patent application
  misc_feature: The sequence is a functional homolog of SEQ ID NO 788 in the 10/374,780US patent application
  misc_feature: The sequence is a functional homolog of SEQ ID NO 789 in the 10/374,780US patent application
  misc_feature: The sequence is a functional homolog of SEQ ID NO 8 in the 10/374,780US patent application
  misc_feature: The sequence is a functional homolog of SEQ ID NO 804 in the 10/374,780US patent application
  misc_feature: The sequence is a functional homolog of SEQ ID NO 811 in the 10/666,642US patent application
  misc_feature: Useful for making plants with modulated growth and phenotype characteristics
  misc_feature: The sequence is a functional homolog of SEQ ID NO 116 in the 20040045049 US patent application
  misc_feature: The sequence is a functional homolog of SEQ ID NO 1168 in the 20040045049 US patent application
  misc_feature: The sequence is a functional homolog of SEQ ID NO 30 in the 20040045049 US patent application
  misc_feature: The sequence is a functional homolog of SEQ ID NO 308 in the 20040045049 US patent application
  misc_feature: The sequence is a functional homolog of SEQ ID NO 48 in the 20050086718 US patent application
  misc_feature: The sequence is a functional homolog of SEQ ID NO 64 in the 20050086718 US patent application
  misc_feature: The sequence is a functional homolog of SEQ ID NO 66 in the 20050086718 US patent application
  misc_feature: The sequence is a functional homolog of SEQ ID NO 416 in the 20060015972 US patent application
  misc_feature: The sequence is a functional homolog of SEQ ID NO 418 in the 20060015972 US patent application
  misc_feature: The sequence is a functional homolog of SEQ ID NO 420 in the 20060015972 US patent application
  misc_feature: The sequence is a functional homolog of SEQ ID NO 787 in the 20060162006 US patent application
  misc_feature: The sequence is a functional homolog of SEQ ID NO 788 in the 20060162006 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: The sequence is a functional homolog of SEQ ID NO 788 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 60 in the 10/675,852 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 66 in the 10/675,852 US patent application
  misc_feature: The sequence is a functional homolog of SEQ ID NO 791 in the 10/374,780 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 62 in the 10/675,852 US patent application
  misc_feature: The sequence is a functional homolog of SEQ ID NO 38 in the 10/675,852 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 44 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 795 in the 10/374,780 US patent application
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 22 in US patent 7166765
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO. 318 in the 11/188,298 US application
MASSSTTQDANNGVRHDNNLLPIANVGRIMKDALPPQAKISKHAKETIQECATEFVGFVTGEASERCRRERRKTINGDDICHAMRSLGLDHYADSMHRYLQRYRETEELAATLNNGGGGRDGRAIQIDVRAELSIFKGSNQQDGRD

SEQ ID NO: 1801 - DNA, 2352 bp, Sorghum bicolor
  misc_feature: Ceres ANNOT ID no. 6016992
  misc_feature: Encodes the peptide sequence at SEQ ID NO 1802
  misc_feature: Down-regulated in shoot tissues in response to salicylic acid treatment
atggacgccgaggcaggtgtcgccggcgccgatcagctgccgcggaggcagtactacatgaatctattgcttttagcttaccagagctttggtgttgtttacggggacctaagcacatcgcctctttacgtttataaaagtacattctctggaaagctcagtcagtaccaagatgaggagacggtgttcggtgtgctttccctgatcttttggaccttcactctgattcctttgctcaagtatgtcaccattgtcttgagtgctgatgataacggtgaaggtggaccattcgctctctattcgctcctttgcaggcatgcaaaactcagtttgcttccaaatcaacaagcagccgatgaggaactctcttcatactacagaaatggctttgcaccccgcaatggatcttcaccttggttaaaaaggtttctggagaagcacaaaaaaatgagaactgtgctccttctcatagttctctgtggcgctagcatggtgattggtgatggtgtccttaccccagcaatctcagtcctctcatctatgtctggattacaagttcgagctactggtttagagcatagttctgtagttctcctttcgtgcattgtgttggttggtctatttgccttgcaacaccgaggtactcagaaggttgcattcatgtttgcaccaattgtcatcatctggctgctttccattggaggaattggtttatacaacatttttcattggaacccaaatatatatcaagctctctctccatattatatggttaagttctttagaaagacaggtaaagatggatggattgctttaggagggatccttctttctatgacaggcagtgaagcaatgtttgctgaccttggtcactttacgagtgcatctgttagggtggcctttattaccgtcatatatccatgccttatactacaatatatgggtcatgctgcatttctgtcgaagaacacatttcacatgccaacaagtttttatgatactatcccagaacctgtgttttggcctgtattcgtggtggccacactcgctgcagttgttggtagccaagctgttatttcagcaacattctccattgtgaaacaatgccatgctttgggatgtttcccacgagtgaaggttgttcacacatcgaggtggatctatgggcagatatatattccagaaataaattggatccttatggttctttgtgtcgctgtcactattgcatttcgtgatactacacttatcggcaatgcctacggtgttgcctgcatgactgttatgcttgttactacattcttgatggcattgataatcatctttgtttggcaaaggaacataatatttgccctagttttcctggttttctttggatccattgaagctgtatatctttcttcatctctcatgaaggttcctcagggaggatgggtgcctcttgtgcttgctttcatattcatgtcagtcatgtatatctggcactatgggttaaggaggaagtaccagtttgacctacaaaacaaagtatcaatgagatccatcttgtctctgggtccaagccttggcatagttcgggttcctggtattggattgatttacacagagctggtcactggtgtaccctccatcttctcacattttgtcacaaacctccctgccttccatgaagtcctagtcttcctttgtgtgaagtcagtgccagtgccatatgtttcacaagatgagcgataccttgtgggtaggattggacctaaagaatatcggatgtaccgttgcattgttagatatggttacaaagacgtgcagagagatgatgacaattttgagaacatgttagttatgagcattgcaaagttcattatgatggaagccgaggatgcttcttcttcagcaagttatgatatcgctaatgaaggaaggatggcggtcataacaaccactgatgcctctggcagtccattggccatgagggatttcaacggcctagctgactccatgactacgaggagcagcaaatcagaaagccttcgaagtttgcaatcctcttacgagcaagaatccccaagtgtaagccggcgccgccgtgttcgctttgaggtcccagaggaggatgacatgggtcagcaagtgaaagaagaactcatggcactagtggaagcgaaacatgctggggtggcatacatcatgggtcattcttatatcaaagctaggaggagctcaagtttcctgaagaagtttgctattgatgttggctactctttcctccggaagaactgcagaggtccatcagtcactctgcacattccacacattagtctgatagaagtcggcatgatctactatgtttaa

SEQ ID NO: 1802 - protein, 783 aa, Sorghum bicolor
  misc_feature: Ceres ANNOT ID no. 6016992
  misc_feature (24)..(783): Pfam Id: K_trans Pfam Desc: K+ potassium transporter
  misc_feature (1)..(783): NCBI GI: 93138735 NCBI Desc: potassium transporter hak4 [hordeum vulgare]
  misc_feature (1)..(783): NCBI GI: 75164097 NCBI Desc: probable potassium transporter 2 (oshak2)
  misc_feature (1)..(783): NCBI GI: 92019691 NCBI Desc: potassium transporter [phragmites australis]
  misc_feature (1)..(783): NCBI GI: 92019685 NCBI Desc: potassium transporter [phragmites australis]
  misc_feature (16)..(783): NCBI GI: 62900304 NCBI Desc: potassium transporter 7 (oshak7)
  misc_feature: Useful for making plants with modulated biomass
  misc_feature: Functional homolog of the protein sequence given in SEQ ID NO 13565
  misc_feature: Down-regulated in shoot tissues in response to salicylic acid treatment
  misc_feature: The sequence is a functional homolog of SEQ ID NO. 279 in the 11/188,298 US application
MDAEAGVAGADQLPRRQYYMNLLLLAYQSFGVVYGDLSTSPLYVYKSTFSGKLSQYQDEETVFGVLSLIFWTFTLIPLLKYVTIVLSADDNGEGGPFALYSLLCRHAKLSLLPNQQAADEELSSYYRNGFAPRNGSSPWLKRFLEKHKKMRTVLLLIVLCGASMVIGDGVLTPAISVLSSMSGLQVRATGLEHSSVVLLSCIVLVGLFALQHRGTQKVAFMFAPIVIIWLLSIGGIGLYNIFHWNPNIYQALSPYYMVKFFRKTGKDGWIALGGILLSMTGSEAMFADLGHFTSASVRVAFITVIYPCLILQYMGHAAFLSKNTFHMPTSFYDTIPEPVFWPVFVVATLAAVVGSQAVISATFSIVKQCHALGCFPRVKVVHTSRWIYGQIYIPEINWILMVLCVAVTIAFRDTTLIGNAYGVACMTVMLVTTFLMALIIIFVWQRNIIFALVFLVFFGSIEAVYLSSSLMKVPQGGWVPLVLAFIFMSVMYIWHYGLRRKYQFDLQNKVSMRSILSLGPSLGIVRVPGIGLIYTELVTGVPSIFSHFVTNLPAFHEVLVFLCVKSVPVPYVSQDERYLVGRIGPKEYRMYRCIVRYGYKDVQRDDDNFENMLVMSIAKFIMMEAEDASSSASYDIANEGRMAVITTTDASGSPLAMRDFNGLADSMTTRSSKSESLRSLQSSYEQESPSVSRRRRVRFEVPEEDDMGQQVKEELMALVEAKHAGVAYIMGHSYIKARRSSSFLKKFAIDVGYSFLRKNCRGPSVTLHIPHISLIEVGMIYYV

SEQ ID NO: 1803 - DNA, 1038 bp, Sorghum bicolor
  misc_feature: Ceres ANNOT ID no. 6016999
  misc_feature: Encodes the peptide sequence at SEQ ID NO 1804
atggggcgccgcgggttgctgacggccgcgcttctgctgtgcttccttgctgtttgctccgggagagaacttgcgatcaaacagaacccatcaactaccatatataattcgactcttgcccagatacttgtggagtatgctgctgcaatctatacggctgatttgacagaattgtttacttggacatgtgccagatgtggtgacttgatcaaagggttcgagatgatagagatcattgtagatgtcgagaactgcttgcaggcatatgttggttttgccagtgatataaatgctgtcatcgttgtttttagaggaactcaagagaacagcatccagaattggatagaggacttgttatggaaacaactggatcttgactaccctggcatgcctgaagcaatggtgcaccgagggttttatgctgcttaccacaacacaacactacgtgatggagtagtcagtggtattcaaaagactagggaagcttacggagatattccaatcatgatcacggggcattcaatgggtggagctatggcttcattttgtgcgctcgatcttgttgtgaactatggtttggatggcgtaaaattgatgacatttgggcagccccgtattggcaatgctgcatttgcttcttatttcaagacatacttgcctcaagcaattcgagttactcatgcccacgatatcgtgcctcacctgccaccgtactttgcattcttcccacagaagacctaccatcacttcccaagagaggtatgggtccataatgttggattaggaaccctagtgtactccatagaaaagatctgtgatgattctggtgaagaccctacatgctgcaggtcagtaattggaaacagcgtgcgggaccatatatactatcttggtgtcagcatgcatgcagaagactggagctcctgcagaatcgtcatggactacagcaaattgcggtatcagatggacctcaatggtaatcttgtattatcaaagcagcccgctttgtcgaatgacagaggattcagtgcccagtga

SEQ ID NO: 1804 - protein, 345 aa, Sorghum bicolor
  misc_feature: Ceres ANNOT ID no. 6016999
  misc_feature (100)..(240): Pfam Id: Lipase_3 Pfam Desc: Lipase (class 3)
  misc_feature (1)..(345): NCBI GI: 21425569 NCBI Desc: triacylglycerol lipase [triticum aestivum]
  misc_feature (1)..(345): NCBI GI: 21425571 NCBI Desc: triacylglycerol lipase [triticum aestivum]
  misc_feature (1)..(332): NCBI GI: 15238889 NCBI Desc: lipase class 3 family protein [arabidopsis thaliana]
  misc_feature (1)..(332): NCBI GI: 50198977 NCBI Desc: at5g18630 [arabidopsis thaliana]
  misc_feature (6)..(334): NCBI GI: 77552336 NCBI Desc: triacylglycerol lipase [oryza sativa (japonica cultivar-group)]
MGRRGLLTAALLLCFLAVCSGRELAIKQNPSTTIYNSTLAQILVEYAAAIYTADLTELFTWTCARCGDLIKGFEMIEIIVDVENCLQAYVGFASDINAVIVVFRGTQENSIQNWIEDLLWKQLDLDYPGMPEAMVHRGFYAAYHNTTLRDGVVSGIQKTREAYGDIPIMITGHSMGGAMASFCALDLVVNYGLDGVKLMTFGQPRIGNAAFASYFKTYLPQAIRVTHAHDIVPHLPPYFAFFPQKTYHHFPREVWVHNVGLGTLVYSIEKICDDSGEDPTCCRSVIGNSVRDHIYYLGVSMHAEDWSSCRIVMDYSKLRYQMDLNGNLVLSKQPALSNDRGFSAQ

SEQ ID NO: 1805 - DNA, 1134 bp, Sorghum bicolor
  misc_feature: Ceres ANNOT ID no. 6017005
  misc_feature: Encodes the peptide sequence at SEQ ID NO 1806
atgggccaggacctcgtcgagatccaaccgcgcgagctccagttcacctttgaggtgaagaaacaaagttcatgtgttgtccacctaatcaacaagtctaacgaatatgttgctttcaaggttaaaacaacatctcctaaaagatactgtgttcgaccaaataccggggttatccttccgaggaaaacatgtgaattcatagttaccatgcaagcactccgagctgctccaccagacatgcaattaaaagacaagtttttggtacagaccacagttgttccttatggtacatctgacgaggaactggttcctgcttttttctccaaagaaactggcagatacatcgaggaaagcaaattaagagttgttcttgttagtgcataccaatcccttgaagagcaaccgactaatggaattcatgacaccgagccagctgttggaattcctgtacagaaggagatgccaaatatagagaatcaagtgccagatgtttcaatagaagttcctgcccctctggcacaagctccagcaattgtgactggaataccttcacctgtcgaagagactccaggcctgagagaaattcctgtgccactgaatgaagcaccagctgtattggcagaatctccttccgctcaaaaagacccctctgctattacagttgaacatgcctctactgttacaattgaacatgcccctgctatttccattgaatcccctccttcaaaacaaagcgttccagtttttaaggaatctcctcctttgaaacaaagcgttgcagtttttaaggaatctcctccactggaggaaactactcctaaagaagctgttatgctaagtgaccgaggacttttcaatgtgcaaaaccatcaattatctcatgtaacagaagatgttcagaatatgaaatcaaagctcaacaatcttgaattaaaattggaagaggctgaaaagatgataataaggctaagagaagagagcagaagtaccacccaggagcgggataagctacagcaagaaatggtattcctaagaaagaagggaaccccaaggagtcaagtgggtttccccttgctctttgtggtgtatgtggcgcttcttggtacctcactcggttacctgctccgaatatga

SEQ ID NO: 1806 - protein, 377 aa, Sorghum bicolor
  misc_feature: Ceres ANNOT ID no. 6017005
  misc_feature (5)..(112): Pfam Id: Motile_Sperm Pfam Desc: MSP (Major sperm protein) domain
  misc_feature (1)..(137): NCBI GI: 79317397 NCBI Desc: vap27-2 (vamp/synaptobrevin-associated protein 27-2); structural molecule [arabidopsis thaliana]
  misc_feature (2)..(129): NCBI GI: 6688926 NCBI Desc: vap27 [nicotiana plumbaginifolia]
  misc_feature (4)..(144): NCBI GI: 92872094 NCBI Desc: major sperm protein [medicago truncatula]
  misc_feature (1)..(125): NCBI GI: 115459632 NCBI Desc: os04g0534400 [oryza sativa (japonica cultivar-group)]
  misc_feature (1)..(125): NCBI GI: 116310461 NCBI Desc: osigba0159i10.10 [oryza sativa (indica cultivar-group)]
  misc_feature: The sequence is a functional homolog of SEQ ID NO. 356 in the 11/188,298 US application
MGQDLVEIQPRELQFTFEVKKQSSCVVHLINKSNEYVAFKVKTTSPKRYCVRPNTGVILPRKTCEFIVTMQALRAAPPDMQLKDKFLVQTTVVPYGTSDEELVPAFFSKETGRYIEESKLRVVLVSAYQSLEEQPTNGIHDTEPAVGIPVQKEMPNIENQVPDVSIEVPAPLAQAPAIVTGIPSPVEETPGLREIPVPLNEAPAVLAESPSAQKDPSAITVEHASTVTIEHAPAISIESPPSKQSVPVFKESPPLKQSVAVFKESPPLEETTPKEAVMLSDRGLFNVQNHQLSHVTEDVQNMKSKLNNLELKLEEAEKMIIRLREESRSTTQERDKLQQEMVFLRKKGTPRSQVGFPLLFVVYVALLGTSLGYLLRI

SEQ ID NO: 1807 - DNA, 1365 bp, Sorghum bicolor
  misc_feature: Ceres ANNOT ID no. 6017023
  misc_feature: Encodes the peptide sequence at SEQ ID NO 1808
atggcggaggacggggacaaggccgcggcgtctgcgggggaggcaggaggaggcggaggaggagggaacgagggcggcgaggaggagaagagcgtcaagctcttcgtgggccaggtgcctaagcacatgaccgaggccgacctgctcgccatgttccgcgaggtcgccgccgtcgacgaggtcaccgtcatcaaggacaaggtcaccaaggtctcccgagggtgctgcttcgtcatatgcccgtcaagggaggaagctgacaaggcggtgaatgcctaccacaacaagcgcacactctctggggcatcaagtcctttgcaagtaaaatatgctgatggagagttggagaggctggaacataagcttttcattggaatgcttccgaaaaatgttacagacactgagttgactgatttgttttccaaatatgggaatgtcaaggatttgcaaattttgagaggttcacaacaaacaagcaaagctggctgtgccttcattaaatatcaaacaaaagatcaagcattggcagctattgaagctctaaacgggaagcacaaaatagagggttctagtgtgccgttggttgtcaaatgggccgatacagaaaaggaaaggcaggctcggaaagcacaaaaggctcagttacagctatctaatatgcccagtgcaagtccaatgcagcagtcttcagtatttggagctttacagatgggatatatgcctcaatacaatggatttggctatcagccaccagggacatatggacttatgcagtaccctttatctcctatgcaaaatcaaggccccttccagaatatggttcaacctcttaatcaagggaactcgataagaggagtcaatcctgaactgtctcccagttcagttcaaaggtcctttgcaatgcagttagggagcccttatcctgctatccctggtatgcagtatcctgggtcatatcctggtggtcccatgaacaatcgtccttttggaaattctcacaattcaatttcaattaaagttccaaattcgaatgccaattccgccatttcttctagtcccagcagcaatgccggtggacaggttgaaggtcctcctggagccaatctatttatttaccatatcccacaagactatggtgaccaagagctttccagtgcctttcagagttttggtagagtactaagtgctaaggtgtttgtagacaaagcaacgggtgtcagcaaatgcttcggttttgtgagctacgattctcctacctctgcacaggcagccatcaataggatgaatgggtaccaattaggcggtaaaaaactcaaagtacaactcaagagagaaaacaacaacaagcacagtaaaccttattga

SEQ ID NO: 1808 - protein, 454 aa, Sorghum bicolor
  misc_feature: Ceres ANNOT ID no. 6017023
  misc_feature (34)..(106): Pfam Id: RRM_1 Pfam Desc: RNA recognition motif. (a.k.a. RRM, RBD, or RNP domain)
  misc_feature (122)..(194): Pfam Id: RRM_1 Pfam Desc: RNA recognition motif. (a.k.a. RRM, RBD, or RNP domain)
  misc_feature (369)..(440): Pfam Id: RRM_1 Pfam Desc: RNA recognition motif. (a.k.a. RRM, RBD, or RNP domain)
  misc_feature (6)..(454): NCBI GI: 115463535 NCBI Desc: os05g0373400 [oryza sativa (japonica cultivar-group)]
  misc_feature (27)..(452): NCBI GI: 9280669 NCBI Desc: f21b7.8 [arabidopsis thaliana]
  misc_feature (26)..(222): NCBI GI: 24583877 NCBI Desc: cg31762-pa, isoform a [drosophila melanogaster]
  misc_feature (26)..(222): NCBI GI: 2148976 NCBI Desc: bruno
  misc_feature (26)..(222): NCBI GI: 24583875 NCBI Desc: cg31762-pc, isoform c [drosophila melanogaster]
  misc_feature: The sequence is a functional homolog of SEQ ID NO. 339 in the 11/188,298 US application
MAEDGDKAAASAGEAGGGGGGGNEGGEEEKSVKLFVGQVPKHMTEADLLAMFREVAAVDEVTVIKDKVTKVSRGCCFVICPSREEADKAVNAYHNKRTLSGASSPLQVKYADGELERLEHKLFIGMLPKNVTDTELTDLFSKYGNVKDLQILRGSQQTSKAGCAFIKYQTKDQALAAIEALNGKHKIEGSSVPLVVKWADTEKERQARKAQKAQLQLSNMPSASPMQQSSVFGALQMGYMPQYNGFGYQPPGTYGLMQYPLSPMQNQGPFQNMVQPLNQGNSIRGVNPELSPSSVQRSFAMQLGSPYPAIPGMQYPGSYPGGPMNNRPFGNSHNSISIKVPNSNANSAISSSPSSNAGGQVEGPPGANLFIYHIPQDYGDQELSSAFQSFGRVLSAKVFVDKATGVSKCFGFVSYDSPTSAQAAINRMNGYQLGGKKLKVQLKRENNNKHSKPY

SEQ ID NO: 1809 - DNA, 1377 bp, Sorghum bicolor
  misc_feature: Ceres ANNOT ID no. 6017034
  misc_feature: Encodes the peptide sequence at SEQ ID NO 1810
atggttgggagcgtgcacgtcaatggatcggtccacggtggcaatggcacggccacggaggagcggctggacgagctgcgccggctgctcggcaagtcggagggcgacttgctgaagatcgtcagcgtcggcgccggtgcgtggggcagtgtcttcgcggctctcctgcaggatgcctacggccatttccgggacaaggtgcagataaggatctggcgccgcccggggcggacggtggaccgctccaccgcggagcacctgttcgaggtgatcaactccagggaggacgtgctcaggcgcctcatccgccgctgcgcctacctcaagtacgtcgaggcgcggctcggagaccgcacgctgtatgctgacgagatactcaaggatggcttctgtctgaacatgatcgagacgccgctctgccctctcaaggtcgtcaccaacctgcaggaggccgtctgggatgccgacatcgtcgtgaatggggtgccgtcaaccgagacgagggaggtgtttgatgagatcagcaagtattggaaggagaggatcagtgttccagtgataatttcccttgccaagggaatagaagcctcgttggatccaatacctcgtatcattacacctactcaaatgattagctctgcaactggagttccaactgagaatatactgtatctaggaggaccaaacatcgcctcagaaatttataacaaagaatatgcaaacgctcgaatctgtggatccaacaagtggaggaagcctcttgctaagtttttgaggcagccacatttcattgtctgggacaacagtgatcttgtcactcatgaggtgatgggtggcctgaagaatgtctatgcaattggcgctggaatggtggctgctttaacgaatgagagtgcaacaagcaaatctgtatatttttctcattgcacatcagaaatgatcttcatcactcatttgctgacagaacaacctgagaaactcgctggtcctctgctggctgacacttatgtaactctcctaaaaggtcgcaatgcatggtatgggcaaatgcttgccaagggagagttgagtcctgacatgggcgatagtatcaagggaaagggaatgattcagggtgtctctgccgttggtgcattttttgagctgcttagtcaacccagcttaagtgtgcagcacccggaagaaaacaagctggtcgctccagctgagctatgcccaattctgaagaggctttatagaatactgataaaaagggagctcccagcaagggacatcctccaagcactgagggatgaaacgatgaatgatcctcgggaaaggattgagatggcacaaagccatgcattctaccgcccgtctctccttggaaaaccatga

SEQ ID NO: 1810 - protein, 458 aa, Sorghum bicolor
  misc_feature: Ceres ANNOT ID no. 6017034
  misc_feature (269)..(429): Pfam Id: NAD_Gly3P_dh_C Pfam Desc: NAD-dependent glycerol-3-phosphate dehydrogenase C-terminus
  misc_feature (38)..(241): Pfam Id: NAD_Gly3P_dh_N Pfam Desc: NAD-dependent glycerol-3-phosphate dehydrogenase N-terminus
  misc_feature (1)..(458): NCBI GI: 115442141 NCBI Desc: os01g0939600 [oryza sativa (japonica cultivar-group)]
  misc_feature (1)..(458): NCBI GI: 115464667 NCBI Desc: os05g0495700 [oryza sativa (japonica cultivar-group)]
  misc_feature (20)..(458): NCBI GI: 79396613 NCBI Desc: glycerol-3-phosphate dehydrogenase (nad+) [arabidopsis thaliana]
  misc_feature (14)..(238): NCBI GI: 29367963 NCBI Desc: glycerol-3-phosphate dehydrogenase-like protein [oryza sativa (japonica cultivar-group)]
  misc_feature (118)..(390): NCBI GI: 133915197 NCBI Desc: glycerol-3-phosphate dehydrogenase (nad(p)+) [saccharopolyspora erythraea nrrl 2338]
MVGSVHVNGSVHGGNGTATEERLDELRRLLGKSEGDLLKIVSVGAGAWGSVFAALLQDAYGHFRDKVQIRIWRRPGRTVDRSTAEHLFEVINSREDVLRRLIRRCAYLKYVEARLGDRTLYADEILKDGFCLNMIETPLCPLKVVTNLQEAVWDADIVVNGVPSTETREVFDEISKYWKERISVPVIISLAKGIEASLDPIPRIITPTQMISSATGVPTENILYLGGPNIASEIYNKEYANARICGSNKWRKPLAKFLRQPHFIVWDNSDLVTHEVMGGLKNVYAIGAGMVAALTNESATSKSVYFSHCTSEMIFITHLLTEQPEKLAGPLLADTYVTLLKGRNAWYGQMLAKGELSPDMGDSIKGKGMIQGVSAVGAFFELLSQPSLSVQHPEENKLVAPAELCPILKRLYRILIKRELPARDILQALRDETMNDPRERIEMAQSHAFYRPSLLGKP

SEQ ID NO: 1811 - DNA, 855 bp, Sorghum bicolor
  misc_feature: Ceres ANNOT ID no. 6017035
  misc_feature: Encodes the peptide sequence at SEQ ID NO 1812
atggcggcggcgctggagcaactgagcaggagcaagatgttcgacggcttcaacctccgcttccgccaccaaagcgccaccctcggctgcgccatgactttctccatctacatgcccccgtccccggcgtccaacatacccgtgctgtactggctctctggcctaacctgcaccgacgaaaatttcatcatgaagtccggcgcccagcgcgccgccgccgcccacggcatcgccctcgtctcgcctgacacatccccacgtgggttaaatattgaaggagagtcagacagctatgattttggtgttggtgccgggttttatttgaacgccacaaatgaaaagtggaaaaactggcgcatgtatgattatgttgtgaaggaacttccaaaagttttaagtgacaactttgaacagcttaacacttcacaggcatcaatttttgggcactcaatgggagggcatggtgcgctgacaatttacttgaaaaacactgataaatacaagtcagtatcagcatttgctccaattgccaatccaataaactgcccgtggggtcagaaagcattctcaaattacctgggcccaactaaatcagattgggaggaatatgatgcaacctgcctgattaaaaagaacagcaatgttcccactcctatcctaattgaccagggggatgctgacaagttcctggctgagcagcagttgctacctcacaacttcgaggaggcatgcaaggctgtaggggctactctgatcttacggatgcagcctcgatatgaccattcctactatttcatcgctacgttcatggacgatcacattgcgcaccatgctaagtttctcaagagcgcctga

SEQ ID NO: 1812 - protein, 284 aa, Sorghum bicolor
  misc_feature: Ceres ANNOT ID no. 6017035
  misc_feature (20)..(276): Pfam Id: Esterase Pfam Desc: Putative esterase
  misc_feature (4)..(281): NCBI GI: 51895957 NCBI Desc: mgc84363 protein [xenopus laevis]
  misc_feature (4)..(283): NCBI GI: 62900112 NCBI Desc: esterase d
  misc_feature (4)..(283): NCBI GI: 7288152 NCBI Desc: esterase d [sus scrofa]
  misc_feature (4)..(281): NCBI GI: 51593227 NCBI Desc: mgc85439 protein [xenopus laevis]
  misc_feature (4)..(283): NCBI GI: 61372772 NCBI Desc: esterase d/formylglutathione hydrolase [synthetic construct]
  misc_feature (1)..(282): SWISSPROT Homolog: EC 3.1.2.12 S-formylglutathione hydrolase
  misc_feature: The plant is abnormally small.
  misc_feature: Useful for making plants with altered cell wall content and/or composition
  misc_feature: Useful for making plants with modulated biomass
  misc_feature: GREAT-hit functional homolog of the protein sequence given in SEQ ID NO 13173
  misc_feature: Useful for making plants with altered cell wall content and/or composition
  misc_feature: Useful for making plants with modulated biomass
  misc_feature: Functional homolog of the protein sequence given in SEQ ID NO 13173
MAAALEQLSRSKMFDGFNLRFRHQSATLGCAMTFSIYMPPSPASNIPVLYWLSGLTCTDENFIMKSGAQRAAAAHGIALVSPDTSPRGLNIEGESDSYDFGVGAGFYLNATNEKWKNWRMYDYVVKELPKVLSDNFEQLNTSQASIFGHSMGGHGALTIYLKNTDKYKSVSAFAPIANPINCPWGQKAFSNYLGPTKSDWEEYDATCLIKKNSNVPTPILIDQGDADKFLAEQQLLPHNFEEACKAVGATLILRMQPRYDHSYYFIATFMDDHIAHHAKFLKSA

SEQ ID NO: 1813 - DNA, 1572 bp, Sorghum bicolor
  misc_feature: Ceres ANNOT ID no. 6017036
  misc_feature: Encodes the peptide sequence at SEQ ID NO 1814
atgaggccaccatcactggtgcactgcttcaagctgctggtcctcctggcgctcgccaggttgaccatgcacgtccccgacgaggacgtgctgtcgtccctcggcacgctgcccctcgatggccatttcagcttccatgacgtctccgccatggcgcgggatttcggtaaccagtgcagcttcctgccagccgcagtcctccaccccggctcggtctccgatatcgccaccaccgtgaggcacgtcttctccctgggcgagggatcaccactcactgtcgcggcacgcgggcatgggcactccctcatgggtcagtcccaggcggcccaggggatcgtggtccggatggagtcgctccgtcgtggtgctagactccaggtccacggtggtgtgtcaccgtttgtcgatgctcccggcggagagctctggatcaacgtgctgcgtcagacactcaagcacggcctggcacccaagtcgtggacggactatctccatctcacggtcggtggcacgttgtctaatgcgggggtcagcgggcaggcgttccgccacggaccgcaggtcagcaatgtcaatcaactggagattgtgacaggaagaggagatgtcgttacatgctcacccgaggataactctgatctcttctatggtgctcttggcggtcttggtcagttcgggatcatcatcagagcaaggattgcacttgagcctgctccaaagatggtgaggtggataagagttctttactcggattttgaaaccttcaccgaggaccaggagatgttgatcatggcagagaactcctttgactacattgaaggttttgtcatcataaacaggacaggcatcctcaacaactggagggcgtccttcaagccacaagacccagtccaagcaagccattttaagtcggatggaagagtactatactgcctcgagctaaccaagaacttcaatagtgacgacgctgatatcatggaacaggaagttactgtggtgctatctcgacttagattcatacagtctactctattccacaccgatgtcacgtacctggagttcttggacagggtccacacctctgagttgaagctgagggcacaaggcctctgggaagttccacacccttggttgaatcttctaataccgaggagctcaatccgcagatttgctaaggaagtctttggcaagatcctgaaagacagcaacaatggtcccatactgctttatccagtgaacaaatcaaagtgggacaacagaacgtcagtagtcataccagatgaggaaattttctacctagtgggattcctttcttcagcaccgtctctctcaggtcacggcagcattgcacatgcaatgaacctgaacaaccaaatagtagagttctgtgaagaggctgatattgggatgaaacagtatctggcaccctacaccacacagcagcagtggaaagcccactttggagcaaggtgggagacatttgaacggaggaaacacagatatgatcccctagccatcctagcaccaggacagagaatattcccaaaggcctcactgccgttgcctttgtga

SEQ ID NO: 1814 - protein, 523 aa, Sorghum bicolor
  misc_feature: Ceres ANNOT ID no. 6017036
  misc_feature (239)..(514): Pfam Id: Cytokin-bind Pfam Desc: Cytokinin dehydrogenase 1, FAD and cytokinin binding
  misc_feature (63)..(207): Pfam Id: FAD_binding_4 Pfam Desc: FAD binding domain
  misc_feature (1)..(523): NCBI GI: 38520863 NCBI Desc: cytokinin oxidase 3 [zea mays]
  misc_feature (1)..(523): NCBI GI: 38520861 NCBI Desc: cytokinin oxidase 2 [zea mays]
  misc_feature (1)..(523): NCBI GI: 38520865 NCBI Desc: cytokinin oxidase 3 [zea mays]
  misc_feature (11)..(523): NCBI GI: 115463543 NCBI Desc: os05g0374200 [oryza sativa (japonica cultivar-group)]
  misc_feature (6)..(521): NCBI GI: 23267157 NCBI Desc: cytokinin dehydrogenase 2 [hordeum vulgare]
  misc_feature (29)..(518): SWISSPROT Homolog: EC 1.5.99.12 Cytokinin dehydrogenase 1 precursor
MRPPSLVHCFKLLVLLALARLTMHVPDEDVLSSLGTLPLDGHFSFHDVSAMARDFGNQCSFLPAAVLHPGSVSDIATTVRHVFSLGEGSPLTVAARGHGHSLMGQSQAAQGIVVRMESLRRGARLQVHGGVSPFVDAPGGELWINVLRQTLKHGLAPKSWTDYLHLTVGGTLSNAGVSGQAFRHGPQVSNVNQLEIVTGRGDVVTCSPEDNSDLFYGALGGLGQFGIIIRARIALEPAPKMVRWIRVLYSDFETFTEDQEMLIMAENSFDYIEGFVIINRTGILNNWRASFKPQDPVQASHFKSDGRVLYCLELTKNFNSDDADIMEQEVTVVLSRLRFIQSTLFHTDVTYLEFLDRVHTSELKLRAQGLWEVPHPWLNLLIPRSSIRRFAKEVFGKILKDSNNGPILLYPVNKSKWDNRTSVVIPDEEIFYLVGFLSSAPSLSGHGSIAHAMNLNNQIVEFCEEADIGMKQYLAPYTTQQQWKAHFGARWETFERRKHRYDPLAILAPGQRIFPKASLPLPL

SEQ ID NO: 1815 - DNA, 1494 bp, Sorghum bicolor
  misc_feature: Ceres ANNOT ID no. 6017037
  misc_feature: Encodes the peptide sequence at SEQ ID NO 1816
atggggcgggtcgggctcggcgtggcggcgggctgcgcggccgccacgtgcgcgatcgccgccgcgctggtggcgcgcagggcgtcggcgcgggcgcgctggcgccgcgccgtcgcgctgctcagggagttcgaggaaggctgcgccacgccgacgccgcgcctgcgccaggtcgtcgacgccatggtcgtcgagatgcacgcgggcctcgcctccgacggcggcagcaagctcaagatgctgctcaccttcgtcgacgcgctccccgccggaaatgaacaaggcacatattattccatcgatcttggaggaacaaactttagagtgttgagagttgaagttggtgctgtgtctgtggtgaccagtcgggaggttaaacttcccatccctgaggaattgaccaagggtacaattgaggagctattcaactttgttgccatgaccctaaaggaatttgtagagacagaagatgttaaagatgaacaaagggcgcttggtttcacattttctttcccagttagacaaacttcagtgtcttcagggtcattaattaggtggactaaaggttttttgattgaagatgcggttgggaaagatgtggctcaatgcttaaatgaagctcttgctaggagtggactaaatgtgcgagttactgcactggtgaacgacaccgtggggacattagctctaggacattattatgatgaggatacagtggctgctgtgatcatcggtgctggcaccaatgcttgctatattgaacgcactgatgcaattattaaatgtcagggtcttcttacaaactctggtggcatggtagtaaacatggaatggggcaatttctggtcatcacatttgccaagaactccttatgacatctcccttgatgatgagacgcaaaatcgcaatgatcaggggtttgagaaaatgatctctgggatttatctcggggaaattgcaaggctggtgctgcatcgcatggctctagaatcagatgtttttggcgatgctgctgatcatctatctacccccttcacattgagcacaccacttctggctgcaattcgcaaggacgattcaccagatctgagtgaagtcagaaggatactgcaagaacatctgaagataatggacactcccctgaaaactcgaaggctagtcgtcaaagtctgcgacattgtcacccgaagagctgcacgcctagctgctgctggtattgtcgggatactgaaaaagctcggtcgggatgggagcggcgtggcttcaagcgggagaacacgagggcagctgaggcggacggtggttgcgatcgagggtggcctgtatgagggctacccagtgttcagggagtacctagatgaagctctggtggagatcttgggggaggaggtggcgcagacggtggcgctaagggtgacagaggacgggtctggggctggcgctgccctcctcgccgccgtacattcgtcgaatagacagcaaggttccatatag

SEQ ID NO: 1816 - protein, 497 aa, Sorghum bicolor
  misc_feature: Ceres ANNOT ID no. 6017037
  misc_feature (35)..(236): Pfam Id: Hexokinase_1 Pfam Desc: Hexokinase
  misc_feature (237)..(490): Pfam Id: Hexokinase_2 Pfam Desc: Hexokinase
  misc_feature (1)..(494): NCBI GI: 110808553 NCBI Desc: hexokinase-3 (hexokinase-8)
  misc_feature (1)..(494): NCBI GI: 62130768 NCBI Desc: hexokinase 8 [oryza sativa (japonica cultivar-group)]
  misc_feature (9)..(496): NCBI GI: 110808551 NCBI Desc: hexokinase-10 (hexokinase-7)
  misc_feature (9)..(496): NCBI GI: 62130766 NCBI Desc: hexokinase 7 [oryza sativa (japonica cultivar-group)]
  misc_feature (1)..(491): NCBI GI: 45387415 NCBI Desc: hexokinase 6 [nicotiana tabacum]
  misc_feature (1)..(494): SWISSPROT Homolog: EC 2.7.1.1 Hexokinase-3
  misc_feature: The sequence is a functional homolog of SEQ ID NO. 321 in the 11/188,298 US application
MGRVGLGVAAGCAAATCAIAAALVARRASARARWRRAVALLREFEEGCATPTPRLRQVVDAMVVEMHAGLASDGGSKLKMLLTFVDALPAGNEQGTYYSIDLGGTNFRVLRVEVGAVSVVTSREVKLPIPEELTKGTIEELFNFVAMTLKEFVETEDVKDEQRALGFTFSFPVRQTSVSSGSLIRWTKGFLIEDAVGKDVAQCLNEALARSGLNVRVTALVNDTVGTLALGHYYDEDTVAAVIIGAGTNACYIERTDAIIKCQGLLTNSGGMVVNMEWGNFWSSHLPRTPYDISLDDETQNRNDQGFEKMISGIYLGEIARLVLHRMALESDVFGDAADHLSTPFTLSTPLLAAIRKDDSPDLSEVRRILQEHLKIMDTPLKTRRLVVKVCDIVTRRAARLAAAGIVGILKKLGRDGSGVASSGRTRGQLRRTVVAIEGGLYEGYPVFREYLDEALVEILGEEVAQTVALRVTEDGSGAGAALLAAVHSSNRQQGSI

SEQ ID NO: 1817 - DNA, 1164 bp, Sorghum bicolor
  misc_feature: Ceres ANNOT ID no. 6017044
  misc_feature: Encodes the peptide sequence at SEQ ID NO 1818
atgcgcaagtggtcgcacggcctcgcgcccgcctccgtcgtactgctcgccgcgctcacggtggccgggctgcggccggcgacggcgcacgcgcacgggcggccgccgctccggttcgggccggcaggagtgttcaaggtggccctgttcgcagacctgcattacggcgagaacgcgtggacggactggggccccgcgcaggacgccaagtccgaccgcgtcatggccgccgtcctcgacgccgagaacccagacttcgtggtgtacctcggcgacctggtgacggcgaacaacctcccgatccccaacgcgagcctgtactgggaccgcgccatctcggcctcccgaagccggggcgtcccgtgggcgacggtgttcggcaaccacgacgacatgcccttcgagtggccgcccgagtggttctcccccgacggcgtccctccgctgcgctgccccgccagcccaccgccgagcacgccggactcaggatgcagcttccgagggactccccggaccgacctcatggcggcggagaccggcgccaacagtcggctgtcctactcgtccagcgggcccagggagctgtggcccggcgtctccaactacgtcctgcaggtgctctcgcgacgacgacgaacccgcgccggcgacgatcacgacccagctctgctcatgtacttcctcgattcgggcggcgggtcgtacaccgaagtggtgtccagcgctcaggtcaagtggttccacagccagtctcagttcctcaatccaaatggaaggatccctgagctcatcttttggcatataccaagcacggcgtacgtgaaggtaggtccaaaagccaagtcagagataaggaagccctgcgttggctccatcaacaaggaggaagtggcgccacaggcagctgaatggggcatcatggatgcactcgccaagaggccgtcagttaaggcagtgtttgttggccataaccacgggctggactggtgctgcccgtaccaggagctgtggctgtgcttcgcacggcacactgggtacgggggatacggtggctggcccaaaggagcgaggatcattgaggtcacggaggatccattctcggcagtgtcatggatacggatggagaacgggagcaggcacagccatgttacgctcagctcctga

SEQ ID NO: 1818 - protein, 387 aa, Sorghum bicolor
  misc_feature: Ceres ANNOT ID no. 6017044
  misc_feature (45)..(327): Pfam Id: Metallophos Pfam Desc: Calcineurin-like phosphoesterase
  misc_feature (75)..(386): NCBI GI: 50198970 NCBI Desc: at3g10150 [arabidopsis thaliana]
  misc_feature (223)..(376): NCBI GI: 115469740 NCBI Desc: os06g0699200 [oryza sativa (japonica cultivar-group)]
  misc_feature (199)..(375): NCBI GI: 82745454 NCBI Desc: phosphohydrolase, icc family [clostridium beijerincki ncimb 8052]
  misc_feature (198)..(378): NCBI GI: 6323393 NCBI Desc: dcr2p [saccharomyces cerevisiae]
  misc_feature (223)..(376): NCBI GI: 53791873 NCBI Desc: calcineurin-like phosphoesterase-like [oryza sativa (japonica cultivar-group)]
MRKWSHGLAPASVVLLAALTVAGLRPATAHAHGRPPLRFGPAGVFKVALFADLHYGENAWTDWGPAQDAKSDRVMAAVLDAENPDFVVYLGDLVTANNLPIPNASLYWDRAISASRSRGVPWATVFGNHDDMPFEWPPEWFSPDGVPPLRCPASPPPSTPDSGCSFRGTPRTDLMAAETGANSRLSYSSSGPRELWPGVSNYVLQVLSRRRRTRAGDDHDPALLMYFLDSGGGSYTEVVSSAQVKWFHSQSQFLNPNGRIPELIFWHIPSTAYVKVGPKAKSEIRKPCVGSINKEEVAPQAAEWGIMDALAKRPSVKAVFVGHNHGLDWCCPYQELWLCFARHTGYGGYGGWPKGARIIEVTEDPFSAVSWIRMENGSRHSHVTLSS

SEQ ID NO: 1819 - DNA, 1554 bp, Sorghum bicolor
  misc_feature: Ceres ANNOT ID no. 6017055
  misc_feature: Encodes the peptide sequence at SEQ ID NO 1820
atggcgctggcgccgccccgctccgtcgagctgcccgtcgccgacccggacagggcccggttgcatcagcttggatacaagcaggagctcaagcgcggcctctctgtggtctcgaacttcgccttctccttcgccatcatctccgtgctgacgggcgtgacgacgacctacaacacgggcctccgctacggcgggccggcgtccatgacgctgggctggctcgtcgtggcgaccttcaacggctgcgtggcgctgtccatggcggagatctgctcggcgtacccgacctccggcggcctctactactggagcgccaagctcgccggcaagaactgggcctcgctggcttcctgggtcaccggatggttcaacatcgtgggacagtgggcaggtacgacgagcatagacttctcgctggcgcagcttgtccaggtgatcatcctgctgggcaccgggggagccaacggcggtggctacatggcctccaagtacgtcctgctcgccatctacggcgtcatcctcatccttcacggcctcatcaactgcctccccatccactggctctcatggtttggtcatcttggagtcttctggaatacagcaggtgtctttgtcctggtgatcttggttccagcggtcgccaaggagcgagcgagcgtggggttcatcttcacccacttcaacacggacaacggcatgggaatccacgacaaggcatacattctcttcgtcggcttgctcatgagccagtactccctcctcggctacgacacatctgctcacatgtcagaggaaacgaagggcgcggaccggagcgggtcgatcgggatcgtgacctcggttgccctggcgtccatgtttggatggatctacctggtggccttgacgtcgctgatgacagacatcccctacctcctgagccccagcaacgacgccggcgggtacgccgtcgcgcaggctctctacaccgccttccacgggaggtacggcagcggcgccggggcggtcgcgtgcctggcggtcatcgccgtcgccgtcttcctctgcggcatcgcatgtgtcaccaccaactcaaggatgggctacgccttctccagggacggagccatgccgttctcgcgtgtatggtaccggctcaacagccaggaggtgcccatcaacgtcgtctgcctttctgtcacggttgcattcatcatgtccctcacgtcacttgggagccaggtggcgttccaggcgatggtgtccgtggcgacgaccgggctatacatcgcgtacgcgctgcccatcttcttccgcgtcacgacggccaggaaatccttcgtcccggggccgttccacctcgggaggtacgggctcgccgtcggctgggtcgccgtcgcctgggtggcgctcgtcaccgtgctcttctgcctgccggtggcgtaccccgtcgcggaggacaacctcaactacacgccggtcgccgtcggcggcgtgctggtcctcagcgtgggcacgtggctgctccacgcacggttctggtttgaaggccccgtcatcaacgtcgacgcgtag

SEQ ID NO: 1820 - protein, 517 aa, Sorghum bicolor
  misc_feature: Ceres ANNOT ID no. 6017055
  misc_feature (14)..(262): NCBI GI: 115442199 NCBI Desc: os01g0945700 [oryza sativa (japonica cultivar-group)]
  misc_feature (7)..(516): NCBI GI: 19386876 NCBI Desc: p0614d08.21 [oryza sativa (japonica cultivar-group)]
  misc_feature (1)..(516): NCBI GI: 115442195 NCBI Desc: os01g0945300 [oryza sativa (japonica cultivar-group)]
  misc_feature (14)..(516): NCBI GI: 15290172 NCBI Desc: p0660f12.28 [oryza sativa (japonica cultivar-group)]
  misc_feature (14)..(201): NCBI GI: 15290171 NCBI Desc: p0660f12.27 [oryza sativa (japonica cultivar-group)]
  misc_feature: The sequence is a functional homolog of SEQ ID NO. 297 in the 11/188,298 US application
  misc_feature: The sequence is a functional homolog of SEQ ID NO. 510 in the 11/188,298 US application
MALAPPRSVELPVADPDRARLHQLGYKQELKRGLSVVSNFAFSFAIISVLTGVTTTYNTGLRYGGPASMTLGWLVVATFNGCVALSMAEICSAYPTSGGLYYWSAKLAGKNWASLASWVTGWFNIVGQWAGTTSIDFSLAQLVQVIILLGTGGANGGGYMASKYVLLAIYGVILILHGLINCLPIHWLSWFGHLGVFWNTAGVFVLVILVPAVAKERASVGFIFTHFNTDNGMGIHDKAYILFVGLLMSQYSLLGYDTSAHMSEETKGADRSGSIGIVTSVALASMFGWIYLVALTSLMTDIPYLLSPSNDAGGYAVAQALYTAFHGRYGSGAGAVACLAVIAVAVFLCGIACVTTNSRMGYAFSRDGAMPFSRVWYRLNSQEVPINVVCLSVTVAFIMSLTSLGSQVAFQAMVSVATTGLYIAYALPIFFRVTTARKSFVPGPFHLGRYGLAVGWVAVAWVALVTVLFCLPVAYPVAEDNLNYTPVAVGGVLVLSVGTWLLHARFWFEGPVINVDA

SEQ ID NO: 1821 - DNA, 1563 bp, Sorghum bicolor
  misc_feature: Ceres ANNOT ID no. 6017059
  misc_feature: Encodes the peptide sequence at SEQ ID NO 1822
atgtctccccgccgctcctccgccggcggcgagctgcccgtcgtcgccgacagagaccaagcccggctgcagcagctgggatacaagcaggagctcaagcgcggcctctccgtcctctctaacttcgccttctccttctccatgatctccgtgctggccggcgtgacgacgacctacaacaccggcctgcgctacggcgggccggcgtccatgacgctgggctggctcgtcgtggcgctcttcaacggctgcgtcgcgctgtccatggcggagatctgctcggcgtacccgaccaccggcggcctctactactggagcgccaagctcgccggcaaggactgggctccgcttgcctcctgggtcaccggatggtttaacatcgtgggccagtgggcttgcaccacgagcgtggacttctcattggcacagtttatccaagtcatcgtcttgcttagcaccgggggagccaatggcggtggttatctggcctccaaatacgtcgtgctggcaatctactgtgtcatcctcatcctgcacgggcttatcaatagcctctccatcaattggctggcctttttcggtcagcttggagctttctggaatcttgcaggtgtatttgtcttgacggtattgattccggttgttgctaaggacagggcaagcatggagtttatgttcaccaactgctacactgacgataccgtggggatccacagcaaggtctatatactagccattggtttgctgacaagccaatattccctcctcggatatgatacttctgcccacatgtcagaggagacgaagaacgcggagtggagtggcccgatggggatcgtggtttcagtcgcgctgtcgagcgtcttcggctggatttacgtggtggccttgacatccatggtgaccgacatcccgtcgctcctggaccctaccaacgacgccggcgggaacgccatcgcgcaagccctgtacaccaccttccgccagaggttcggcagcggcggcggcggtgtcatctgcttggcggccatggccgtctccatattcctctgcggcacggcgtccgtgaccagcaactcgaggatggggtacgccttctccagggacggcgccatgccgctgtcgcggctctggtaccgtgtcaacaagcacgaggtgccgttcaatgtcgtctggctctccgtctcggtggcattcgtcatggcactcacgtcgctggggagccaggtggcgttccaggcaatggtgtccatcacgacgctgggcatgtacatcgcctacgccctgcccatcttcttccgcgtgacgacggcgcggaactcgttcgtcccggggccgtttcatctcggacgccgctgcagccttgtcgtcggctgggtcgccgtcctctggggggccctcgtcaccgtgctgttctgcttgccggtggcgtaccccgtcgccgggatcaacttcaactacacgccggtggccgtcggcggcgtgctgctgctcagtctaggggcgtgggtgctccacgcgcggttttggtttcgaggacccatcaccaccgttgacacgtga

SEQ ID NO: 1822 - protein, 520 aa, Sorghum bicolor
  misc_feature: Ceres ANNOT ID no. 6017059
  misc_feature (45)..(520): Pfam Id: AA_permease Pfam Desc: Amino acid permease
  misc_feature (16)..(264): NCBI GI: 115442199 NCBI Desc: os01g0945700 [oryza sativa (japonica cultivar-group)]
  misc_feature (17)..(520): NCBI GI: 19386876 NCBI Desc: p0614d08.21 [oryza sativa (japonica cultivar-group)]
  misc_feature (17)..(519): NCBI GI: 115442195 NCBI Desc: os01g0945300 [oryza sativa (japonica cultivar-group)]
  misc_feature (16)..(520): NCBI GI: 15290172 NCBI Desc: p0660f12.28 [oryza sativa (japonica cultivar-group)]
  misc_feature (135)..(519): NCBI GI: 15290170 NCBI Desc: p0660f12.26 [oryza sativa (japonica cultivar-group)]
  misc_feature: The sequence is a functional homolog of SEQ ID NO. 297 in the 11/188,298 US application
MSPRRSSAGGELPVVADRDQARLQQLGYKQELKRGLSVLSNFAFSFSMISVLAGVTTTYNTGLRYGGPASMTLGWLVVALFNGCVALSMAEICSAYPTTGGLYYWSAKLAGKDWAPLASWVTGWFNIVGQWACTTSVDFSLAQFIQVIVLLSTGGANGGGYLASKYVVLAIYCVILILHGLINSLSINWLAFFGQLGAFWNLAGVFVLTVLIPVVAKDRASMEFMFTNCYTDDTVGIHSKVYILAIGLLTSQYSLLGYDTSAHMSEETKNAEWSGPMGIVVSVALSSVFGWIYVVALTSMVTDIPSLLDPTNDAGGNAIAQALYTTFRQRFGSGGGGVICLAAMAVSIFLCGTASVTSNSRMGYAFSRDGAMPLSRLWYRVNKHEVPFNVVWLSVSVAFVMALTSLGSQVAFQAMVSITTLGMYIAYALPIFFRVTTARNSFVPGPFHLGRRCSLVVGWVAVLWGALVTVLFCLPVAYPVAGINFNYTPVAVGGVLLLSLGAWVLHARFWFRGPITTVDT

SEQ ID NO: 1823 - DNA, 1257 bp, Sorghum bicolor
  misc_feature: Ceres ANNOT ID no. 6017087
  misc_feature: Encodes the peptide sequence at SEQ ID NO 1824
atgatgcaccatcacctctcgcgcgtcctcacccgccgcctcctcctcctccccgtcccactccccaccgccgcaacctctccctacgccgcggcgctctccacgccccacagacgcgcgtacgcccgccgcgccaagccgccggcgccaccagcggcggacgccggcgaccacaccgcctcccctgcagcgccggctgactcggatgcgaaggccacgtggcagagggagaagctcccgggcgagctgccgcggccaccgaccatcccgttccagccgcgcgtcgctaacgccgtgcacctcgtcggcaccgtctgcgcccccgtgcacgtgcagcaactgcccgacggcagattctccgcggtctccgtgctcgtgcacgaccacggcatcaacttgcccaagttctgggttcccatagttttcaaagatgacttggcacaagtagctgcttcccacttgaaagaaaatgaccttgtctccgtgtctgggaaattaacttgtgattctccacctttccagcttgctgatggcgaagcaaacattcaggtgttagcaaattcgctgaaatttgttgatagtaaagctgttcaaacggatgccatactggatgaagatgaaggatttatagagattgttgaggctgaaaagaaagttgaagcaaaaagacccacctccaagtttccgcctggcacagtttcaggttataggaacaaggcagataagataaataagctctggaatgatgttatatctcatccacaagattggattgataaccggcctcagaaaaaaaatggattgaggagtccaaagtatcctgattttaaaagcaaggtttcagatgaggcactctggcttgacagtgcaccagcatcagttcgtgaaaagttggatgatttggttttcggtagtggttgtgccgccacaggaagaaaagataaaccttttggtaatgatacacaaaaaggtacgagtacaagctggatgaaccataggaagagcccagatgcttcttttgcatcgaaacaaaaacttgaagaggacttgtggcgagatcttgtggacaatccagcaaactggtgggacaaccgaacagacaagccgacaccaaagcatcctgatttcaagaacaagaattcagggcaaggtctatggttaggaaccaaatcgcctcaatgggctagagatgcactgccatccttgaaatttaagggaggtagcaagggtacaaggaaagaaaccttactgtcatga

SEQ ID NO: 1824 - protein, 418 aa, Sorghum bicolor
  misc_feature: Ceres ANNOT ID no. 6017087
  misc_feature (96)..(192): Pfam Id: SSB Pfam Desc: Single-strand binding protein family
  misc_feature (17)..(418): NCBI GI: 115442235 NCBI Desc: os01g0949200 [oryza sativa (japonica cultivar-group)]
  misc_feature (84)..(389): NCBI GI: 60685032 NCBI Desc: mitochondrial sbp40 [solanum tuberosum]
  misc_feature (350)..(412): NCBI GI: 144924397 NCBI Desc: single-stranded dna binding [medicago truncatula]
  misc_feature (238)..(402): NCBI GI: 37545634 NCBI Desc: rna-binding protein rb38 [chlamydomonas reinhardtii]
  misc_feature (85)..(299): NCBI GI: 9802592 NCBI Desc: t2e6.21 [arabidopsis thaliana]
MMHHHLSRVLTRRLLLLPVPLPTAATSPYAAALSTPHRRAYARRAKPPAPPAADAGDHTASPAAPADSDAKATWQREKLPGELPRPPTIPFQPRVANAVHLVGTVCAPVHVQQLPDGRFSAVSVLVHDHGINLPKFWVPIVFKDDLAQVAASHLKENDLVSVSGKLTCDSPPFQLADGEANIQVLANSLKFVDSKAVQTDAILDEDEGFIEIVEAEKKVEAKRPTSKFPPGTVSGYRNKADKINKLWNDVISHPQDWIDNRPQKKNGLRSPKYPDFKSKVSDEALWLDSAPASVREKLDDLVFGSGCAATGRKDKPFGNDTQKGTSTSWMNHRKSPDASFASKQKLEEDLWRDLVDNPANWWDNRTDKPTPKHPDFKNKNSGQGLWLGTKSPQWARDALPSLKFKGGSKGTRKETLLS

SEQ ID NO: 1825 - DNA, 687 bp, Sorghum bicolor
  misc_feature: Ceres ANNOT ID no. 6017098
  misc_feature: Encodes the peptide sequence at SEQ ID NO 1826
atgtctccgcctgttaagatcatcggccattacgcgagcccattctcgcaccgcgtcgaggccgctctgcagctcaagggcgtgccatacgagctgatccaggaagacctgagcaacaagagtgagctgctgctcaccaagaaccctgtccacaagaaggtgcccgtgctcctccatggcgatctggcagtctgtgagtcactcgtcatcgtcgagtacatcgacgaggccttcgacgggccggctatcctgccggccgacccctacgaccgcgccatggcccgtttctggactaacttcattgacaccaagttcttccagccgttctggctggcacactgggcggagggtgaggcgcagaaggctgtggtgaaggaggccaaggagaacctggcgctcctggaggcgcagctcgacgggaagaggttctttggtggcgacacacccgggtaccttgacatagccgcgtgtgcgttaggtccttggatcggcgtgcttgaggaggtgactggagtgaccttggtggatggcaacgagttcccctctctgtttcagtgggccaaggagtactacaattccagtgaagctctcaagccttgcctcccggacaaggaccgactcgtcgcatacttcactgagaacaaggagaagtacagaatgatggccaagacaattttgcagcagtag

SEQ ID NO: 1826 - protein, 228 aa, Sorghum bicolor
  misc_feature: Ceres ANNOT ID no. 6017098
  misc_feature (3)..(76): Pfam Id: GST_N Pfam Desc: Glutathione S-transferase, N-terminal domain
  misc_feature (1)..(228): NCBI GI: 4468798 NCBI Desc: gst7 protein [zea mays]
  misc_feature (2)..(228): NCBI GI: 13699857 NCBI Desc: glutathione s-transferase gst 24 [zea mays]
  misc_feature (5)..(223): NCBI GI: 11385507 NCBI Desc: glutathione s-transferase gst 28 [zea mays]
  misc_feature (3)..(228): NCBI GI: 11385493 NCBI Desc: glutathione s-transferase gst 21 [zea mays]
  misc_feature (5)..(225): NCBI GI: 11385509 NCBI Desc: glutathione s-transferase gst 29 [zea mays]
  misc_feature: Useful for making plants with modulated nitrogen use efficiency
  misc_feature: Functional homolog of the protein sequence encoded by LOCUS at3g09270
MSPPVKIIGHYASPFSHRVEAALQLKGVPYELIQEDLSNKSELLLTKNPVHKKVPVLLHGDLAVCESLVIVEYIDEAFDGPAILPADPYDRAMARFWTNFIDTKFFQPFWLAHWAEGEAQKAVVKEAKENLALLEAQLDGKRFFGGDTPGYLDIAACALGPWIGVLEEVTGVTLVDGNEFPSLFQWAKEYYNSSEALKPCLPDKDRLVAYFTENKEKYRMMAKTILQQ

SEQ ID NO: 1827 - DNA, 711 bp, Sorghum bicolor
  misc_feature: Ceres ANNOT ID no. 6017107
  misc_feature: Encodes the peptide sequence at SEQ ID NO 1828
atgtcgtctccgccgccgccgccggtgaagctgatcggcttcttcggcagcccgtacgcgttccgcgcggaggcggcgctgtgcctcaagggcgtgccgtacgagctcattctggaggacctcttcggcaccaagagcgacctcctactccaccacaaccccgtccacaagaaggtccccgtgctcctccacggcgacgacagggccatctccgaatccctcgtcattgccgagtacgtcgacgaggtcttcgacgggccgccgctcctccccgccgacccctacgaccgcgccaccgccaggttctgggctgacttcatcgagaacaagcttaccaagccgttcttcatggcgatctgggtggaggagagcgaagcgcggctgcggttcgagaaggaggccaaggagctggtggcgctgctggaggcgcagctcgacggcaagaagttcttcgccggcgacagggcgggatacctcgacgtcgccgcgtcctcgctcggcccctggcgcagcgtcatcgaggagctcaacggagtgaccgtgctcagcgaggacgagcaccccaacctgtgccggtggagcagggactactgcgcctgcgaggatctgaagccgtgcatgccggatcgggagaagctgctcgcctacttcaccaagaacttcgacaggtacaaggcggccgtcaatgcgacgttatcgcagtcgcagtag

SEQ ID NO: 1828 - protein, 236 aa, Sorghum bicolor
  misc_feature: Ceres ANNOT ID no. 6017107
  misc_feature (7)..(82): Pfam Id: GST_N Pfam Desc: Glutathione S-transferase, N-terminal domain
  misc_feature (1)..(236): NCBI GI: 11385493 NCBI Desc: glutathione s-transferase gst 21 [zea mays]
  misc_feature (7)..(234): NCBI GI: 4468798 NCBI Desc: gst7 protein [zea mays]
  misc_feature (1)..(234): NCBI GI: 13699857 NCBI Desc: glutathione s-transferase gst 24 [zea mays]
  misc_feature (9)..(230): NCBI GI: 11385509 NCBI Desc: glutathione s-transferase gst 29 [zea mays]
  misc_feature (9)..(231): NCBI GI: 11385507 NCBI Desc: glutathione s-transferase gst 28 [zea mays]
  misc_feature: Useful for making plants with modulated nitrogen use efficiency
  misc_feature: Functional homolog of the protein sequence encoded by LOCUS at3g09270
MSSPPPPPVKLIGFFGSPYAFRAEAALCLKGVPYELILEDLFGTKSDLLLHHNPVHKKVPVLLHGDDRAISESLVIAEYVDEVFDGPPLLPADPYDRATARFWADFIENKLTKPFFMAIWVEESEARLRFEKEAKELVALLEAQLDGKKFFAGDRAGYLDVAASSLGPWRSVIEELNGVTVLSEDEHPNLCRWSRDYCACEDLKPCMPDREKLLAYFTKNFDRYKAAVNATLSQSQ

SEQ ID NO: 1829 - DNA, 1320 bp, Sorghum bicolor
  misc_feature: Ceres ANNOT ID no. 6017113
  misc_feature: Encodes the peptide sequence at SEQ ID NO 1830
atggtgcaaaggaagccggcgcgtaagaagcccaaggaccccgacgccgtgccggctaggggcggtggccctggcccgggaagcaggggtggtgctggcggtagcggcatggccccagcgccgctccccaactacatgagggcgacgagctgctccggcgccaaggctggcgcctccggggcccccgccgcgccacagtcggggagagcgaaggtggtgctgacggctgcggcggcggccgtgccgcgcgcgggcagggcgacgtgctcctctgccatgaaggggcccggggctgacgggctggcgcacgcgtgcccgtacgcgtactgctccttcaagggccatgcccacgcgccgcctctgggcaccttcgtggcggagcggaggcggctcatcaagacgcagcagagcatgaagctcaagggcgcctcaccgttccgcaggcccggcggcggcggcggctacttcgtcgagatacgcgccgggtccgccgcgccgacggtgacctcggatgtgagttgcagcgatctctcctcggaggaggtgggcgcggtggtggggcaggcggagtacgtcgtgttcggtcgcctgggctgcggtggcgacgcggaggacgcgccggagggtttggaagctgcttccgtggacggttcttgcgcgtccagtgacgtgatctcggttgcttcggttgagctgtcttggatgaccaagcatcttggccgtaaggcggaggaggagacctcgacggaggtggatcatgaaaccgaggacttcggtggctgcaagtctgacatctccgaggatctgggtgctaaacatggaggaaacctccctgaaggtggcgtcggcgatgcttcaaaggaatcgtcagtcgatagcatttccagctcgctcagtgggataagctttgaagatgttagctctgctcgtgcctatgcagcatcctctcagaaaaagaacaggtcgagcattgccaggaggaggagaacatcccaagagggtgtcaagcaaatgcgtcctttcaaacccaagcctccgaacttccttccggcagaaaccggtccagaggcagagaaggttgatctcaaacatcaggaggttgatgatcggagggccgctgaggagtggatggttgattacgctattcggaaggaagtgaagaagttggctcgtgctcagaagagaaaagttgagatgcttgttcaggcctttgaatctgttcttcccacggttgcaaatgagaagaagcaacccgagcaacaggataatggtgacaagagttcattcactcttacatggccttcgcaagcatgtagctga

SEQ ID NO: 1830 - protein, 439 aa, Sorghum bicolor
  misc_feature: Ceres ANNOT ID no. 6017113
  misc_feature (288)..(409): Pfam Id: CaM_binding Pfam Desc: Plant calmodulin-binding domain
  misc_feature (280)..(411): NCBI GI: 92898452 NCBI Desc: calmodulin-binding, plant [medicago truncatula]
  misc_feature (328)..(410): NCBI GI: 92886520 NCBI Desc: calmodulin-binding, plant [medicago truncatula]
  misc_feature (333)..(413): NCBI GI: 24637279 NCBI Desc: pathogen-induced calmodulin-binding protein [phaseolus vulgaris]
  misc_feature (286)..(409): NCBI GI: 17933110 NCBI Desc: pncbp [solanum tuberosum]
  misc_feature (201)..(410): NCBI GI: 24637243 NCBI Desc: pathogen-induced calmodulin-binding protein [arabidopsis thaliana]
MVQRKPARKKPKDPDAVPARGGGPGPGSRGGAGGSGMAPAPLPNYMRATSCSGAKAGASGAPAAPQSGRAKVVLTAAAAAVPRAGRATCSSAMKGPGADGLAHACPYAYCSFKGHAHAPPLGTFVAERRRLIKTQQSMKLKGASPFRRPGGGGGYFVEIRAGSAAPTVTSDVSCSDLSSEEVGAVVGQAEYVVFGRLGCGGDAEDAPEGLEAASVDGSCASSDVISVASVELSWMTKHLGRKAEEETSTEVDHETEDFGGCKSDISEDLGAKHGGNLPEGGVGDASKESSVDSISSSLSGISFEDVSSARAYAASSQKKNRSSIARRRRTSQEGVKQMRPFKPKPPNFLPAETGPEAEKVDLKHQEVDDRRAAEEWMVDYAIRKEVKKLARAQKRKVEMLVQAFESVLPTVANEKKQPEQQDNGDKSSFTLTWPSQACS

SEQ ID NO: 1831 - DNA, 1431 bp, Sorghum bicolor
  misc_feature: Ceres ANNOT ID no. 6017119
  misc_feature: Encodes the peptide sequence at SEQ ID NO 1832
atggacgccgcggcgctggagtcgctcatcctggacctgcacgccatcgaggccgtgaagctgggctccttcgtgctcaagtccggcatcacctcgcccatctacctggacctccgcgcgctcgtctcccacccgcgcctgctctccgccgtcgcctcgctcctccacgcgctccccgccacgcgcccctacggcctcgtctgcggcgtcccctacaccgcgctccccatcgctgccgttctctccgtcgaccgctccatccccatgctcatgcgccgcaaggaggtcaaggcccacggcaccgccaagtccatcgagggctccttccgccccggggacaccgtcctcatcatcgaggacctcgtcaccagcggcgcctccgtgctcgagaccgccgccccgctccgcgccgaggggctcatcgtcgccgacgccgtcgtcgtcgtcgaccgcgagcagggcgggagggagaacctcgccgctaatgggatcacgctccactcgctcatgaccctcaccgaggtgctcgccgtgctgctcaagcacgggaaggtgaccgaggagaaggcgcaggaggtgaggcagttcctcgacgccaacaggaaggtggcggtgccgggggcggcgcctgttaaacccagggtgctcaggaagacattttcggatagggcgaaactggccgccaaccctatggggaagaagctcttcgagctgatggaggccaagcagaccaacctgtgtgtcgctgctgatgttgggacagcaaaggaactccttgagctggctgacaaggtcggccctcaaatttgtatgttgaaaacccatgtggatatattgtctgattttacaccagattttggctctgagctccgctcgattgctgagaagcacaactttctgatcttcgaagaccgcaagtttgctgacattggaaatacagtaaccatgcaatatgaaggaggaatattccgcatattggactgggcagatattgttaatgcgcatatagtacctggacctggaatcgtagatggcttgaagctgaagggtttgcctaaaggaagagggctacttctgctcgctgagatgagctctgctggcaaccttgctcatggagattacactgctgctgctgtaaagattgctgagcaacattctgactttgtgatgggatttatatcggtaaatcctgcatcctggtcagtaacaccatcaagcccggcgttcatccatgccacacctggagttcagatggtcgctggaggagatgatcttgggcaacaatacaacactcctgagtctgtggtaaactacaggggcagtgacataatcatagttggacgtgggattataaaggctagcgaccctatgaagacggcatgggagtaccgcttgcaagggtggcaggcatacaagaacagcttgctatga

SEQ ID NO: 1832 - protein, 476 aa, Sorghum bicolor
  misc_feature: Ceres ANNOT ID no. 6017119
  misc_feature (244)..(463): Pfam Id: OMPdecase Pfam Desc: Orotidine 5'-phosphate decarboxylase / HUMPS family
  misc_feature (37)..(158): Pfam Id: Pribosyltran Pfam Desc: Phosphoribosyl transferase domain
  misc_feature (1)..(476): NCBI GI: 9255871 NCBI Desc: ump synthase [zea mays]
  misc_feature (1)..(475): NCBI GI: 7381462 NCBI Desc: ump synthase [oryza sativa]
  misc_feature (1)..(471): NCBI GI: 9255873 NCBI Desc: ump synthase [nicotiana plumbaginifolia]
  misc_feature (4)..(471): NCBI GI: 443818 NCBI Desc: pyre-f [arabidopsis thaliana]
  misc_feature (16)..(471): NCBI GI: 747980 NCBI Desc: ump synthase
  misc_feature (218)..(475): SWISSPROT Homolog: EC 4.1.1.23 Orotidine 5'-phosphate decarboxylase
MDAAALESLILDLHAIEAVKLGSFVLKSGITSPIYLDLRALVSHPRLLSAVASLLHALPATRPYGLVCGVPYTALPIAAVLSVDRSIPMLMRRKEVKAHGTAKSIEGSFRPGDTVLIIEDLVTSGASVLETAAPLRAEGLIVADAVVVVDREQGGRENLAANGITLHSLMTLTEVLAVLLKHGKVTEEKAQEVRQFLDANRKVAVPGAAPVKPRVLRKTFSDRAKLAANPMGKKLFELMEAKQTNLCVAADVGTAKELLELADKVGPQICMLKTHVDILSDFTPDFGSELRSIAEKHNFLIFEDRKFADIGNTVTMQYEGGIFRILDWADIVNAHIVPGPGIVDGLKLKGLPKGRGLLLLAEMSSAGNLAHGDYTAAAVKIAEQHSDFVMGFISVNPASWSVTPSSPAFIHATPGVQMVAGGDDLGQQYNTPESVVNYRGSDIIIVGRGIIKASDPMKTAWEYRLQGWQAYKNSLL

SEQ ID NO: 1833 - DNA, 1434 bp, Sorghum bicolor
  misc_feature: Ceres ANNOT ID no. 6017120
  misc_feature: Encodes the peptide sequence at SEQ ID NO 1834
atggacgccggcgcgaaggagacgctgatcctggacctgcacgcggtggaggccgtgaagctaggcaccttcgtgctcaagtccgggatcacctccccgatctacctagacctgcgcgtgctcgtctcccacccgcggctgctcgcctccgtggcgtcactcctcggctccctccccgccacgcgcccctacgacctcctctgcggcgtgccctacacggcgctgccgttcgcggccgcgctctccgtctccgcctccgtgcccatgctgctcagccgctacgacaccaagggtgtcgagggtaccttccgcgccggcggcggacagaccgtgctcatcgtcgaggacctcgtcaccagcggagcatccgtgctcgagaccgtgggcccgctccgcgccgaggggcttgttgtcgccgacgccgtcgtcgtcatcgaccgcgagcaaggtgggcgggagaacctcgccgccaacggggtcgcgctgcactcgctcatgacccttacggagatgctcgccgtgttggtgaagcacgggagggtggacgaggataaggtcgcggaggtcaggcgcttcctcgacgccaaccggaaggtggcggtgcccggcgtgcctgctggatcgcccaagccgtcggctgctactgctaggaggaagtcgtttgcggagagggcggggttggccacgaaccccatggggaggaagctgttcgaggtgatggaggcgaagcagagcaacttgtgtgttgcggcggatgttgggacagccaaggagctgcttgagcttgctgacaaggttggcccagagatttgtatgctgaaaactcatgttgatatcttgtctgattttacaccagattttggagacaagcttcgcacaattgctgggaagcacaactttctgatcttcgaagaccgcaagtttgctgacattgggaacacagtaactatgcaatctgaaggaggtatattccgcatattagactgggcggatattattaatgctcacatagttcctggacctgggattgtagatggcttgaagctgaaggctttgcctaaaggaaggggcctactcttgcttgctgaaatgagctcagctggcaaccttgcttatggagactacactgctgcggctgtaaagatcgctgagcaacatcctgactttgtaataggatttatatcagtaaatcctgcatcttggtcaccagcaccgtcgagcccagcgtttatccatgccactcctggagttcagatggctgctggaggagatggccttgggcaacaatataacactcccttttctgtcataaacgatagaggcagtgatataattatagtcggaagagggattataaaggcgagtaaccctgcagagaccgcgaggcagtatcgcatccaagggtggcaggcctatcaatccagtctgtcttga

SEQ ID NO: 1834 - protein, 477 aa, Sorghum bicolor
  misc_feature: Ceres ANNOT ID no. 6017120
  misc_feature (245)..(464): Pfam Id: OMPdecase Pfam Desc: Orotidine 5'-phosphate decarboxylase / HUMPS family
  misc_feature (37)..(154): Pfam Id: Pribosyltran Pfam Desc: Phosphoribosyl transferase domain
  misc_feature (1)..(476): NCBI GI: 7381462 NCBI Desc: ump synthase [oryza sativa]
  misc_feature (1)..(476): NCBI GI: 9255871 NCBI Desc: ump synthase [zea mays]
  misc_feature (1)..(472): NCBI GI: 9255873 NCBI Desc: ump synthase [nicotiana plumbaginifolia]
  misc_feature (5)..(477): NCBI GI: 443818 NCBI Desc: pyre-f [arabidopsis thaliana]
  misc_feature (16)..(472): NCBI GI: 747980 NCBI Desc: ump synthase
  misc_feature (219)..(477): SWISSPROT Homolog: EC 4.1.1.23 Orotidine 5'-phosphate decarboxylase
MDAGAKETLILDLHAVEAVKLGTFVLKSGITSPIYLDLRVLVSHPRLLASVASLLGSLPATRPYDLLCGVPYTALPFAAALSVSASVPMLLSRYDTKGVEGTFRAGGGQTVLIVEDLVTSGASVLETVGPLRAEGLVVADAVVVIDREQGGRENLAANGVALHSLMTLTEMLAVLVKHGRVDEDKVAEVRRFLDANRKVAVPGVPAGSPKPSAATARRKSFAERAGLATNPMGRKLFEVMEAKQSNLCVAADVGTAKELLELADKVGPEICMLKTHVDILSDFTPDFGDKLRTIAGKHNFLIFEDRKFADIGNTVTMQSEGGIFRILDWADIINAHIVPGPGIVDGLKLKALPKGRGLLLLAEMSSAGNLAYGDYTAAAVKIAEQHPDFVIGFISVNPASWSPAPSSPAFIHATPGVQMAAGGDGLGQQYNTPFSVINDRGSDIIIVGRGIIKASNPAETARQYRIQGWQAYQSSLS

SEQ ID NO: 1835 - DNA, 2952 bp, Sorghum bicolor
  misc_feature: Ceres ANNOT ID no. 6017126
  misc_feature: Encodes the peptide sequence at SEQ ID NO 1836
atgtcaactgcaaaagtgttagatcctgcttttcaaggggctggccaaaaagttgggacagaaatatggcggattgaagattttaagcctgttgcgctgccaaaatctgattatggtaaattctactgtggagattcatacatagttctgcagacgacctgtactaaaggtggtgcctatctatacgatatccacttctggattgggaaagattcgagtcaagatgaagctggtactgcagccatcaagacagttgaactcgatgccatccttgggggtcgtgcaatccaacatagggaactccaaggttatgaatctgacaaattcttgtcatacttcaagccttgcattatacctttggagggtggtttcgcctctgggttcaaaaagcctgaagaggagaagtttgaaacacggttgtatatttgcagagggaagagagctattcgggttaaagaggttccctttgcccgttcatcattaaaccatgatgatgtgtttgtcttagatactgaaaataagatataccagtttaatggtgctaactccaatatccaagaaagggccaaggcgttggaagtaatccaacatttaaaggagaagtaccatgggggtgtttgcgatgttgcgatcgttgatgatgggaaattacaagcagagtcagactctggagaattctgggtcctttttggaggttttgcaccaattgggaaaaaaactgtgagtgatgatgatgttgtacttgaaactacagcaccaaagctgtacagcatcaatgatggccaattgaagctggaagaaacagctcttacaaaagctgtgcttgaaaataccaaatgtttcttacttgactgtggggctgaaatatatgtatgggttggccgggtaacacaaatggaggatagaaaatctgccactaaagcagttgaggaattccttattaatcaaaagcgtccaaagacaacgagggtaactcaagtgattcaaggttatgagagtcatgctttcaagtccaagtttgaatcatggccagtgggtaatgctgctgggagccctggcgcagaagaagggcggggaaaggttgcagctttattgaagcaacaaggtgttgatctcaagggagctgcaaaaagcgccactccagtgaatgaggaagttcctcctttgcttgaaggcggtgggaagcttgaggtatggtgcattgatggcaatgctaagactgccctgccaaaagaggatattggaaagttttacagtggagactgttatatcattctctatacgtatcattcaggcgacaagaaagaagaatactatctcagctactggattgggaaggatagcttggtggacgatcaagtatcggcatctcaaataactaatacagtgtggaattcattgaaaggacggccagttctgggccgtatataccaagggaaggagccaccacaatttgttgctcttttccagcccatggttatcttgaagggtggaattggatctggatacaagaagctcatagaagaaaagggtgcgacggctgagacttattctactgaaggcatagctctaattcgagtatctgggacatctatccacaacaacaagactcttcaagttgatgcggtggcaacgtctttaagctcaacggagtgttttgtactgcaatctggaaatgctatgtttacatggtttggcaattctagcacatatgagcaacagcagtgggcagcaaaagttgctgaatttttgaagcctggcattgcagtgaagcactgcaaggaggggacagagagttctgctttctggtttgcacttggaggaaaacagagttatacaaataaaaatgctcctcaggatattattactagagagcctcacttatatgcattctcattcaagaacgggagactggaggttactgagatcttcaacttttcccaagatgatttgttaactgaagacatgatgatacttgacacacatggtgaggttttcatttggattggtcagtgcgtagaatcaaaagagaaacagaaagcctttgatattggccagaaatacgtggagcatgcaaattctattgaagatctttctccatatgtaccactatataaagtcatggaagggaatgagccatgcttcttcaagacgtacttctcttgggataacacaaaatctttggttcatggaaattctttccagaagaaactctcactactttttggattgcggtctgagggtgcatctaggagctctggtaatggtggaccaactcagagggcatctgcattagcagctctatcatccgcattcaatccatcatctcaacaaaggctgtctaatgagaggcctaaaagcacaggcgatggacccactcagcgtgcctcagcactggctgccttatctaatgcattcaaaacatccttaaaacccaacaaaacaccacctccatctcgctcaggtcaaggttctcaaagagcagctgctgtagctgcactatcctctgtgctgactgctgagcaatctggatcttcagaaaatctacgagcaaaagctagcagcacagctgataagactgatgtcgacagggttgtcataactccagctggggtatctggtccatcttctcctcagtctgaagctggggagtccaatgtgtttcaccaggaaaaagatgctgcagtagatggggcaccatctggcacagatggagcagtggctgaggccccagtggaagaaacaacagagaatgttggtgaagcgacatttagctatgaccgcttgatatccaaatctaccgatccagttcgtgggatagattacaaacgtagagaggcatacttatcagatagtgaattccaaactgtttttggcatgactaaggatgcattctaccaacagccaaattggaagcaagaactacagaagcgaaaagcagatctcttctga

SEQ ID NO: 1836 - protein, 983 aa, Sorghum bicolor
  misc_feature: Ceres ANNOT ID no. 6017126
  misc_feature (27)..(110): Pfam Id: Gelsolin Pfam Desc: Gelsolin repeat
  misc_feature (147)..(227): Pfam Id: Gelsolin Pfam Desc: Gelsolin repeat
  misc_feature (261)..(337): Pfam Id: Gelsolin Pfam Desc: Gelsolin repeat
  misc_feature (403)..(486): Pfam Id: Gelsolin Pfam Desc: Gelsolin repeat
  misc_feature (533)..(603): Pfam Id: Gelsolin Pfam Desc: Gelsolin repeat
  misc_feature (637)..(717): Pfam Id: Gelsolin Pfam Desc: Gelsolin repeat
  misc_feature (948)..(983): Pfam Id: VHP Pfam Desc: Villin headpiece domain
  misc_feature (1)..(983): NCBI GI: 3415115 NCBI Desc: villin 2 [arabidopsis thaliana]
  misc_feature (2)..(896): NCBI GI: 5880464 NCBI Desc: actin bundling protein abp135 [lilium longiflorum]
  misc_feature (3)..(897): NCBI GI: 3415117 NCBI Desc: villin 3 [arabidopsis thaliana]
  misc_feature (3)..(897): NCBI GI: 18410709 NCBI Desc: villin 3 (vln3) [arabidopsis thaliana]
  misc_feature (1)..(622): NCBI GI: 25295744 NCBI Desc: probable villin 2 [imported] - arabidopsis thaliana
MSTAKVLDPAFQGAGQKVGTEIWRIEDFKPVALPKSDYGKFYCGDSYIVLQTTCTKGGAYLYDIHFWIGKDSSQDEAGTAAIKTVELDAILGGRAIQHRELQGYESDKFLSYFKPCIIPLEGGFASGFKKPEEEKFETRLYICRGKRAIRVKEVPFARSSLNHDDVFVLDTENKIYQFNGANSNIQERAKALEVIQHLKEKYHGGVCDVAIVDDGKLQAESDSGEFWVLFGGFAPIGKKTVSDDDVVLETTAPKLYSINDGQLKLEETALTKAVLENTKCFLLDCGAEIYVWVGRVTQMEDRKSATKAVEEFLINQKRPKTTRVTQVIQGYESHAFKSKFESWPVGNAAGSPGAEEGRGKVAALLKQQGVDLKGAAKSATPVNEEVPPLLEGGGKLEVWCIDGNAKTALPKEDIGKFYSGDCYIILYTYHSGDKKEEYYLSYWIGKDSLVDDQVSASQITNTVWNSLKGRPVLGRIYQGKEPPQFVALFQPMVILKGGIGSGYKKLIEEKGATAETYSTEGIALIRVSGTSIHNNKTLQVDAVATSLSSTECFVLQSGNAMFTWFGNSSTYEQQQWAAKVAEFLKPGIAVKHCKEGTESSAFWFALGGKQSYTNKNAPQDIITREPHLYAFSFKNGRLEVTEIFNFSQDDLLTEDMMILDTHGEVFIWIGQCVESKEKQKAFDIGQKYVEHANSIEDLSPYVPLYKVMEGNEPCFFKTYFSWDNTKSLVHGNSFQKKLSLLFGLRSEGASRSSGNGGPTQRASALAALSSAFNPSSQQRLSNERPKSTGDGPTQRASALAALSNAFKTSLKPNKTPPPSRSGQGSQRAAAVAALSSVLTAEQSGSSENLRAKASSTADKTDVDRVVITPAGVSGPSSPQSEAGESNVFHQEKDAAVDGAPSGTDGAVAEAPVEETTENVGEATFSYDRLISKSTDPVRGIDYKRREAYLSDSEFQTVFGMTKDAFYQQPNWKQELQKRKADLF

SEQ ID NO: 1837 - DNA, 3792 bp, Sorghum bicolor
  misc_feature: Ceres ANNOT ID no. 6017132
  misc_feature: Encodes the peptide sequence at SEQ ID NO 1838
atgaccgcggcggcggagcgccgcaagctcagcggctacctacgcgccgtggtgtccgtacccggcgttgacgcctcggcggcgtcttcgatcccgcctctgtccccgtgcacgctctccgcgtgcggggccgtggccctagcgccgctccccgacgacgtggggacccagccgcggtggcccaggtggcgcgcgcccggcgtcgtgcgcctgctcaggacgctcgtggcgaaccgctgcgtcgaggtggagggcacgctgctgcgggtcgtgaccaggaaggccggggaaggggacggcgacggcgccgaggtggaggccagggccgtcctgctcctcgacgtctacctgcccgtcgctgcgtggtccgggtggcagttcccgcgctcgcgctccgctgccgccgccgtattcaaacatgtcagttgcaactgggatgctaggaaagctttgcttgattttgactggacttctcatgccaatacacactgtgatgaccgttccatttggagctgcaccgattgtcacgtgcttggttgcgaggaccacaagatagcatcaatatcaaataaagagaagtcatttgacctgcatgaaatcttcaagatgctccctggtgttaggatggagaagaacatgcaggtagcaagaataataccagatgcaggagcactggaactgggtatttggtctgtccctgacgatgtattgcataaagtactaattctacttaaacccagagatttgataagagtggcagcaacttgtcatcatcttaggactcttgctgcctctgttatgccttgcatgaagcttaagctcttcccccatcaagaggctgctgttgaatggatgttgaagagagaacagaacgtgcatgtcctagcacatcctttgtacaaggatttctgcactgaggatggtttcccattctacataaatgttatctctgctgaaatatctaccggtgatgctccaaccataaatgatttctgtggaggtatgttttgtgatgaacctgggttagggaagacagtaaccacactctctctgattctaaaaacccaaggaacaatggcgtatgctccacaaggggtcgatgtgagttggtgcatgcataagccagataaaaaatgtggttactatgaattaagtgccagctgctcttctaatagaaacagctcttcgtctgcgtcaagaaagcttttgggggaggatgtgataacagattatcaaagtccagatgattctgtctgcagtaccagatattcaagaaagagaggtaggttactgagccctgatccaactaaggtaatgttgcatgctgcgattgagaattccccatcgtcatcacacagcaaagagcattcaatgccagctacgcatatactgaagttcactaaaaactcgagacaagttaggaaaaacctcatggatgcatacagcgacgtttcagttggcaataaaaggaagattggtatcagctctgagttaagtgagacctgggttcagtgtgatgcttgcaaaaagtggcgaaggttatctgatggaacagttcttgattctaccacagtgtggttttgcactatgaacactgatcctacacgacagaaatgtactgacccggaggaatcctgggattttaagagaaagataacctatttgccaggattttacaagaaaaattctttgcctggaaatgaggaaaacgtgacatttttcgcaaacatattgaaagataatgttactatgatcaattcagaaaccaagaaggctttgttatggttagcaaaactttctcccacaaaacttctcgagatggaatttgttggtttgactcgaccagttctagatacacgtgcaactactagcaagggtgctcgtccatattacaagatattccaagcatttggccttgtgagaaagattgagaaaggtgtgactcgctggtactatccctctatgcttgatgatttatcttttgattcgactgcacttggagctgctcttgaaaaacctctggattcaactagattttatttatctacagccaccttgatagtggtacctgctaacttaattgatcactggacaacacagatacagcgtcatgtatcctcggatacccttaatgtttttgtgtggggagaccacaagaagccatcttctcacaaccttgcttgggactatgacattgtcataaccacattcagcagactaagtgcagaatggggtccaaagaagagaagcccactaaagcagatccattggttcagggtaatactggatgaagggcacacactaggttccagccttgccctgacaaacaagttacagatggctgtcgctttggttgcatcaaataggtggatattaactggtacacctacaccaaatacaccaactagtcaagttgctcatcttcaccccatgcttaagtttcttcatgatgaaacttatggtgagaactaccagtcatgggactcggggatccatagaccttttgaggcgcaaatggaagagggacgtgctcgtcttgtgcagctgcttcagaggactatgattagtgcaagaaaagcagacctgaaaaatattcctccttgcataaagaagataacctacctagacttcaatgaggggcatgcaaaaagttacaatgaactggttgttactatacgccgaaatattctgatggctgattggaatgacccttctcatgtagaatcccttcttaaccccaagcagtggaaattccgtgctactactttgaagaatgtccgtttatcttgctgtgttgccgggcatatcagagtagccgaggcaggtcaggatatacaggaaacaatggatgaattggtgcagcatggccttgatccttcttcagacgaatatcagtttataagatattctcttttaaatggtgccagttgtttcaggtgtagagtttggtgtcgcttgcctgttatcacaccctgtcgacatcttttgtgccttgactgtgtagctcttgatagtgaaaaatgtacattacctggttgtggtaatcattatgagatgcagtctcctgagactcgtgcaaggccagaaaatccaaacccaaagtggccagtgcctaaggatctaattgagttgcagccttcatataagcaggatgattgggatcccgattggcaatcaacatctagcagcaaagttgcttatctgattgagaagctaagaagtctgcgagaaactgggaataacataaccgatagtgttggtcatgctaatacactatcttatcaaccacaggcagtgttggacaaagttataattttttctcagtttctagagcatattcacgtgattcaacagcagctgactattgctggaataatatatgcgggaatgtatagtccgatgcctctagccagtaagagaagtgcactaatgaagtttcaggaggacccaacgtgtatggctttagtcatggatggaactgctgcactggggcttgatttgagttttgtgactcatgtttttctcatggaaccaatatgggataggagtatggaggaacaggttattagtcgggcacatcgaatgggggctacgcgtccaatacatgtcgaaactttggctatgcgtggtaccgttgaagagcaaatgcttaggcttctgcaggattctagcgcctgcagaaaaatagtgaataaaggaacaggcagcactgacaatgaaggaggccggtctcatcggagcctccatgattttgctgaaagcagctatctgttgcaactcagctctgtgtag

SEQ ID NO: 1838 - protein, 1263 aa, Sorghum bicolor
  misc_feature: Ceres ANNOT ID no. 6017132
  misc_feature (500)..(546): Pfam Id: zf-CW Pfam Desc: CW-type Zinc Finger
  misc_feature (277)..(933): Pfam Id: SNF2_N Pfam Desc: SNF2 family N-terminal domain
  misc_feature (1119)..(1196): Pfam Id: Helicase_C Pfam Desc: Helicase conserved C-terminal domain
  misc_feature (227)..(274): Pfam Id: F-box Pfam Desc: F-box domain
  misc_feature (654)..(1013): NCBI GI: 124360542 NCBI Desc: snf2-related; zinc finger, ring-type; atp-requiring dna helicase recq [medicago truncatula]
  misc_feature (676)..(1077): NCBI GI: 115457136 NCBI Desc: os04g0177300 [oryza sativa (japonica cultivar-group)]
  misc_feature (682)..(1219): NCBI GI: 67989453 NCBI Desc: zinc finger protein; zf-c3hc4 type (ring finger); ubiquitin ligase (e3) [schizosaccharomyces pombe 972h-]
  misc_feature (682)..(1219): NCBI GI: 443973 NCBI Desc: rad8 [schizosaccharomyces pombe]
  misc_feature (676)..(1077): NCBI GI: 58531994 NCBI Desc: osjnba0096f01.3 [oryza sativa (japonica cultivar-group)]
MTAAAERRKLSGYLRAVVSVPGVDASAASSIPPLSPCTLSACGAVALAPLPDDVGTQPRWPRWRAPGVVRLLRTLVANRCVEVEGTLLRVVTRKAGEGDGDGAEVEARAVLLLDVYLPVAAWSGWQFPRSRSAAAAVFKHVSCNWDARKALLDFDWTSHANTHCDDRSIWSCTDCHVLGCEDHKIASISNKEKSFDLHEIFKMLPGVRMEKNMQVARIIPDAGALELGIWSVPDDVLHKVLILLKPRDLIRVAATCHHLRTLAASVMPCMKLKLFPHQEAAVEWMLKREQNVHVLAHPLYKDFCTEDGFPFYINVISAEISTGDAPTINDFCGGMFCDEPGLGKTVTTLSLILKTQGTMAYAPQGVDVSWCMHKPDKKCGYYELSASCSSNRNSSSSASRKLLGEDVITDYQSPDDSVCSTRYSRKRGRLLSPDPTKVMLHAAIENSPSSSHSKEHSMPATHILKFTKNSRQVRKNLMDAYSDVSVGNKRKIGISSELSETWVQCDACKKWRRLSDGTVLDSTTVWFCTMNTDPTRQKCTDPEESWDFKRKITYLPGFYKKNSLPGNEENVTFFANILKDNVTMINSETKKALLWLAKLSPTKLLEMEFVGLTRPVLDTRATTSKGARPYYKIFQAFGLVRKIEKGVTRWYYPSMLDDLSFDSTALGAALEKPLDSTRFYLSTATLIVVPANLIDHWTTQIQRHVSSDTLNVFVWGDHKKPSSHNLAWDYDIVITTFSRLSAEWGPKKRSPLKQIHWFRVILDEGHTLGSSLALTNKLQMAVALVASNRWILTGTPTPNTPTSQVAHLHPMLKFLHDETYGENYQSWDSGIHRPFEAQMEEGRARLVQLLQRTMISARKADLKNIPPCIKKITYLDFNEGHAKSYNELVVTIRRNILMADWNDPSHVESLLNPKQWKFRATTLKNVRLSCCVAGHIRVAEAGQDIQETMDELVQHGLDPSSDEYQFIRYSLLNGASCFRCRVWCRLPVITPCRHLLCLDCVALDSEKCTLPGCGNHYEMQSPETRARPENPNPKWPVPKDLIELQPSYKQDDWDPDWQSTSSSKVAYLIEKLRSLRETGNNITDSVGHANTLSYQPQAVLDKVIIFSQFLEHIHVIQQQLTIAGIIYAGMYSPMPLASKRSALMKFQEDPTCMALVMDGTAALGLDLSFVTHVFLMEPIWDRSMEEQVISRAHRMGATRPIHVETLAMRGTVEEQMLRLLQDSSACRKIVNKGTGSTDNEGGRSHRSLHDFAESSYLLQLSSV

SEQ ID NO: 1839 - DNA, 3342 bp, Sorghum bicolor
  misc_feature: Ceres ANNOT ID no. 6017136
  misc_feature: Encodes the peptide sequence at SEQ ID NO 1840
  misc_feature: Down-regulated in root tissues in response to methyl jasmonate treatment
atggctttagcttatgctagtgccatgtttcctccttcgagctcttcacataaaacttgggaggacccgtcattcttcaagtggagaaagcgtgaggcgcatgtgccattgcgctcacaggacacgctggaaggagccctgaagtattggcatgaacggaggaatgtgaactacctcaattctgacactgctgtctggaacgatgatgcggttcgcggtgctctggaaagtgctgttttttggtccaagggcttaccatacgccaaatctctaagtggatactggaaattccttctgtctccttcggtggaaagtgttccagagagattctatgatactcattttgatgattcaaattgggcggctttgccagttccctcaaattggcaaatgcatgggtttgaccgtccaatctacacaaatatgacttatcctttcccattgaacccaccatttgtgccggctgataatcccacgggttgttacaggacagtttttcacatcccaaaagagtggaaaggtcggaggatcttgctgcactttgaagctgttgattctgcattttttgcttgggtaaatggagtaccaattgggtatagccaggacagcaggcttcctgctgagtttgaagttaccgattgctgccatccttgtgattcggacaaggaaaatgttcttgctgttcaagttatgaggtggagtgatggttcttatcttgaagatcaggatcactggaggctgtctggtattcacagggatgtgctcctactatcaaagccacagatttttatcacagattacttcttcaaagcaaccttggatgataatttcagtttagctgatattgaggtcgacgtggagattgactcacacaagaaagaccgggagcatgtcccaactttgtctattgaagcaacactctttgataactctggactatctatcagtatagatgctggtctttcatatgctaatgcagtcaatttgaaaccgaagccaaacccaactggaagcccttgtcgtggttttcatggttatgttcttggtggaaaaatagaaaatccaaaactttggtctagtgagcatcccaacttatacactcttgttgttctccttaaagatgccaatgggaagcttattgattgtgagtcatgccaagtgggcattcgtaatgtggtcctggcacacaagcaaatgcttgtcaatggatgtcctgttgtactaagaggtgtcaacagacatgagcaccatccacgccttggaaagacaaatttagaagcatgcatgattgaggatgtgattttgatgaagcaaaacaatatcaatgctgttagaaatagccattacccacagcacccgaggtggtatgagttatgtgacatctttggtctttatgtcatagatgaagccaacattgagacacatggttttgatgattctagcactttcaagcatcctacactagaacctatctgggcaaatgcaatgcttgatcgtgttgttagcatggtggagagagataagaatcatgcatgcattattgtttggtccctaggaaatgaatcttcatatggacctaatcatgtttccatgtctgggtggattcgtggaagggatccaacaagactccttcattatgagggaggtggttccagaacatcatccacagatattgtgtgccccatgtatatgcgtgtctgggatattgttaagatagcaaaagatccatctgaaacaaggcctctaattctttgcgaatattcacatgctatgggaaacagtaatgggaatattgatgcgtattggatggccatagacaacacttttggactccaaggaggttttatatgggactgggttgatgagggtttactgaaggaggactcagatggatctaaattttgggcatatggtggtgactttggagatactccaaatgactccaatttttgcctcaatggcattgtgtggcctgatcggacgattcacccagctgttcatgaagttaaataccttcaccagcctatcaaaatatcatcagcagaaaacatgcttaagattgaaaatggacacttttttgagacaacagaatctttggacttcagttgggttcttcatggagatggttgcatcttgggctctggtcctttgaatgttccaactttggcaccgcaaactagtcatctcatcaacatggaattatcaccatggtttgccctttggagtgcttgtgcagcaaaagaagtatttttgtctgtaaatgtgaaacagaggcatgaaacacgatgggctaaagccggtcatctcttggcttcagcacaactgtgtttgcctcagaaaaatgtctttgtccccaacgtgatagcattctccagcagccctttggtctgtgaacgcattggtgatagtgtaaccatctgcaagaataatgcatggaaaattaaagtaaacagtcaattgggaacaatcgacagctggaaggtcaacgacgttgagcttatgagcaaggggatactcccatgcttttggcgcgcaccaactgacaacgacaaaggaggtttcttcaccaagccatacgcttcgcgatggagagaagccttcctcgacaacgtctcgttccacagcagtcagttctctatcaaggaatcgccggacaacaccgtggagttctccaccgtctactacggcgttcccgggcacttgccgaagcctgacgacgaagcctccgagtccattctcttccgggtgaagatggtctgccggatccacgagtcaggcgacgtggttctcgactacgaggtgaaccccaaggccgacctccctccccttccccgggtaggcgtcgtgttcagcgccgagaggtccctgagccacgtcacttggtacgggcggggccccttcgagtgctacccggaccgcaaggcggcggcgcacgtcggcgtgtacgagagcagcgtggaggagctgcacgtgccgtacattgcccccgtggagtgcggcgggcgggcggacgtcaggtgggtggcgctccgcgacggcggcgggctcggcctgtacgcgtcggcgcacggcggctccccgccgatgcaggtgagcgccagctactacggcgccgcggagctcgacagggcgacgcacgtccacaggctggtgaagggggacgacatcgaggtgcatcttgaccacaggcacatggggctgggcggcgacgacagctggtcgccgtgcgtgcacgagcagtacctgctgccgccgacgcggtacgccttctccctgcggctctgccccctgctgccgacgtcgttgtgccatgacatctacaggtctcagctacccagctga

SEQ ID NO: 1840 - protein, 1113 aa, Sorghum bicolor
  misc_feature: Ceres ANNOT ID no. 6017136
  misc_feature (392)..(678): Pfam Id: Glyco_hydro_2_C Pfam Desc: Glycosyl hydrolases family 2, TIM barrel domain
  misc_feature (85)..(260): Pfam Id: Glyco_hydro_2_N Pfam Desc: Glycosyl hydrolases family 2, sugar binding domain
  misc_feature (805)..(1095): Pfam Id: Bgal_small_N Pfam Desc: Beta galactosidase small chain
  misc_feature (262)..(390): Pfam Id: Glyco_hydro_2 Pfam Desc: Glycosyl hydrolases family 2, immunoglobulin-like beta-sandwichdomain
  misc_feature (3)..(1112): NCBI GI: 20147224 NCBI Desc: at3g54435 [arabidopsis thaliana]
  misc_feature (3)..(1112): NCBI GI: 79314957 NCBI Desc: beta-galactosidase/ hydrolase, hydrolyzing o-glycosyl compounds [arabidopsis thaliana]
  misc_feature (232)..(1112): NCBI GI: 7258347 NCBI Desc: beta galactosidase-like protein [arabidopsis thaliana]
  misc_feature (3)..(622): NCBI GI: 110741846 NCBI Desc: beta galactosidase - like protein [arabidopsis thaliana]
  misc_feature (224)..(1092): NCBI GI: 40806810 NCBI Desc: beta-galactosidase [pseudoalteromonas sp. 22b]
  misc_feature: Useful for making plants with altered alkaloid content
  misc_feature: Functional homolog of the protein sequence given in SEQ ID NO 13068
  misc_feature: Useful for making plants with altered alkaloid content
  misc_feature: Functional homolog of the protein sequence given in SEQ ID NO 13068
  misc_feature: Down-regulated in root tissues in response to methyl jasmonate treatment
MALAYASAMFPPSSSSHKTWEDPSFFKWRKREAHVPLRSQDTLEGALKYWHERRNVNYLNSDTAVWNDDAVRGALESAVFWSKGLPYAKSLSGYWKFLLSPSVESVPERFYDTHFDDSNWAALPVPSNWQMHGFDRPIYTNMTYPFPLNPPFVPADNPTGCYRTVFHIPKEWKGRRILLHFEAVDSAFFAWVNGVPIGYSQDSRLPAEFEVTDCCHPCDSDKENVLAVQVMRWSDGSYLEDQDHWRLSGIHRDVLLLSKPQIFITDYFFKATLDDNFSLADIEVDVEIDSHKKDREHVPTLSIEATLFDNSGLSISIDAGLSYANAVNLKPKPNPTGSPCRGFHGYVLGGKIENPKLWSSEHPNLYTLVVLLKDANGKLIDCESCQVGIRNVVLAHKQMLVNGCPVVLRGVNRHEHHPRLGKTNLEACMIEDVILMKQNNINAVRNSHYPQHPRWYELCDIFGLYVIDEANIETHGFDDSSTFKHPTLEPIWANAMLDRVVSMVERDKNHACIIVWSLGNESSYGPNHVSMSGWIRGRDPTRLLHYEGGGSRTSSTDIVCPMYMRVWDIVKIAKDPSETRPLILCEYSHAMGNSNGNIDAYWMAIDNTFGLQGGFIWDWVDEGLLKEDSDGSKFWAYGGDFGDTPNDSNFCLNGIVWPDRTIHPAVHEVKYLHQPIKISSAENMLKIENGHFFETTESLDFSWVLHGDGCILGSGPLNVPTLAPQTSHLINMELSPWFALWSACAAKEVFLSVNVKQRHETRWAKAGHLLASAQLCLPQKNVFVPNVIAFSSSPLVCERIGDSVTICKNNAWKIKVNSQLGTIDSWKVNDVELMSKGILPCFWRAPTDNDKGGFFTKPYASRWREAFLDNVSFHSSQFSIKESPDNTVEFSTVYYGVPGHLPKPDDEASESILFRVKMVCRIHESGDVVLDYEVNPKADLPPLPRVGVVFSAERSLSHVTWYGRGPFECYPDRKAAAHVGVYESSVEELHVPYIAPVECGGRADVRWVALRDGGGLGLYASAHGGSPPMQVSASYYGAAELDRATHVHRLVKGDDIEVHLDHRHMGLGGDDSWSPCVHEQYLLPPTRYAFSLRLCPLLPTSLCHDIYRSQLPS

SEQ ID NO: 1841 - DNA, 1719 bp, Sorghum bicolor
  misc_feature: Ceres ANNOT ID no. 6017138
  misc_feature: Encodes the peptide sequence at SEQ ID NO 1842
atgccattgccattggcggcccagagcgctctcgtcgcggcagccgtcgccatagccacggccaccgtcctcctcctcgtcccatggacgccaacgccgcgggaccgcttcgccgacatggtgctggccaacgccaccatctacaccgccgaccccgcccgccccttcgccgacgccatggccgtccgcgacggccgcgtgctccgcgtcgggacctacgagtccgtcaaggagctcaacggccgccacacgcatgagctgagtctcagtgggaacgtggtactgccagggttcatcgactcccatgtccacttcatcgatggtggattccagctagcgagggtgccacttcgagggatcagaaacaaagatgacttcattggcagagtcgaggaagctgtcagagataaacatcctgggcagtggattttaggaggaggttggaacaatgatttttggggaggtgacctccctgctgctgcttggctggatgatatgtcacctgataatccagtctggctctctcgtatggatggtcatatgggagtagccaactcattagctatgaagattgctgggattgacaaaaacacagacgatccaattggtggaacaatcatgcgaacaaccggaggagagcctactggtcttctagttgatactgctatgaagcttatatttgatgtcattgaaaaagtttctaaccatgaaagaagagaggctcttcttagagcaagtaaacatgccctaatgaggggagtgactactgttgttgatgttggaagttacttccctgggacctcaacagagaaaacatggcaagattttgcagacatctatgaatgggctcactcaatggaaaaaatgattatgagagtatgcttattctttccaatgcccacatggtctcgtgtttctgatcttattgatgaacatggtcgatcactaagtcagtggatccatctaggtggtgttaaagcttttcttgatggttctctgggttcttcaagcgcattgttccatgagccttacgagggtgatcctggtaattatggtctgcaagtgacagatttggacagcctacttaatagaacactagaatctgataaatctggactccaggttgccatacatgcaattggggataaagctaatgacttgctactggatatgattgacaaggttgttgatttaaatggagtgaaggaccgtagattccggattgagcatgcccaacatctggctccaggtgcagcaaatcgctttggcaagcatggtatcattgcatccgtgcagccagatcatctattagatgacgccaactcagctggaaacaagattggggtggaacgggctgaacgaagctcctacacatttcgatcactgttagatggcggtgcacagctagcttttggctctgattggcctgtttcagacatcaaccctctacaagctatccgaaccgcaatgttccgtaagcctcctgggtgggaggtcccctggatccctgcagagcgcttgaccctagatgaatcactgaaagcgcatacgatgtctgctgcctacgcctgcttcttggaccacgccgtgggcagcctttctgaagggaaatacgcggattttgtggtgctgccctctacatcgtgggacgaattctccaacgatgtgccggggcaggtcctggcgacgtacgtgagcggcaggcaagcctatccatga

SEQ ID NO: 1842 - protein, 572 aa, Sorghum bicolor
  misc_feature: Ceres ANNOT ID no. 6017138
  misc_feature (93)..(543): Pfam Id: Amidohydro_3 Pfam Desc: Amidohydrolase family
  misc_feature (93)..(545): Pfam Id: Amidohydro_1 Pfam Desc: Amidohydrolase family
  misc_feature (2)..(572): NCBI GI: 31616515 NCBI Desc: laf3 isoform 1 [arabidopsis thaliana]
  misc_feature (9)..(572): NCBI GI: 31616517 NCBI Desc: laf3 isoform 2 [arabidopsis thaliana]
  misc_feature (177)..(572): NCBI GI: 23308369 NCBI Desc: at3g55850/f27k19_30 [arabidopsis thaliana]
  misc_feature (38)..(571): NCBI GI: 121533338 NCBI Desc: amidohydrolase 3 [thermosinus carboxydivorans nor1]
  misc_feature (20)..(571): NCBI GI: 94970470 NCBI Desc: amidohydrolase 3 [acidobacteria bacterium ellin345]
MPLPLAAQSALVAAAVAIATATVLLLVPWTPTPRDRFADMVLANATIYTADPARPFADAMAVRDGRVLRVGTYESVKELNGRHTHELSLSGNVVLPGFIDSHVHFIDGGFQLARVPLRGIRNKDDFIGRVEEAVRDKHPGQWILGGGWNNDFWGGDLPAAAWLDDMSPDNPVWLSRMDGHMGVANSLAMKIAGIDKNTDDPIGGTIMRTTGGEPTGLLVDTAMKLIFDVIEKVSNHERREALLRASKHALMRGVTTVVDVGSYFPGTSTEKTWQDFADIYEWAHSMEKMIMRVCLFFPMPTWSRVSDLIDEHGRSLSQWIHLGGVKAFLDGSLGSSSALFHEPYEGDPGNYGLQVTDLDSLLNRTLESDKSGLQVAIHAIGDKANDLLLDMIDKVVDLNGVKDRRFRIEHAQHLAPGAANRFGKHGIIASVQPDHLLDDANSAGNKIGVERAERSSYTFRSLLDGGAQLAFGSDWPVSDINPLQAIRTAMFRKPPGWEVPWIPAERLTLDESLKAHTMSAAYACFLDHAVGSLSEGKYADFVVLPSTSWDEFSNDVPGQVLATYVSGRQAYP

SEQ ID NO: 1843 - DNA, 735 bp, Sorghum bicolor
  misc_feature: Ceres ANNOT ID no. 6017140
  misc_feature: Encodes the peptide sequence at SEQ ID NO 1844
atggaccatcagctgttcgacgaccccttcgggagcagcatctcgtcgctggaggcggacatcttctccgccggcggcggcggacagctgccgtcgccgccgtggccggacctcgacctcgacgacgactacgacatacacgacctctccgcgccggccgccaacgccgccacctcctcgggcggcggctatggctccggcggctccggcaggaagctcagccacaacgcatacgagcgcgaccgccggaagcagctcaacgagctctactcctcgctccgatccctcctcccggacgctgatcacactaagaagctgagcatccccaccaccgtgtcccgagttctcaagtacatcccggagctgcagaagcaggtggataacctggagaggaggaagaaggagctgaccaacgccaactgcaagccgggagttctcaacaccaaagagatcgtaactcccattgtttctgctacttgccttaacgacacggagatcatggttcaggtcagcctgcacagcaatgtggccgccacagctctccctctctccaagtgcataaaggtgctagaaaacgaaggccttctcctcgtcagctcatcaacctactccaccttcgagaacaagacattctatagcctccatcttcagagaagtcaaagaacgatgaaggagcagtgcccaggattctgcgacgaactggagaagatcgtcaggaagaaagcaggggcgtag

SEQ ID NO: 1844 - protein, 244 aa, Sorghum bicolor
  misc_feature: Ceres ANNOT ID no. 6017140
  misc_feature (71)..(123): Pfam Id: HLH Pfam Desc: Helix-loop-helix DNA-binding domain
  misc_feature (4)..(242): NCBI GI: 115442289 NCBI Desc: os01g0952800 [oryza sativa (japonica cultivar-group)]
  misc_feature (1)..(243): NCBI GI: 113734244 NCBI Desc: basic helix-loop-helix protein [hordeum vulgare subsp. vulgare]
  misc_feature (71)..(241): NCBI GI: 92898443 NCBI Desc: helix-loop-helix dna-binding [medicago truncatula]
  misc_feature (71)..(217): NCBI GI: 30688583 NCBI Desc: basic helix-loop-helix (bhlh) family protein [arabidopsis thaliana]
  misc_feature (71)..(171): NCBI GI: 87331151 NCBI Desc: basic helix-loop-helix family protein [thlaspi caerulescens]
  misc_feature: The sequence is a functional homolog of SEQ ID NO 1315 in the 10/666,642US patent application
  misc_feature: The sequence is a functional homolog of SEQ ID NO 1540 in the 10/666,642US patent application
  misc_feature: The sequence is a functional homolog of SEQ ID NO 1542 in the 10/666,642US patent application
  misc_feature: The sequence is a functional homolog of SEQ ID NO 594 in the 10/666,642US patent application
  misc_feature: Useful for making plants with modulated growth and phenotype characteristics
  misc_feature: The sequence is a functional homolog of SEQ ID NO 1315 in the 20070033671 US patent application
  misc_feature: The sequence is a functional homolog of SEQ ID NO 1540 in the 20070033671 US patent application
  misc_feature: The sequence is a functional homolog of SEQ ID NO 1542 in the 20070033671 US patent application
  misc_feature: The sequence is a functional homolog of SEQ ID NO 594 in the 20070033671 US patent application
  misc_feature: The sequence is a functional homolog of SEQ ID NO 1315 in the 10/666,642 US patent application
  misc_feature: The sequence is a functional homolog of SEQ ID NO. 483 in the 11/188,298 US application
  misc_feature: The sequence is a functional homolog of SEQ ID NO. 414 in the 11/188,298 US application
MDHQLFDDPFGSSISSLEADIFSAGGGGQLPSPPWPDLDLDDDYDIHDLSAPAANAATSSGGGYGSGGSGRKLSHNAYERDRRKQLNELYSSLRSLLPDADHTKKLSIPTTVSRVLKYIPELQKQVDNLERRKKELTNANCKPGVLNTKEIVTPIVSATCLNDTEIMVQVSLHSNVAATALPLSKCIKVLENEGLLLVSSSTYSTFENKTFYSLHLQRSQRTMKEQCPGFCDELEKIVRKKAGA

SEQ ID NO: 1845 - DNA, 597 bp, Sorghum bicolor
  misc_feature: Ceres ANNOT ID no. 6017141
  misc_feature: Encodes the peptide sequence at SEQ ID NO 1846
atggaagccgcggcggcgtcagcgagagtcctgcgcgtggccgccatctgcggctccctccgcaaggcctccttcaaccgcggcctcctccgcgccgccgcggaggtgtgcgaggactccatcccggggctccgcgtcgacgagctcgacatctccgacctgcccttgatcaacaccgacctcgagaccggcggcggcactggcttcccgcccgccgtcgaggccttccgcgccaaggtctgccaggccgactgcttcctcttcggcgcgcccgagtacaactactccatcgccacccccctgaagaatgcacttgactgggcttctagaggaaagaactgttgggcagacaaacccgctgcaattgtgagtgcaggcggtggctttggaggagggaggtcacagtaccatctccgtcaggttggagtattcttggatcttcatttcatcaacaagccagaactgtgcgtccaagcatttcagcaaccacccaagtttgacagcgatggaaatctgattgatgctgaaatcagagagcggctcaagcaagtgctcttatcccttcaggccttcacactcaggctccagaaggactga

SEQ ID NO: 1846 - protein, 198 aa, Sorghum bicolor
  misc_feature: Ceres ANNOT ID no. 6017141
  misc_feature (11)..(179): Pfam Id: FMN_red Pfam Desc: NADPH-dependent FMN reductase
  misc_feature (1)..(196): NCBI GI: 75273736 NCBI Desc: nadph:quinone oxidoreductase
  misc_feature (1)..(196): NCBI GI: 5002232 NCBI Desc: nadph:quinone oxidoreductase [arabidopsis thaliana]
  misc_feature (6)..(196): NCBI GI: 24745889 NCBI Desc: nad(p)h:quinone oxidoreductase [solanum tuberosum]
  misc_feature (8)..(196): NCBI GI: 92869442 NCBI Desc: nadph-dependent fmn reductase [medicago truncatula]
  misc_feature (11)..(196): NCBI GI: 49081686 NCBI Desc: pa1204 [synthetic construct]
  misc_feature (1)..(196): SWISSPROT Homolog: EC 1.6.5.2 NADPH:quinone oxidoreductase
MEAAAASARVLRVAAICGSLRKASFNRGLLRAAAEVCEDSIPGLRVDELDISDLPLINTDLETGGGTGFPPAVEAFRAKVCQADCFLFGAPEYNYSIATPLKNALDWASRGKNCWADKPAAIVSAGGGFGGGRSQYHLRQVGVFLDLHFINKPELCVQAFQQPPKFDSDGNLIDAEIRERLKQVLLSLQAFTLRLQKD

SEQ ID NO: 1847 - DNA, 753 bp, Sorghum bicolor
  misc_feature: Ceres ANNOT ID no. 6017143
  misc_feature: Encodes the peptide sequence at SEQ ID NO 1848
atggccggcgaggaggcgtccggcggcgccgggctgatggagccggcgccggcgccggcgcgggcgctgatgcccgtgacggcgaggaagccgcgcgggcggccgctggggtccaagaacaagccgaagccaccggtggtggtgacgcgggagagcgatgcggcgatgcggcccgtggtgctggagctggcggcggggtgcgacgtggtgtccgcggtggcggcgttcgcgcgccgccgccgcgtgggcgtgtccgtgctctgcgggcgcggcgccgtcgccgccgtcacgctgcgccttgcggcggcggaggataccgcctccgcggtgacgctgcacgggcggttcgaggtgctggcgctctccgggaccgtgctgccgtcgtattcgccgtcgttggcgccggcgttctcggtgtcgctggcaggcctgggcgggcaggtgatcggcgggaccctggccggggagatgaccgcggcggacggggtggtcgtggtggccgccgtgttcaggaccgccgaagtgcaccggctgcccgctgctggcgcagaggatggggacggcgacggtggtagggaggaggggaggcagctgcaggtggcggccagcggcgccgatgctgcgggactgggtggctacggcggcggcggccacgtgggccagcacgcggagcagctgcctgagatgggtctgtggggccagcagccgacgcccactcgcggaccggtccatcctctgcaaaaccgcttctag

SEQ ID NO: 1848 - protein, 250 aa, Sorghum bicolor
  misc_feature: Ceres ANNOT ID no. 6017143
  misc_feature (4)..(225): NCBI GI: 15528814 NCBI Desc: p0431g06.21 [oryza sativa (japonica cultivar-group)]
  misc_feature (26)..(212): NCBI GI: 38346718 NCBI Desc: osjnba0086o06.16 [oryza sativa (japonica cultivar-group)]
  misc_feature (29)..(230): NCBI GI: 50725742 NCBI Desc: dna-binding protein-like [oryza sativa (japonica cultivar-group)]
  misc_feature (6)..(215): NCBI GI: 115474893 NCBI Desc: os08g0159700 [oryza sativa (japonica cultivar-group)]
  misc_feature (19)..(233): NCBI GI: 119331586 NCBI Desc: at-hook dna-binding protein [catharanthus roseus]
  misc_feature: The sequence is a functional homolog of SEQ ID NO 10 in the 10/669,824US patent application
  misc_feature: The sequence is a functional homolog of SEQ ID NO 10 in the 10/870,198US patent application
  misc_feature: The sequence is a functional homolog of SEQ ID NO 1395 in the 10/374,780US patent application
  misc_feature: The sequence is a functional homolog of SEQ ID NO 1399 in the 10/374,780US patent application
  misc_feature: The sequence is a functional homolog of SEQ ID NO 1400 in the 10/374,780US patent application
  misc_feature: The sequence is a functional homolog of SEQ ID NO 1402 in the 10/374,780US patent application
  misc_feature: The sequence is a functional homolog of SEQ ID NO 1403 in the 10/374,780US patent application
  misc_feature: The sequence is a functional homolog of SEQ ID NO 1404 in the 10/374,780US patent application
  misc_feature: The sequence is a functional homolog of SEQ ID NO 1406 in the 10/374,780US patent application
  misc_feature: The sequence is a functional homolog of SEQ ID NO 1408 in the 10/374,780US patent application
  misc_feature: The sequence is a functional homolog of SEQ ID NO 1410 in the 10/374,780US patent application
  misc_feature: The sequence is a functional homolog of SEQ ID NO 150 in the 10/412,699US patent application
  misc_feature: The sequence is a functional homolog of SEQ ID NO 1507 in the 10/412,699US patent application
  misc_feature: The sequence is a functional homolog of SEQ ID NO 1509 in the 10/412,699US patent application
  misc_feature: The sequence is a functional homolog of SEQ ID NO 1510 in the 10/412,699US patent application
  misc_feature: The sequence is a functional homolog of SEQ ID NO 2154 in the 10/374,780US patent application
  misc_feature: The sequence is a functional homolog of SEQ ID NO 22 in the 10/669,824US patent application
  misc_feature: The sequence is a functional homolog of SEQ ID NO 22 in the 10/870,198US patent application
  misc_feature: The sequence is a functional homolog of SEQ ID NO 26 in the 10/669,824US patent application
  misc_feature: The sequence is a functional homolog of SEQ ID NO 26 in the 10/870,198US patent application
  misc_feature: The sequence is a functional homolog of SEQ ID NO 28 in the 10/669,824US patent application
  misc_feature: The sequence is a functional homolog of SEQ ID NO 28 in the 10/870,198US patent application
  misc_feature: The sequence is a functional homolog of SEQ ID NO 314 in the 11/435,388US patent application
  misc_feature: The sequence is a functional homolog of SEQ ID NO 316 in the 10/714,887US patent application
  misc_feature: The sequence is a functional homolog of SEQ ID NO 318 in the 10/666,642US patent application
  misc_feature: The sequence is a functional homolog of SEQ ID NO 32 in the 10/669,824US patent application
  misc_feature: The sequence is a functional homolog of SEQ ID NO 32 in the 10/870,198US patent application
  misc_feature: The sequence is a functional homolog of SEQ ID NO 340 in the 11/435,388US patent application
  misc_feature: The sequence is a functional homolog of SEQ ID NO 342 in the 10/714,887US patent application
  misc_feature: The sequence is a functional homolog of SEQ ID NO 344 in the 11/435,388US patent application
  misc_feature: The sequence is a functional homolog of SEQ ID NO 346 in the 10/714,887US patent application
  misc_feature: The sequence is a functional homolog of SEQ ID NO 346 in the 11/435,388US patent application
  misc_feature: The sequence is a functional homolog of SEQ ID NO 348 in the 10/714,887US patent application
  misc_feature: The sequence is a functional homolog of SEQ ID NO 348 in the 11/435,388US patent application
  misc_feature: The sequence is a functional homolog of SEQ ID NO 350 in the 10/714,887US patent application
  misc_feature: The sequence is a functional homolog of SEQ ID NO 350 in the 11/435,388US patent application
  misc_feature: The sequence is a functional homolog of SEQ ID NO 352 in the 10/714,887US patent application
  misc_feature: The sequence is a functional homolog of SEQ ID NO 352 in the 11/435,388US patent application
  misc_feature: The sequence is a functional homolog of SEQ ID NO 354 in the 10/714,887US patent application
  misc_feature: The sequence is a functional homolog of SEQ ID NO 38 in the 10/669,824US patent application
  misc_feature: The sequence is a functional homolog of SEQ ID NO 38 in the 10/870,198US patent application
  misc_feature: The sequence is a functional homolog of SEQ ID NO 44 in the 10/669,824US patent application
  misc_feature: The sequence is a functional homolog of SEQ ID NO 44 in the 10/870,198US patent application
  misc_feature: The sequence is a functional homolog of SEQ ID NO 64 in the 10/669,824US patent application
  misc_feature: The sequence is a functional homolog of SEQ ID NO 64 in the 10/870,198US patent application
  misc_feature: The sequence is a functional homolog of SEQ ID NO 830 in the 11/435,388US patent application
  misc_feature: The sequence is a functional homolog of SEQ ID NO 90 in the 10/669,824US patent application
  misc_feature: The sequence is a functional homolog of SEQ ID NO 92 in the 10/669,824US patent application
  misc_feature: Useful for making plants with modulated growth and phenotype characteristics
  misc_feature: The sequence is a functional homolog of SEQ ID NO 150 in the 20040045049 US patent application
  misc_feature: The sequence is a functional homolog of SEQ ID NO 1507 in the 20040045049 US patent application
  misc_feature: The sequence is a functional homolog of SEQ ID NO 1509 in the 20040045049 US patent application
  misc_feature: The sequence is a functional homolog of SEQ ID NO 1510 in the 20040045049 US patent application
  misc_feature: The sequence is a functional homolog of SEQ ID NO 26 in the 20040128712 US patent application
  misc_feature: The sequence is a functional homolog of SEQ ID NO 28 in the 20040128712 US patent application
  misc_feature: The sequence is a functional homolog of SEQ ID NO 32 in the 20040128712 US patent application
  misc_feature: The sequence is a functional homolog of SEQ ID NO 38 in the 20040128712 US patent application
  misc_feature: The sequence is a functional homolog of SEQ ID NO 44 in the 20040128712 US patent application
  misc_feature: The sequence is a functional homolog of SEQ ID NO 64 in the 20040128712 US patent application
  misc_feature: The sequence is a functional homolog of SEQ ID NO 90 in the 20040128712 US patent application
  misc_feature: The sequence is a functional homolog of SEQ ID NO 92 in the 20040128712 US patent application
MAGEEASGGAGLMEPAPAPARALMPVTARKPRGRPLGSKNKPKPPVVVTRESDAAMRPVVLELAAGCDVVSAVAAFARRRRVGVSVLCGRGAVAAVTLRLAAAEDTASAVTLHGRFEVLALSGTVLPSYSPSLAPAFSVSLAGLGGQVIGGTLAGEMTAADGVVVVAAVFRTAEVHRLPAAGAEDGDGDGGREEGRQLQVAASGADAAGLGGYGGGGHVGQHAEQLPEMGLWGQQPTPTRGPVHPLQNRF

SEQ ID NO: 1849 - DNA, 414 bp, Sorghum bicolor
  misc_feature: Ceres ANNOT ID no. 6017160
  misc_feature: Encodes the peptide sequence at SEQ ID NO 1850
atgctggcgtcgttcggccgcgacggcgaggtctcggcggcgtccgagctgcgggggctctgcctctgcatgcgggacgcgtcggacgaggacgtgggcgcgctcgtgacatcagcagtgaaaattggcggcgacggcgggccgctcgacgagaaggatgagctggcgggggagcaggcggaggccgccggagaggaggaggacaacgacgagcgcaggtggctgcgggagacgttcgggatgtacgagatggagggcgccgggtgcatcacgccgctgagcctaaagctggtcctggccaggctcggcgtgcgccgggacatcgccgagtgccaggccatcatctgccgcttcgacatggacggcgacggcgtgctcagcttcgacgagttcaggactatgatgatagcatag

SEQ ID NO: 1850 - protein, 137 aa, Sorghum bicolor
  misc_feature: Ceres ANNOT ID no. 6017160
  misc_feature (110)..(138): Pfam Id: efhand Pfam Desc: EF hand
  misc_feature (1)..(137): NCBI GI: 20161868 NCBI Desc: b1139b11.9 [oryza sativa (japonica cultivar-group)]
  misc_feature (8)..(135): NCBI GI: 12963415 NCBI Desc: regulator of gene silencing [nicotiana tabacum]
  misc_feature (75)..(135): NCBI GI: 56542459 NCBI Desc: avr9/cf-9 rapidly elicited protein 57 [nicotiana tabacum]
  misc_feature (8)..(135): NCBI GI: 92868987 NCBI Desc: calcium-binding ef-hand [medicago truncatula]
  misc_feature (8)..(135): NCBI GI: 92868990 NCBI Desc: calcium-binding ef-hand [medicago truncatula]
MLASFGRDGEVSAASELRGLCLCMRDASDEDVGALVTSAVKIGGDGGPLDEKDELAGEQAEAAGEEEDNDERRWLRETFGMYEMEGAGCITPLSLKLVLARLGVRRDIAECQAIICRFDMDGDGVLSFDEFRTMMIA

SEQ ID NO: 1851 - DNA, 465 bp, Sorghum bicolor
  misc_feature: Ceres ANNOT ID no. 6017161
  misc_feature: Encodes the peptide sequence at SEQ ID NO 1852
atggcggtgtacgcatcatccgagttcagccgcgtgttctcagcgctagaccgggacggcgacggcaagctatcggcgaccgagctgcgcctcttcatgaaggcggcgctgggcgaggacgtgtcgtcggaggaggcggaccgcctggtggcgtctgcagacgccgacggcgacgggctgctgagccaggaggagctcctggcgctggcgctggcgggaacggcggcggaggaggaggaggaggaggaggagggaggcgagcggcgccgggagctcagggaggcgttcgggatgtacgccatggaaggccaagggtgcatcacgccgctgagcctgaagcagatgctctccaggctcggctcgcaccaggacattgatgagtgcagggccatgatctgcaggttcgacctcaacggcgacggggtgctcagctttgaggaattcaaggtcatgatggatgcatag

SEQ ID NO: 1852 - protein, 154 aa, Sorghum bicolor
  misc_feature: Ceres ANNOT ID no. 6017161
  misc_feature (8)..(36): Pfam Id: efhand Pfam Desc: EF hand
  misc_feature (127)..(155): Pfam Id: efhand Pfam Desc: EF hand
  misc_feature (8)..(154): NCBI GI: 20161868 NCBI Desc: b1139b11.9 [oryza sativa (japonica cultivar-group)]
  misc_feature (6)..(152): NCBI GI: 12963415 NCBI Desc: regulator of gene silencing [nicotiana tabacum]
  misc_feature (6)..(152): NCBI GI: 49425165 NCBI Desc: regulator of gene silencing [lycopersicon esculentum]
  misc_feature (6)..(152): NCBI GI: 50656897 NCBI Desc: calmodulin-like protein [datura metel]
  misc_feature (9)..(152): NCBI GI: 92868987 NCBI Desc: calcium-binding ef-hand [medicago truncatula]
MAVYASSEFSRVFSALDRDGDGKLSATELRLFMKAALGEDVSSEEADRLVASADADGDGLLSQEELLALALAGTAAEEEEEEEEGGERRRELREAFGMYAMEGQGCITPLSLKQMLSRLGSHQDIDECRAMICRFDLNGDGVLSFEEFKVMMDA

SEQ ID NO: 1853 - DNA, 1818 bp, Sorghum bicolor
  misc_feature: Ceres ANNOT ID no. 6017189
  misc_feature: Encodes the peptide sequence at SEQ ID NO 1854
atggcgcgcagagccacgccgcaggaggccgcggaggccgccatacgctccgtcggcctcggtttcgatgtcgtcagtgacgtccgtctcaagtactgcaagcagcgtggcgcgcccgatccctggctcatcgagctcgaccatggggaggctcaggatatcgtgctgcccggcggcgtcaccgtcgctggcgtcaccaagtcggttaagtgcgacaaaggggagcggatgaggttccgctccgatgtcctctcgttccagcagatgtctgagcaattcaaccaggagctatctttgtctgggaaaatcccatctggcttcttcaatactatgtttgagttttctggcagctggcagaaagatgctgctaataccaaaacacttgctttcgatggttggtatgtcacactatacagtgttgcactctcaaaagggcaaattgtactccgggatcatgttaaacaggctgttccatcaacctgggaacctgccaccttggctaggttcattagaaaatttggcactcatatagttgttggtctaaagatgggcgggaaagatgtaatttatttgaagcaacagcattcatcgaccttgcaagctgctgatgttcaaaaacgattgaaggagatgtcagacaggagattttttgatgcaaatgggcaatctgacatgggtttcaaggacacatatgggaacaataagagtgatatcagagagcaacagctgagatttgtacagtccagtccattgaattcttactcgtcaactgaggatttggtgatgatgcctaagcgaagaggtgggagggataaagaatttatatcccatagcgagtggcttaatactgttcaagcagagcctgatgttatctcaatgtcctttataccaatcacttcactattgaatggagttcctggaagtggatttttgaaccatgcaattaatctgtatctccggcataaacccccaatcgaggaattacatcagtttctggagttccagcttccaaggcagtgggcacctgtttacagtgatcttgctctgggtcctcagaggaaaagacaaagcagtacatcgttgccagtaaatataatcggtccaaagctttatatttgcactaacatggttgatgtgggtaaaagaccagttacaggactccggttgttccttgaaggaaggaagagcaacaaattagctatacatcttcaatatctctgctctcttcctcagattatccagcttgaagatgacccttacaatcaccaaattccagaatatgaccgcaaatactatgaaccaattggaccgtggaagcgtttttctcatgtctgcgcagcaccagtcgagtcagatgatttgtccattgtcacaggggcacaattagacgtggtcaaccatggcctcaagaaaattctgttccttcgcctgcatttctcaaaagcctgcaatgcagttgtaaggaactcggaatgggagaattctcccaacctagctcagaaatcaggccttatctcaacactcatcagcacacatttctcctcagcagctcagaagcccccaccgcggccagccgatgtgaacataaactcggcagtgtaccctggtggcccacctgttccagtgcagaccccaaagctgctcaagtttgttgatccaacagagatgatgcgtgggccgcaggattcaccgggctactgggtggtttcaggtgcaaagctgaaccttgagagaggtaagatatcattgcgggtgaaatactcactgttgacagctatgatgtcagatgatgagtcacttgatgatgatgaattttag

SEQ ID NO: 1854 - protein, 605 aa, Sorghum bicolor
  misc_feature: Ceres ANNOT ID no. 6017189
  misc_feature (125)..(320): Pfam Id: MACPF Pfam Desc: MAC/Perforin domain
  misc_feature (9)..(603): NCBI GI: 92870237 NCBI Desc: membrane attack complex component/perforin/complement c9 [medicago truncatula]
  misc_feature (10)..(599): NCBI GI: 92875831 NCBI Desc: membrane attack complex component/perforin/complement c9 [medicago truncatula]
  misc_feature (258)..(594): NCBI GI: 92875832 NCBI Desc: membrane attack complex component/perforin/complement c9 [medicago truncatula]
  misc_feature (8)..(452): NCBI GI: 92895124 NCBI Desc: membrane attack complex component/perforin/complement c9 [medicago truncatula]
  misc_feature (266)..(591): NCBI GI: 140065035 NCBI Desc: membrane attack complex component/perforin/complement c9 [medicago truncatula]
MARRATPQEAAEAAIRSVGLGFDVVSDVRLKYCKQRGAPDPWLIELDHGEAQDIVLPGGVTVAGVTKSVKCDKGERMRFRSDVLSFQQMSEQFNQELSLSGKIPSGFFNTMFEFSGSWQKDAANTKTLAFDGWYVTLYSVALSKGQIVLRDHVKQAVPSTWEPATLARFIRKFGTHIVVGLKMGGKDVIYLKQQHSSTLQAADVQKRLKEMSDRRFFDANGQSDMGFKDTYGNNKSDIREQQLRFVQSSPLNSYSSTEDLVMMPKRRGGRDKEFISHSEWLNTVQAEPDVISMSFIPITSLLNGVPGSGFLNHAINLYLRHKPPIEELHQFLEFQLPRQWAPVYSDLALGPQRKRQSSTSLPVNIIGPKLYICTNMVDVGKRPVTGLRLFLEGRKSNKLAIHLQYLCSLPQIIQLEDDPYNHQIPEYDRKYYEPIGPWKRFSHVCAAPVESDDLSIVTGAQLDVVNHGLKKILFLRLHFSKACNAVVRNSEWENSPNLAQKSGLISTLISTHFSSAAQKPPPRPADVNINSAVYPGGPPVPVQTPKLLKFVDPTEMMRGPQDSPGYWVVSGAKLNLERGKISLRVKYSLLTAMMSDDESLDDDEF

SEQ ID NO: 1855 - DNA, 1938 bp, Sorghum bicolor
  misc_feature: Ceres ANNOT ID no. 6017197
  misc_feature: Encodes the peptide sequence at SEQ ID NO 1856
atgggccacgcggcgtcgcggcccaatggcggcgccggcgacggcgacggcgaggtggtgctgccctcgcgcttcgcgcgcttccgccgccgcctccgccaccgcctccaccgccgccgcggcaacggcgacgattcggcctccgccaaggccctcgccgccgaagacttcgccggaatcgcgcgcatccggatagtcaagttcaaggacaagttcttcgcgtgcctctcgctcggcgagcgcacgtaccgcaccgagacgtccgacaacacgcacaggcctgtgtgggactcggaaaagaaggtcatagtagagacaaatggtcctcatattgcacgtatctctgtttttgagacgaaccgattttcaaagaatactttggttggttactgcgaagttgatctcttcgaaatgcttactaaggacttggaggaacactctgaggaccttcctctgttggacccatcgtcacccaatactaacgtgggcagcatatccatctcctgtcacatcgaagaccctgttgaaacagaacaaagctttgcccgccgtgtcttagctatagtggactacgatgaagatggaacactttccttatctgagttctcagacttgatgaaagcttttggtaataaattagcagttgcaaagattgaagagcttttccgtcaagcagatacaaatagtgatggcatagttgacatagatgaactggcagccctactggctgatcaacaagaaaaagaaccacttataactaactgccctgtctgtggtgaagatcttgggaaatatgataacataaatgatatgatacatatgacactttgctttgatgagggaactggtaatcagattatgactggtggatttctaacagataagcaggcttcttatgggtggatgttcaagctcagtgaatgggcacattactccacatatgatgttggtttgcgctccggctctacagcttcacatattctggtttttgaccggcgaacaaagaggatagtcgaagaagttattgatggaaaaattgtattgtccatgagagctttataccaatcaaaagtaggcctcactcttataaatacaggtgttaaagacctcttgaagaatctatctgagaagcaaggaaaaaagatgaactcaacggaatctgcaaaagatattcccaagttccttgagttatttaagggtcaaattaatatggatgaggtcaaggaccctattgaaagttttaagacttttaatgaatttttcataagaggactgaagcctggtgccagaccaattgcacacggtgaccaagacagtgttgctacttgtgctgctgatagccgtttaatggctttcagttccattgatgagagcacaaggctttggatcaagggtcgcaaattttcaattgagggtctcctagggaccagtgtgcactcagatgctttaaacaagggatcattggtcattttccggctcgcacctcaggattaccataggtttcatgtgccagtctcaggaactgtggagaaatttgtggaaattcctgggtgcctgtacacggtcaatcccattgctgtgaatagcaagtattgcaatgtattcactgagaataaaagagttgtctcaataatatcaacttccgagtttggaaaggtagcatttgttgcgattggagcaaccatggtaggaagcatcacgttcttgaaaaaagagggtgactacatccacaaaggagatgagtttgggtatttctcctttggagggagcacagtgatatgcgtcttcgagaaggatgcgatccaatttgatgctgatctcgtggcgaacagcgaaaggtcactggaaacccttgtttctgttggtatgactctgggcgtctcgacaaggaacaaggggctgcaagtcccggatctgcagaaattctcacttgaatga

SEQ ID NO: 1856 - protein, 645 aa, Sorghum bicolor
  misc_feature: Ceres ANNOT ID no. 6017197
  misc_feature (417)..(627): Pfam Id: PS_Dcarbxylase Pfam Desc: Phosphatidylserine decarboxylase
  misc_feature (217)..(245): Pfam Id: efhand Pfam Desc: EF hand
  misc_feature (99)..(422): NCBI GI: 57900287 NCBI Desc: phosphatidylserine decarboxylase-like [oryza sativa (japonica cultivar-group)]
  misc_feature (157)..(422): NCBI GI: 115442363 NCBI Desc: os01g0959800 [oryza sativa (japonica cultivar-group)]
  misc_feature (13)..(630): NCBI GI: 126673485 NCBI Desc: phosphatidylserine decarboxylase [arabidopsis thaliana]
  misc_feature (13)..(628): NCBI GI: 126673483 NCBI Desc: phosphatidylserine decarboxylase [arabidopsis thaliana]
  misc_feature (190)..(628): NCBI GI: 79487037 NCBI Desc: psd2 [arabidopsis thaliana]
MGHAASRPNGGAGDGDGEVVLPSRFARFRRRLRHRLHRRRGNGDDSASAKALAAEDFAGIARIRIVKFKDKFFACLSLGERTYRTETSDNTHRPVWDSEKKVIVETNGPHIARISVFETNRFSKNTLVGYCEVDLFEMLTKDLEEHSEDLPLLDPSSPNTNVGSISISCHIEDPVETEQSFARRVLAIVDYDEDGTLSLSEFSDLMKAFGNKLAVAKIEELFRQADTNSDGIVDIDELAALLADQQEKEPLITNCPVCGEDLGKYDNINDMIHMTLCFDEGTGNQIMTGGFLTDKQASYGWMFKLSEWAHYSTYDVGLRSGSTASHILVFDRRTKRIVEEVIDGKIVLSMRALYQSKVGLTLINTGVKDLLKNLSEKQGKKMNSTESAKDIPKFLELFKGQINMDEVKDPIESFKTFNEFFIRGLKPGARPIAHGDQDSVATCAADSRLMAFSSIDESTRLWIKGRKFSIEGLLGTSVHSDALNKGSLVIFRLAPQDYHRFHVPVSGTVEKFVEIPGCLYTVNPIAVNSKYCNVFTENKRVVSIISTSEFGKVAFVAIGATMVGSITFLKKEGDYIHKGDEFGYFSFGGSTVICVFEKDAIQFDADLVANSERSLETLVSVGMTLGVSTRNKGLQVPDLQKFSLE

SEQ ID NO: 1857 - DNA, 2142 bp, Sorghum bicolor
  misc_feature: Ceres ANNOT ID no. 6017208
  misc_feature: Encodes the peptide sequence at SEQ ID NO 1858
atgctgctccgcctccgcccgccgccgcatcaatccaccgcggtggccgcaaccatctcgtccttcctcccgtccacttcattccgccgcctcatccctttgccgcgctggcgcccccctccgcgccgacgtctctccgccgccaccgccgccgtcaaggattcgagcggccggttggatccgcgccaggagcggtacgacgtcattgtggtcggaggtggccatgccggctgcgaggccgcccttgcttcggctcgcctcggcgcgcgcaccctccttcttacgctcaacattgaccggattgcgtggcagccttgtaaccctgctgttggtgggcccgcaaagtctcaacttgttcacgaggtagatgcccttggtggtgaaattggaaaaattactgataggtgctacctgcaaaagcgtgtactgaacagctcaaaaggccctgctgtacgtgcactgcgtgctcagactgataagagagaatatgcaatagagatgaagaatgttgtggaaagcacagaaaatcttttcattagggaagcaatggctacagaggttttgattggaaaaaatgacagcgttgagggtgttcgcactttcttcggcatggacttttacgcaccatctgttgtacttaccactggaacattcatgagtggtaagatttgggttggtaggacatcaatgcctgctgggcgagctggagagtcagcttctcatggacttactgaaaacttgcagcttctgggttttgaaactgaccgcttaaaaaccggtacaccaccacgaattgatcgcaggacagttgatttttctggattggaaccccagcatggtgatgaagaggtaggttggtttagttttgatcctgaatttcacgtcgagagagaacagatgtgctgctatctaacacgaactacaaaagagacgcaccaaattgttatagacaacttagaggaaacaccaacttatggtggctgggttgaagcaaagggaccaagatactgcccggcaatcgaagataagactgtaaggttcaaagataaagagtctcatcagatctttcttgaacctgagggtagaaatgttcctgaactatatctacagggcttttctactgggcttcctgagagattgcaattgtcccttgtgcgaactataccagggctggagaactgtctaatgctaaggcctgcatatgcagttgaatatgattacttacctgcatatcaatgctcaagatcacttatgacaaagaagtttgagggtttattcttctctggccagataaatggaacaacaggatatgaagaagctgcagctcagggtatagtttctggaatcaatgcagctaggcattctgatgggaaatcattaattattcttgagagggaaagcagttatataggaactcttattgatgatcttgttacgaaagatctcagagagccctatcgcatgctaacaagccgttcagaacaccggctattgcttcgagcagataatgctgatagtcgtttaacccctttgggacgagagattggtttaatagatgatagacgctgggagctttatcagtcaaagcaagctcgcattaagcaagaaaaagagcggttgaaatctacaaaagttccaggaggtgaatttgctgctgaagttactgcagtatccaaccaacctgtaaaggatttatctacacttgaagccatactaaagaagccacatgtacaatataaactccttgataagcatggatgtggaaacgaaaatttatctcgaattgagaaggaatgtgtagagattgatatcaagtatgaaggtttcatcgcacggcaacagagtcaattacatcagattgtaaaccaagaacacaggaaacttcctgaagatttggattaccactcaatgacaaatctatcacttgaagctcgtgagaaactttccaaggtgcgcccgcaaacaataggtcaagctagcagaattggcggtgtgagcccagcagacatgacagttctccttatttggatggagagcaaccgacgcatggctaaccacaggaaacagcaagagcagctgagatcagctgcagtcgaggcggatggttcttcagaggaggtggtccatgccagcactgcataa

SEQ ID NO: 1858 - protein, 713 aa, Sorghum bicolor
  misc_feature: Ceres ANNOT ID no. 6017208
  misc_feature (67)..(459): Pfam Id: GIDA Pfam Desc: Glucose inhibited division protein A
  misc_feature (1)..(701): NCBI GI: 102139963 NCBI Desc: glucose-inhibited division a family protein [musa acuminata]
  misc_feature (43)..(706): NCBI GI: 144924597 NCBI Desc: pyridine nucleotide-disulphide oxidoreductase, class i; glucose-inhibited division protein a subfamily [medicago truncatula]
  misc_feature (41)..(701): NCBI GI: 4733959 NCBI Desc: similar to glucose inhibited division protein a from prokaryotes [arabidopsis thaliana]
  misc_feature (1)..(620): NCBI GI: 104295013 NCBI Desc: glucose-inhibited division a family protein [musa acuminata]
  misc_feature (63)..(678): NCBI GI: 53687210 NCBI Desc: cog0445: nad/fad-utilizing enzyme apparently involved in cell division [nostoc punctiforme pcc 73102]
MLLRLRPPPHQSTAVAATISSFLPSTSFRRLIPLPRWRPPPRRRLSAATAAVKDSSGRLDPRQERYDVIVVGGGHAGCEAALASARLGARTLLLTLNIDRIAWQPCNPAVGGPAKSQLVHEVDALGGEIGKITDRCYLQKRVLNSSKGPAVRALRAQTDKREYAIEMKNVVESTENLFIREAMATEVLIGKNDSVEGVRTFFGMDFYAPSVVLTTGTFMSGKIWVGRTSMPAGRAGESASHGLTENLQLLGFETDRLKTGTPPRIDRRTVDFSGLEPQHGDEEVGWFSFDPEFHVEREQMCCYLTRTTKETHQIVIDNLEETPTYGGWVEAKGPRYCPAIEDKTVRFKDKESHQIFLEPEGRNVPELYLQGFSTGLPERLQLSLVRTIPGLENCLMLRPAYAVEYDYLPAYQCSRSLMTKKFEGLFFSGQINGTTGYEEAAAQGIVSGINAARHSDGKSLIILERESSYIGTLIDDLVTKDLREPYRMLTSRSEHRLLLRADNADSRLTPLGREIGLIDDRRWELYQSKQARIKQEKERLKSTKVPGGEFAAEVTAVSNQPVKDLSTLEAILKKPHVQYKLLDKHGCGNENLSRIEKECVEIDIKYEGFIARQQSQLHQIVNQEHRKLPEDLDYHSMTNLSLEAREKLSKVRPQTIGQASRIGGVSPADMTVLLIWMESNRRMANHRKQQEQLRSAAVEADGSSEEVVHASTA

SEQ ID NO: 1859 - DNA, 1146 bp, Sorghum bicolor
  misc_feature: Ceres ANNOT ID no. 6017210
  misc_feature: Encodes the peptide sequence at SEQ ID NO 1860
atgtggggtgagagaactcatcacaagcactggcatcaaggtcatggttcctctgggcattccaaggacaaaaaccatgataaaaggcagccaaaatttataccagacaattatagctccgtcgatgcggttactactgcactgagagaagctggtctcgaatcatcaaatctaattcttggtattgatttcaccaaaagcaatgagtggtcaggcaggcattcctttagaagaaaatctctgcacgccattaatggcaccccaaatccatatgagcaagctatctctataatcgggcgaacactgtcaccttttgatgatgataacttaataccatgttttggatttggcgatgcttctacacatgatcactctgtcttcagcttctacccagagaaccgactctgtcgtggctttgaggaggttcttgcaaggtatcggcaaattgtaccacatttgaacctttcaggaccaacttcttttgcacctcttatttatgcagcgatttctgttgttgaaaatagtaattggcaataccatgtcctcgtgatcatagctgatggacaggtgactgcctctaatacaaatgatggaagattaagtccacaggaacaagcaactatacaagcaattgttgatgctagccactatcctctttcaatagtaatggttggggtgggtgatggaccatgggatgcgatgcagcattttgatgactgtatccctgaaagagcttttgacaatttccagtttgtgaacttcactgatattatgtcaacaagtaaggatatgtcaaagaaggaggctgcatttgcccttgcagctcttatggaaataccttctcagtataaagcaactcaaggcctccgacctccagaaaagcatgcacaaaggattggctctcctaggattcttcctcctccaaataaagttcttgaaaatgataatgctgcagcttcacatcctcctcaaactgcaagctcgaagtcaactggtattggcaaaagcactgccgacgagcaggtatgtcccatatgtttaaccaatccaaaggacatggcttttcagtgtggtcacctgagtccagctcatccttggatacatcatcattccagtcatcagtataatggcgacatggactgttag

SEQ ID NO: 1860 - protein, 381 aa, Sorghum bicolor
  misc_feature: Ceres ANNOT ID no. 6017210
  misc_feature (80)..(227): Pfam Id: Copine Pfam Desc: Copine
  misc_feature (1)..(361): NCBI GI: 57900296 NCBI Desc: copine i-like [oryza sativa (japonica cultivar-group)]
  misc_feature (7)..(360): NCBI GI: 46390797 NCBI Desc: copine i-like protein [oryza sativa (japonica cultivar-group)]
  misc_feature (17)..(359): NCBI GI: 30697566 NCBI Desc: copine-related [arabidopsis thaliana]
  misc_feature (15)..(359): NCBI GI: 42408845 NCBI Desc: copine i-like [oryza sativa (japonica cultivar-group)]
  misc_feature (25)..(361): NCBI GI: 22137140 NCBI Desc: at1g79380/t8k14_20 [arabidopsis thaliana]
MWGERTHHKHWHQGHGSSGHSKDKNHDKRQPKFIPDNYSSVDAVTTALREAGLESSNLILGIDFTKSNEWSGRHSFRRKSLHAINGTPNPYEQAISIIGRTLSPFDDDNLIPCFGFGDASTHDHSVFSFYPENRLCRGFEEVLARYRQIVPHLNLSGPTSFAPLIYAAISVVENSNWQYHVLVIIADGQVTASNTNDGRLSPQEQATIQAIVDASHYPLSIVMVGVGDGPWDAMQHFDDCIPERAFDNFQFVNFTDIMSTSKDMSKKEAAFALAALMEIPSQYKATQGLRPPEKHAQRIGSPRILPPPNKVLENDNAAASHPPQTASSKSTGIGKSTADEQVCPICLTNPKDMAFQCGHLSPAHPWIHHHSSHQYNGDMDC

SEQ ID NO: 1861 - DNA, 1629 bp, Sorghum bicolor
  misc_feature: Ceres ANNOT ID no. 6017221
  misc_feature: Encodes the peptide sequence at SEQ ID NO 1862
  misc_feature: Down-regulated in shoot tissues in response to salicylic acid treatment
atgaacacggtgtcttcgctgtctttggtgccgcacctgctcattaagccctccatcgcctgcttctccagaaagggcgttggccgctatggcggaatcaaggtgtacgccgtgctcagggaagacggagctgagttcgccaagaacaacaacctggaggccctgttccatgtggatgaccccgggccgaggtgccccatcaagaagggcaagttcctggatgtgaacgaggcactcgaggtggtccgattcgacatccagtactgcgactggagggcgcgccaggatctcctcaccatcatgcttctccacaacaaggtggtggaggttctcaatcccttagcgagggagttcaagtcgatcggaaccttgaggaaagagcttgccgagctgcagcaggagctggaaaaagctcacaatcaggtccatctatctgaagctagagtttcatctgcactcgacaagctagcgcatatggagaccctggtgaacgacaggctattgccaccagatggagcctccggtacttccacagccgagtccacttccctggttccaagcacatcgtccaccgcccatgtccgagccaagaaacagccacgtcggagtcttaacgtgtccggcccagtgaagccgtacaatcccagcctgaagaacttctggtacccagttgccttctccagtgatctgaaggatgacaccatggtgccgatagattgtttcgaggagcagtgggtgatattccgaggaaaagatggaaggcctgggtgtgttcagaacacatgtgctcacagagcttgcccactgcatcttggttcagtgaacgagggtagaatccagtgcccttaccatggttgggagtattcaactgatgggaaatgtgaaaaaatgccatcaacaaagatgctcaacgtgcgcatccagtcattgccatgctttgagcaggaaggaatggtttggatttggcctggggatgatccaccaaaggctacaatcccttctttgctgcctccttcaggatttacgattcacgcagagatagtgatggaactaccagttgaacatggactcctcctggataatctcttggaccttgctcatgctccttttacacacacatccacctttgccaagggctggagtgttccaagcttggtgaagttcttaacacctgcgtcggggctccaagggtactgggatccttacccgatcgacatggaattccgaccaccgtgtatggtcttgtcgaccatcgggatctcaaagcctggaaagctagaagggaagagcacccagcaatgttctacacatctccaccaactccatgtctgcttgccctcctctaggaataaaactaggctgctgtaccggatgtcactagactttgctccatggctcaagcacgtaccgctcatgcacctgctgtggtcacatttcgcagagaaggtgttgaacgaggacctacggcttgttcttggtcagcaagagcgaatgatcaatggcgccaacatctggaactggccggtatcatatgacaagctcgggatccggtatcgattgtggagggacgccgttgagcggggctctgaccggttgccattcagtaaccaagccgagagtggatcatag

SEQ ID NO: 1862 - protein, 542 aa, Sorghum bicolor
  misc_feature: Ceres ANNOT ID no. 6017221
  misc_feature (408)..(507): Pfam Id: PaO Pfam Desc: Pheophorbide a oxygenase
  misc_feature (220)..(317): Pfam Id: Rieske Pfam Desc: Rieske [2Fe-2S] domain
  misc_feature (1)..(542): NCBI GI: 75247969 NCBI Desc: chlorophyllide a oxygenase, chloroplast precursor (chlorophyll a oxygenase) (chlorophyll b synthase)
  misc_feature (1)..(542): NCBI GI: 83317156 NCBI Desc: chlorophyll synthase [phyllostachys pubescens]
  misc_feature (1)..(542): NCBI GI: 9944967 NCBI Desc: lls1 protein [oryza sativa]
  misc_feature (5)..(535): NCBI GI: 75264959 NCBI Desc: chlorophyllide a oxygenase, chloroplast precursor (chlorophyll a oxygenase) (chlorophyll b synthase)
  misc_feature (5)..(535): NCBI GI: 5853117 NCBI Desc: chlorophyll a oxygenase [arabidopsis thaliana]
  misc_feature (1)..(542): SWISSPROT Homolog: EC 1.13.12.14 Chlorophyllide a oxygenase, chloroplast precursor
  misc_feature: Down-regulated in shoot tissues in response to salicylic acid treatment
MNTVSSLSLVPHLLIKPSIACFSRKGVGRYGGIKVYAVLREDGAEFAKNNNLEALFHVDDPGPRCPIKKGKFLDVNEALEVVRFDIQYCDWRARQDLLTIMLLHNKVVEVLNPLAREFKSIGTLRKELAELQQELEKAHNQVHLSEARVSSALDKLAHMETLVNDRLLPPDGASGTSTAESTSLVPSTSSTAHVRAKKQPRRSLNVSGPVKPYNPSLKNFWYPVAFSSDLKDDTMVPIDCFEEQWVIFRGKDGRPGCVQNTCAHRACPLHLGSVNEGRIQCPYHGWEYSTDGKCEKMPSTKMLNVRIQSLPCFEQEGMVWIWPGDDPPKATIPSLLPPSGFTIHAEIVMELPVEHGLLLDNLLDLAHAPFTHTSTFAKGWSVPSLVKFLTPASGLQGYWDPYPIDMEFRPPCMVLSTIGISKPGKLEGKSTQQCSTHLHQLHVCLPSSRNKTRLLYRMSLDFAPWLKHVPLMHLLWSHFAEKVLNEDLRLVLGQQERMINGANIWNWPVSYDKLGIRYRLWRDAVERGSDRLPFSNQAESGS

SEQ ID NO: 1863 - DNA, 2847 bp, Sorghum bicolor
  misc_feature: Ceres ANNOT ID no. 6017230
  misc_feature: Encodes the peptide sequence at SEQ ID NO 1864
atggaggctctcgatcagatcaaaacagaggcgattaatctggagagcattcctatgcaacaagtgtttatcaccctcagatgcagtaaggaaggtcttagctctggcgaggctcagcaacgcaccgctatatttggtcccaataaattggaagaaaagaaggagagcaaaatattgaagttcttaatgtttatgtataacccactgtcgtgggtgatggagtttgctgctgtggtagccattctgctcgccaacggagacggcaggccgccggactggcaagatttcatcggcatcgtggtgctcctcgtcatcaactccaccatctcatttatcgaggagaacaacgccgggagcgccgccgaggcactcatggccaaccttgcgcccaagaccaaggtcctgcgtgacggccagtggagcgaggaggacgcggcggtccttgtcccgggcgacattatcagcatcaagctcggcgacatcatcccggccgacgctcgcttgctcgagggcgacgcgctcaagattgaccagtcggcgctcaccggcgagtgtcttccggtcaccaagaaccccggcgatagcgtctactcgggctccacgtgcaagcagggcgagatcgaggcgatcgtcatcgccaccggcgtgcacaccttctttgggagggcggcgcacctcgtcgacagcaccaaccaagtcggccacttccagcaggtgctcaaggccatcggcaacttctgcatagccaccatcgccatcggcatagttgttgaggtcatcatcatgtacgcggtccagcaccgccggtaccgtgaaggcatcgacaacatcctcgtgcttctcatcggcggcataccgattgccatgcctaccgtgctctccgtcaccatggcaatcggctctcacaagctgtcgctgcagggcgccatcaccaagcgtatgaccgccatcgaggagatggccggcatggatgtgctgtgcagtgacaagaccggcacgctcaccctcaataagcttagcgtcgatcgtggccttattgagatctttgccgcgggtgttgagaaggacgatgttgtcttgttcgccgccagggcatctagggtggagaaccaggacgcaatcgatgccgccatggttggcatgctcgctgaccccaaggaggctagggaaggcattgaagaggtgcacttcttccccttcaaccccgtcgacaagcgaactgccctcacatatattgatctcgccgacggcagctggcaccgtgtcagcaagggcgctcccgaacagatgttggccctctgcaactgtggagataatgtcaagaacctggttcacactgtgatcgacaagtacgccgagcgtggccttcggtctcttgcagttgcaagacagcaagttcccgagaagagtaaagaaagcctcggagagccatgggagttcgtgggcctgctccctctcctagacccgccgaggtcagatagttctgacacaatcaagcgtgcactcgacctcggtgtcaacgtgaagatgatcacaggtgatcagctcgccattgctaaggagacggggagacggctagggatgggcacaaacatgtatccatcatcggctctgcttgggaaaagcaaagatgaagccactgcttcgattcctttggacgacttgatcgagaaggccgacggctttgccggcgtcttcccagagcacaagtatgagattgtcaagaagctgcaggagatgaagcacatctgcggaatgacaggagatggcgtgaacgatgcgcctgctttgaagaaagcggatatcggaattgctgtagctggagctactgatgcggcacggagcgcctctgacattgtgcttacccaagaagggctcagtgtcatcatcagtgctgtgctcactagcagggccatcttccagaggatgaagaattacactatatatgcagtgtcaatcactatccgtattgtgcttgggtttctgctgattgcgctgatatggaaatttgatttctcaccattcatgattctggtcattgcaattctgaatgatggcactatcatgactatcgcaaaggacattgtaaagccgtcgccacaacctgatagctggaagctaaacgagattttcgccacgggaatcgtgtacggaacctacatggctgtaatgaccgtggtgttcttctgggccatgagaagcaccgacttcttctctgacaccttccacgtgaggtctcttcgtggcagcaacgacgagatgatgtcggcgctgtacctgcaagtgagcatcatcagccaggccctcatcttcgtgacgcggtcgcggagctggtgcttcacggagcgccccggtttctggctgtgcgcggcgttcgtcatcgcgcagatcgttgccactctgattgcagtgttggccaactttgggttcgcccacatcagagggatcggatggggttgggcgggcgtcatctggctctacagcgtcgtcaccttcgtgccgctggacgtgttcaagttcggcatccgctacgtgctgagcggcagggcctggaacaacctgctgcagaacaagacggccttcacgacgaagaaggactacggcagggaggagcgcgcggcgcagtgggcgacgacgcagcgaagcctgcacggcctcgatatcgagtccggcggcggcgacaggagctacgcggaggaggtgccggagatcgcggagcaggccaggcggcgagccgagttcgcgaggctgcgcgagaagaagacgctgaggggacacctcgagtcggcggccaagctcaggggcatcgacatcaacgccgtcaggccgcccttctacagcatgtga

SEQ ID NO: 1864 - protein, 948 aa, Sorghum bicolor
  misc_feature: Ceres ANNOT ID no. 6017230
  misc_feature (98)..(319): Pfam Id: E1-E2_ATPase Pfam Desc: E1-E2 ATPase
  misc_feature (5)..(86): Pfam Id: Cation_ATPase_N Pfam Desc: Cation transporter/ATPase, N-terminus
  misc_feature (323)..(610): Pfam Id: Hydrolase Pfam Desc: haloacid dehalogenase-like hydrolase
  misc_feature (2)..(942): NCBI GI: 20302439 NCBI Desc: plasma membrane h+-atpase [oryza sativa (japonica cultivar-group)]
  misc_feature (1)..(942): NCBI GI: 75232938 NCBI Desc: plasma membrane atpase (proton pump)
  misc_feature (1)..(942): NCBI GI: 39545733 NCBI Desc: osjnba0071i13.11 [oryza sativa (japonica cultivar-group)]
  misc_feature (4)..(942): NCBI GI: 113374057 NCBI Desc: p-type h+-atpase [zostera marina]
  misc_feature (4)..(942): NCBI GI: 31580853 NCBI Desc: plasma membrane h+-atpase [sesbania rostrata]
  misc_feature (1)..(942): SWISSPROT Homolog: EC 3.6.3.6 Plasma membrane ATPase
MEALDQIKTEAINLESIPMQQVFITLRCSKEGLSSGEAQQRTAIFGPNKLEEKKESKILKFLMFMYNPLSWVMEFAAVVAILLANGDGRPPDWQDFIGIVVLLVINSTISFIEENNAGSAAEALMANLAPKTKVLRDGQWSEEDAAVLVPGDIISIKLGDIIPADARLLEGDALKIDQSALTGECLPVTKNPGDSVYSGSTCKQGEIEAIVIATGVHTFFGRAAHLVDSTNQVGHFQQVLKAIGNFCIATIAIGIVVEVIIMYAVQHRRYREGIDNILVLLIGGIPIAMPTVLSVTMAIGSHKLSLQGAITKRMTAIEEMAGMDVLCSDKTGTLTLNKLSVDRGLIEIFAAGVEKDDVVLFAARASRVENQDAIDAAMVGMLADPKEAREGIEEVHFFPFNPVDKRTALTYIDLADGSWHRVSKGAPEQMLALCNCGDNVKNLVHTVIDKYAERGLRSLAVARQQVPEKSKESLGEPWEFVGLLPLLDPPRSDSSDTIKRALDLGVNVKMITGDQLAIAKETGRRLGMGTNMYPSSALLGKSKDEATASIPLDDLIEKADGFAGVFPEHKYEIVKKLQEMKHICGMTGDGVNDAPALKKADIGIAVAGATDAARSASDIVLTQEGLSVIISAVLTSRAIFQRMKNYTIYAVSITIRIVLGFLLIALIWKFDFSPFMILVIAILNDGTIMTIAKDIVKPSPQPDSWKLNEIFATGIVYGTYMAVMTVVFFWAMRSTDFFSDTFHVRSLRGSNDEMMSALYLQVSIISQALIFVTRSRSWCFTERPGFWLCAAFVIAQIVATLIAVLANFGFAHIRGIGWGWAGVIWLYSVVTFVPLDVFKFGIRYVLSGRAWNNLLQNKTAFTTKKDYGREERAAQWATTQRSLHGLDIESGGGDRSYAEEVPEIAEQARRRAEFARLREKKTLRGHLESAAKLRGIDINAVRPPFYSM

SEQ ID NO: 1865 - DNA, 1674 bp, Sorghum bicolor
  misc_feature: Ceres ANNOT ID no. 6017232
  misc_feature: Encodes the peptide sequence at SEQ ID NO 1866
atggaggacgagcgagaggagccgccgccagcggggagcgcggccgccaacgccagctccacctccggcggcggcggcggcggcgggagcaaggggtccccgtgcgaggagtgcggggagcagccgtggaagtaccggtgccccgggtgcgtccgcctcacctgcagcctcccctgcgtgcaggcgcacaagcgccgcaccgcctgcacaggcaagcgcccccgcacggaccccgtcccgctcacccgcttcgacgacaaccaactcatctccgattacaactttctggaggaggtgaagcaggcccacgagtccgcgcacaggctcgtcggcggcttcggcggcaactttgggggacggggatccggcggcgccaagctgcccggatggctcttgtacctcagcaaggcggcgaaacgccggggcgttagtctctgcttcctccccaggggcatggccaggagagagcagaaccgctcgcgccacaactacaggaaggattgcatatactggacacttgagtggagattcaattcaactgatgttgtcctaaccgatcatgaggtagacgagcacacaaccttgctctctctattggaaaaacatcttagtcctggcccttggaaggatcagcttacacaatatcggaataccgatttgcatgatctgaaactgttcattcaaaagtgtgccaagcgatcagagtcaccgtaccgcctactcaatatagaagaaccattgcgcccacagctgaggggtatactcgttgttgagtacccaaccatcaatgtctttcttccgtcggacaattatgactttgaaatcgagaaaatggtgaacagtcttcataaagatggaaaaaaccctggcagcagaactgacgagccacctgtagaaggcagcgagtttcatgaggaggaaatagaggaaggtgagttctcacctgagacagaaattatagatctcaaggactgtggagcttcgaatgcctgtaaaatttctcaagcagatgttacaagtgaatcaaagattgttaacaatgttgattcttttgtgctctcgtaccttggctgtcaagcattacatggtcagccaaaagaactgaatcagtatagcaagatgtcaccaaatggaacctctgggcctgcagaaactaagtcccgcatggaagtctgtcctctgggtatggagaagacaaggaaaagtaggttgtcctcagaggggcacattgtagatctgaaggggcatggaacttcatatcctggcagcattgcagagtcagaaggtgcagctgtatccaagatagacatcaagataacagattctttagtagcatcttccatcagcattgtagcaactgatggtgtgatgggtcctcagctggaacacagtcaacaaaacaaacggacgccaagctcaactcctgaagcgctgaaaaggaaatcttgcatgaaagtttatccactggactttgacgagaggctgttcccagaggtacccgacttggcctttgagcaagagatgatggatacctacccagatctgtttgagaatatggatgttgatgacttcttaagttgtgattttgcaatgatgaacagggttgagccagtagaggcaacgactgggttactgtgggacgacttagaggaaggggagattccaacattgtga

SEQ ID NO: 1866 - protein, 557 aa, Sorghum bicolor
  misc_feature: Ceres ANNOT ID no. 6017232
  misc_feature (90)..(203): NCBI GI: 7211996 NCBI Desc: #ests gbn96604, gbaa394313, gbt75857 and gbh77171 come from this gene. [arabidopsis thaliana]
  misc_feature (29)..(275): NCBI GI: 55240040 NCBI Desc: ensangp00000000640 [anopheles gambiae str. pest]
  misc_feature (35)..(299): NCBI GI: 125983222 NCBI Desc: ga13128-pa [drosophila pseudoobscura]
  misc_feature (33)..(201): NCBI GI: 12060843 NCBI Desc: serologically defined breast cancer antigen ny-br-75 [homo sapiens]
  misc_feature (35)..(264): NCBI GI: 24641569 NCBI Desc: cg1463-pa [drosophila melanogaster]
MEDEREEPPPAGSAAANASSTSGGGGGGGSKGSPCEECGEQPWKYRCPGCVRLTCSLPCVQAHKRRTACTGKRPRTDPVPLTRFDDNQLISDYNFLEEVKQAHESAHRLVGGFGGNFGGRGSGGAKLPGWLLYLSKAAKRRGVSLCFLPRGMARREQNRSRHNYRKDCIYWTLEWRFNSTDVVLTDHEVDEHTTLLSLLEKHLSPGPWKDQLTQYRNTDLHDLKLFIQKCAKRSESPYRLLNIEEPLRPQLRGILVVEYPTINVFLPSDNYDFEIEKMVNSLHKDGKNPGSRTDEPPVEGSEFHEEEIEEGEFSPETEIIDLKDCGASNACKISQADVTSESKIVNNVDSFVLSYLGCQALHGQPKELNQYSKMSPNGTSGPAETKSRMEVCPLGMEKTRKSRLSSEGHIVDLKGHGTSYPGSIAESEGAAVSKIDIKITDSLVASSISIVATDGVMGPQLEHSQQNKRTPSSTPEALKRKSCMKVYPLDFDERLFPEVPDLAFEQEMMDTYPDLFENMDVDDFLSCDFAMMNRVEPVEATTGLLWDDLEEGEIPTL

SEQ ID NO: 1867 - DNA, 1089 bp, Sorghum bicolor
  misc_feature: Ceres ANNOT ID no. 6017243
  misc_feature: Encodes the peptide sequence at SEQ ID NO 1868
atgtctcgtgctcctacgctcgctgccgctgccgcggtggcggccgtcgtcctcatctgctcctcctcaacggctaccgcggcggacggcaacgcgaggcagccgccgctggccccgggcctgtccttcgacttctacaagcgcagctgccctaaggcggagtccatcgtgcggagcttcgtgcaggacgccgtgcgcagggacgtcggcctcgccgccggcctcctccgcctccacttccacgactgcttcgtgcagggctgcgacgcctccgtgctcctcgacggctccgccaccgggccgggagagcagcaggcgccgcccaacctcacgctgcgccccaccgcgttcaaggccatcaacgacatccacgaccgcctccacaaggagtgcggcggcaccgtcgtctcctgctccgacgtcctcgcgctcgccgcacgggactccgtcgtcgtgtccggcgggccgagctacaaggtgcccctgggtcgtcgcgacagcgcgagctttgcgacgcagcaggacgtcctgagcgggctcccgccgccgacggccgcggtgccggcgctcctcgccgtgctgtccaagatcaacctggacgcgacggacctggtggcgctgtcaggcgggcacaccatcgggctgggccactgcacgtcgttcgaggaccgcctgttcccgcgcccggacccgacgctgaacgccaccttcgccggccagctccggcggacatgcccggcgaagggcaccgaccgccggacgccgctggacgtgcgcacgcccaacgcgttcgacaacaagtactacgtgaacctggtgaaccgtgaggggctcttcacctcggaccaggacctcttcagcaacgcccgcaccagggccctcgtcgacaagttcgcgcgcagccagagggacttcttcgaccagttcgccttctccgtggtgaagatggggcagatcaaggtgctgacgggcacgcaggggcagatccgcaccaactgctccgcacgcaacgccgccgggacgacgatgctgccgtggtccgtctccgtcgtcgaggaggctgcagatgagagcctcggcgtgttctag

SEQ ID NO: 1868 - protein, 362 aa, Sorghum bicolor
  misc_feature: Ceres ANNOT ID no. 6017243
  misc_feature (57)..(301): Pfam Id: peroxidase Pfam Desc: Peroxidase
  misc_feature (1)..(360): NCBI GI: 167081 NCBI Desc: peroxidase bp 1
  misc_feature (1)..(360): NCBI GI: 28916432 NCBI Desc: peroxidase precursor [aegilops tauschii subsp. strangulata]
  misc_feature (1)..(360): NCBI GI: 22001285 NCBI Desc: peroxidase 1 [triticum aestivum]
  misc_feature (34)..(337): NCBI GI: 2624498 NCBI Desc: crystal structure of barley grain peroxidase 1
  misc_feature (10)..(360): NCBI GI: 312692 NCBI Desc: bp 2b [hordeum vulgare subsp. vulgare]
  misc_feature (2)..(361): SWISSPROT Homolog: EC 1.11.1.7 Peroxidase 12 precursor
  misc_feature: Useful for making plants with altered cell wall content and/or composition
  misc_feature: GREAT-hit functional homolog of the protein sequence encoded by LOCUS at1g71695
  misc_feature: Useful for making plants with altered cell wall content and/or composition
  misc_feature: Functional homolog of the protein sequence given in SEQ ID NO 13759
  misc_feature: Useful for making plants with altered carbohydrate content
  misc_feature: Functional homolog of the protein sequence given in SEQ ID NO 13713
MSRAPTLAAAAAVAAVVLICSSSTATAADGNARQPPLAPGLSFDFYKRSCPKAESIVRSFVQDAVRRDVGLAAGLLRLHFHDCFVQGCDASVLLDGSATGPGEQQAPPNLTLRPTAFKAINDIHDRLHKECGGTVVSCSDVLALAARDSVVVSGGPSYKVPLGRRDSASFATQQDVLSGLPPPTAAVPALLAVLSKINLDATDLVALSGGHTIGLGHCTSFEDRLFPRPDPTLNATFAGQLRRTCPAKGTDRRTPLDVRTPNAFDNKYYVNLVNREGLFTSDQDLFSNARTRALVDKFARSQRDFFDQFAFSVVKMGQIKVLTGTQGQIRTNCSARNAAGTTMLPWSVSVVEEAADESLGVF

SEQ ID NO: 1869 - DNA, 702 bp, Sorghum bicolor
  misc_feature: Ceres ANNOT ID no. 6017244
  misc_feature: Encodes the peptide sequence at SEQ ID NO 1870
atgagctcggcgcaggatccgttctacatcgtccgggaggagatccaggactcgattgataaactgcaaagtaccttccaccgctgggagcaaactgcttcaaacacaggagaatatgttcatttgacaaaggagcttctgaccagctgtgaaagcatcgagtggcaggtggtagatgagctggagaagacaatctcagtcgcatcaagggatccagcatactatggacttgatgaagttgagctttccagacgaagaaactggactggttctgctcgtaagcaggttggtacagtcaagagagctattgaaaagggcaagagcaatgcagcaacttcaaaataccaggatacaagcaggaccaaccactattctgcccaagacaatgatgactttatttcttcagaatcagataggcagcttctactcatgaggcagcaggatgaagaacttgatgagctcagtgaaagtgtccaaaggattggtggcgtagggctaaccatacacgaagagctgtctggacaggaaaggatccttaatgacttaagcttggagatggagactacttccaacagacttgactttgtgcagaaaagagtggccatggtgatgaagaaggctggcatcaagggtcagatcatgttgatcgcattcctggttgttctgttcattattcttttcgtttcggtgttcttgacatag

SEQ ID NO: 1870 - protein, 233 aa, Sorghum bicolor
  misc_feature: Ceres ANNOT ID no. 6017244
  misc_feature (6)..(100): Pfam Id: Syntaxin-6_N Pfam Desc: Syntaxin 6, N-terminal
  misc_feature (146)..(208): Pfam Id: SNARE Pfam Desc: SNARE domain
  misc_feature (44)..(233): NCBI GI: 145323020 NCBI Desc: syp61 (syntaxin of plants 61) [arabidopsis thaliana]
  misc_feature (1)..(178): NCBI GI: 498040 NCBI Desc: orf
  misc_feature (58)..(197): NCBI GI: 6560768 NCBI Desc: f3m18.7 [arabidopsis thaliana]
  misc_feature (4)..(232): NCBI GI: 20148776 NCBI Desc: syntaxin 6 [chlamydomonas reinhardtii]
  misc_feature (1)..(231): NCBI GI: 20148782 NCBI Desc: syntaxin 6 [phytophthora infestans]
MSSAQDPFYIVREEIQDSIDKLQSTFHRWEQTASNTGEYVHLTKELLTSCESIEWQVVDELEKTISVASRDPAYYGLDEVELSRRRNWTGSARKQVGTVKRAIEKGKSNAATSKYQDTSRTNHYSAQDNDDFISSESDRQLLLMRQQDEELDELSESVQRIGGVGLTIHEELSGQERILNDLSLEMETTSNRLDFVQKRVAMVMKKAGIKGQIMLIAFLVVLFIILFVSVFLT

SEQ ID NO: 1871 - DNA, 522 bp, Sorghum bicolor
  misc_feature: Ceres ANNOT ID no. 6017245
  misc_feature: Encodes the peptide sequence at SEQ ID NO 1872
atggcgaccttcgctaccggcagcgccacagcgcgcgcggcgctggcgtcgccgactccgtgccggccggccgcgctcgcctcgcgcccggcgccggcgctgtggatgccgctgcgctgctcgacgccggccctgggcctcaggggagggtccgcgcgttctcggcggggcgccacgctacgggtggaggctaagaagcaaacgttttcttcgtttgatgagttgctggagaagtctgagaagcctttattagttgacttctatgcaacttggtgtggtccatgccaatacatggttcccatacttgaagaagtcagtgaaaagttaggcgacaaaattcaagttgtgaaaattgataccgagaagtacactagcattgcaagtcgttacagaattgaagcattgccaacttttatcatattcaaggatgggaaaccttgctatcgctttgtaagtgaaggagcattgcctgcaaaccagatgatcgaacagattgagaatgctttggcagtcacgaagtag

SEQ ID NO: 1872 - protein, 173 aa, Sorghum bicolor
  misc_feature: Ceres ANNOT ID no. 6017245
  misc_feature (63)..(168): Pfam Id: Thioredoxin Pfam Desc: Thioredoxin
  misc_feature (51)..(173): NCBI GI: 57899183 NCBI Desc: thioredoxin m-like [oryza sativa (japonica cultivar-group)]
  misc_feature (51)..(173): NCBI GI: 115442413 NCBI Desc: os01g0963400 [oryza sativa (japonica cultivar-group)]
  misc_feature (1)..(171): NCBI GI: 38604000 NCBI Desc: at1g76760 [arabidopsis thaliana]
  misc_feature (25)..(171): NCBI GI: 6143893 NCBI Desc: thioredoxin-like protein; 49720-48645 [arabidopsis thaliana]
  misc_feature (5)..(171): NCBI GI: 92874983 NCBI Desc: thioredoxin domain 2 [medicago truncatula]
MATFATGSATARAALASPTPCRPAALASRPAPALWMPLRCSTPALGLRGGSARSRRGATLRVEAKKQTFSSFDELLEKSEKPLLVDFYATWCGPCQYMVPILEEVSEKLGDKIQVVKIDTEKYTSIASRYRIEALPTFIIFKDGKPCYRFVSEGALPANQMIEQIENALAVTK

SEQ ID NO: 1873 - DNA, 621 bp, Sorghum bicolor
  misc_feature: Ceres ANNOT ID no. 6017250
  misc_feature: Encodes the peptide sequence at SEQ ID NO 1874
atgaagatcacggcgttgctggtgctcaaatcccctggcgattcctccgcctccggcggcggggagcagcaggctgtggtgctggccaacgcgtcggacgtcagccacttcggctacttccagcgcgccgccgcccgcgagttcatcctcttcgtcgcccgcaccgtcgccctccgcacccccgccggcagccgccagaacgtccagcacgaagagtacacggtgcattgctacaacaaggatggcctttgcgccatcgccttcaccgacgcccactatcccgtcaggagcgccttctccctcctcaacatcgtgctggaacagtaccagaagacttttggagagtcatggaggacaaccaaaactgatgtgacccaaccttggcaatacttggatgatgccctaaccaaataccaggatcctgcagaagctgacaagctgttgaaaattcagagggacttggatgaaaccaagattattttgcataaaaccattgatagcatgcttgatagaggtgaaaggttggacagcctagtggagaagagttctgatctaagtatttcttcacagatgttctacaagcaggcgaagaaaaccaactcttgctgtaccatcctgtaa

SEQ ID NO: 1874 - protein, 206 aa, Sorghum bicolor
  misc_feature: Ceres ANNOT ID no. 6017250
  misc_feature (110)..(196): Pfam Id: Synaptobrevin Pfam Desc: Synaptobrevin
  misc_feature (1)..(206): NCBI GI: 22137308 NCBI Desc: at5g58060/k21l19_40 [arabidopsis thaliana]
  misc_feature (1)..(206): NCBI GI: 4097579 NCBI Desc: ntgp1 [nicotiana tabacum]
  misc_feature (1)..(206): NCBI GI: 35187452 NCBI Desc: fiber ntgp1-related protein [gossypium barbadense]
  misc_feature (1)..(206): NCBI GI: 8777319 NCBI Desc: atgp1-like protein [arabidopsis thaliana]
  misc_feature (1)..(206): NCBI GI: 62901306 NCBI Desc: synaptobrevin homolog ykt6
MKITALLVLKSPGDSSASGGGEQQAVVLANASDVSHFGYFQRAAAREFILFVARTVALRTPAGSRQNVQHEEYTVHCYNKDGLCAIAFTDAHYPVRSAFSLLNIVLEQYQKTFGESWRTTKTDVTQPWQYLDDALTKYQDPAEADKLLKIQRDLDETKIILHKTIDSMLDRGERLDSLVEKSSDLSISSQMFYKQAKKTNSCCTIL

SEQ ID NO: 1875 - DNA, 636 bp, Sorghum bicolor
  misc_feature: Ceres ANNOT ID no. 6017257
  misc_feature: Encodes the peptide sequence at SEQ ID NO 1876
atggcgttagcctgtacagcagccaggctagtccacccctgcaagggcatgggcatggtgtccaagcagcacccaagaacaccgccgccgccgtcctcctcctgcttacacctccacaccctcctccataggcccgtcgccagcagccacttcgcgcgccactccgtcgacgtgtccaaggacgacaagccgcttgagacgccgacggcgacgaccacagagacagagagcccccagcaagccgccgccgccgctttgcagcaggaggccgaggacgacgacggcgggccaaagctggaccctcggcggttcgaggagaagttcgcggtgctcaacacggggatccacgagtgccgctcctgcgggtaccgctacgaccaggcggcgggggacccgtcgtacccggtgccgccgggcctgcccttcgcgcagctgcccgacgactggcggtgcccgacctgcggcgccgcgcagtccttcttcgagagcaagagcgtggagatcgccgggttcgcgcagaaccagcagttcgggctgggcggcaactccctcacctccggccagaagggcctgctcatctacggcagcctcctcgtcggcttcctcttcttcatctccggctacttcctgcaatga

SEQ ID NO: 1876 - protein, 211 aa, Sorghum bicolor
  misc_feature: Ceres ANNOT ID no. 6017257
  misc_feature (115)..(161): Pfam Id: Rubredoxin Pfam Desc: Rubredoxin
  misc_feature (103)..(211): NCBI GI: 88770690 NCBI Desc: rubredoxin [rhodomonas salina]
  misc_feature (106)..(211): NCBI GI: 4583668 NCBI Desc: rubredoxin [guillardia theta]
  misc_feature (103)..(210): NCBI GI: 126658552 NCBI Desc: rubredoxin [cyanothece sp. ccy0110]
  misc_feature (116)..(211): NCBI GI: 53688523 NCBI Desc: cog1773: rubredoxin [nostoc punctiforme pcc 73102]
  misc_feature (105)..(208): NCBI GI: 16329682 NCBI Desc: rubredoxin [synechocystis sp. pcc 6803]
MALACTAARLVHPCKGMGMVSKQHPRTPPPPSSSCLHLHTLLHRPVASSHFARHSVDVSKDDKPLETPTATTTETESPQQAAAAALQQEAEDDDGGPKLDPRRFEEKFAVLNTGIHECRSCGYRYDQAAGDPSYPVPPGLPFAQLPDDWRCPTCGAAQSFFESKSVEIAGFAQNQQFGLGGNSLTSGQKGLLIYGSLLVGFLFFISGYFLQ

SEQ ID NO: 1877 - DNA, 1044 bp, Sorghum bicolor
  misc_feature: Ceres ANNOT ID no. 6017265
  misc_feature: Encodes the peptide sequence at SEQ ID NO 1878
atggccgcctctgcctctgccgccgccgcggtgcctgctaccttcctcccgcgcctcgccacgccacggtccccgtctcctgtgctcccttcgcccgtactgagagcgcatcccgtcgtcgctcctctctccctctccgccaaacgctgcgcctgcgcctgcgccgccacgggctccggcttctcctcctccaactccggaaatcaaacctcactgatgccgccgttcagctttacattcgaccaagattcttctagttccaaaaggccatatagatggaaaagggtattgcttaaagtaagtggggaagcacttgctgggaatcacacagaaaacatcgacccaaagattacaatggctattgcaagagaggttgcttctgtcaccaagctaggtgtagaggttgcaattgttgttggcggtggcaatatcttccgtggggcctcttgggctggatgtagtggtcttgaccgctcatctgcggattacattggcatgttggccactgtgatgaatgctatatttcttcaagcaacaatggagagcattggaataccgacccgcgtccaaactgccttccgtatgtcagaagttgcagaaccatacatacgccgaagagctgtaaggcatttagagaaaggaagagttgtcatatttgctgcaggaactgggaacccatttttcacaactgatacagctgctgctctccgttgtgctgaaatcaatgcagaggtagtgcttaaagcgacaaatgttgatggtgtgtatgacgcggaccccaggcataacccaaatgcctgccttcttgagactgtgagctatcatgaagttacgacaagagatctatcagtaatggatatgactgctattacactatgccaagaaaacaacattccgattgttgtgttcaacttgcaaaagactggaaacattgcaaaggctattgtcggtgataaggttggtaccttcatcggatgcacaggaaatcaggaacgaaatggaaacgtgctagttgaagaaagaagtttggttaatgaggtgtga

SEQ ID NO: 1878 - protein, 347 aa, Sorghum bicolor
  misc_feature: Ceres ANNOT ID no. 6017265
  misc_feature (94)..(304): Pfam Id: AA_kinase Pfam Desc: Amino acid kinase family
  misc_feature (93)..(325): NCBI GI: 113477238 NCBI Desc: uridylate kinase [trichodesmium erythraeum ims101]
  misc_feature (92)..(334): NCBI GI: 86607044 NCBI Desc: uridylate kinase [cyanobacteria bacterium yellowstone a-prime]
  misc_feature (93)..(325): NCBI GI: 119487065 NCBI Desc: uridylate kinase [lyngbya sp. pcc 8106]
  misc_feature (92)..(334): NCBI GI: 86609733 NCBI Desc: uridylate kinase [cyanobacteria bacterium yellowstone b-prime]
  misc_feature (93)..(325): NCBI GI: 75906851 NCBI Desc: uridylate kinase [anabaena variabilis atcc 29413]
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: GREAT-hit functional homolog of the protein sequence given in SEQ ID NO 12927
  misc_feature: Useful for biocontainment applications
  misc_feature: Useful for making plants with modulated biomass
  misc_feature: Functional homolog of the protein sequence given in SEQ ID NO 12927
MAASASAAAAVPATFLPRLATPRSPSPVLPSPVLRAHPVVAPLSLSAKRCACACAATGSGFSSSNSGNQTSLMPPFSFTFDQDSSSSKRPYRWKRVLLKVSGEALAGNHTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRHNPNACLLETVSYHEVTTRDLSVMDMTAITLCQENNIPIVVFNLQKTGNIAKAIVGDKVGTFIGCTGNQERNGNVLVEERSLVNEV

SEQ ID NO: 1879 - DNA, 1053 bp, Sorghum bicolor
  misc_feature: Ceres ANNOT ID no. 6017266
  misc_feature: Encodes the peptide sequence at SEQ ID NO 1880
atgggccgcgccgcgccgccgtcatcgccgagctcgccgcagctcgggcgcaagcgcacggcggctcccacaccggagccgccgacgccgcggcgctactgctccatggacgacgtcatgcgccgcgcgcgcgccgtcgacgcgccgccccccgtcgcccgcgcgcgggtgtacacctactacgagaacctcatctgcgagacctgcggctccggcgaccgcgacgacgacctgctcctctgcgaccgctgcgaccgcggccaccacaccttctgcctccgccccatcgccgccagggtccccatcggcccctggttctgccccgtctgcgccccgcccgccaaggcccccaagaatgctagaaggcgaaggaagcgttctcttgttatgcacaagaagaggaggaggatactgccatttgttccatctgaagatgaagctagaagactaaaacaaatggcgtctctggccactgctatgacgtcttctaaaacaaagttcagtaatgaactgacttacatgcctaatatggctcctagatcttccaatctggcaagattggaggtaggcggtatgcaggttctgcccaaagaggataaggaaagtatagagttgtgcagaaccatgcaacaaagaggcgaatgccctccacttcttgtggtcttcgattcccttgaaggtttcactgtgcaggctgatgctgatattaaggatatgaccttcctcgctgaatatgctggggatgtcgattatctggagaagagggcaaatgatgatattgactgcattatgacgctcctcttgacagctgacccttcccaaaggctggtcatttgccctgacaagcgggggaacatttctcgctttatcagtggcatcaataaccacacacaggatggcaagaagaagcagaatgtaaagtgtgtgcggtatgacattgatggggagagccatgtcttgttggtggcctgccgtgatatacctcgtggtgaaaagctatattacgattacaatggatacgagcatgcctatcccactcaacatttcctctaa

SEQ ID NO: 1880 - protein, 350 aa, Sorghum bicolor
  misc_feature: Ceres ANNOT ID no. 6017266
  misc_feature (210)..(345): Pfam Id: SET Pfam Desc: SET domain
  misc_feature (65)..(113): Pfam Id: PHD Pfam Desc: PHD-finger
  misc_feature (8)..(350): NCBI GI: 21464579 NCBI Desc: at5g09790/f17i14_20 [arabidopsis thaliana]
  misc_feature (121)..(350): NCBI GI: 71388893 NCBI Desc: atxr5 [arabidopsis thaliana]
  misc_feature (121)..(350): NCBI GI: 92898862 NCBI Desc: nuclear protein set; zinc finger, ring-type; zinc finger, fyve/phd-type [medicago truncatula]
  misc_feature (41)..(350): NCBI GI: 140070221 NCBI Desc: nuclear protein set; zinc finger, fyve/phd-type [medicago truncatula]
  misc_feature (194)..(350): NCBI GI: 92898865 NCBI Desc: nuclear protein set; zinc finger, ring-type; zinc finger, phd-type [medicago truncatula]
  misc_feature (8)..(350): SWISSPROT Homolog: EC 2.1.1.43 Histone-lysine N-methyltransferase ATXR5
MGRAAPPSSPSSPQLGRKRTAAPTPEPPTPRRYCSMDDVMRRARAVDAPPPVARARVYTYYENLICETCGSGDRDDDLLLCDRCDRGHHTFCLRPIAARVPIGPWFCPVCAPPAKAPKNARRRRKRSLVMHKKRRRILPFVPSEDEARRLKQMASLATAMTSSKTKFSNELTYMPNMAPRSSNLARLEVGGMQVLPKEDKESIELCRTMQQRGECPPLLVVFDSLEGFTVQADADIKDMTFLAEYAGDVDYLEKRANDDIDCIMTLLLTADPSQRLVICPDKRGNISRFISGINNHTQDGKKKQNVKCVRYDIDGESHVLLVACRDIPRGEKLYYDYNGYEHAYPTQHFL

SEQ ID NO: 1881 - DNA, 1770 bp, Sorghum bicolor
  misc_feature: Ceres ANNOT ID no. 6017277
  misc_feature: Encodes the peptide sequence at SEQ ID NO 1882
atggccctcaggcggctccgaccttgggccttcattctcttcttccttgtccttttctcctacgatgaatctggacttgggagcagaagcaggaggagtggcgtcgcgcaggccacgcagagagtcttcctgtatccacaggctcccaaggtctcctccatcgtgagcagcaagtacaggactgcgtaccacttccagcctcccaagaactggatcaacggaccaatgtactacaatggtatctatcaccaattctaccagtacaacccaaatggttctgtctggggtaacatagtctgggcccactcggtctcaacagatctcatcaactggatccagctcgaaccagcgatagagcggacgactccgagcgatatcaatggctgctggacaggttcagccacaatcctcaagagtgaccagcctgccattatatacactggtgctgacacggagaagcgtcaggtccaaaacattgcgtttcccaagaacttgtctgatccatacctgagggagtggatcaaaccagacaacaacccactgatccaaccagttggacaaggattgatcccaaaccagttcagagatccgacaaccggttggatcggaccagatgggctatggagaatagcagttggggctgaactggacggctacagtgctgcacttctgtacaagagtgaggattttttgcactggactagagtggatcacccactatactcttccaatgcctccaccatgtgggagtgcccggatttcttcgcagtgttaccaggcaagaacattgggctggacctgtcggcggcaatcccgaatggcgccaagcatgtcctcaagatgagccttgacaattgtgacaagtacatgattggcatttatgatctgaaaagtgatgtctttgtgccagattccgtccttgaggaccgaagactgtggtcaaggattgattatggcaactactatgcttcaaagtcattctttgattcgaagaaaggcaggaggatcatatggggttggacaaatgagacagacagttcgtcgtatgacgttgccaaaggttgggctggaatccatgcaatccccaggactatatggttagataaagacagtaagcaactgctgcaatggccagttgaagagattgagtcgcttcgaggaaaagaagtcagccagcaaggcctggagctcaagaagggagatctgtttgagattaaggaaattgatctctgcaggttagcagatgtggagatagatttcgagcttacatccatagacagtgccgatgcttttgacccttcctggctcttggacatcgagaagcactgtcgagaagcagatgcgtcagttcatggcggtgtaggcccatttgggcttgtgcttcttgcatctgacaacatggaagagcacacctctgtgcacttcagagtttacaaatcacaggagaagtacatggttcttatgtgctctgatctgagaaagtcgtccttgagaccagaactgtacacaccagcctatggaggcttctttgagttcgacctcgagaaggaaaagactatatctttgagaactttgatcgatcgctctgcagtggaaagcttcggtggaggtggtagggtctgcatcatggctagggtctatccggtggcgctcatcgacgatggtggcactcgcatgtatgccttcaacaatggcactacaaccgtcaaagtgcctcggctaaaggcatggagcatgaggagagcacaagttaatgttaagaagggataa

SEQ ID NO: 1882 - protein, 589 aa, Sorghum bicolor
  misc_feature: Ceres ANNOT ID no. 6017277
  misc_feature (64)..(378): Pfam Id: Glyco_hydro_32N Pfam Desc: Glycosyl hydrolases family 32 N terminal
  misc_feature (420)..(538): Pfam Id: Glyco_hydro_32C Pfam Desc: Glycosyl hydrolases family 32 C terminal
  misc_feature (9)..(589): NCBI GI: 73920070 NCBI Desc: beta-fructofuranosidase, insoluble isoenzyme 4 precursor (sucrose hydrolase 4) (invertase 4) (cell wall beta-fructosidase 4) (oscin4)
  misc_feature (9)..(589): NCBI GI: 57900173 NCBI Desc: cell wall invertase [oryza sativa (japonica cultivar-group)]
  misc_feature (9)..(589): NCBI GI: 40217607 NCBI Desc: cell wall invertase [oryza sativa (japonica cultivar-group)]
  misc_feature (9)..(583): NCBI GI: 71153893 NCBI Desc: fructan exohydrolase [lolium perenne]
  misc_feature (9)..(589): NCBI GI: 28411218 NCBI Desc: fructan 1-exohydrolase [triticum aestivum]
  misc_feature (9)..(589): SWISSPROT Homolog: EC 3.2.1.26 Beta-fructofuranosidase, insoluble isoenzyme 4 precursor
  misc_feature: Useful for making plants with altered carbohydrate content
  misc_feature: Functional homolog of the protein sequence given in SEQ ID NO 13760
  misc_feature: Useful for making plants with modulated biomass
  misc_feature: Functional homolog of the protein sequence given in SEQ ID NO 13761
MALRRLRPWAFILFFLVLFSYDESGLGSRSRRSGVAQATQRVFLYPQAPKVSSIVSSKYRTAYHFQPPKNWINGPMYYNGIYHQFYQYNPNGSVWGNIVWAHSVSTDLINWIQLEPAIERTTPSDINGCWTGSATILKSDQPAIIYTGADTEKRQVQNIAFPKNLSDPYLREWIKPDNNPLIQPVGQGLIPNQFRDPTTGWIGPDGLWRIAVGAELDGYSAALLYKSEDFLHWTRVDHPLYSSNASTMWECPDFFAVLPGKNIGLDLSAAIPNGAKHVLKMSLDNCDKYMIGIYDLKSDVFVPDSVLEDRRLWSRIDYGNYYASKSFFDSKKGRRIIWGWTNETDSSSYDVAKGWAGIHAIPRTIWLDKDSKQLLQWPVEEIESLRGKEVSQQGLELKKGDLFEIKEIDLCRLADVEIDFELTSIDSADAFDPSWLLDIEKHCREADASVHGGVGPFGLVLLASDNMEEHTSVHFRVYKSQEKYMVLMCSDLRKSSLRPELYTPAYGGFFEFDLEKEKTISLRTLIDRSAVESFGGGGRVCIMARVYPVALIDDGGTRMYAFNNGTTTVKVPRLKAWSMRRAQVNVKKG

SEQ ID NO: 1883 - DNA, 1575 bp, Sorghum bicolor
  misc_feature: Ceres ANNOT ID no. 6017283
  misc_feature: Encodes the peptide sequence at SEQ ID NO 1884
atggctctgctccgcctccacctcccgaggcctccgctgccggcccgccgcatccccgccctcccttccgctctctcctcctccaccacgtcgtgcttgtggcgcggccgtcttcccgcctcgcgcctcctctgctccagccaccccgcctcgtcccccgacgcctcctccgccgccccgccctccatcgtcgccggcctcctcgactacctcaacgagtcatggacgcagttccacgccacagctgaggccaagagacagctgctcgacgcgggattcaagctgctcagcgagagtgatgactgggacctgcagcccggcggccgctacttcttcacgcgcaacatgtcctgcttggtcgcttttgccattggggaaaagtacagagttgggaacggtttcaacataatcgcagcccacactgatagtccctgtctcaagctcaaacccaggtctgccaccatcaaatctggccaccagatggtcaatgtgcagacatacggaagtgggctgtggcatacatggttcgatagagatctaactttggctgggagagtcatcctcaaggctacagacggttcctttaagcataagcttgtcaaactcaccaggccactgatacgtgtacctacactggctatccatcttaaccgcacagtgaatactgatgggttcaagcctaacctagagactcatcttgttccacttcttgcaacaaaacatgaagacacaactacaaattctgatgacaaaagctctagctctacaaaagtcacgcaccatccactacttttgcagattctctcagaggaaatcggttgtgactcagatgaaataatcggtatggagttgaatgtatgtgatacccagcctagttgccttggtgggggaaacaatgagttcatctattctggaagactggataatcttgcttcatgttattgtgctctcagatctctcatggactcttccaagatggcagaacaattatccaatgagaaggccataagaatggtagctatgttcgataatgaggaggtgggttcagattcaatgcaaggggctggtgcaccaaccatgttccaggctatgagacgaatcattgattccttgatgcatcagtcgatgggggagggagctctggaacgtgcaatacattcttcattccttgtttcggcagacatggctcacgctctgcacccaaactatgccgaaaagcatgaagagtgccacagaccagaactacagaagggacttgtcatcaagcacaatgctaaccaacgttatgccacaagtgctgttacagcttttctcttcaaagaaatagcaaggattcataatcttccggttcaggaatttgttgtaaggaatgatatgggatgtggctccaccattggacccatacttgcttctggtgttggcatacggactgtagactgtggtatccctcagctttcgatgcatagtgtacgagaaatgtgtggtaaagaagacgtggacacaacatacagacacttcaaagctttttttgagatgttttctgatatcgataggaagttaaatgtagatttttaa

SEQ ID NO: 1884 - protein, 524 aa, Sorghum bicolor
  misc_feature: Ceres ANNOT ID no. 6017283
  misc_feature (70)..(510): Pfam Id: Peptidase_M18 Pfam Desc: Aminopeptidase I zinc metalloprotease (M18)
  misc_feature (1)..(523): NCBI GI: 18844846 NCBI Desc: aspartyl aminopeptidase-like protein [oryza sativa (japonica cultivar-group)]
  misc_feature (19)..(523): NCBI GI: 140052881 NCBI Desc: peptidase m18, aminopeptidase i [medicago truncatula]
  misc_feature (62)..(523): NCBI GI: 21537290 NCBI Desc: aspartyl aminopeptidase-like protein [arabidopsis thaliana]
  misc_feature (50)..(523): NCBI GI: 6912248 NCBI Desc: aspartyl aminopeptidase [homo sapiens]
  misc_feature (50)..(523): NCBI GI: 119591140 NCBI Desc: aspartyl aminopeptidase, isoform cra_e [homo sapiens]
MALLRLHLPRPPLPARRIPALPSALSSSTTSCLWRGRLPASRLLCSSHPASSPDASSAAPPSIVAGLLDYLNESWTQFHATAEAKRQLLDAGFKLLSESDDWDLQPGGRYFFTRNMSCLVAFAIGEKYRVGNGFNIIAAHTDSPCLKLKPRSATIKSGHQMVNVQTYGSGLWHTWFDRDLTLAGRVILKATDGSFKHKLVKLTRPLIRVPTLAIHLNRTVNTDGFKPNLETHLVPLLATKHEDTTTNSDDKSSSSTKVTHHPLLLQILSEEIGCDSDEIIGMELNVCDTQPSCLGGGNNEFIYSGRLDNLASCYCALRSLMDSSKMAEQLSNEKAIRMVAMFDNEEVGSDSMQGAGAPTMFQAMRRIIDSLMHQSMGEGALERAIHSSFLVSADMAHALHPNYAEKHEECHRPELQKGLVIKHNANQRYATSAVTAFLFKEIARIHNLPVQEFVVRNDMGCGSTIGPILASGVGIRTVDCGIPQLSMHSVREMCGKEDVDTTYRHFKAFFEMFSDIDRKLNVDF

SEQ ID NO: 1885 - DNA, 1362 bp, Sorghum bicolor
  misc_feature: Ceres ANNOT ID no. 6017299
  misc_feature: Encodes the peptide sequence at SEQ ID NO 1886
atggccgacccctccgccgccgccgccgctgcaaaccctagccctggcgccggcgaggaaggagccgcctgctctccgccgtcgccgtctcaaagggggcggggcaaggtggttatcgttatgggcgccacgggagccggcaagtcgcggctggccgtcgacctcgcggcccacttcgccggcgtcgaggtggtcagcgccgactccatgcagctctaccgcggcctcgacgtcctcaccaacaaggtccccctccacgagcagaacggtgttcctcatcatctccttagcgtgattgatccctccgttgagttcacttgccatgatttccgcgaccatgccgttccgattatacaggaaatattggatcgcggtggcctccctgtgattgtcggcggcacaaacttctacatccagagtcttgttagcccattcctctttgatgatatggcagaagaaatgcacgactgtactttgagagaacacatagatgatgatagaggccttaccaatgatgatgaagacagtgggtatgaacgcttgaaggatattgatcctgtggctgcgcaaaggatccatccaaacgaccatagaaaaatcaaacgctacctcgagttgtatgcaacgacaggttccctacccagtgatctttttcaaggagaggctgctaagaaatggggtcgacctagtaactccagattcgactgttgtttcctgtgggtagatgctgatcttcaagctctggatagttatgtcaacaaaagggtcgattgcatgatggatgctggcctgctgaatgaagtatgcaacatatatgatgcagatgctctttatacccaagggctgcggcaggccattggggttcgtgaatttgacgagtttttcagactatatttaccaagacaagaatctggtgaggattcttctgcaaacttgttagatatacatgacgatcagcttaagagcttgttggatgaagctgtttcccagctgaaggcaaacactcgcagattagttcgacgtcaaagacgaagactgcaccgactgggtaaagattttgggtggaatttgcatcactttgatgcaactgaagcattctgtgccactggggactcgtggcaaaagaaagttgttgaaccttgtgtggatgtcgtaaaaaggttcttgtccgatgattcaactgttttaccaagcacgagcgcctcagatggtgtggttgggagcgcctgtgacaaccgggtgcttcgaggggcgcacgagtgggagcagcacaagcaagggcgaggtcaccggaagcgagtgcagcgcctgaagcagaagagcctgaggccacggccattgctgtcgcaagactgcaactga

SEQ ID NO: 1886 - protein, 453 aa, Sorghum bicolor
  misc_feature: Ceres ANNOT ID no. 6017299
  misc_feature (70)..(354): Pfam Id: IPPT Pfam Desc: IPP transferase
  misc_feature (6)..(441): NCBI GI: 78483675 NCBI Desc: eukaryotic trna isopentenyltransferase [oryza sativa (japonica cultivar-group)]
  misc_feature (17)..(335): NCBI GI: 92888013 NCBI Desc: trna isopentenyltransferase [medicago truncatula]
  misc_feature (13)..(157): NCBI GI: 110671857 NCBI Desc: isopentenyltransferase [malus hupehensis]
  misc_feature (37)..(142): NCBI GI: 92867006 NCBI Desc: trna isopentenyltransferase [medicago truncatula]
  misc_feature (230)..(391): NCBI GI: 46430949 NCBI Desc: adenylate isopentenyltransferase [humulus lupulus]
MADPSAAAAAANPSPGAGEEGAACSPPSPSQRGRGKVVIVMGATGAGKSRLAVDLAAHFAGVEVVSADSMQLYRGLDVLTNKVPLHEQNGVPHHLLSVIDPSVEFTCHDFRDHAVPIIQEILDRGGLPVIVGGTNFYIQSLVSPFLFDDMAEEMHDCTLREHIDDDRGLTNDDEDSGYERLKDIDPVAAQRIHPNDHRKIKRYLELYATTGSLPSDLFQGEAAKKWGRPSNSRFDCCFLWVDADLQALDSYVNKRVDCMMDAGLLNEVCNIYDADALYTQGLRQAIGVREFDEFFRLYLPRQESGEDSSANLLDIHDDQLKSLLDEAVSQLKANTRRLVRRQRRRLHRLGKDFGWNLHHFDATEAFCATGDSWQKKVVEPCVDVVKRFLSDDSTVLPSTSASDGVVGSACDNRVLRGAHEWEQHKQGRGHRKRVQRLKQKSLRPRPLLSQDCN

SEQ ID NO: 1887 - DNA, 663 bp, Sorghum bicolor
  misc_feature: Ceres ANNOT ID no. 6017300
  misc_feature: Encodes the peptide sequence at SEQ ID NO 1888
atggacgccgacgactcctcttccgcatcctcatcctcaccgccggtgtctcccgccgaccaccaccaccaccacagcctgcccccgaagcggcgtgcggggcggaagaagttccgggagacgcggcacccggtgtaccgcggcgtgcgcgcgcgcggcgggggcacccggtgggtgtgcgaggtgcgggagccgcaggcgcaggcgcgcatctggctcggcacctacccgaccccggagatggccgcgcgcgcgcacgacgtcgccgccatcgcgctccgcggcgccaccgccgccgacctcaacttcccggactccgcgcacgcgctcccgcgcgcgcgcaccgccgcgcccgaggacatacgatgcgccgccgcgcagcagcacgcccgccggacgatcaccccgccgccgccggaggtttcttctgcatgctgctggacgaccagtacggggacccgatcagccggcggaggaggagatagcagcacggcggctagctgctacggcttcctggacgaggacgctatatttgacatgcccgggctcatcgacgacatggccagagggatgctgctcacgccgccggccatgggacggggcgccctgcttgacgacgaccaccatagccacgtggactgcacgctctggatggtggactga

SEQ ID NO: 1888 - protein, 220 aa, Sorghum bicolor
  misc_feature: Ceres ANNOT ID no. 6017300
  misc_feature (44)..(96): Pfam Id: AP2 Pfam Desc: AP2 domain
  misc_feature (1)..(218): NCBI GI: 18844857 NCBI Desc: similar to avr9/cf-9 rapidly elicited protein 111b [oryza sativa (japonica cultivar-group)]
  misc_feature (1)..(218): NCBI GI: 33637700 NCBI Desc: transcription factor rcbf2 [oryza sativa]
  misc_feature (1)..(127): NCBI GI: 145952336 NCBI Desc: cbf/dreb1 transcription factor 2 [betula pendula]
  misc_feature (1)..(127): NCBI GI: 145952334 NCBI Desc: cbf/dreb1 transcription factor 1 [betula pendula]
  misc_feature (5)..(217): NCBI GI: 71041116 NCBI Desc: cbf1 [malus x domestica]
  misc_feature: The plant flowers significantly late compared to wild-type.
  misc_feature: The sequence is a functional homolog of SEQ ID NO 1222 in the 10/374,780US patent application
  misc_feature: The sequence is a functional homolog of SEQ ID NO 1223 in the 10/374,780US patent application
  misc_feature: The sequence is a functional homolog of SEQ ID NO 1225 in the 10/374,780US patent application
  misc_feature: The sequence is a functional homolog of SEQ ID NO 1226 in the 10/374,780US patent application
  misc_feature: The sequence is a functional homolog of SEQ ID NO 1230 in the 10/374,780US patent application
  misc_feature: The sequence is a functional homolog of SEQ ID NO 1232 in the 10/374,780US patent application
  misc_feature: The sequence is a functional homolog of SEQ ID NO 1237 in the 10/374,780US patent application
  misc_feature: The sequence is a functional homolog of SEQ ID NO 1243 in the 10/374,780US patent application
  misc_feature: The sequence is a functional homolog of SEQ ID NO 1314 in the 11/479,226US patent application
  misc_feature: The sequence is a functional homolog of SEQ ID NO 1411 in the 10/412,699US patent application
  misc_feature: The sequence is a functional homolog of SEQ ID NO 1412 in the 10/412,699US patent application
  misc_feature: The sequence is a functional homolog of SEQ ID NO 16 in the 10/225,068US patent application
  misc_feature: The sequence is a functional homolog of SEQ ID NO 186 in the 10/374,780US patent application
  misc_feature: The sequence is a functional homolog of SEQ ID NO 190 in the 11/375,241US patent application
  misc_feature: The sequence is a functional homolog of SEQ ID NO 516 in the 11/435,388US patent application
  misc_feature: The sequence is a functional homolog of SEQ ID NO 566 in the 10/225,066US patent application
  misc_feature: The sequence is a functional homolog of SEQ ID NO 616 in the 10/412,699US patent application
  misc_feature: The sequence is a functional homolog of SEQ ID NO 698 in the 11/435,388US patent application
  misc_feature: The sequence is a functional homolog of SEQ ID NO 712 in the 11/435,388US patent application
  misc_feature: The sequence is a functional homolog of SEQ ID NO 716 in the 11/435,388US patent application
  misc_feature: The sequence is a functional homolog of SEQ ID NO 718 in the 11/435,388US patent application
  misc_feature: The sequence is a functional homolog of SEQ ID NO 724 in the 11/435,388US patent application
  misc_feature: The sequence is a functional homolog of SEQ ID NO 768 in the 11/435,388US patent application
  misc_feature: The sequence is a functional homolog of SEQ ID NO 774 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: Useful for making plants with altered terpenoid content
  misc_feature: Useful for making plants with modulated flowering time
  misc_feature: Useful for making plants with modulated growth and phenotype characteristics
  misc_feature: Functional homolog of the protein sequence given in SEQ ID NO 13195
  misc_feature: The sequence is a functional homolog of SEQ ID NO 1411 in the 20040045049 US patent application
  misc_feature: The sequence is a functional homolog of SEQ ID NO 1412 in the 20040045049 US patent application
  misc_feature: The sequence is a functional homolog of SEQ ID NO 616 in the 20040045049 US patent application
  misc_feature: The sequence is a functional homolog of SEQ ID NO 1225 in the 20060162006 US patent application
  misc_feature: The sequence is a functional homolog of SEQ ID NO 1226 in the 20060162006 US patent application
  misc_feature: The sequence is a functional homolog of SEQ ID NO 1230 in the 20060162006 US patent application
  misc_feature: The sequence is a functional homolog of SEQ ID NO 1232 in the 20060162006 US patent application
  misc_feature: The sequence is a functional homolog of SEQ ID NO 1237 in the 20060162006 US patent application
  misc_feature: The sequence is a functional homolog of SEQ ID NO 1243 in the 20060162006 US patent application
  misc_feature: The sequence is a functional homolog of SEQ ID NO 698 in the 20060272060 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 1222 in the 10/374,780 US patent application
  misc_feature: The sequence is a functional homolog of SEQ ID NO 1411 in the 10/412,699 US patent application
  misc_feature: The sequence is a functional homolog of SEQ ID NO 712 in the 11/435,388 US patent application
  misc_feature: The sequence is a functional homolog of SEQ ID NO 1237 in the 10/374,780 US patent application
  misc_feature: The sequence is a functional homolog of SEQ ID NO 774 in the 11/435,388 US patent application
  misc_feature: Useful for making plants with modulated biomass
  misc_feature: Useful for making plants with modulated flowering time
  misc_feature: Functional homolog of the protein sequence given in SEQ ID NO 13574
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 1248 in the 10/374,780 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 1236 in the 10/374,780 US patent application
  misc_feature: The sequence is a functional homolog of SEQ ID NO 172 in the 11/375,241 US patent application
  misc_feature: The sequence is a functional homolog of SEQ ID NO 800 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO. 274 in the 11/188,298 US application
MDADDSSSASSSSPPVSPADHHHHHSLPPKRRAGRKKFRETRHPVYRGVRARGGGTRWVCEVREPQAQARIWLGTYPTPEMAARAHDVAAIALRGATAADLNFPDSAHALPRARTAAPEDIRCAAAQQHARRTITPPPPEVSSACCWTTSTGTRSAGGGGDSSTAASCYGFLDEDAIFDMPGLIDDMARGMLLTPPAMGRGALLDDDHHSHVDCTLWMVD

SEQ ID NO: 1889 - DNA, 1098 bp, Sorghum bicolor
  misc_feature: Ceres ANNOT ID no. 6017316
  misc_feature: Encodes the peptide sequence at SEQ ID NO 1890
atggagaacgggcacgccaagtaccgggtggccgtcattggcagcggcaactggggcagcgtcgcctcccgcctcatcgcctccaacaccgccaagctgccctccttctatgatgaagtaaggatgtgggtctttgaggaaatactgccaacaggcaagaagctatccgagtccattaacgaacaaaatgagaactgcaaatacttgccaggtataaagcttggaaagaacgttattgccgaccctgacttggagagtgcagtcaaagatgccaatatgctggtttttgtgactccccatcaatttgtggagggtatatgtaagaagcttgtagggaagctaagaccaggagctgaggctatctccctcatcaagggcatggaggtcaagatggaaggaccgtgcatgatatccaaattaatcgcggatacacttggagtcaattgttgtgtcctcatgggtgctaacattgcaaacgagattgctgttgaagagttcagtgaagcaacaattgggtataggaaagataaggaagtggcaaaccgatgggctcaactttttaccacaccctacttcctagtttctatcgcagaagatattgaaggagtagagctgtgtggaactctgaaaaatatcgtggctattgcagcaggccttgttgacggcttggatatgggaaacaatacaaaggctgcaataatgcggattggtttgcgagaaatgcgtgctttctctaagcttctgtttccttcagtcagagataacacattctttgagagttgtggtgtcgctgacctaataaccacatgccttggcgggaggaacagaagagtggctgaggcctttgcacgaaatggtggcaaaaggtcttttgatgacctggaggccgagatgttgcgtggccaaaaactccagggagtgtccacagcaagggaagtctatgaagtcttgacttatcgaggatggcaggagctgtttcctctgttatccacagtgcatgagatttgtattggacaattgcctcctacatcaatagttgaatacagtgagcacacgcccaacctctccctcatcggtggtcctactccattctactga

SEQ ID NO: 1890 - protein, 365 aa, Sorghum bicolor
  misc_feature: Ceres ANNOT ID no. 6017316
  misc_feature (198)..(349): Pfam Id: NAD_Gly3P_dh_C Pfam Desc: NAD-dependent glycerol-3-phosphate dehydrogenase C-terminus
  misc_feature (8)..(181): Pfam Id: NAD_Gly3P_dh_N Pfam Desc: NAD-dependent glycerol-3-phosphate dehydrogenase N-terminus
  misc_feature (9)..(350): NCBI GI: 840731 NCBI Desc: glycerol-3-phosphate dehydrogenase (nad+) [cuphea lanceolata]
  misc_feature (88)..(349): NCBI GI: 124359460 NCBI Desc: peptidase s26a, signal peptidase i; nad-dependent glycerol-3-phosphate dehydrogenase, c-terminal [medicago truncatula]
  misc_feature (7)..(348): NCBI GI: 61816942 NCBI Desc: glycerol-3-phosphate dehydrogenase [dunaliella salina]
  misc_feature (1)..(357): NCBI GI: 51555846 NCBI Desc: glycerol-3-phosphate dehydrogenase-1 [bombyx mori]
  misc_feature (1)..(347): NCBI GI: 51555848 NCBI Desc: glycerol-3-phosphate dehydrogenase-2 [bombyx mori]
  misc_feature (9)..(350): SWISSPROT Homolog: EC 1.1.1.8 Glycerol-3-phosphate dehydrogenase [NAD+]
MENGHAKYRVAVIGSGNWGSVASRLIASNTAKLPSFYDEVRMWVFEEILPTGKKLSESINEQNENCKYLPGIKLGKNVIADPDLESAVKDANMLVFVTPHQFVEGICKKLVGKLRPGAEAISLIKGMEVKMEGPCMISKLIADTLGVNCCVLMGANIANEIAVEEFSEATIGYRKDKEVANRWAQLFTTPYFLVSIAEDIEGVELCGTLKNIVAIAAGLVDGLDMGNNTKAAIMRIGLREMRAFSKLLFPSVRDNTFFESCGVADLITTCLGGRNRRVAEAFARNGGKRSFDDLEAEMLRGQKLQGVSTAREVYEVLTYRGWQELFPLLSTVHEICIGQLPPTSIVEYSEHTPNLSLIGGPTPFY

SEQ ID NO: 1891 - DNA, 1449 bp, Sorghum bicolor
  misc_feature: Ceres ANNOT ID no. 6017329
  misc_feature: Encodes the peptide sequence at SEQ ID NO 1892
atgacgctcgcggcgccggcctcggacgccaagccgcgcctcaacgtgccgccgtccatggcggccgcgctccgcctcgaccccgtggggctgggggcggggccctcgacgccgtccccctcccgccgcctcgccgagcctcccaagacgccctccccgtccaagaccacctacagcgaccgcttcatcccctgccgctcctcctcccgcctccagaacttcgcgctcctcgactcccctctctccccggccaaggacgacacgccctactcccgcctcctccgagccgagctcttcggccccgattcgcccaaacccgccaccgcagcatccgcctcgcccaacaccaacctcttccgcttcaagaaagaccactccgcgcccacctcccccttcgccaaagccgccgccgcgcaccatgactgcaccgcgggctccggagatgcgccgtcgccgcagaagccacccaggaaggtccccaagacgccgcataaggttctggacgcgccctccctgcaggacgacttctacctcaaccttgtcgactggtcctcgcagaacgtgctcgccgtcggcctaggcacctgcgtctatctctggtccgcgtccaatagcaaggtcaccaagctctgcgatttggggcccagggacagtgtctgcgccgtgcattggtcacgcgaaggctcttatctttccattggcaccggccttggagatgtccagatttgggacagttctcgctgtaaacggattagaaatatgggaggtcaccaaacacggactggggtattagcatggagctcatgcatcttgtcctcaggtagcagggacaagaatatattgcagcatgacatccgtgtccccagtgactatatcagcaagttttgtggtcatagatcagaggtttgtggactcaaatggtcgcatgacgaccgcgagcttgcctcgggtggaaatgacaaccagttattagtgtggaaccaacgatcgcaacagccagtgttgcagttgacagaacatacagccgctgttaaagcaatagcgtggtcgccacatcagcaaggactcctggcatcaggaggtggaacagctgatagatgcatcaggttttggaacacggctaatggaaatgttctgaactcaattgacacaggcagccaggtttgcaaccttgcctggtgtaaaaatgtgaatgagcttgtgagcacacatgggtattcccaaaatcaaatcatggtgtggaaatatccatccatgtcaaaggttgcaactctaaccggacatacaatgcgtgtgctttaccttgcatcgtcgcctgatggacagaccatagtaacaggagcaggcgacgaaactctacggttctggaacatatttccatcagttaaaacgcagacccctgtgcgtgatattgggctctggtcattctcaagaagccacatccggtga

SEQ ID NO: 1892 - protein, 482 aa, Sorghum bicolor
  misc_feature: Ceres ANNOT ID no. 6017329
  misc_feature (289)..(327): Pfam Id: WD40 Pfam Desc: WD domain, G-beta repeat
  misc_feature (419)..(457): Pfam Id: WD40 Pfam Desc: WD domain, G-beta repeat
  misc_feature (3)..(482): NCBI GI: 20466231 NCBI Desc: cell cycle switch protein [arabidopsis thaliana]
  misc_feature (19)..(482): NCBI GI: 34451597 NCBI Desc: b-type cell cycle switch protein ccs52b [medicago truncatula]
  misc_feature (3)..(465): NCBI GI: 10177650 NCBI Desc: cell cycle switch protein [arabidopsis thaliana]
  misc_feature (36)..(482): NCBI GI: 42362327 NCBI Desc: wd-repeat cell cycle regulatory protein [glycine max]
  misc_feature (17)..(482): NCBI GI: 66932877 NCBI Desc: cell cycle switch protein ccs52a [lotus corniculatus var. japonicus]
  misc_feature: The sequence is a functional homolog of SEQ ID NO 2 in US patent 7101712
  misc_feature: Useful for making plants with modulated biomass
  misc_feature: Functional homolog of the protein sequence given in SEQ ID NO 13536
  misc_feature: The sequence is a functional homolog of SEQ ID NO. 502 in the 11/188,298 US application
MTLAAPASDAKPRLNVPPSMAAALRLDPVGLGAGPSTPSPSRRLAEPPKTPSPSKTTYSDRFIPCRSSSRLQNFALLDSPLSPAKDDTPYSRLLRAELFGPDSPKPATAASASPNTNLFRFKKDHSAPTSPFAKAAAAHHDCTAGSGDAPSPQKPPRKVPKTPHKVLDAPSLQDDFYLNLVDWSSQNVLAVGLGTCVYLWSASNSKVTKLCDLGPRDSVCAVHWSREGSYLSIGTGLGDVQIWDSSRCKRIRNMGGHQTRTGVLAWSSCILSSGSRDKNILQHDIRVPSDYISKFCGHRSEVCGLKWSHDDRELASGGNDNQLLVWNQRSQQPVLQLTEHTAAVKAIAWSPHQQGLLASGGGTADRCIRFWNTANGNVLNSIDTGSQVCNLAWCKNVNELVSTHGYSQNQIMVWKYPSMSKVATLTGHTMRVLYLASSPDGQTIVTGAGDETLRFWNIFPSVKTQTPVRDIGLWSFSRSHIR

SEQ ID NO: 1893 - DNA, 1200 bp, Sorghum bicolor
  misc_feature: Ceres ANNOT ID no. 6017335
  misc_feature: Encodes the peptide sequence at SEQ ID NO 1894
atggctgctccccagcacgtccgcgccgctcccctcgcccgtgcgctccgcgctagcgccaccgccaccgccaccgccaccgtgtccgcctcagcccccgcccccgcccccatcaagtctcaggggacttcccgccgcgcgctgctcggcctctcggagcctcagctccgccagctcgccctcgatctcggcgaggaaagctaccggggcaagcagctgcacgacctcctctacaaatcaagagccaagcaaatccaagatttcaaccacgtgcccaaggcattccgggaggcgttgcttggcgctgggtggagtgctggccggtcaccagtgcaccacgccgtcacagcctcggatggcactaccaagatacttctcaagttggaggataaccggttgattgagacagtagggattcctgttgatgatgacaacaaaggctcttctaggctcaccgcctgtgtttcatcacaggtcggctgccccttacgttgctcattttgtgccacgggcaagggagggtttgcaaggaaccttcaaccaaatgagatcgttgagcaggtgttggccatcgaggagacgttcaaacaaagggtgacaaatgttgtgttcatggggatgggtgagcccatgatgaacctcaagtcagttctagaagcacaccgatgcttcaataaggaactaaaaattgggcaaaggatgatgacaatatctacagttggtgttcctaatacgataaaaatgctagcgtctcataagcttcagtcaacactggctgtcagtctgcatgccccaaatcagaagctgcgggagacaattgttcctagtgccaagtcttaccccttgggagcactgatggatgactgcaagaattacttccttgaaactgggcgcagagtatcctttgagtacactctgctagctgggatcaacgatgaaaaggagcatgccgaagagctagctgaactacttcgtacgtgtggaggtggttaccatgtgaacctgattccctataacccaattgaaggctccgagtacaagagaccttacagaaaagtggttcaagcatttgtggatgctttagaagctcggaagataaccgtcagcgttcgacagacccgtgggcttgatgctaacgcagcctgtgggcagctgagaaatgagttccagaagaatccactgcttgcaattgaagcgtga

SEQ ID NO: 1894 - protein, 399 aa, Sorghum bicolor
  misc_feature: Ceres ANNOT ID no. 6017335
  misc_feature (155)..(321): Pfam Id: Radical_SAM Pfam Desc: Radical SAM superfamily
  misc_feature (1)..(395): NCBI GI: 57899699 NCBI Desc: radical sam domain-containing protein-like [oryza sativa (japonica cultivar-group)]
  misc_feature (1)..(367): NCBI GI: 115442535 NCBI Desc: os01g0973400 [oryza sativa (japonica cultivar-group)]
  misc_feature (1)..(395): NCBI GI: 30687969 NCBI Desc: radical sam domain-containing protein [arabidopsis thaliana]
  misc_feature (48)..(389): NCBI GI: 86607188 NCBI Desc: radical sam enzyme, cfr family [cyanobacteria bacterium yellowstone a-prime]
  misc_feature (48)..(386): NCBI GI: 113476505 NCBI Desc: radical sam enzyme, cfr family [trichodesmium erythraeum ims101]
MAAPQHVRAAPLARALRASATATATATVSASAPAPAPIKSQGTSRRALLGLSEPQLRQLALDLGEESYRGKQLHDLLYKSRAKQIQDFNHVPKAFREALLGAGWSAGRSPVHHAVTASDGTTKILLKLEDNRLIETVGIPVDDDNKGSSRLTACVSSQVGCPLRCSFCATGKGGFARNLQPNEIVEQVLAIEETFKQRVTNVVFMGMGEPMMNLKSVLEAHRCFNKELKIGQRMMTISTVGVPNTIKMLASHKLQSTLAVSLHAPNQKLRETIVPSAKSYPLGALMDDCKNYFLETGRRVSFEYTLLAGINDEKEHAEELAELLRTCGGGYHVNLIPYNPIEGSEYKRPYRKVVQAFVDALEARKITVSVRQTRGLDANAACGQLRNEFQKNPLLAIEA

SEQ ID NO: 1895 - DNA, 1143 bp, Sorghum bicolor
  misc_feature: Ceres ANNOT ID no. 6017336
  misc_feature: Encodes the peptide sequence at SEQ ID NO 1896
atgccgtcctcgatggctaaatccctcctcctccctccccccttcgtctccgtctcaccccgcccgcaccctcacccgcgcgccggcttccctgtcctcaagccccgccgcaccatgctgctggccgccaccggcggggacgccacgcccgcgcccgcgccagacgccgacgccaactccagcaccaaccctctcgccgcgctcgtcgaggtgccccgcgcgctatggcgccgcaccctgcagcccctcggcgactacggcttcggcaagcgcagcgtctgggagggcggcgtcggcctcttcatggtctccggggccgccctcctcgccctcgccctcgcatggctcacgggattccagctccgctcccgcttccgcaagtacaacaccgtcttcgagttcacgcaggcgtgcggcatctgcgtcggcacgcccgtccggatacgaggggtcaccgtcggatccgtcgtccgcgtcgactcctccctcaggagcatcgatgccaccgtcgaggttgaagatgataaaatcatcataccacggaattcagtggtcgaggtgaaccagtccggtcttctaatggagacactcattgatatcacacccaaggatccactccctgcaccttcagtaggaccacttgaccctgactgcaccaaagaaggcttgattctctgtgacaaagagaggatgaaaggacagcaaggtgtaagcttagacgcattggtggggatatttactcgtctaggtcgagacatggaggagattggcgttagcaaaagctataagttggctgaaaaagttgcaactataatggaagaagcacagcctcttcttacacggattgaggccttggctgaagaaatgcaacctttactctctgaggttcgtgaaagtgatctgctgaaggatgtggagactatagctaaaggcctggctgatgcgtctggtgacctaagaaagctgaagtcgtccatgcttactccagagaacacagatcttattaagcagtctattttcacccttatatttaccctgaagaacattgagagtatcagctcggacatctctgggttcactggcgatgagacgacaaggcggaacatcaagcttctgatcaagtctctcagcaggctattgtga

SEQ ID NO: 1896 - protein, 380 aa, Sorghum bicolor
  misc_feature: Ceres ANNOT ID no. 6017336
  misc_feature (126)..(203): Pfam Id: MCE Pfam Desc: mce related protein
  misc_feature (11)..(380): NCBI GI: 57899922 NCBI Desc: abc-type transport system-like [oryza sativa (japonica cultivar-group)]
  misc_feature (2)..(281): NCBI GI: 42572499 NCBI Desc: mce-related family protein [arabidopsis thaliana]
  misc_feature (91)..(377): NCBI GI: 53688472 NCBI Desc: cog1463: abc-type transport system involved in resistance to organic solvents, periplasmic component [nostoc punctiforme pcc 73102]
  misc_feature (91)..(370): NCBI GI: 113475810 NCBI Desc: methyl-accepting chemotaxis sensory transducer [trichodesmium erythraeum ims101]
  misc_feature (91)..(360): NCBI GI: 86608565 NCBI Desc: mce related protein [cyanobacteria bacterium yellowstone b-prime]
MPSSMAKSLLLPPPFVSVSPRPHPHPRAGFPVLKPRRTMLLAATGGDATPAPAPDADANSSTNPLAALVEVPRALWRRTLQPLGDYGFGKRSVWEGGVGLFMVSGAALLALALAWLTGFQLRSRFRKYNTVFEFTQACGICVGTPVRIRGVTVGSVVRVDSSLRSIDATVEVEDDKIIIPRNSVVEVNQSGLLMETLIDITPKDPLPAPSVGPLDPDCTKEGLILCDKERMKGQQGVSLDALVGIFTRLGRDMEEIGVSKSYKLAEKVATIMEEAQPLLTRIEALAEEMQPLLSEVRESDLLKDVETIAKGLADASGDLRKLKSSMLTPENTDLIKQSIFTLIFTLKNIESISSDISGFTGDETTRRNIKLLIKSLSRLL

SEQ ID NO: 1897 - DNA, 444 bp, Sorghum bicolor
  misc_feature: Ceres ANNOT ID no. 6017337
  misc_feature: Encodes the peptide sequence at SEQ ID NO 1898
atgcctcacggcggcttctccggcagcctgacgtcaccgaaattcgactttgccgtggacatgggccatcctttcctcaaccgcaccgtcgacggcttcatcaggatcggcgttggcggttgcaaggtcgccgccgaggaaaccttcgagtgcctgcaaagaggggacgtttccaagcacaaagtcgagcacgcgctgaagaaaatgtgcaaggaaggcgcctactggggtactgttgctggtgtatacgtcggggtggagtacggaatccagaagatccgtggacacagggactggaaaaacgcgatggttggaggtgccctgacgggagccttggtgtctgccgtgaacaaccaccaccggcacaacgtggtgaagaacgccatcaccggaggagccatcgcaacggccgccgagtttctcacccacctcacctcatcatga

SEQ ID NO: 1898 - protein, 147 aa, Sorghum bicolor
  misc_feature: Ceres ANNOT ID no. 6017337
  misc_feature (18)..(145): Pfam Id: Tim17 Pfam Desc: Tim17/Tim22/Tim23 family
  misc_feature (1)..(145): NCBI GI: 3758827 NCBI Desc: amino acid selective channel protein [hordeum vulgare subsp. vulgare]
  misc_feature (1)..(145): NCBI GI: 60279270 NCBI Desc: pom14 [solanum tuberosum]
  misc_feature (1)..(145): NCBI GI: 1370287 NCBI Desc: core protein [pisum sativum]
  misc_feature (54)..(142): NCBI GI: 30683558 NCBI Desc: mitochondrial import inner membrane translocase subunit tim17/tim22/tim23 family protein [arabidopsis thaliana]
  misc_feature (20)..(142): NCBI GI: 7268365 NCBI Desc: pore protein homolog [arabidopsis thaliana]
MPHGGFSGSLTSPKFDFAVDMGHPFLNRTVDGFIRIGVGGCKVAAEETFECLQRGDVSKHKVEHALKKMCKEGAYWGTVAGVYVGVEYGIQKIRGHRDWKNAMVGGALTGALVSAVNNHHRHNVVKNAITGGAIATAAEFLTHLTSS

SEQ ID NO: 1899 - DNA, 4227 bp, Sorghum bicolor
  misc_feature: Ceres ANNOT ID no. 6017346
  misc_feature: Encodes the peptide sequence at SEQ ID NO 1900
atggtctcgcggggactcttcggctggtcgccgccccacgtccagccgctcacgcccgtctccgagacctctgagccgcccgagtcgccctccccctacgccgccgacctcggcctcggaggggacggcgctccgccgcctgacgacgacgcccaaccgcccctagacgatgccgacgacgacccggacccgccgcctgccgctgtccccttcaagcgcctcttcgcctgcgccgaccgcatcgactgggcgctcatggtcgccggcagcctcgcagccgctgcccacggagtcgcgctcgtcgtctacctccacctcttcggcaaagccatcaactcgcttcatgcccatgggcggcatacccacgacctcttccacaatatcaaccaggcagttgcatatgctctcttccacgctttgtacttcctctatatagccattggcgttttctttgctggatggatagaggtttcgtgctggattttgactggggaaagacagacggcagtgattagatcaaagtacgttcaagtcctcttaaaccaagacatgagtttctttgatacgtacggcaacaatggtgatattgtcagtcaagtgctgagtgatgtcttgctcattcagtcagctctgagtgagaaagttgggaactacattcacaacatggccacattttttggtggtcttgtcattggtctggtcaactgctggcaaatagctttattgacattagcaactgggcccttcatcgttgctgcaggaggaatatcaaacatatttctccacaggcttgcagaaaatattcaggatgcttatggtgaggcagcaagcattgctgaacaggcaatcttgtacattaggaccttgtattccttcacaaatgagacccttgcaaagtattcttatgctacttcacttcaagcaacactgcgctatggaatccttataagtttggtgcaaggtcttggtctcggatttacatatggccttgccatatgttcttgtgccttacaactttgggttgggaggttccttatctctcatggaagagctaatggcggtgaagttgtagtagcactgtttgctattatcttgagtggacttggacttaatcaagcagcaacaaacttctattcctttgagcaaggacgtatagctgcatacagactatacgaaatgataagccgttcaacatctactgtgaaccaggatggccgtaccttgtcttcagtgcaaggcaacatcgagttccgcaatgtctacttcagttatttgtcccgccctgaaatccccatcttaagtggattttaccttactgtacctgctagaaaaactgttgctcttgttggcagaaatggttcaggaaaaagcagcataattcctctaatggaacgcttctatgacccaaccttaggtgaagtgcttttggatggggagaacataaagaatttgaagctagagtggttaagaagccaaataggacttgtgactcaagaaccagctttgttgagcttgagcatcatggaaaatattgcatatggtagatctgccacaactgaccaaattgaagaggcagccaaaacagctcatgtgcatgctttcatcagttcactagaaaaaggatatgaaacacaggttggtcgggctggcctctctctgacagaagaacaaaagataaagctttccattgctcgtgctgtgctctcaaatccctcaattcttctactggatgaggttactggtgctcttgattttgaggctgagaaagcagtccaggaagcactagacattctaatgcttgggagatctaccatcatcatagctcggcgcctcagtcttatcaggaatgctgattatatagcagtaatggaggaaggacaacttgttgagatggggacacatgaagaattgttaaaccttgatggtctttatgcagaacttcttaggtgtgaagaagccgcaaaacttccaaagagaacaccaataagaaattataaagagccaagctccttccaaattgaaagggattcgtcagcaagtcacagctttcaagaatcatcttctccaaagatgtcaaaatcgccatcacttcagaaaacacatggttttctcacattccgaacttcagatgccaatcataactcacgcgaatcaccaaatattcaaagccccccttcagagcaaatggcagaagccagactaccaatggttgcttctgagagagctccatccatcaaaaggcaggacagttttgaaatgaaattgcctgatctccccaaaatagatgtcccgctgcaccgacagtcctcaaatacatcagacccagaatctccaatatctccattattgacttctgatccaaaaaatgagcgctcccactcaaaaactttcagccgacctctcgacatatttgatagttttcatgctgacgattccaagcagcagcacacaaaagcaccatctttttggaggcttgcagagcttagtcttgcagaatatttttatgctttgttaggaagtgctggggctgcttgttttggttcatttaatcctcttcttgcttatacaatatctctaatagtagtggcctactacaaaataggggtccgtgatgtacatgctgaagtgaataagtactgctcattcattgttggcatgggtataattactgtactagccaactttttgcagcacttctacttcggtataatgggagagaaaatgaccgagcgtgtcagaaggatgatgttttcagcaattctgcgcaacgaagttggttggtttgatgacgaagaaaatagtgcagacatattatcgatgagacttgcaaatgatgcaacatttgtccgcgctgctttcagtaacagactttctatattcattcaggatacatcggccattcttgttgcacttcttcttggtatgttactacaatggcgtgttgctcttgttgcattggcaacgttaccgatccttatcgtttctgcggttgcacagaaaatgtggctttctggcttttccagaggaattcaggagatgcacaggaaagcttctttggttcttgaagatgccgtgaggaatatctatactgtggtggcattttgtgctggtaacaaaataatggaactttatagattgcagcttggtaatattctcaagaaaagctttattcatgggatgggcattggttttgcctttggcttctctcagttccttcttttcgcatgcaatgcacttctgttgtggtatacagccgctgctgtgaaggatggacatctcagtctcgtaaccgctgtcaaggagtacattgtcttctcttttgcgtctttcgcactggtggaaccatttggccttgccccttatatactgaaacgccggaaatccctgacctcagtatttgaaattattgatcgcgtacccaagattgatccagatgatgccagcggcctgaaaccccctaacgtgtatgggagcattgaattcaggagtgttgatttttgctaccctacacgccctgagatgatggttttgagtaattttagcctcagagtgaatggaggacaaactgttgctgtagtaggtgtatcaggatccgggaagagcacgataatttctttgattgagaggttctatgatccaactgctgggcaagttttgttggatggccgtgatttgaagttgttcaacttgagatggctgcggagccacatggggttggttcctcaggatcctgttatattttcaacaaccataagagaaaacataatatatgcaaggcacaatgcaactgaatctgagatgaaagaagctgccaggatcgcgaatgcccatcacttcatcagtagcctgcctcatggttatgatacacatgtgggaatgcgtggggtggatttgactcctgggcagaagcagcgcattgccattgctcgtgtggtgttaaagaatgcgcccattttgctgcttgacgaagccagctcagctatcgaatctgagtcgagtagggtggtccaggaagcccttgacactttgatcatggggaacaaaacaacgattttgatcgcgcacagggcagcgatgatgaagcatgtggatagcatcgttgtgttaaatggtggtaggattgtcgagcagggaagtcatgattcgttggtgcagttgaatggcttgtatgtgaagttgatgcagcctcattttagcaaagggttccgccagcgtagattaatatag

SEQ ID NO: 1900 - protein, 1408 aa, Sorghum bicolor
  misc_feature: Ceres ANNOT ID no. 6017346
  misc_feature (443)..(626): Pfam Id: ABC_tran Pfam Desc: ABC transporter
  misc_feature (1187)..(1372): Pfam Id: ABC_tran Pfam Desc: ABC transporter
  misc_feature (86)..(373): Pfam Id: ABC_membrane Pfam Desc: ABC transporter transmembrane region
  misc_feature (833)..(1112): Pfam Id: ABC_membrane Pfam Desc: ABC transporter transmembrane region
  misc_feature (1)..(1408): NCBI GI: 7019665 NCBI Desc: p-glycoprotein-like [arabidopsis thaliana]
  misc_feature (1)..(1408): NCBI GI: 20453064 NCBI Desc: at2g39480/f12l6.14 [arabidopsis thaliana]
  misc_feature (763)..(1395): NCBI GI: 27368845 NCBI Desc: mdr-like abc transporter [oryza sativa (japonica cultivar-group)]
  misc_feature (56)..(655): NCBI GI: 38347317 NCBI Desc: osjnba0063c18.8 [oryza sativa (japonica cultivar-group)]
  misc_feature (1)..(554): NCBI GI: 115442569 NCBI Desc: os01g0976100 [oryza sativa (japonica cultivar-group)]
MVSRGLFGWSPPHVQPLTPVSETSEPPESPSPYAADLGLGGDGAPPPDDDAQPPLDDADDDPDPPPAAVPFKRLFACADRIDWALMVAGSLAAAAHGVALVVYLHLFGKAINSLHAHGRHTHDLFHNINQAVAYALFHALYFLYIAIGVFFAGWIEVSCWILTGERQTAVIRSKYVQVLLNQDMSFFDTYGNNGDIVSQVLSDVLLIQSALSEKVGNYIHNMATFFGGLVIGLVNCWQIALLTLATGPFIVAAGGISNIFLHRLAENIQDAYGEAASIAEQAILYIRTLYSFTNETLAKYSYATSLQATLRYGILISLVQGLGLGFTYGLAICSCALQLWVGRFLISHGRANGGEVVVALFAIILSGLGLNQAATNFYSFEQGRIAAYRLYEMISRSTSTVNQDGRTLSSVQGNIEFRNVYFSYLSRPEIPILSGFYLTVPARKTVALVGRNGSGKSSIIPLMERFYDPTLGEVLLDGENIKNLKLEWLRSQIGLVTQEPALLSLSIMENIAYGRSATTDQIEEAAKTAHVHAFISSLEKGYETQVGRAGLSLTEEQKIKLSIARAVLSNPSILLLDEVTGALDFEAEKAVQEALDILMLGRSTIIIARRLSLIRNADYIAVMEEGQLVEMGTHEELLNLDGLYAELLRCEEAAKLPKRTPIRNYKEPSSFQIERDSSASHSFQESSSPKMSKSPSLQKTHGFLTFRTSDANHNSRESPNIQSPPSEQMAEARLPMVASERAPSIKRQDSFEMKLPDLPKIDVPLHRQSSNTSDPESPISPLLTSDPKNERSHSKTFSRPLDIFDSFHADDSKQQHTKAPSFWRLAELSLAEYFYALLGSAGAACFGSFNPLLAYTISLIVVAYYKIGVRDVHAEVNKYCSFIVGMGIITVLANFLQHFYFGIMGEKMTERVRRMMFSAILRNEVGWFDDEENSADILSMRLANDATFVRAAFSNRLSIFIQDTSAILVALLLGMLLQWRVALVALATLPILIVSAVAQKMWLSGFSRGIQEMHRKASLVLEDAVRNIYTVVAFCAGNKIMELYRLQLGNILKKSFIHGMGIGFAFGFSQFLLFACNALLLWYTAAAVKDGHLSLVTAVKEYIVFSFASFALVEPFGLAPYILKRRKSLTSVFEIIDRVPKIDPDDASGLKPPNVYGSIEFRSVDFCYPTRPEMMVLSNFSLRVNGGQTVAVVGVSGSGKSTIISLIERFYDPTAGQVLLDGRDLKLFNLRWLRSHMGLVPQDPVIFSTTIRENIIYARHNATESEMKEAARIANAHHFISSLPHGYDTHVGMRGVDLTPGQKQRIAIARVVLKNAPILLLDEASSAIESESSRVVQEALDTLIMGNKTTILIAHRAAMMKHVDSIVVLNGGRIVEQGSHDSLVQLNGLYVKLMQPHFSKGFRQRRLI

SEQ ID NO: 1901 - DNA, 1215 bp, Sorghum bicolor
  misc_feature: Ceres ANNOT ID no. 6017356
  misc_feature: Encodes the peptide sequence at SEQ ID NO 1902
atggatgacggcggcgagggctccggggctgcgggtgctgaggcggtggccgtggaggaggtggtggcgaggaaccctaggtgcttcctcgacgtgagcatcggcggggagctggaggggcggatcgtggtggagctctacgcctccgtggtgccgcgcacggcggagaacttccgcgcgctctgcaccggcgagaagggcgtcggcgccgaaaccggcgtgaagctccactacaagggctcatgttttcatcgcatagtcaagggttttatggtgcaaggcggagatataactgttggtgatggaactggggggcagtcgatatatggattgaattttgaggatgagaattttaccctgaagcatgagagaaaagggatgctatcaatggcaaatgctggccccaacacaaatgggtctcagtttttcatcactaccacccgaacacctcacctggatgggaatcatgttgtttttggaagggctataaaaggaatgggggtggttcgtgcaatggagcatatttctgttgatgaagctgatcgtccgactgatgatattgttattgttgattgtggagaacttccagaaggttccaatgatggagttgtaaattttttcaaggatggtgacatgtatcctgattggccgattgatctcgatgaaaagcctgcagaaatttcttggtggatggatgctgtggagtctgcaaaggcttttggaaatgaaagcttcaagaaacaggattacaagacagcgctcagaaaatacaggaaatctatgcggtacttagatctttgctgggagaaagaagacattgatgaagagaggagcaccgctctgcgaaaaacaaagtcaattatattcacaaatagctctgcttgcaaactgaagttgggagatttcgagggtgctttgttagatgctgattttgcactgcgtgaaagggaggacaatgcgaaagcttttttccgacaaggacaggtacgcatggcactcaaccatattgatgcagcagtcgagagcttcaagcaagcactggagctagagccaaacgatggaggaattaagcgagagcttgctgctgcaaaaaagaagatttctgacaggcgggatcgggagaagaaggcgttttcaaagttgttccaaccttcaggaggatcagagaagggtgacaaagtaacagaagggactttgcacgacggtttacgttag

SEQ ID NO: 1902 - protein, 404 aa, Sorghum bicolor
  misc_feature: Ceres ANNOT ID no. 6017356
  misc_feature (27)..(195): Pfam Id: Pro_isomerase Pfam Desc: Cyclophilin type peptidyl-prolyl cis-trans isomerase/CLD
  misc_feature (320)..(353): Pfam Id: TPR_2 Pfam Desc: Tetratricopeptide repeat
  misc_feature (320)..(353): Pfam Id: TPR_1 Pfam Desc: Tetratricopeptide repeat
  misc_feature (24)..(383): NCBI GI: 144924501 NCBI Desc: peptidyl-prolyl cis-trans isomerase, cyclophilin type [medicago truncatula]
  misc_feature (25)..(382): NCBI GI: 109892831 NCBI Desc: peptidyl-prolyl cis-trans isomerase d (ppiase d) (rotamase d)
  misc_feature (23)..(382): NCBI GI: 50344784 NCBI Desc: zgc:86711 [danio rerio]
  misc_feature (23)..(382): NCBI GI: 49900877 NCBI Desc: peptidylprolyl isomerase d [rattus norvegicus]
  misc_feature (25)..(382): NCBI GI: 27806463 NCBI Desc: peptidylprolyl isomerase d [bos taurus]
  misc_feature (27)..(382): SWISSPROT Homolog: EC 5.2.1.8 Peptidyl-prolyl cis-trans isomerase CYP40
MDDGGEGSGAAGAEAVAVEEVVARNPRCFLDVSIGGELEGRIVVELYASVVPRTAENFRALCTGEKGVGAETGVKLHYKGSCFHRIVKGFMVQGGDITVGDGTGGQSIYGLNFEDENFTLKHERKGMLSMANAGPNTNGSQFFITTTRTPHLDGNHVVFGRAIKGMGVVRAMEHISVDEADRPTDDIVIVDCGELPEGSNDGVVNFFKDGDMYPDWPIDLDEKPAEISWWMDAVESAKAFGNESFKKQDYKTALRKYRKSMRYLDLCWEKEDIDEERSTALRKTKSIIFTNSSACKLKLGDFEGALLDADFALREREDNAKAFFRQGQVRMALNHIDAAVESFKQALELEPNDGGIKRELAAAKKKISDRRDREKKAFSKLFQPSGGSEKGDKVTEGTLHDGLR

SEQ ID NO: 1903 - DNA, 681 bp, Sorghum bicolor
  misc_feature: Ceres ANNOT ID no. 6017357
  misc_feature: Encodes the peptide sequence at SEQ ID NO 1904
atggcgagggagcggcgggagataaagaggatagagagcgcggcggcgcggcaggtcacgttctccaagcgccgccgcggcctcttcaagaaggccgaggagctctccgtgctgtgcgatgccgacgtcgcgctcatcgtcttctcctccacggggaagctctcccagttcgccagctccagtatgaatgagatcattgacaagtacaacacacattctaaaaacctggggaaagcagaagagccttctcttgacttgaacttagaacatagcaaatacgcaaatttgaacgagcaacttgtggaagcaagccttagactcaggcagatgagaggtgaagaacttgagggattgagtgttgaagaactccagcaattggagaagaacctggaaactggtctgcacagggtgcttcaaacaaaggatcaacaattcttggaacagatcagcgaccttgaacggaagagtacacagctggcagaggagaacatgcaactgaggaatcaagtatcccagatacctccagctggcaaacaagcagttgctgatactgaaaatgttattgctgaagatgggcaatcctctgaatcagtgatgactgcgttgcactctggaagttcacaggataatgatgatggttcggatgtatctctaaagttaggagtaagtttgaccgaatag

SEQ ID NO: 1904 - protein, 226 aa, Sorghum bicolor
  misc_feature: Ceres ANNOT ID no. 6017357
  misc_feature (9)..(59): Pfam Id: SRF-TF Pfam Desc: SRF-type transcription factor (DNA-binding and dimerisationdomain)
  misc_feature (69)..(172): Pfam Id: K-box Pfam Desc: K-box region
  misc_feature (1)..(222): NCBI GI: 71025326 NCBI Desc: mads10 [lolium perenne]
  misc_feature (1)..(222): NCBI GI: 95981862 NCBI Desc: mads-box transcription factor taagl11 [triticum aestivum]
  misc_feature (1)..(222): NCBI GI: 120407344 NCBI Desc: mads-box protein 10 [hordeum vulgare subsp. vulgare]
  misc_feature (1)..(222): NCBI GI: 75315340 NCBI Desc: mads-box transcription factor 22 (osmads22)
  misc_feature (1)..(222): NCBI GI: 66271022 NCBI Desc: mads box protein vrt-2 [triticum aestivum]
  misc_feature: Abnormal phyllotaxy, leaf number higher than wild-type
  misc_feature: The plant flowers significantly earllier than wild-type.
  misc_feature: The sequence is a functional homolog of SEQ ID NO 1453 in the 10/374,780US patent application
  misc_feature: The sequence is a functional homolog of SEQ ID NO 1454 in the 10/374,780US patent application
  misc_feature: The sequence is a functional homolog of SEQ ID NO 2064 in the 10/374,780US patent application
  misc_feature: The sequence is a functional homolog of SEQ ID NO 572 in the 10/412,699US patent application
  misc_feature: The sequence is a functional homolog of SEQ ID NO 816 in the 10/225,066US patent application
  misc_feature: Useful for making plants with altered alkaloid content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12958
  misc_feature: GREAT-hit functional homolog of the protein sequence given in SEQ ID NO 13063
  misc_feature: The sequence is a functional homolog of SEQ ID NO 572 in the 20040045049 US patent application
  misc_feature: The sequence is a functional homolog of SEQ ID NO 1453 in the 20060162006 US patent application
  misc_feature: The sequence is a functional homolog of SEQ ID NO 1454 in the 20060162006 US patent application
  misc_feature: Useful for making plants with altered alkaloid content
  misc_feature: Functional homolog of the protein sequence given in SEQ ID NO 13063
  misc_feature: The sequence is a functional homolog of SEQ ID NO 1453 in the 10/374,780 US patent application
  misc_feature: Useful for making plants with modulated flowering time
  misc_feature: Functional homolog of the protein sequence given in SEQ ID NO 13660
  misc_feature: Useful for making plants with modulated biomass
  misc_feature: Functional homolog of the protein sequence given in SEQ ID NO 13659
  misc_feature: The sequence is a functional homolog of SEQ ID NO 1955 in the 10/412,699 US patent application
  misc_feature: The sequence is a functional homolog of SEQ ID NO 1949 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 359 in the 11/188,298 US application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 420 in the 11/188,298 US application
  misc_feature: The sequence is a functional homolog of SEQ ID NO. 518 in the 11/188,298 US application
  misc_feature: The sequence is a functional homolog of SEQ ID NO. 377 in the 11/188,298 US application
  misc_feature: The sequence is a functional homolog of SEQ ID NO. 491 in the 11/188,298 US application
MARERREIKRIESAAARQVTFSKRRRGLFKKAEELSVLCDADVALIVFSSTGKLSQFASSSMNEIIDKYNTHSKNLGKAEEPSLDLNLEHSKYANLNEQLVEASLRLRQMRGEELEGLSVEELQQLEKNLETGLHRVLQTKDQQFLEQISDLERKSTQLAEENMQLRNQVSQIPPAGKQAVADTENVIAEDGQSSESVMTALHSGSSQDNDDGSDVSLKLGVSLTE

SEQ ID NO: 1905 - DNA, 1830 bp, Sorghum bicolor
  misc_feature: Ceres ANNOT ID no. 6017372
  misc_feature: Encodes the peptide sequence at SEQ ID NO 1906
atggcgacgctcaaggatctcctaccggcgcccaagacgtcggcgtccaccttctacgaccacagcagcgacccctggttcaaggagcgctacggcggggagtcggcgcaggcggccgcggcagcgaggcccgcggccgccgcccgccccgtgccgccgtacggaaagcggacggggttcgtgccgcgacggccggaggacttcggcgatggcggcgccttcccggagatccacgtcgcgcagtacccgctcggtatgggacgccgcgatgataagggcgggtccaagatccttgcgctcaccgtggacgcgcacggcagcgtcgccttcgacgccgtcgtcaagcaaggtgagaacgcaggcaagatcgtctactccaagcatagcgacctcgtgccgaagatagccactgccgattcccaggcgacgtcagacgacgacgaggagcagaagcagatcgaggagaccactgaacggaccaaggccgccttggagaaggttgtcaacgtccgcctctctgcagctcagcccaagaatgtgccgactcatgattctgagtccaagttcatcaagtataagccgtcccagcaatccgcggccttcaattcaggtgcaaaggagaggatcattaggatgtcagagatggctgtggatcctcttgagccaccaaagttcaagcacaagcgtgtgccccgagcatctgggtcaccacctgttccagtgatgcactcgccgccacggccggttacagtgaaggatcagcaggattggaagatcccaccttgcatttcaaattggaaaaatccgaagggttacacgattccgcttgataagaggttggcggctgatgggagggggctgcaggaggtgcagatcaatgataattttgcaaagctttctgaagcattgtatgtggcagagcagaaggcgagggaggcagtgcagatgcgctccaaggttcagagggaacttatgctgaaggagaaggagaggaaggagcaagagcttagggctcttgcacaaagggcacgtatggagaggactggtgccccgcctgcaccgtcaggtgtaccagctggtggcggcaggggagcagttgaggctgttgatgaagatatggatatggagcaaccacgtgaaccacgtgaaccgcgtgagcagcgcagggagtctagagaagagagggaagcaaggattgagcgtgatagaatccgtgaggagcgcagacgtgagagggagagggagaggaggctggaagccaaggatgctgcaatgggcaagaagagtaagatcactagagacagggatcgtgatatcagtgagaagattgctcttggtatggcaagcactggtggtgcaaaaggtggtgaggtcatgtatgatcagcggctgttcaaccaggacaagggaatggactcaggttttgccacagatgatcagtacaacatctattctaagggtctcttcacagctcagtccacgatgtccacactatacaggcctaagaaggatggggattcagatgtatatggtgatgcagatgagcagttggagaaggttatgaagactgagaggttcaagcctgacaagggatttactggtgcttcagagaggactggcaagcgagacaggcctgtggagttcgataagcaggaagaaaatgatccatttggtctggatcagttcttgactgaggtgaagaagggtaagaaagctgtggagaagattggaggtggaggaaccatgaaggcgagtggtgggtcctcaatgagggacgattatgatggtggatctgggaggtcccgcattaattttgaaagggggcgctga

SEQ ID NO: 1906 - protein, 609 aa, Sorghum bicolor
  misc_feature: Ceres ANNOT ID no. 6017372
  misc_feature (187)..(353): Pfam Id: SKIP_SNW Pfam Desc: SKIP/SNW domain
  misc_feature (1)..(608): NCBI GI: 71798018 NCBI Desc: gamyb-binding protein [glycine max]
  misc_feature (94)..(608): NCBI GI: 27948454 NCBI Desc: gamyb-binding protein [hordeum vulgare subsp. vulgare]
  misc_feature (51)..(413): NCBI GI: 62868248 NCBI Desc: ski interacting protein [echinococcus multilocularis]
  misc_feature (37)..(571): NCBI GI: 74683636 NCBI Desc: pre-mrna splicing factor prp45 (pre-mrna-processing protein 45)
  misc_feature (51)..(570): NCBI GI: 19075713 NCBI Desc: nuclear protein [schizosaccharomyces pombe]
  misc_feature: Abnormal phyllotaxy, leaf number higher than wild-type
  misc_feature: The plant flowers significantly late compared to wild-type.
  misc_feature: Useful for making plants with modulated biomass
  misc_feature: Useful for making plants with modulated flowering time
  misc_feature: GREAT-hit functional homolog of the protein sequence given in SEQ ID NO 13552
  misc_feature: Useful for making plants with modulated biomass
  misc_feature: Useful for making plants with modulated flowering time
  misc_feature: Functional homolog of the protein sequence given in SEQ ID NO 13552
MATLKDLLPAPKTSASTFYDHSSDPWFKERYGGESAQAAAAARPAAAARPVPPYGKRTGFVPRRPEDFGDGGAFPEIHVAQYPLGMGRRDDKGGSKILALTVDAHGSVAFDAVVKQGENAGKIVYSKHSDLVPKIATADSQATSDDDEEQKQIEETTERTKAALEKVVNVRLSAAQPKNVPTHDSESKFIKYKPSQQSAAFNSGAKERIIRMSEMAVDPLEPPKFKHKRVPRASGSPPVPVMHSPPRPVTVKDQQDWKIPPCISNWKNPKGYTIPLDKRLAADGRGLQEVQINDNFAKLSEALYVAEQKAREAVQMRSKVQRELMLKEKERKEQELRALAQRARMERTGAPPAPSGVPAGGGRGAVEAVDEDMDMEQPREPREPREQRRESREEREARIERDRIREERRRERERERRLEAKDAAMGKKSKITRDRDRDISEKIALGMASTGGAKGGEVMYDQRLFNQDKGMDSGFATDDQYNIYSKGLFTAQSTMSTLYRPKKDGDSDVYGDADEQLEKVMKTERFKPDKGFTGASERTGKRDRPVEFDKQEENDPFGLDQFLTEVKKGKKAVEKIGGGGTMKASGGSSMRDDYDGGSGRSRINFERGR

SEQ ID NO: 1907 - DNA, 1860 bp, Sorghum bicolor
  misc_feature: Ceres ANNOT ID no. 6017375
  misc_feature: Encodes the peptide sequence at SEQ ID NO 1908
  misc_feature: Down-regulated in shoot tissues in response to salicylic acid treatment
atgcgggacgcggcggaggacgactccgactcgccgccgtcgcagatgtcggaggacgaccccggcgggggcggggacaggtgggagccggatctgaggggcggcaacaacggcgggggcgggaggtgggcgccgccggaccaggtgctggagaacgtgctcgagaccgtgctcgagttcctcaccgccgcgcgggaccgcaacgccgcctcgctcgtctgccgttcctggtaccgcgcagaggcgcagacgcgccgcgagctcttcatcggcaactgctacgccgtctcgccgcgacgcgccgtcgagcgcttcggcggcctgcgcgccgtcgtgctcaagggcaagccccgcttcgcggacttcagcctcgtgccatacggctggggcgcctacgtctccccctgggtggcagcgctcgggcccgcgtacccgcgcctcgagcgcatctgcctcaagcggatgaccgtctccgacgacgacctcgcactcatcgccaagtccttccccttgttcagggagctctcgctagtgtgctgcgatggcttcagcacggtcgggctcgccgtcatcgtcgagcgctgccggcatcttcgcgtgctggatctgattgaagattaccttgaggatgaagaggacgagctggtggattggatctccaagttttcagagtccaacacctctctggagtcacttgtcttcgactgcgtcagtgtgcccttcaactttgaggccctcgaggcacttgttgcacgctcaccggctttgcgtcggttgcgtgtcaaccaccacgtgtcagtagagcagctgcgccgtctcatggcaagagcaccccagctcacacactttggaaccggtgcattccgatctgagggtgcccctgatgggggtctggctgtgactgagcttgctacatcttttgctgcagccaggtctctcgtttgtctatcaggttttcgggaggtcgatccacaatatctcccagcgatctaccctgtttgtgccaagctcacctcactaaacttcagctttgcaagcctaacggctgcggaactcaagccagttattcgcaactgcaccaatcttcgcactttctgggtccttgatactgtgggtgatgaaggcctacgtgctgtggctgatacatgctctgatctccgtgagctgagagtttttcctttggatgcctctgaagattctgagggttcggtctcagatgttggtcttcaggcaatatcagaaggctgccggaagctagaatcaatcctctacttttgccagcggatgacaaatgaagcagtaattgctatgtcgaagaactgtcctgagcttgtagcgttccgcctctgtattatgggccgccaccgccctgatcgagtcactggggacccaatggatgaaggttttggcgcaattgtgatgaactgcaagaaactcaccaggctttcagtctctggcctgcttactgataaagcctttgcatacattggaaaatatgggaagctaataaagactctgtctgttgccttcgctgggaatagtgacatgtccctccaatatgtatttgagggatgcactaagttgcagaagcttgaggtcagagatagcccttttactgacagggggttactctccggactgaactacttctacaatatgaggttcttatggatgaactcatgcaggctaactatgagaggatgtaaagatgtagctcagcaaatgcaaaatttggtggttgaagtaattaaggaccactctgaagatgaaggggaggctgagattgttgacaagttgtacttgtatcggtcactggcaggaccaaggaatgatgctccaccatttgttaccctcttgtag

SEQ ID NO: 1908 - protein, 619 aa, Sorghum bicolor
  misc_feature: Ceres ANNOT ID no. 6017375
  misc_feature (3)..(619): NCBI GI: 13249030 NCBI Desc: f-box containing protein tir1 [populus tremula x populus tremuloides]
  misc_feature (46)..(619): NCBI GI: 30102460 NCBI Desc: at4g24390/t22a6_220 [arabidopsis thaliana]
  misc_feature (46)..(619): NCBI GI: 7269289 NCBI Desc: transport inhibitor response-like protein [arabidopsis thaliana]
  misc_feature (256)..(619): NCBI GI: 47497358 NCBI Desc: f-box containing protein tir1-like [oryza sativa (japonica cultivar-group)]
  misc_feature (51)..(619): NCBI GI: 92887633 NCBI Desc: cyclin-like f-box [medicago truncatula]
  misc_feature: Down-regulated in shoot tissues in response to salicylic acid treatment
MRDAAEDDSDSPPSQMSEDDPGGGGDRWEPDLRGGNNGGGGRWAPPDQVLENVLETVLEFLTAARDRNAASLVCRSWYRAEAQTRRELFIGNCYAVSPRRAVERFGGLRAVVLKGKPRFADFSLVPYGWGAYVSPWVAALGPAYPRLERICLKRMTVSDDDLALIAKSFPLFRELSLVCCDGFSTVGLAVIVERCRHLRVLDLIEDYLEDEEDELVDWISKFSESNTSLESLVFDCVSVPFNFEALEALVARSPALRRLRVNHHVSVEQLRRLMARAPQLTHFGTGAFRSEGAPDGGLAVTELATSFAAARSLVCLSGFREVDPQYLPAIYPVCAKLTSLNFSFASLTAAELKPVIRNCTNLRTFWVLDTVGDEGLRAVADTCSDLRELRVFPLDASEDSEGSVSDVGLQAISEGCRKLESILYFCQRMTNEAVIAMSKNCPELVAFRLCIMGRHRPDRVTGDPMDEGFGAIVMNCKKLTRLSVSGLLTDKAFAYIGKYGKLIKTLSVAFAGNSDMSLQYVFEGCTKLQKLEVRDSPFTDRGLLSGLNYFYNMRFLWMNSCRLTMRGCKDVAQQMQNLVVEVIKDHSEDEGEAEIVDKLYLYRSLAGPRNDAPPFVTLL

SEQ ID NO: 1909 - DNA, 1167 bp, Sorghum bicolor
  misc_feature: Ceres ANNOT ID no. 6017381
  misc_feature: Encodes the peptide sequence at SEQ ID NO 1910
atgctgcgccttggacatcatctcctgtcctccatccgcacggcctcgcctcgccaccgctgcctcctctccaccgctaccaccgccacttcccgcgtccgattcgtcgctgaagaatacctggtcaccacctgcgggctcaccccagcgcaagcgggcagggcctccaagaacctcacccacctcaagtccccggtccaacccgacgctgtcctcgcctttctcgcaggcgtcggcctcgccaaagacgacatcgccgctggaatcgccaggtacccgcggctcctctgctccaaggtggacaaaaccctaacccctcgcttcgctcagctcatcagcattgggctatcccctccccaaatctcccgcctcatggccatcgtccccaacatcttcggcgctcccaaaatgatttcccacctccagttctatctctccttcatgggtagcttcgatctgctgcactccgccatcaagatcaatcggatcctcctcggtcggagccttgagaatgtggtcaagcctaacatagcattcctacagcagtgcggtctaactgcctctaacagtttagagttcccaatactgatatccatgaagcccgagaatgtcagggaaagggtggcatgtgctgagaagcttggtgtgccgcgcaatacagggatgttcaagagtgccttgtgggccgtttgttgcgttggtcccaactccattggtgcaaaaatggatgtcatgaaggcgactcttggatgctcagaggcagagctggcttctgtggtgcgcaagtttccccaaattctgaggatatcagaaggcaagctgagtagcacaatgaagttcctgaaggtggatgttgggttgaaggttcagtacatcttgggtaggccagcaatactgggctatagcatgcagaggcggctgatgcccaggcattatttcatcaagattctgaaggcgaaggggcttgtgaaggaaaacattgacttttataatactgtttgtttaactgagaagagatttgtccagaagtttattgatccttacaacaagagtactgcagggcttgcagatgcttatgctactgcttgtgctgggaaaatacctcatgaagatgaggtgcatttgcagcagcatgctagggatactgagaagcaaaggcaaagatag

SEQ ID NO: 1910 - protein, 388 aa, Sorghum bicolor
  misc_feature: Ceres ANNOT ID no. 6017381
  misc_feature (39)..(342): Pfam Id: mTERF Pfam Desc: mTERF
  misc_feature (1)..(368): NCBI GI: 115467190 NCBI Desc: os06g0225100 [oryza sativa (japonica cultivar-group)]
  misc_feature (20)..(364): NCBI GI: 51536067 NCBI Desc: mitochondrial transcription termination factor-like [oryza sativa (japonica cultivar-group)]
  misc_feature (22)..(367): NCBI GI: 51536066 NCBI Desc: mitochondrial transcription termination factor-like [oryza sativa (japonica cultivar-group)]
  misc_feature (17)..(370): NCBI GI: 51536063 NCBI Desc: mitochondrial transcription termination factor-like [oryza sativa (japonica cultivar-group)]
  misc_feature (10)..(367): NCBI GI: 115467186 NCBI Desc: os06g0224900 [oryza sativa (japonica cultivar-group)]
  misc_feature: Useful for making plants with altered alkaloid content
  misc_feature: Functional homolog of the protein sequence given in SEQ ID NO 13002
MLRLGHHLLSSIRTASPRHRCLLSTATTATSRVRFVAEEYLVTTCGLTPAQAGRASKNLTHLKSPVQPDAVLAFLAGVGLAKDDIAAGIARYPRLLCSKVDKTLTPRFAQLISIGLSPPQISRLMAIVPNIFGAPKMISHLQFYLSFMGSFDLLHSAIKINRILLGRSLENVVKPNIAFLQQCGLTASNSLEFPILISMKPENVRERVACAEKLGVPRNTGMFKSALWAVCCVGPNSIGAKMDVMKATLGCSEAELASVVRKFPQILRISEGKLSSTMKFLKVDVGLKVQYILGRPAILGYSMQRRLMPRHYFIKILKAKGLVKENIDFYNTVCLTEKRFVQKFIDPYNKSTAGLADAYATACAGKIPHEDEVHLQQHARDTEKQRQR

SEQ ID NO: 1911 - DNA, 981 bp, Sorghum bicolor
  misc_feature: Ceres ANNOT ID no. 6017386
  misc_feature: Encodes the peptide sequence at SEQ ID NO 1912
atggcaaccagggttgcagtggtcaccggagggaacagaggaatcgggctggagatctgcaggcagctcgcgagcaatggcgtcctcgtcgtcctgacagccagagacgcgaagaagggctcgcaggccgtggaggagctgcagagctccggcctctccggcgtgattttccatcggttggacgtcgctgaccggtcgagcatcacgcagctcgcggagttcgtcaaggccaggttcggcaagctcgacatcttgtgcagcagcttcaggcgcattgtttcaggggttcagttcggtctcacagtttgggttcttcaggtgaacaatgcagccgttggtggaacaacaatcgatcctgagaggttaaaacagctccaaaagcaggatcctaaggcaagtcctcaagcacatagtttggaagatgtaagaacttttgtggatggttacattggaagtctgcatcaaaattatgagctagccaaggagtgtctggaaataaacttcaacggcacaaaggacgttacagattgcctgatccccctcctcctgctgtccaaatcaggaagggttgtgaatgtttcttcacaagttgcacagctcaagttcatgtcaaacgaaggagtcataaaggtgctaagcgacatcgacaacctctcagaggcgaagctcgatgaggtgatgagcgttttcctggcagatttcaaggacggtatcctagcggctcgtgggtggctccccgtggtgtcggcctacgcggtgtccaagacgctggtgaacgcgcactccaggctgctggcaaggaggcacccgtcgctggcggtgtgctgcgtcaacccgggcttcgtgaggaccggcatgaactacggcatgggccttgtctccgccgaggaaggcgccacggcgcccgtcgcgctcgcgctgcgggacgagcccgccgactccggactcaactttgagctgttggacgtctgcgagttctga

SEQ ID NO: 1912 - protein, 326 aa, Sorghum bicolor
  misc_feature: Ceres ANNOT ID no. 6017386
  misc_feature (4)..(208): Pfam Id: adh_short Pfam Desc: short chain dehydrogenase
  misc_feature (153)..(326): NCBI GI: 87162646 NCBI Desc: short-chain dehydrogenase/reductase sdr [medicago truncatula]
  misc_feature (107)..(326): NCBI GI: 145329603 NCBI Desc: short-chain dehydrogenase/reductase (sdr) family protein [arabidopsis thaliana]
  misc_feature (107)..(326): NCBI GI: 8671854 NCBI Desc: contains similarity to a retinal short-chain dehydrogenase/reductase retsdr4 from homo sapiens gbaf126782. it contains a short chain dehydrogenase pf00106 domain. [arabidopsis
  misc_feature (107)..(326): NCBI GI: 8671854 (continued) thaliana]
  misc_feature (153)..(318): NCBI GI: 87162647 NCBI Desc: short-chain dehydrogenase/reductase sdr [medicago truncatula]
  misc_feature (146)..(318): NCBI GI: 92871098 NCBI Desc: short-chain dehydrogenase/reductase sdr [medicago truncatula]
  misc_feature: The sequence is a functional homolog of SEQ ID NO. 453 in the 11/188,298 US application
MATRVAVVTGGNRGIGLEICRQLASNGVLVVLTARDAKKGSQAVEELQSSGLSGVIFHRLDVADRSSITQLAEFVKARFGKLDILCSSFRRIVSGVQFGLTVWVLQVNNAAVGGTTIDPERLKQLQKQDPKASPQAHSLEDVRTFVDGYIGSLHQNYELAKECLEINFNGTKDVTDCLIPLLLLSKSGRVVNVSSQVAQLKFMSNEGVIKVLSDIDNLSEAKLDEVMSVFLADFKDGILAARGWLPVVSAYAVSKTLVNAHSRLLARRHPSLAVCCVNPGFVRTGMNYGMGLVSAEEGATAPVALALRDEPADSGLNFELLDVCEF

SEQ ID NO: 1913 - DNA, 930 bp, Sorghum bicolor
  misc_feature: Ceres ANNOT ID no. 6017390
  misc_feature: Encodes the peptide sequence at SEQ ID NO 1914
atgatggaaggacacgtacgcgggcaagatgaaaaagaggtggccgtggttaccggagggaacagagggattgggttagaaatatgcaggcagcttgcttccaaaggagtcacggtagtattgacagccagggacgagatgaggggtgcagaagcggtcaaaaatcttgcagcgcaggggctatccaacgtcctgtttcatcaactggaggttggagatctctcaagcgctgcacgtctcgctgattttatccgagacaaatttggcaaactggatatattggtcaacaatgcagcaattgccgggtccaaaacagagatcagcgatccagaatctttcaagttagagcttgcaggcatgaatacccaggaaaagctcgaaaggatcaggaggcacaccacagacccttacgacaaagcagaggagtgcttaagaacaaactaccatggcaccaaaattgtcacagaagcgcatcttcctctcctgcacctctcgtcgcatggaagaattgtaaacatatcatctcgtttcggactactcaggtttttcagtggcgataaacttaagaaggagctagacaacattgatgacctatccgaagagagattagatgagctgtcagaattgtttctcaatcacttcaagaatggccagctagaaccctatgggtggccgactgaaggagggtatcttgcatataaagtgtccaaggctcttgtcaatgcttattcgagaatcgttgcaaagaagcacccaacacttcgtgtgaattgtgcgcatcctggctttgtcagtacagacatgagcttccacaccggagatctcacagtcgaggaaggcgcaaggggagctttgattctagctctcgtacccaagggaggcacgaccggagtgttcttgaaccgcacagaggtcgcatccttcgtgtaa

SEQ ID NO: 1914 - protein, 309 aa, Sorghum bicolor
  misc_feature: Ceres ANNOT ID no. 6017390
  misc_feature (13)..(186): Pfam Id: adh_short Pfam Desc: short chain dehydrogenase
  misc_feature (12)..(309): NCBI GI: 38346767 NCBI Desc: osjnba0081c01.18 [oryza sativa (japonica cultivar-group)]
  misc_feature (2)..(309): NCBI GI: 38346993 NCBI Desc: osjnbb0039l24.1 [oryza sativa (japonica cultivar-group)]
  misc_feature (14)..(309): NCBI GI: 115459598 NCBI Desc: os04g0531700 [oryza sativa (japonica cultivar-group)]
  misc_feature (2)..(309): NCBI GI: 38346995 NCBI Desc: osjnbb0039l24.6 [oryza sativa (japonica cultivar-group)]
  misc_feature (2)..(309): NCBI GI: 38346768 NCBI Desc: osjnba0081c01.19 [oryza sativa (japonica cultivar-group)]
  misc_feature: The sequence is a functional homolog of SEQ ID NO. 453 in the 11/188,298 US application
MMEGHVRGQDEKEVAVVTGGNRGIGLEICRQLASKGVTVVLTARDEMRGAEAVKNLAAQGLSNVLFHQLEVGDLSSAARLADFIRDKFGKLDILVNNAAIAGSKTEISDPESFKLELAGMNTQEKLERIRRHTTDPYDKAEECLRTNYHGTKIVTEAHLPLLHLSSHGRIVNISSRFGLLRFFSGDKLKKELDNIDDLSEERLDELSELFLNHFKNGQLEPYGWPTEGGYLAYKVSKALVNAYSRIVAKKHPTLRVNCAHPGFVSTDMSFHTGDLTVEEGARGALILALVPKGGTTGVFLNRTEVASFV

SEQ ID NO: 1915 - DNA, 657 bp, Sorghum bicolor
  misc_feature: Ceres ANNOT ID no. 6017400
  misc_feature: Encodes the peptide sequence at SEQ ID NO 1916
atggcggaggatcgtcgagctgaggtgcagcaagcgcggagctcgatcgccgccatgtctttcaccggcacgcaggacaagtgcaaaacctgcgacaagacggtccacttcatcgacctcctcaccgccgacggcgtctcgtaccacaagacatgcttcaagtgcagccactgcaagggcacactctcgattagcagctactcttccatggacggtgtcctgtactgcaagacgcactttgaacagctcttcaaggagacagggaccttctccaagaaatttcaaggtggagcatcttcaaccaagaccgaccaggcaaaggctccgagcaagctatcatctgcattctctggaactcaagataaatgcgcagcctgccagaaaaccgtgtatccattggagaagatgacgttggaaggcgagtcttaccacaagagctgcttcaagtgctcgcacgggggctgcatcctgacaacctcctcctacgccgcgctcaatgggatcctctactgcaagatccacttctcgcagctgttcaaggagaagggcagctacaaccacctcatccagacggcgcagaccaagaagaacgaggctgcggaggccgcacaggaggcaccgtcggaagcaggcgcggctgagccagaagcagcgtag

SEQ ID NO: 1916 - protein, 218 aa, Sorghum bicolor
  misc_feature: Ceres ANNOT ID no. 6017400
  misc_feature (28)..(84): Pfam Id: LIM Pfam Desc: LIM domain
  misc_feature (123)..(179): Pfam Id: LIM Pfam Desc: LIM domain
  misc_feature (20)..(218): NCBI GI: 42566107 NCBI Desc: lim domain-containing protein [arabidopsis thaliana]
  misc_feature (19)..(218): NCBI GI: 8515104 NCBI Desc: lim domain protein plim-2 [nicotiana tabacum]
  misc_feature (20)..(218): NCBI GI: 6850890 NCBI Desc: lim domain protein [arabidopsis thaliana]
  misc_feature (19)..(216): NCBI GI: 117950165 NCBI Desc: lim domain protein plim2a [populus tremula x populus alba]
  misc_feature (19)..(217): NCBI GI: 92877745 NCBI Desc: lim, zinc-binding; zinc finger, ring-type [medicago truncatula]
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
  misc_feature: Useful for making plants with modulated heat sensitivity
  misc_feature: Functional homolog of the protein sequence given in SEQ ID NO 13762
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
  misc_feature: Useful for making plants with altered carbohydrate content
  misc_feature: Functional homolog of the protein sequence given in SEQ ID NO 13763
MAEDRRAEVQQARSSIAAMSFTGTQDKCKTCDKTVHFIDLLTADGVSYHKTCFKCSHCKGTLSISSYSSMDGVLYCKTHFEQLFKETGTFSKKFQGGASSTKTDQAKAPSKLSSAFSGTQDKCAACQKTVYPLEKMTLEGESYHKSCFKCSHGGCILTTSSYAALNGILYCKIHFSQLFKEKGSYNHLIQTAQTKKNEAAEAAQEAPSEAGAAEPEAA

SEQ ID NO: 1917 - DNA, 714 bp, Sorghum bicolor
  misc_feature: Ceres ANNOT ID no. 6017414
  misc_feature: Encodes the peptide sequence at SEQ ID NO 1918
atggcgcttggcggccttggcgtgcgagcggcgcccttcacgtacgcggcgcacgcgctggccgtcgcggcggcggccatggttctggtctgggccatccagttccgcggcgggctcgccatcgaggccaccaacaagaacctcatcttcaacgttcaccctgttcttatgcttatcggttatattattatcggcggtgaagctataatggtatacagggtacttccaacaacgaaccatgacacaactaagctgatccatctaattctccacgggattgcacttgtccttggtgccgttggaatatattttgctttcaaaaatcacaatgagagtgggattgccaatctttacagtctgcactcttggattgggatcggaacaattactttatatggtattcagtggataattggatttgttacattcttcttccctggtgctgcgccaaacgtgaagaagggcgttcttccttggcacatactctttgggctctttgtctacatcttagcactggctaatgcagaactcggctttcttgagaagctcactttcctcgagagctcaggtctcgacaaatatggcacagaggcattcttggtgaacttcacagcattggttgtcgtgttatttggtgcctctgttgtagtggctgctatagctccagttcgccttgaagaaccacagggttatgctccaattccagaaaactag

SEQ ID NO: 1918 - protein, 237 aa, Sorghum bicolor
  misc_feature: Ceres ANNOT ID no. 6017414
  misc_feature (14)..(229): Pfam Id: Cytochrom_B561 Pfam Desc: Cytochrome b561
  misc_feature (5)..(237): NCBI GI: 49387475 NCBI Desc: cytochrome b561 [zea mays]
  misc_feature (5)..(237): NCBI GI: 38346996 NCBI Desc: osjnbb0039l24.15 [oryza sativa (japonica cultivar-group)]
  misc_feature (5)..(237): NCBI GI: 116310452 NCBI Desc: osigba0159i10.1 [oryza sativa (indica cultivar-group)]
  misc_feature (6)..(234): NCBI GI: 77403835 NCBI Desc: cytochrome b561 [citrullus lanatus]
  misc_feature (8)..(221): NCBI GI: 21553731 NCBI Desc: cytochrome b561 [arabidopsis thaliana]
MALGGLGVRAAPFTYAAHALAVAAAAMVLVWAIQFRGGLAIEATNKNLIFNVHPVLMLIGYIIIGGEAIMVYRVLPTTNHDTTKLIHLILHGIALVLGAVGIYFAFKNHNESGIANLYSLHSWIGIGTITLYGIQWIIGFVTFFFPGAAPNVKKGVLPWHILFGLFVYILALANAELGFLEKLTFLESSGLDKYGTEAFLVNFTALVVVLFGASVVVAAIAPVRLEEPQGYAPIPEN

SEQ ID NO: 1919 - DNA, 861 bp, Sorghum bicolor
  misc_feature: Ceres ANNOT ID no. 6017418
  misc_feature: Encodes the peptide sequence at SEQ ID NO 1920
atgggagaaggcggagaagagaagtcgttcaatttccttcaaattttgctcgagggaagcatagctggaggaaccgctggtgttgttgtggaaacagcattgtaccctattgatactataaaaaccaggcttcaggctgctcgtggtggaagccgaattgaatggaaaggcttgtattctggattggctggaaatctagctggtgtcctgccggcctctgcaatattcgtcggagtgtatgagccgactaaaagaaaactactggagacacttcctgaaaatttgagtgcagttgcccattttactgcaggggccattggtggtattgctgcttcccttgtccgtgtccctacagaggtggtcaaacaaagaatgcaaaccggtcaattcaagtctgcgcctgatgctgttcgtctcattgtcggtaaagaagggtttaaaggactgtacgctggttatggttcctttctacttcgagatcttccattcgatgccattcaattctgcatttacgagcagcttcgaattggttacaaacttgtggcaaggagggagttgaatgatccagagaatgcgcttattggtgctttttctggcgccatcactggagctataactactccctttgatgtcatgaagacaagattgatggttcagggacaagggaaccaatacactggaattgtaagctgtgctcagacaatcctcagagaggagggccctaaggcattcttgaagggcattgagccgcgagtgctgtggattggcatcggtggatccatattttttggtgtgctggagaaaaccaagtcgatgctagccgagaggaggaaacgcgagctacccgtcaaggacgaatga

SEQ ID NO: 1920 - protein, 286 aa, Sorghum bicolor
  misc_feature: Ceres ANNOT ID no. 6017418
  misc_feature (15)..(91): Pfam Id: Mito_carr Pfam Desc: Mitochondrial carrier protein
  misc_feature (96)..(182): Pfam Id: Mito_carr Pfam Desc: Mitochondrial carrier protein
  misc_feature (187)..(277): Pfam Id: Mito_carr Pfam Desc: Mitochondrial carrier protein
  misc_feature (1)..(283): NCBI GI: 34394981 NCBI Desc: mitochondrial aspartate-glutamate carrier protein-like [oryza sativa (japonica cultivar-group)]
  misc_feature (5)..(277): NCBI GI: 119391879 NCBI Desc: s-adenosylmethionine transporter [nicotiana benthamiana]
  misc_feature (6)..(275): NCBI GI: 119391875 NCBI Desc: s-adenosylmethionine transporter [capsicum annuum]
  misc_feature (5)..(277): NCBI GI: 140069183 NCBI Desc: mitochondrial carrier protein [medicago truncatula]
  misc_feature (11)..(279): NCBI GI: 63147372 NCBI Desc: at1g34065 [arabidopsis thaliana]
  misc_feature: The sequence is a functional homolog of SEQ ID NO. 398 in the 11/188,298 US application
  misc_feature: The sequence is a functional homolog of SEQ ID NO. 385 in the 11/188,298 US application
  misc_feature: The sequence is a functional homolog of SEQ ID NO. 517 in the 11/188,298 US application
MGEGGEEKSFNFLQILLEGSIAGGTAGVVVETALYPIDTIKTRLQAARGGSRIEWKGLYSGLAGNLAGVLPASAIFVGVYEPTKRKLLETLPENLSAVAHFTAGAIGGIAASLVRVPTEVVKQRMQTGQFKSAPDAVRLIVGKEGFKGLYAGYGSFLLRDLPFDAIQFCIYEQLRIGYKLVARRELNDPENALIGAFSGAITGAITTPFDVMKTRLMVQGQGNQYTGIVSCAQTILREEGPKAFLKGIEPRVLWIGIGGSIFFGVLEKTKSMLAERRKRELPVKDE

SEQ ID NO: 1921 - DNA, 678 bp, Sorghum bicolor
  misc_feature: Ceres ANNOT ID no. 6017419
  misc_feature: Encodes the peptide sequence at SEQ ID NO 1922
atgagcaccgagcccggggagctgctcgggatcgaccccatcgagctccggtttccattcgaattaaataagcagatctcctgcacgctgcagctgacgaacaagacagacaagcaggtcgcgttcaaggttaagacaacaagcccgaaaaagtactgtgttcggccaaacaatggcatggtggcaccccggtccaaagctgatgttgttgttacaatgcaagcgcagcgggaagtgccgccagacatgcaatgcaaggacaagttccttgtgcagagcgccattgtggccaaggagatcatgccaaaggaggtcactggagacatgtttaccaaagattcaggcaatatagtggatgaagtgaagttgaaggtagtttacttagcgcaatcgtcctctcaaagcgagggatatgaggatggtaatctgggcagtttgagttatcaagaggaaacaaaagaacctaaagaatcagaaaaaataatcactgagccatttgctttgatttcgaaactgatggaggagaagaattctgctgttgaactgaacaacaagcttcgacaagaattggaccttctgaggcgagacatcagcaggcagcatggtggtttctcattagttttagtactggtggttgctattctgggaatactgctagggttcctcatgaagagatga

SEQ ID NO: 1922 - protein, 225 aa, Sorghum bicolor
  misc_feature: Ceres ANNOT ID no. 6017419
  misc_feature (8)..(115): Pfam Id: Motile_Sperm Pfam Desc: MSP (Major sperm protein) domain
  misc_feature (1)..(225): NCBI GI: 6688926 NCBI Desc: vap27 [nicotiana plumbaginifolia]
  misc_feature (6)..(225): NCBI GI: 90738686 NCBI Desc: vap25 [solanum chacoense]
  misc_feature (1)..(157): NCBI GI: 115459632 NCBI Desc: os04g0534400 [oryza sativa (japonica cultivar-group)]
  misc_feature (1)..(157): NCBI GI: 116310461 NCBI Desc: osigba0159i10.10 [oryza sativa (indica cultivar-group)]
  misc_feature (1)..(223): NCBI GI: 92872094 NCBI Desc: major sperm protein [medicago truncatula]
  misc_feature: The sequence is a functional homolog of SEQ ID NO. 356 in the 11/188,298 US application
MSTEPGELLGIDPIELRFPFELNKQISCTLQLTNKTDKQVAFKVKTTSPKKYCVRPNNGMVAPRSKADVVVTMQAQREVPPDMQCKDKFLVQSAIVAKEIMPKEVTGDMFTKDSGNIVDEVKLKVVYLAQSSSQSEGYEDGNLGSLSYQEETKEPKESEKIITEPFALISKLMEEKNSAVELNNKLRQELDLLRRDISRQHGGFSLVLVLVVAILGILLGFLMKR

SEQ ID NO: 1923 - DNA, 765 bp, Sorghum bicolor
  misc_feature: Ceres ANNOT ID no. 6017421
  misc_feature: Encodes the peptide sequence at SEQ ID NO 1924
atgatgtcgtcctcgtcctcgtcgtcggccgccttcccgctggaccacctcgcgccgtcccccaccgagcagctctgctacgtgcactgcaactgctgcgacaccatcctcgccgtcggcgtgccttgcagcagcctgttcaagacggtgacggtgcgctgcggccactgcgccaacctactctccgtcaacctccgcggcctcctgctcccgcccgccgcgccgccggccaaccatctcaacttcggtcactccttgctctcgcccacatccccgcatggcctcttggacgagttggcgctccaggcgccgagcctcctcatggagcaggcgagcgccaacctgagcagcagcaccatgacgggcggcagcaacagcagctgcgccagcaacctgccggccgggccgatgccggcagccaagcctgtgcagcaggagcccgaactgcccaagaccaccgccccgtcggtgaacaggcctccggagaagcggcagagagtcccgtcggcatacaaccggttcatcaaggacgagatccagcgcatcaaggccgggaacccggacatcacccaccgggaggcgttcagcgcagccgcaaagaattgggcccatttcccacacatccacttcggcctcatgccggaccagggcctcaagaagaccttcaagactcaggatggcgctgaagacatgcttctcaaagatggactctacgctgcagcggcagcggctgcagcagccaacatgggcatcactccattctag

SEQ ID NO: 1924 - protein, 254 aa, Sorghum bicolor
  misc_feature: Ceres ANNOT ID no. 6017421
  misc_feature (15)..(212): Pfam Id: YABBY Pfam Desc: YABBY protein
  misc_feature (9)..(254): NCBI GI: 32330677 NCBI Desc: yabby15 protein [zea mays]
  misc_feature (6)..(254): NCBI GI: 38605890 NCBI Desc: osjnbb0020o11.2 [oryza sativa (japonica cultivar-group)]
  misc_feature (6)..(254): NCBI GI: 124271036 NCBI Desc: osyabby5 protein [oryza sativa (japonica cultivar-group)]
  misc_feature (19)..(254): NCBI GI: 32330675 NCBI Desc: yabby14 protein [zea mays]
  misc_feature (157)..(254): NCBI GI: 55771078 NCBI Desc: filamentous flower like protein [amborella trichopoda]
  misc_feature: The plant flowers significantly late compared to wild-type.
  misc_feature: The plant produces a reduced number of seeds.
  misc_feature: The plant senesces significantly late compared to wild-type.
  misc_feature: The sequence is a functional homolog of SEQ ID NO 1150 in the 10/666,642US patent application
  misc_feature: The sequence is a functional homolog of SEQ ID NO 1151 in the 10/666,642US patent application
  misc_feature: The sequence is a functional homolog of SEQ ID NO 1506 in the 10/666,642US patent application
  misc_feature: The sequence is a functional homolog of SEQ ID NO 412 in the 10/666,642US patent application
  misc_feature: The sequence is a functional homolog of SEQ ID NO 414 in the 10/666,642US patent application
  misc_feature: The sequence is a functional homolog of SEQ ID NO 420 in the 10/666,642US patent application
  misc_feature: The sequence is a functional homolog of SEQ ID NO 888 in the 11/435,388US patent application
  misc_feature: There is a problem with the ovules such that no fertilization is occurring
  misc_feature: Useful for biocontainment applications
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated time to senescence
  misc_feature: Functional homolog of the protein sequence given in SEQ ID NO 12923
  misc_feature: The sequence is a functional homolog of SEQ ID NO 888 in the 20060272060 US patent application
  misc_feature: The sequence is a functional homolog of SEQ ID NO 1150 in the 20070033671 US patent application
  misc_feature: The sequence is a functional homolog of SEQ ID NO 1151 in the 20070033671 US patent application
  misc_feature: The sequence is a functional homolog of SEQ ID NO 1506 in the 20070033671 US patent application
  misc_feature: The sequence is a functional homolog of SEQ ID NO 412 in the 20070033671 US patent application
MMSSSSSSSAAFPLDHLAPSPTEQLCYVHCNCCDTILAVGVPCSSLFKTVTVRCGHCANLLSVNLRGLLLPPAAPPANHLNFGHSLLSPTSPHGLLDELALQAPSLLMEQASANLSSSTMTGGSNSSCASNLPAGPMPAAKPVQQEPELPKTTAPSVNRPPEKRQRVPSAYNRFIKDEIQRIKAGNPDITHREAFSAAAKNWAHFPHIHFGLMPDQGLKKTFKTQDGAEDMLLKDGLYAAAAAAAAANMGITPF

SEQ ID NO: 1925 - DNA, 813 bp, Sorghum bicolor
  misc_feature: Ceres ANNOT ID no. 6017427
  misc_feature: Encodes the peptide sequence at SEQ ID NO 1926
atgactcccgcatccaccttccctctcgccgccgccgtcctacccacgaacttatcttccttctctcgctgcccccctcgccgcctcccgcgcgtctcctgcctggcggcgcccgaacgccgcgggggcggcaatgcatcgaacgcctcgcgggcgccgcagcagcagccggggtggcgcgccgcggtatccgccgtgctcgcggcggccgtggtcgccgcctcgatgccagcttacgcggacctgaacaagtttgaagccgagcagcggggcgagtttggcattggctccgccgcgcagttcggctcggccgatctcaagaaggctgtccacgttaacgagaacttcaggcgagccaacttcacatccgctgatatgagagagtcggatttcagtggttccacattcaatggtgcctatcttgaaaaggctgttgcttataaggcaaatttcactggtgccgatttgagtgatacattaatggaccgcatggttctaaatgaagctaaccttacaaacgctgttcttgtacggtcagtcctaacacgtagtgatcttggaggagcgatcattgaaggtgctgacttcagtgatgctgttattgacctaccacagaaacaggcattatgcaaatatgcaagtgggaccaactccataacaggggttagcacccgaaaaagcctaggatgtggcaatagccgtcgaaatgcatatgggagcccttcatcccctctgttgagtgccccgccacaaaagcttcttgaccgagatggtttctgtgatccagctactggaatgtgcgaagcaaactga

SEQ ID NO: 1926 - protein, 270 aa, Sorghum bicolor
  misc_feature: Ceres ANNOT ID no. 6017427
  misc_feature (114)..(153): Pfam Id: Pentapeptide Pfam Desc: Pentapeptide repeats (8 copies)
  misc_feature (164)..(203): Pfam Id: Pentapeptide Pfam Desc: Pentapeptide repeats (8 copies)
  misc_feature (67)..(268): NCBI GI: 145323868 NCBI Desc: thylakoid lumenal protein-related [arabidopsis thaliana]
  misc_feature (105)..(230): NCBI GI: 67921246 NCBI Desc: pentapeptide repeat [crocosphaera watsonii wh 8501]
  misc_feature (101)..(230): NCBI GI: 75908890 NCBI Desc: pentapeptide repeat [anabaena variabilis atcc 29413]
  misc_feature (101)..(230): NCBI GI: 23128670 NCBI Desc: cog1357: uncharacterized low-complexity proteins [nostoc punctiforme pcc 73102]
  misc_feature (101)..(230): NCBI GI: 23129920 NCBI Desc: cog1357: uncharacterized low-complexity proteins [nostoc punctiforme pcc 73102]
MTPASTFPLAAAVLPTNLSSFSRCPPRRLPRVSCLAAPERRGGGNASNASRAPQQQPGWRAAVSAVLAAAVVAASMPAYADLNKFEAEQRGEFGIGSAAQFGSADLKKAVHVNENFRRANFTSADMRESDFSGSTFNGAYLEKAVAYKANFTGADLSDTLMDRMVLNEANLTNAVLVRSVLTRSDLGGAIIEGADFSDAVIDLPQKQALCKYASGTNSITGVSTRKSLGCGNSRRNAYGSPSSPLLSAPPQKLLDRDGFCDPATGMCEAN

SEQ ID NO: 1927 - DNA, 1488 bp, Sorghum bicolor
  misc_feature: Ceres ANNOT ID no. 6017435
  misc_feature: Encodes the peptide sequence at SEQ ID NO 1928
atggctgcgcggtggtgcctcgtgctgctcgtgttggtgctggccgcggcagcggccggcgcggagaagggagagtgggacccggtcattcggatgcctggggaggaggagcctgcagcgtcgtcgcactcgcacagcggcgagggatttgagggagaggaggatgtcgccgtcgggacgaggtgggcagtgctcgttgccgggtcctcaggctacggcaactacaggcaccaggctgatatatgccatgcgtaccagatactgcggaaaggagggataaaagaggagaacattgtggtgttcatgtatgatgacgttgccactagtgcacttaacccaaggcagggggttattatcaatcacccacagggcgaagatgtttatgctggtgttccgaaggactacactggcgaccaggtcactgctaaaaacttctttgcagttctcttgggcaacaaaacagcagtcactggaggcagcaggaaggtcatcaatagcaaaccagatgaccatatttttatctgttactcagatcacggggggcctggtgttcttggtatgcccaatctgccatatctttatgctggtgacttcatgaaggtgttaagagaaaaacatgcttcaaacagctatgccaaaatggttatatatattgaagcatgcgaaagtggcagtatatttgaggggttaatgccagaagaccttaatatttatgtcacgactgcatccaatgcagaagaaagtagctggggtacatactgtccaggaatggaaccatcacctccttccgagtacattacctgcctaggtgatctctatagtgtctcttggatggaagacagtgagactcacaatctgaaggaggaaacaataaaggaacagtatgaagtggtgaaggagcgtacttcagactcgaacagctatggtgcaggctctcatgtcatggagtatggtgacaagaccttcaagggagagaagctttacctttatcaaggttttgatcctgcaaatgccaatgtcacaaataagctacttcggccaggcctagaggctgtggtcaaccaaagggatgctgatattctcttcctatggaagaggtatgaacttttacatgagaagtccgaagagaagcaggaagttctgagggagatcactggaacagtaaggcataggaagcacctggacagtagcatcgatttcattggaaagcttctcttcggcattgagaaagggcctttcacgcttcaagccgttagaccttccggccagccactcgttgatgattgggattgcttgaagcaaatggtacggatcttcgaatcccattgtggatcgctcactcagtacggtatgaagcatatgagggcgttcgcaaatatatgcaacagtggcacgcctggcgcttcgatgaagcaagcgagcatgggtgcctgtggcagctacaactcggcgagatggagcccgttggttcagggctacagcgcttga

SEQ ID NO: 1928 - protein, 495 aa, Sorghum bicolor
  misc_feature: Ceres ANNOT ID no. 6017435
  misc_feature (61)..(333): Pfam Id: Peptidase_C13 Pfam Desc: Peptidase C13 family
  misc_feature (1)..(495): NCBI GI: 37542690 NCBI Desc: vacuolar processing enzyme 1 [zea mays]
  misc_feature (1)..(495): NCBI GI: 115459656 NCBI Desc: os04g0537900 [oryza sativa (japonica cultivar-group)]
  misc_feature (79)..(495): NCBI GI: 115447565 NCBI Desc: os02g0644000 [oryza sativa (japonica cultivar-group)]
  misc_feature (32)..(495): NCBI GI: 17864752 NCBI Desc: c13 cysteine proteinase precursor [oryza sativa subsp. indica]
  misc_feature (8)..(495): NCBI GI: 9622221 NCBI Desc: asparaginyl endopeptidase [sesamum indicum]
  misc_feature (55)..(495): SWISSPROT Homolog: EC 3.4.22.34 Legumain precursor
MAARWCLVLLVLVLAAAAAGAEKGEWDPVIRMPGEEEPAASSHSHSGEGFEGEEDVAVGTRWAVLVAGSSGYGNYRHQADICHAYQILRKGGIKEENIVVFMYDDVATSALNPRQGVIINHPQGEDVYAGVPKDYTGDQVTAKNFFAVLLGNKTAVTGGSRKVINSKPDDHIFICYSDHGGPGVLGMPNLPYLYAGDFMKVLREKHASNSYAKMVIYIEACESGSIFEGLMPEDLNIYVTTASNAEESSWGTYCPGMEPSPPSEYITCLGDLYSVSWMEDSETHNLKEETIKEQYEVVKERTSDSNSYGAGSHVMEYGDKTFKGEKLYLYQGFDPANANVTNKLLRPGLEAVVNQRDADILFLWKRYELLHEKSEEKQEVLREITGTVRHRKHLDSSIDFIGKLLFGIEKGPFTLQAVRPSGQPLVDDWDCLKQMVRIFESHCGSLTQYGMKHMRAFANICNSGTPGASMKQASMGACGSYNSARWSPLVQGYSA

SEQ ID NO: 1929 - DNA, 888 bp, Sorghum bicolor
  misc_feature: Ceres ANNOT ID no. 6017445
  misc_feature: Encodes the peptide sequence at SEQ ID NO 1930
atgaaggtgcagtgcgacgtgtgcgcggccgaggcggcgtcggtgttctgctgcgccgacgaggccgcgctgtgcgacgcgtgcgaccgccgcgtgcaccgcgccaacaagctcgccggcaagcaccgccgcttctcgctgctcaacccggcgccgccgtcctcgtcggggtcggggtcgccggcgcagcagcaggcacagcctccgctctgcgacatctgccaggagaagcgggggctcctgttctgcaaggaggaccgcgccatcctgtgccgcgactgcgacgtgtcggtgcacacggccagcgagctgacgatgcgccacacccggttcctgctcacgggcgtgcgcctctccgccgagcccgccgcgtgcccggcgccgccgccgccgccgtcggggtcggaggacgagaacagcagcggcagcggcagcttctgctgcagcgcaggcggcgacgcgtccgccgcccctcctccgtcgtcggcggcgcccgccaccagccacgggagcgggagcgataacggcagcagcatctccgagtacctcatcaagacgctgcccgggtggcacgtcgaggacttcctcgtggacgaggccgccgccggcgccgcgacaaacatcgccggcgtctccgcagacgcgtcgtatcagggagggctagctcggatcggcggcctgcaggacggctacggctactcggcgtggatggcgccggagcagctcttctacgaggactcgtccgccgccggcggcgcgcggggcatcagggagcagtgggtgccgcagatggcgatgtacagcagcagcacggggctgtccgtggccggcgccggcagcaagagatcccgagccacgtcggcggcatcctcgtattcctactggtga

SEQ ID NO: 1930 - protein, 295 aa, Sorghum bicolor
  misc_feature: Ceres ANNOT ID no. 6017445
  misc_feature (1)..(47): Pfam Id: zf-B_box Pfam Desc: B-box zinc finger
  misc_feature (66)..(113): Pfam Id: zf-B_box Pfam Desc: B-box zinc finger
  misc_feature (1)..(214): NCBI GI: 115469928 NCBI Desc: os06g0713000 [oryza sativa (japonica cultivar-group)]
  misc_feature (1)..(211): NCBI GI: 116310380 NCBI Desc: h0115b09.3 [oryza sativa (indica cultivar-group)]
  misc_feature (1)..(208): NCBI GI: 22329252 NCBI Desc: zinc finger (b-box type) family protein [arabidopsis thaliana]
  misc_feature (1)..(208): NCBI GI: 92888719 NCBI Desc: zinc finger, b-box [medicago truncatula]
  misc_feature (1)..(291): NCBI GI: 115435138 NCBI Desc: os01g0202500 [oryza sativa (japonica cultivar-group)]
  misc_feature: The sequence is a functional homolog of SEQ ID NO 1023 in the 10/666,642US patent application
  misc_feature: The sequence is a functional homolog of SEQ ID NO 1024 in the 10/666,642US patent application
  misc_feature: The sequence is a functional homolog of SEQ ID NO 1370 in the 10/666,642US patent application
  misc_feature: The sequence is a functional homolog of SEQ ID NO 1478 in the 10/666,642US patent application
  misc_feature: The sequence is a functional homolog of SEQ ID NO 1522 in the 10/374,780US patent application
  misc_feature: The sequence is a functional homolog of SEQ ID NO 1593 in the 10/412,699US patent application
  misc_feature: The sequence is a functional homolog of SEQ ID NO 16 in the 10/412,699US patent application
  misc_feature: The sequence is a functional homolog of SEQ ID NO 1645 in the 10/374,780US patent application
  misc_feature: The sequence is a functional homolog of SEQ ID NO 1646 in the 10/374,780US patent application
  misc_feature: The sequence is a functional homolog of SEQ ID NO 1671 in the 10/412,699US patent application
  misc_feature: The sequence is a functional homolog of SEQ ID NO 1672 in the 10/412,699US patent application
  misc_feature: The sequence is a functional homolog of SEQ ID NO 18 in the 10/412,699US patent application
  misc_feature: The sequence is a functional homolog of SEQ ID NO 1890 in the 10/412,699US patent application
  misc_feature: The sequence is a functional homolog of SEQ ID NO 2148 in the 10/374,780US patent application
  misc_feature: The sequence is a functional homolog of SEQ ID NO 2246 in the 10/374,780US patent application
  misc_feature: The sequence is a functional homolog of SEQ ID NO 234 in the 10/666,642US patent application
  misc_feature: The sequence is a functional homolog of SEQ ID NO 256 in the 10/714,887US patent application
  misc_feature: The sequence is a functional homolog of SEQ ID NO 256 in the 11/435,388US patent application
  misc_feature: The sequence is a functional homolog of SEQ ID NO 288 in the 10/374,780US patent application
  misc_feature: The sequence is a functional homolog of SEQ ID NO 454 in the 11/435,388US patent application
  misc_feature: The sequence is a functional homolog of SEQ ID NO 582 in the 10/225,066US patent application
  misc_feature: The sequence is a functional homolog of SEQ ID NO 662 in the 11/435,388US patent application
  misc_feature: The sequence is a functional homolog of SEQ ID NO 670 in the 10/225,066US patent application
  misc_feature: The sequence is a functional homolog of SEQ ID NO 676 in the 10/225,066US patent application
  misc_feature: The sequence is a functional homolog of SEQ ID NO 90 in the 10/412,699US patent application
  misc_feature: The sequence is a functional homolog of SEQ ID NO 906 in the 10/412,699US patent application
  misc_feature: Useful for making plants with modulated growth and phenotype characteristics
  misc_feature: The sequence is a functional homolog of SEQ ID NO 1593 in the 20040045049 US patent application
  misc_feature: The sequence is a functional homolog of SEQ ID NO 16 in the 20040045049 US patent application
  misc_feature: The sequence is a functional homolog of SEQ ID NO 1671 in the 20040045049 US patent application
  misc_feature: The sequence is a functional homolog of SEQ ID NO 1672 in the 20040045049 US patent application
  misc_feature: The sequence is a functional homolog of SEQ ID NO 18 in the 20040045049 US patent application
  misc_feature: The sequence is a functional homolog of SEQ ID NO 1890 in the 20040045049 US patent application
  misc_feature: The sequence is a functional homolog of SEQ ID NO 90 in the 20040045049 US patent application
  misc_feature: The sequence is a functional homolog of SEQ ID NO 906 in the 20040045049 US patent application
  misc_feature: The sequence is a functional homolog of SEQ ID NO. 370 in the 11/188,298 US application
MKVQCDVCAAEAASVFCCADEAALCDACDRRVHRANKLAGKHRRFSLLNPAPPSSSGSGSPAQQQAQPPLCDICQEKRGLLFCKEDRAILCRDCDVSVHTASELTMRHTRFLLTGVRLSAEPAACPAPPPPPSGSEDENSSGSGSFCCSAGGDASAAPPPSSAAPATSHGSGSDNGSSISEYLIKTLPGWHVEDFLVDEAAAGAATNIAGVSADASYQGGLARIGGLQDGYGYSAWMAPEQLFYEDSSAAGGARGIREQWVPQMAMYSSSTGLSVAGAGSKRSRATSAASSYSYW

SEQ ID NO: 1931 - DNA, 381 bp, Sorghum bicolor
  misc_feature: Ceres ANNOT ID no. 6017446
  misc_feature: Encodes the peptide sequence at SEQ ID NO 1932
atggctctggtcagattggcgtttcccgtcttcttcctcctcgccgcggcggagttcgcggcggcgacgcggtcgccgtcggctttcgtccagaacgccatctactccaaccgcatcaccatcttctccaagacctactgcccccactccatgcgtgctaagcgtatatttcgagatctcaaggaagacccatatgttgttgaactagatacccgagaggatgggcgtgacattcaaaatgttctcctggacctagttgggcgtcgtactgtgccacaggtgtttgtcaatggccagcatgttggtggcgcggacgatacagtaaatgcactttcaaatggacagctcgagaaacttcttgggaagagtcagtcacaatga

SEQ ID NO: 1932 - protein, 126 aa, Sorghum bicolor
  misc_feature: Ceres ANNOT ID no. 6017446
  misc_feature (39)..(101): Pfam Id: Glutaredoxin Pfam Desc: Glutaredoxin
  misc_feature (1)..(126): NCBI GI: 75323542 NCBI Desc: monothiol glutaredoxin-s6 precursor
  misc_feature (20)..(123): NCBI GI: 2995953 NCBI Desc: glutaredoxin i [mesembryanthemum crystallinum]
  misc_feature (6)..(126): NCBI GI: 19548658 NCBI Desc: glutaredoxin [populus tremula x populus tremuloides]
  misc_feature (1)..(123): NCBI GI: 21536938 NCBI Desc: glutaredoxin [arabidopsis thaliana]
  misc_feature (13)..(120): NCBI GI: 119370643 NCBI Desc: glutaredoxin-c8 precursor (glutaredoxin-c4 homolog)
  misc_feature: The sequence is a functional homolog of SEQ ID NO. 382 in the 11/188,298 US application
MALVRLAFPVFFLLAAAEFAAATRSPSAFVQNAIYSNRITIFSKTYCPHSMRAKRIFRDLKEDPYVVELDTREDGRDIQNVLLDLVGRRTVPQVFVNGQHVGGADDTVNALSNGQLEKLLGKSQSQ

SEQ ID NO: 1933 - DNA, 1461 bp, Sorghum bicolor
  misc_feature: Ceres ANNOT ID no. 6017447
  misc_feature: Encodes the peptide sequence at SEQ ID NO 1934
atggggagtgtgccagaggagacggcggccctggacaacatcggcgacctggtgagcgacctgagggaggtgtacgagagcggcaggacccaggacatggagtggcggcagtcgcagctcaggggcctcgtcaggctcctggaggacgaggaggaggccatcttcgacgcgctccacgaggacctgggcaagcaccgcgtcgaggccttcagagacgaggttggggttctgaagaagtccgtcgtcgacaagctgcaaaacctcaagaaatgggcggctccggagaaggctcacacgccgctcgtcgccttcccggcgacggcgctggtggtgccggagccgctcggggttgtgctcatcttctcatgctggaatctcccaataggcctagctctggaacctctctcgggagccctggcggccgggaacgctgcggtggtgaagccatcggagctggcgccgtccacgtcggcgttcctggcggccaacatacccaagtacctggactccaaggccgtgaaggtcgtcgagggcgggcctgaggtcggggacaagctcatggactacccatgggacaaggtcctcttcactggcagcagccgtgttgggcgcctgatcatgaccaaggccgccaagcacctcaccccggtggcgctagagctcggctccaaatgcccctgcatcgtcgactggcttgacagcaacagggacagccagatagctgttaatcgcattattggagcgaaatggtccacctgctccggccaagcctgcatcgccatcgactacctgctggtggaggaggaattcgctccgattctgatcgagatgctcaaatcaacgctcgagaggttcttcaccaggccagagtacatggcgcgcattctgaacgagaagcatttccagaggctcagtggcttcctggccgaccgcagggtggcgtcctccgtcgtccatggcgggcacttcaaccccaagacactgagcatcgagcccacacttctgctgaaccctccgcttgactcggacatcatgacggaggagatattcggcccgctgctcccgatcatcacggtgaagaagatcgaagacagcatcaagttcctcaagtcgaagccgaagccgctggcgatctacgccttcaccaggaacgagaagctcaagcagcggatcatcgacgagacgtcgtcggggagcgtcaccttcaacgacgccatcgtgcagtatgggctggacagcatcccgttcggtggcgtagggcacagtgggttcgggcagtaccacggcaagtacacgttcgagatgttcagccacaagaaggcggtgctcaagaggagcctcctcgtcgaattcatgttccggtacccgccgtgggacgagaccaagatcgggatgctcaggcgcgtctaccgtttcgactacgtctcgctcttcctcgcgatcgtcggcctaaggagataa

SEQ ID NO: 1934 - protein, 486 aa, Sorghum bicolor
  misc_feature: Ceres ANNOT ID no. 6017447
  misc_feature (4)..(442): Pfam Id: Aldedh Pfam Desc: Aldehyde dehydrogenase family
  misc_feature (1)..(486): NCBI GI: 38489178 NCBI Desc: fatty aldehyde dehydrogenase 1 [zea mays]
  misc_feature (1)..(486): NCBI GI: 115447597 NCBI Desc: os02g0647900 [oryza sativa (japonica cultivar-group)]
  misc_feature (12)..(486): NCBI GI: 38344982 NCBI Desc: osjnba0011l07.12 [oryza sativa (japonica cultivar-group)]
  misc_feature (12)..(486): NCBI GI: 33317836 NCBI Desc: aldehyde dehydrogenase [oryza sativa (indica cultivar-group)]
  misc_feature (12)..(486): NCBI GI: 116310383 NCBI Desc: h0115b09.6 [oryza sativa (indica cultivar-group)]
  misc_feature (9)..(486): SWISSPROT Homolog: EC 1.2.1.3 Aldehyde dehydrogenase 3F1
  misc_feature: The sequence is a functional homolog of SEQ ID NO. 537 in the 11/188,298 US application
  misc_feature: The sequence is a functional homolog of SEQ ID NO. 428 in the 11/188,298 US application
  misc_feature: The sequence is a functional homolog of SEQ ID NO. 477 in the 11/188,298 US application
  misc_feature: The sequence is a functional homolog of SEQ ID NO. 437 in the 11/188,298 US application
  misc_feature: The sequence is a functional homolog of SEQ ID NO. 475 in the 11/188,298 US application
  misc_feature: The sequence is a functional homolog of SEQ ID NO. 435 in the 11/188,298 US application
  misc_feature: The sequence is a functional homolog of SEQ ID NO. 442 in the 11/188,298 US application
  misc_feature: The sequence is a functional homolog of SEQ ID NO. 304 in the 11/188,298 US application
MGSVPEETAALDNIGDLVSDLREVYESGRTQDMEWRQSQLRGLVRLLEDEEEAIFDALHEDLGKHRVEAFRDEVGVLKKSVVDKLQNLKKWAAPEKAHTPLVAFPATALVVPEPLGVVLIFSCWNLPIGLALEPLSGALAAGNAAVVKPSELAPSTSAFLAANIPKYLDSKAVKVVEGGPEVGDKLMDYPWDKVLFTGSSRVGRLIMTKAAKHLTPVALELGSKCPCIVDWLDSNRDSQIAVNRIIGAKWSTCSGQACIAIDYLLVEEEFAPILIEMLKSTLERFFTRPEYMARILNEKHFQRLSGFLADRRVASSVVHGGHFNPKTLSIEPTLLLNPPLDSDIMTEEIFGPLLPIITVKKIEDSIKFLKSKPKPLAIYAFTRNEKLKQRIIDETSSGSVTFNDAIVQYGLDSIPFGGVGHSGFGQYHGKYTFEMFSHKKAVLKRSLLVEFMFRYPPWDETKIGMLRRVYRFDYVSLFLAIVGLRR

SEQ ID NO: 1935 - DNA, 2457 bp, Sorghum bicolor
  misc_feature: Ceres ANNOT ID no. 6017458
  misc_feature: Encodes the peptide sequence at SEQ ID NO 1936
atggcttgcgccgccgcggaaaccctcgcctcgttcccaatcgcatccccgtcccgctcgctcctacgccccttcccccagcgaccagccgccgccgccgctgccgccgggagaggcgcagcgtcgatccggatatccgccgtgccgccgcggggcctcgggctcgcgctcgtgcaccgccgcgtgcgccgctgcccgccagcggcgcgcgcgaatgtcgagcgcgacggcgacggcgcctccggcaacggcgagccgtcgtcctcgtccggggatggcggcgaccgcgacgcggctgcggagtccgggggcgataccaccagcacgagcaccacgagcgcggccgcgacgccgccgccgccctcgtcgaagaggggcgaaaataagtggcggcggaggctgattaagggaggcggcggcgtcgggcggtggctatgggagcccatagtccaggggcgggagatgggcttcctcctgctccagctcggcttcgccatatttgctctacgcatgcttcggccagagatcgcgttgcctggttcagagccccgcccgcagaccacctacgtcagtgtaccatacagcgacttcctggcgagcatagacaaggaccaggtgaagaaggttgaggtggacggggtgcacatcatgttccggctccgcccagaggttgagtcccaggtccgtgtggtgcagacaccaacacagcgcggagcagatgctgtggttgataacactggagcttcaaggagaattgtattcacgacgactcgtccagtggacataaagacaccgtacgagaagatggtggaaaacatggttgaatttgggtcaccagacaagaggtccggcggcatgctcaattctgccctggtagctcttatttatgttgtattgattgcagtagttttgcagcggttgccaataagcttttctcagaattcagccggtcagttgaggaataggaagaattcaaattctggtggcacaaaagtttccgaaagtacagatatagttacatttgctgatgtggctggagtagatgaggcaaaagaagagctggaagaaatcgtggagttcttaaggaacccagacagatatattcgtcttggtgctcgccctcctcgtggtgtcttattggtgggtcttccagggactggaaagacacttcttgcaaaagccgtagcaggagaagcagaagtcccattcataagttgctctgctagtgaatttgttgagctgtatgtaggcatgggcgcagctcgagtacgtgacctatttgctagggccaaaaaggaatcaccttcaattatttttatcgatgagattgatgccgttgcaaaaagccgtgatggtcgatatcgcattgtcagtaatgatgaacgtgagcagacactaaaccaattgctcacggaaatggatggctttgacaccaactcggctgtcattgtactgggggcaacaaatcgagctgatgttttggatcctgcccttaggcgccctgggagatttgaccgtgtagttatggttgaagctcctgataggtttgggagagaatcaattctaaaagttcatgtgaacagaagagagcttccactgagtaaagatgtaaatctagctgatattgctgcaatgacaactggttttactggagcagaccttgcaaacttggtaaatgaagctgctttgttggctgggcggttaaataaagaaatggtggaaaagattgacttcatccgtgcggttgagcgatctatagcagggatagagaaaaaacatgctaaattgaagggtaatgaaaaagctgttgttgcacggcatgaagttggtcatgcacttgtggggactgccgtagcaaaccttcttcctggacagccacgtgtggagaaattgagtatattgccaagatcaggaggtgcattaggcttcacgtacacccctcccaccacagaggatagatatttactctttgttgatgaactacgtggccgtttagtaacacttcttggtgggagggcagcagaggaagttgttttaggaggacgggtttccactggtgcacttgatgacataagacgtgctactgacatggcctacaaagctgtagcagaatatggtcttaatcagcgcatcgggccaatatcacttgctacactgtcaaatggtgggttagatgactctggtggctctccatggggaagagatcagggccatctagttgatcttgttcagagggaagtaaaagtgcttttacagtcgtcactggaagtagctctttcagttatccgtgctaatcctgcagttctagaaggcctcggggcatatttagaagagaacgaaaaggttgaaggcgaggagcttcaagagtggctaaagtcggttgttgcaccaaaagagttgacctcttttatcagaggacagcaagagcaagttcttcagctggaagcaagctcctag

(The sequence listing continues in the following parts.)

What is claimed is:

1. An isolated nucleic acid molecule comprising:
   (a) the nucleotide sequence of SEQ ID NO: 14770; or
   (b) a nucleotide sequence encoding the polypeptide sequence of SEQ ID NO: 14771.

2. A vector, comprising:
   (a) a first nucleic acid having a plant regulatory region; and
   (b) a second nucleic acid having any one of the nucleotide sequences of claim 1, wherein said first and second nucleic acids are operably linked.

3. A plant cell which comprises a first nucleic acid molecule comprising the nucleic acid molecule according to claim 1 operably linked to a second nucleic acid molecule that is heterologous with respect to said first nucleic acid molecule.

4. A transgenic plant comprising the plant cell of claim 3.

5. Seed from the transgenic plant according to claim 4 which comprises the first nucleic acid molecule.

6. Vegetative tissue from the transgenic plant according to claim 1.

7. The isolated nucleic acid molecule according to claim 1, wherein said nucleotide sequence comprises SEQ ID NO: 14770.

8. A plant cell which comprises a first nucleic acid molecule comprising the nucleic acid molecule according to claim 7 operably linked to a second nucleic acid molecule that is heterologous with respect to said first nucleic acid molecule.

* * * * *